United States Patent 9,238,822 (COMPOSITIONS AND METHODS FOR CONTROL OF INSECT INFESTATIONS IN PLANTS) - sequence listing, part 2

SEQ ID NO: 2222 - DNA, 1015 bp, Diabrotica virgifera
  misc_feature (933)..(933): n is a, c, g, or t
  misc_feature (970)..(970): n is a, c, g, or t
gacaaacgaagatagataatttatttatgagtgaaggaatcatattcgtttaaagcagtggtagttgtagttaagatttttaccgcgattttctgcagtaagagatggagacagaagaaaaacagaatgaagcatctggtttactacaaacagtacaaaatgggaaagaaaaagaaacagctacacccacagaagtagaagcagaacaagaagatattatacaaaaatgtataggagttttaggaaggtggcatatttggttatgctttataatatttctagtcaaatttggtgtttcttggcaccaacttagtatagtatttctagctccacctattaaatattattgtatcaataatgcaacagaaacatgtttatccaattgtactcattatctgtatgatacgtccatatttactaacactatatccatggaatgggatcttgtgtgttcaaaatcatatttagtcagtcttactcagacgttaacaatgctgggaatcttagttggaaatatgttatttggatatttgtctgacaaatttggtagaaaattaccacttgttctggctgttgctctgcaaggattgtcgggattaggtgcagctttctccccatggtttacattatttataatcttaaaatttttatctgcagtagcgacaggaggtacaatgataacaagcttcgtacttatcatggagataatcggtaccgaatggagaacagttcttggtattttgtaccaaataccattccatttaggtcatcttttgatggcactatttagttattatcttcgaaactggaggcatttcccaataatgatatcagtgccttcgctttttctgatctcatactattggattcttcctgaatcacctcgatggcaactagcagttggtaaagaaaagcaagcaattgaaacattanaaaaagcagccagggcggaacaagctaccaacagaanaaatcgaacacgacgttaatcttttatttagaacacaaacatcta

SEQ ID NO: 2223 - DNA, 428 bp, Diabrotica virgifera
cggacgcgtgggctgaaatccaaattttttataaatataaccttaaagaagtctgtaaagatttaagcatgatttaacgaaatattaaatttttaactttaaaatgccgaactcagatattgatgataacgaaaaagtaactgggcccgtcgacaatgcatgggaactgaaaattccagaattcaaaccagaagataatccacatggattattagaggaaagtagtttcgccacattatttccacaatacagagaacaatatttaagacaagtatggcctttagttaagaaaactctgggtgaatataatataaaagcagaactagatgttgtagaaggtagtatgactgttaaaaccacaaggcaaacatgggatccttacattattattaaagcaagagatgtgataaagttaatgtctagaagtg

SEQ ID NO: 2224 - DNA, 655 bp, Diabrotica virgifera
caaggatagaaattatttccatttattaattgtttaataataaaaaacatttcccacctagctgggattcgaactctcgacctttgggttcaaaggtaggctctcttactgagccacgaaggggttgatttgaatgaacttacacttacaccacgtttacccatgaacgaataactgacgataaatgtcaatagatgaaatccattttgcattttaaaaaacgtagcacagcgaccgagacctccatcttcgaaggctggctaggccgacactgagcaatgcagatgcagcgaggggaaaggggtgggagagagagagagggagagttgtaaggcaatgttgagagattgagcaatgcagatgcagcgaggcgaaagggttgggggagagagagagagggagagttgtaaggtaatgttgccagatttctcccagcccgtcacactctttctcagtgacatagggaaccttttttcacgaataaatttttaaaaattatcttgttttctccggttttcccggtttagttgttgatcacatgagacggagttagtaggaaaaaataaaaatataaatttaaactttaattgcaaacagcacttccgaaatgtcatttacaaaaaaatcttgaatttttgtacatacctaaagtttt

SEQ ID NO: 2225 - DNA, 1142 bp, Diabrotica virgifera
cacacgcgtccgcccaccccacgcgattttgcctctgcaaattagatcataatgaaatcagtcacagtacctatttttctactggctttagctgtacaaacaagcttagcgggagtcatttccgatcagaactacaacaaccaacaaaactacgatcaggaaaagcaagaaacttttaaccatcaagaacattctgattacggatccaatgatataggggaccatgaagctcaaataagtcaacaagccacaggaggcgaacacggaggaggtgattatggtggtgaccacggtggatatggcgatcaacaaggctggacaggatactctggcgaagcaggccacgacggtggagctcaacaaagccatgcatctttggaaaaccttggaaaccttggcagccttatatcccatggtattaacttaggaggacacgatgctggtcatgagggtggccatgatataggaggtgcagatctacacccccaagtcgaagtccaacatgatcacatcccaactcacactatcgaaaaaacaaaagaagtaccagtaaccgtagtcaagaaaatcggagtgccagtacctcacccagtcggcgttcccacaccacaaatcattaaagtacccgttccacaaccttatgcagtacatgttccagtaccacatccaattgcagtaccaatttacaaactggtaccacaagaaattgagaagagggtacccattcatgtagaaaaattagttccagtttacgtagaaaaaccagtgaaaatcgaaattgagaaacaccatgtagagtactacgataaaccttaccccgttcatgttcctgtatacaagcatgttttgcacacgagtggccacaaaaaatggtaaagactgtttttagtctacgactgatgaatataatgtaggttttaatttgcttaactagttctatgaatgcccattcagaatttaaaatctgaacttgttaattgttttttggtattatttttgtaatttttttataaacagattataaaaaatttaaaagtgaaaaaaaaaaaaaaaagggcggccgcccctttttttttttttttttaatatttatctaaattataaaaattaattttattaaattttggttcccttttcctacc

SEQ ID NO: 2226 - DNA, 1923 bp, Diabrotica virgifera
  misc_feature (1411)..(1411): n is a, c, g, or t
gtcgaatataaaattattcttttttaatttttaagtgttttgatgaaaataactttataaatttctgcattttgttataatctcttgactttgtataaacgactgatttcataaagaacttcttaaatgaccatttaatttattgagggttagacattgttggcgacattcaaaaagttttgaaatttgctgcaattacgatattaattttgatgtgaggatttagtagatggcaaaaagtcttgtataagaatttctcgagaattgaaacctgtcttaaatctggtgaagagcgttgaggataaaaaacaaataccgttaaaatggaattttggcgaaagagaaatgggttgaaaggaaatttagtacatcctgatcgacaaaacaagaaactatctgctacagctcagcgaaggatgttaattgaggaaatgttagctgctaatggctctttattttcagaaactgataagaaaatactgacgtctcttgtaggtgatcaaaatcaacctaaagaatgggtcaatccaatgtttaaaaataccgtttattctgataacgaatctcgcgaagtacatggggatctgccatgtaattttaatgaagatcggaacgcaagatgggaccaatgggatgaatctggggccgaaaagcctaaaacatctttcttgtcctcattctcggaccaggatccacctgaaaaatcgaaatcaaagaaatcaatttcctggcgaaacccaaggcgtaaatctgtttaaccctcaaagaagttcttttatacaagaaaggagccctggccaggatccacctgaaaatcgaaatcaaagaaatcaatttcgtggcgaaacccaaggcgtaaatctgtttaaccctcaaagaagttcttttatacaagaaaggagccctggccaggatccacctgaaaatcgaaatcaaagaaatcaatttcgtggcgaaacccaaggcgtaaatctgtttaaccttcaaagaagttcttttatacaagaaaggaaccctcttaacagtgaaagaagttctttagacaacaacctctctgatgcacaaaggcgaaggatggtaattgaggaaatattagctgctaatagctcttcattctcagaagctcacaagaaaacactgaactcgcattttagtgttgaagattgtgtaagaggtccttttaaaaatactgcctattctgataaagaatctcgcggagtatgtggagacttgccatataattttgatgaagaaagaagaaaccaagaagatcggaacgcaaagaacgtttctgggacatctttctggtctaataatcgaaatgaaagaaatgaatttcttcccgaaacccgagacgtaagtccgtttaaccctcaaagaggtcctttaataccagaaaggagtcctctanatcctgaaagaagttccctagagcaatatggaagctcgaataaccaacaagcaaaaagtgtttctgggtcatctttctggtctaaaagtcgatttgaaagaaatgaatttcgccccgaaacccgggacataagtccggttacccctcaaagaaatcctataataccagaaaggagtactctaaactttaaaaaaaggttctctagagcaatatggaaggccgaataaacaagaaccaaaaaaggtttctgggttcatctttcgggcccaaaaaccgattggaaaaaaatcaacttaatccccaaaaccccaaaagtaaagtccccaaagtaaaccccccaaaaaaattttttattaccaaaaagcaacccctctaaaaccggggaaaaaaatttctcctggggcaaaatgggaacttcccaaaaaccccccccacgacaaaaccctctttgttttccaacaccacccaaaaaaaattttgcactaaccccccccccaaatcccttttttacc

SEQ ID NO: 2227 - DNA, 1083 bp, Diabrotica virgifera
agtgtacaaaaacataacctgtaaactgtgaaattgttttggcctatatttattaaataatttattttagttaatttgtgtatgaataaactttaacgttagaaaggaagtgttttaaatatttacagtgcaatcgttcaatcatcgaatcaaccaaaagacaaattgtgccattgtagaacagattgtgtacactagtggagtctcaaataatgacaactttcaaatttacgtttgacaaaaataagaaaccgccaaaaggtgtgttggttgctaaaaagaggaaagctacatctgaggacactattattccaaagaaattagctaaaaataaggtattaaatgaatctgacaatacaaagattaaaaagagaacagaaaaaccacccaaagtagtaagttcttcagaaactaacacagcaaatacacaacaaggaataggaaacaaaaatcttgatattaggcaagcaacaaatactttaaacaatgaaaaaagtagtgattttagtcctaatactagtcagaaatttatcaaacgtaaatggaaaaaagacaagttagcagccaagaaagcagcagctgaaggtaacactccaactcatactgatccacagaaaaaaccccagcaatattcattatttaatacaggacataccacgcgtccggtcaaaggtaatgcgaaaggcaaatcagtggttgaaaaggtttttagtgcagataaaaagtttagtgacttagatatacataaatacatagtttctaatttggaaaaacatcattttacaactctgacgaatgtgcaagaaaaatctatacctgcgatactacaaggacagaatgttttggttagatctcagactggttctggtaaaacgttagcatatgctgttccagtattgcaagctctacaaaatattaatcctaggatacaaaggactgatggagtgcaagtcataattgtcgttcctactaaggaattggctttacaatcctacgaactgtttaaaaagatcaataccttccagtggattgtcgtcggaaatttatgtgggggagaaaatagaaatacagaaaaaactcgtc

SEQ ID NO: 2228 - DNA, 3397 bp, Diabrotica virgifera
aacaaaggaagcaattgagaaggctaagaaacttgtcgataacatgcaagctggaggtggcactcacatgattggtggattggatgctggtctgtatcttgtaaaatctgaaatacaaagaactaaagcaagcaatgaccatagacaacctcttgaaatattcctaaccgatggacagcccaacatacgattacattctacaattgaaattattgatgagtacagctatgataaaaggaaacatatataatccactgtacactcttggttttggagaatatggctactaaagtgacgtataacaactctcttaaacatacaactacttctatagatattgaaacacaataggagaagtgctgccacaacaattagaagttcctattattgatccccgtgcagaaaccaaaaaaaggcctctcatttgaagctctgcttagaagtggaaaaatcatgctccagaagatatcgcctgttgagaatagttatttattatcgaatactttattgacaaacatccatctgcactttgacttatgctacaaaattttggagaaaaccctcccacgtcttacgaaaaacttataaagctacatttcatcttgctacgataccatagccataattttatgtgttcttttgatactgagatataaaataattgagccctaaacgatgagtacgagatttagaaccagtattgggttattttaaagagaaaatccttctgccacacttgggtatgttgtttcagtgaatataaagagtacacacgcgtcgagaaagtagaagacagaggtgttaaatagcaataattatgaaggtaaagttccttatattaccatttttggtaatattaaatttaagggccgtattttccgcaccaggagatgtaagttttattatatcgacaactgaacaaccaaaagaaggcaaggaaggagtgaccacagatattgaagatgtttacttggtgcctgtgatttatgaaatggatgtacattccaatgtaacgaatcgttacgctaagactgtgataacaaatagggtaaaaaacccagctaagtcagccaagcaaacaaccttctctgttgttcttccagaaaaagcatttatttcggaattcgtgatggaaattggctggaacaagtaccaagcttacgtcagggaaaaagaagaggctaaaaaaatttatactaaggcagtagaaagtggccaaagcgcagctcatgtagcgataagtaccaaagattccaacaccttcacagtctccgtgaacgtaggagctgaagaaaaggcaacattctatttgacatatgaggaacttttggaaagaaaaaataaccaatacgatttagttcttaacattcgtcccggacaaatagttgaccatcttaatgttcaagtatacatcaacgaatccagacctttggtctttgtgaaaactccatctctaagatctggcaatgaaatcgctaaaaacagcgataaacttgaccctgcctcttttgtagaaatcattaactctaccagtgctctagttaagttccaaccagacgttgttaaacaacaagaatatgctaaggaattaggaggaatagaattaaatggtcttgcagcgcaatttatagttcagtacgaagttgaaagagacccacaaggtggagaggtgttgttgcaagatggatacttcgtacactttttcgtaccaaaggacgcagaagtcatccccaagcatgtatacttcatcttagatacaagttccagtatgtacggtaacaaactccagcaagtcaaagatgccatgaccagtattttggaggagataaaacccgaagactcactcagtattgtcgaattcaacagcgaaatatacgtgtgggacatagacaatgagaaatcagttcttgctcagtgggacaactacagagaaccgtttgaacaattaggtaaacttaacttaccaggaccagtgtcagcaacaaaggaagcaattgagaaagctaagaaacttgtcgaaaacatgcaagctggaggtggcactcacatgattggtggattggatgctggcctgtatcttgtaaaatctgaaatagaaagaactaaagaaagcaacgatcatagacaacctcttataatattcctaactgacggacagcccaacataggtttacattctacaattgaaatcattgatgtggtcactaagttaaacgaaaacaatatcaaaactccactgtacactctagcttttggagattctgccgacgaaaatttcttaagaaaactctctttgaagaacaaagcattctcaagacaaatatacgaatcagcagatgctgctatccaactacaacaattctacagacaaatatcctctccacttttatcagatgttcacttcaaatacaacgacgatgctagtgaagtaactaacacaggttttcctattttgtacgctggtggagaaattgtagttactggacgattcgtaggtaatcaatttgatccaacaataagagccgtaggtaaacaaggacctttaacatacagaccaagggttcacaagccagtaaactctttggaacgtctctgggcatacttgactgttagagaaactttacagaaaatgaaaattgccaaagataaaactaaaacagaacttaccaagaaagctttgaagcttgctcttcaatattcctttgtgactgaggtaacatcattggttgtagtcaagcccaactctacacatcccatatatccagatgacggatatccaattccaaggccagcttatccatatgcgcctgctgaagcttcaggatacggaggcggtggatttgccggcggtctaaggagtgaggtagcacaagatagtgacttgatagtcaacaggcccgcaccccggattgtacataaaaaagtacgaaagccaaaagtacaagcaacaacagttaagccactccctaaaaacacaacagtagaagattcgttaaagtggttgtcggctgccctaagtgaaaagaaaactctatccctaccatcaggtgaattaaaacttggtgaagattcattaaacattactcccagtgaagcttgccctaaaacacccgaaggcaaagaagggggttttgctctctcattaaagaaattgtcctcaagtatacccccccaactgactgatttcccaaagtatacaaaaagttctcttgtgccctgcaaaacgaaaatgcttggggggtctgttggcccccaaaaaaaaaacgcagaaatggctctggcttaaatttttttgtatttggataaaaaaagctaaaaaggggtggatatatttttttttttgcagaccccaaaggaaattttttttaaaaaataaaagggttttttttttttttat

SEQ ID NO: 2229 - DNA, 555 bp, Diabrotica virgifera
cagacgcatgggcggacgcgtgggcggattttccgccgacgtgtgacagctacagaaaatgccgtctgtaaccttaaaagacgttgatcaacataaatttgtgaaggctttctcctccttcttgaaaaaaactggaaaactacgtgttccagaatgggttgatctcgtcaaaacatccagagctaaggaattagctccctacgatcccgactggtactatgtcagatgtgctgctattgctaggcacatttacatcaggtctcctgtaggtgtaggatcagtcacaaaaatcttcggttcccgcaaacgcaatggaacgaaaccctcccatttctgcagatcagcaggaagcattgcccgtaaagctctccaaagtttagaaacagttaagttgattgaaaaatctgctgatggtggtaggaaaatcacccaacaaggtaggagagatcttgatcgtattgctgcacaggttaaagctaaggaacgtaaagctcttaaggcttccggtgtgcttactttgtaaatgattaagttttaataaaataattatttgat

SEQ ID NO: 2230 - DNA, 581 bp, Diabrotica virgifera
ccgccgacgtgtgacagctacaggttagctaaagtgtttattcttaaattttattataaaatttatctaactacagaaaatgccgtctgtaaccttaaaagacgttgatcaacataaatttgtgaaggctttctcctccttcttgaaaaaaactggaaaactacgtgttccagaatgggttgatctcgtcaaaacatccagagctaaggaattagctccctacgatcccgactggtactatgtcagatgtgctgctattgctaggcacatttacatcaggtctcctgtaggtgtaggatcagtcacaaaaatcttcggttcccgcaaacgcaatggaacgaaaccctcccatttctgcagatcagcaggaagcattgcccgtaaagctctccaaagtttagaaacagttaagttgattgaaaaatctgctgatggtggtaggaaaatcacccaacaaggtaggagagatcttgatcgtattgctgcacaggttaaagctaaggaacgtaaagctcttaaggcttccggtgtgcttactttgtaaatgattaagttttaataaaataattatttgatataaa

SEQ ID NO: 2231 - DNA, 1340 bp, Diabrotica virgifera
caccaagttactgtccgcgttgaaacagtttgtagctgttaggaatatggcaagcggagaatttcttataaacgattcaaaatattcctttctgaaggatttaggactgaaagaaagaaatttgggagtatacgatggagcatggaagggatctggtgcggtagtacaatcaatttgtcccagcaatgggaaagttatagcagaggttcaacagggctcaataacagattatgaatcctgcgtggaagcatccaaagcagcttggaatgtttgggcagacttaccagctccagcaagaggcgaaatcgttagacagattggaaacgccttaagagaaaatctcgttccgttgggaaagttagtatctattgaaatgggaaaaattttacccgaaggtataggagaagtccaagaatatgtagatatttgtgattacgctgtaggattatcaaggacgttagccggatccattttcccatcggaacgtcccggacatgtacttctggaaaaatggaatccgttgggggttataggagtaatttcagcatttaacttccccatagcagtatacggctggaacagtgctattgcaatggtatgtggtgatactgttttatggaaaggagctgaaactactccacttgtatctctagcaacaacaaagatagtagccgatgttcttaaaaagaataatctacctggagctgtagcatccttgtgttgtggtggggcagatgtaggcaaggctatggctgctgatcacaggatcaaattgttatcctttacaggaagcactcatatcggtcacaggtggggagtggaagttcaaaaacgttttggaaaaatttttggtggaacttggcggaaacaatgcaatcatagtaactgaagaccccgatttagatatggtgggaccagcaaggttgtttggatggctaagaacccgctggacaaagatggacaactaccaaaaaaattgttactacctagcaaggtttttaatggaaatttttgggaaaataaaaaaaaattttagggccaggtacctccccagggaaaggaaaaggttttaaaaaaaaaatacctctagaagggccccccttcccccgaaaaaaaaactttttccaaaaaaaatattaaaaacccctttaaaaacaaaatattcaaaaaacaaaggggggggaaaaaattgaaatttggggggggagaaaggtatttaaaaaaaaaaacaaaaagaatattttttgtgtgtaaaacaccaaaaaaaaaataaaaaaaaaaaagagaaaatttttattgcacataggaggaaagacccctcccccctccttttttttttt

SEQ ID NO: 2232 - DNA, 1147 bp, Diabrotica virgifera
cgttcgactgacagttcattcatagtgattctttgctgctactctttggaataacctttgaaaaatgttgcggcagttgatgttgctccttgtaggagctgttgcagtaatggcacaaagaaggttagctcttcctgatcccaggagttgtgcaaacagggtacgtcatgcaacatacagggacgctagaggagtaactcattcatatttcttcagttgggaacatggaccaacaaggggattagaagttgactggctcgatgctagaaacatttgcagaagacattgcatggatgccgtttccttggaaacacctcaagaaaatgaatttattaaacagaggatagctagaggcaatgttcgttacatctggacttctggtagaaaatgcaactttgctggttgcgaacgagctgatctacagccaccaaatatcaacggatggttctggtcaggatctggtgctaaaattggacctaccactcaaagaaataccggcgattggagttatactggtgggtttggacaacaacaaccggacaatagagaagcggcacaaggtaatgatgaatcctgcctatccatcttaaataacttctacaatgatgggctcaaatggcacgatgttgcttgtcaccacgttaaaccattcgtttgtgaagacagtgaagaacttcttaactttgttgcgtcgagaaaccctggaattcgcctttaatctgaaaatttcagagaatcttaaaaaatatgttgtacctttgaaaacggccaagtctataaatattaagtgagaagtgatattattctgaacttattttttttgtccatctcaaatttttcaatatacctactgaataaacgacaaatcataaacaaaatgatttatttcacgtttggcgctcgtccgaaagaaagtaacacaagtcaaaaaatgcataattcaagttaccctgtaaaatttacactaaaaaatccaaaattttgctttttataaaagtttttaatattataaagggcccccacacttttttaaaaaaaaaaaggggcacaaccctcccaaaggggggttttttttttcttttttttaaaaaaaaacaaaaaaaaaaatgggcggttttttgggggtttttttatttattttaacaac

SEQ ID NO: 2233 - DNA, 372 bp, Diabrotica virgifera
ctttggccggaacgctcgacagcaaagtgaacatattgtttgattttctttaaacagtcagtattactataagacattgatgaggatccataatggaaaaggattccttagagatgtctttttgttttttgaattttgaatttttgaatttttttgtttccttcagtatagtgatttgctgctctaatctatgaaaaaaaaatgatggaaaaagatataacatcgttcaagaatgaatataggtgcggtagatgggaaactataaatgcatttctgaaagcaacgaaggtagtgaaagtagtagtgttctaagatatatgtataaaataataatgtaagttagaatttttttataataaaataatattttgt

SEQ ID NO: 2234 - DNA, 1116 bp, Diabrotica virgifera
acaaataaacgcaaaaggaatgaatacccagaaatcacgaattggcttgggttctccgacttgttttagccgatagtggaagatacgagatgagtgtcaaaactaaaatcaagaaaggttagggttatcgagacttctaagtttttacagcgcagtgatagtttgttgtggtgatgtgatagccaataattatgaggctgacctatgttgtttttatcctattggccgtagctcaaaaaataaaaggggcaatagaatccccctgtccaaaagtgtttgtttttgaaccagacaaatcaattgacgacagatggtatggactgatttcgttaaccacccaaaggagtataaaaggtattactttagaattggaatttgacaaatcgattatacagttagggaattggctaggcggagtaacatcggatgacgacaatactatatttactataaagaatgacaacaaagaagtaaacgccggtcaaacctataaagcagaaatttatgtagtttatgatccctactatgacttagaacctccacgattggtgagaattaagtttaacggtagggaaatatgtcctcattacgaagaggaaaaagttagcactacgatattggttgaatccaatgataataacaaaccaaccattctgctaaatattaacgtaccaagatgtggagtaactatagcaactcaaattggattgattactcatggagagtatacaaaaccagggcagtacccctggcatgctgcactctaccgaaaagaaggaagcaacagaatatacatatgcggagcttctctaattagtgagcaacatgtaatcacagctgctcattgcactactatcgatactcaaacacgtaatcctaatgacatggttattgtgttaggcaaacacgggttatgggtagatggtcaaaatgaacaaacctttgcagccaccaaaattattgtacacgaatcattcaataggtcaaattttttcaacgatatatctataataaaactagataaaccaagtcaatatactaagtgggtgagacctatatgtttatgggaagaggatactgatcttactaacatcgtcaatcacacaggtacagccg

SEQ ID NO: 2235 - DNA, 856 bp, Diabrotica virgifera
acgcattactgggtactaagcactttcgtttatctcgtttaaaatttgtctttgagtttttaagaaatatgagggtggaaatttttttgctaattcttattgcagctgtctgttattccattccgaccatacctgatttggatgactttgaagaactgaaaacaaaatgtgataagaggggaggaaatggcacatttgcaaaaataaagacttccatagatgaaactcaaacttgtattgaagacctgatcgacatcgataagtttgctgaagaacttgaagagtccaaaaagacaggatctatggatgaagtatttgccaaatactgcaaaaaacgccctgatgtcaggaaatgtataaaaaaattttatgatgcccttgaaccatgcttagacgaagcagaaaagaaaggtcttaatttcacctatagcattttaaccgaaattagtgattttgcttgtgcaaaggatggcgacagacttgcattgtttgttgctgaaggcggaccagactgtattaaatccaagacagagggcatccagaagtgcttaaatcaaactcttcaatttaatccagataatatatcaaaactttccattaaattggccattgataagaagacatgcgacgatttggggcaagttcagacctgtgtagttgctgaattggagaagtgtaaagagtctacaccagctaatagtcgacgcactttttaaatttgttaagcgaactgcctgtaaggatataaagaagagaagtatagttggattcgtaggcttgtaaacgatttacaattaaacaaaaattctcaataaagatactcaaacttctctaaatatagaaataatttatattt

SEQ ID NO: 2236 - DNA, 1349 bp, Diabrotica virgifera
acctagcccaaaaagatgggtatggaggtttgaatgaatatttgtactcaaatcttttgtggacgacattggcggtactgtaatttaaaacctccatacctagcccaaaaagatgggtcagtgcctttttgggaatatgctggaaatgctattgccagttcggaaaatgtgagattggcgccttctctaagaagtcaaaaaggagcaatatggacaaaaaaccccatcaatttcgactggtgggatgtagatatctcatttagggtaactggaagaggcagaattggagccgatggattagcattttggtacacccaaaataaaggctcagtcactggcgaagtgtttggttcatcagatcaatgggttggattaggtctattttttgattcatttgacaatgacaacaaacacaataacccatacattatggcagtgttgaacgacggaaccaagcagtttgatcatcaaaatgacggaatcacccaacaactggctggatgtttgcgcgatttccgtaacaaacctttccctactcgagcgagaatagaatattaccagaacaccttaacagtcttattccacaacggcagaacaaacagtgatgaagactacgaaatgtgtctgagagctgaaaacgtcgttctacccaaaggagggtatttcggtgtttcagccgccactggcggacttgccgacgatcatgatgtgatacacttccttactagtagtttacacccaccagatcaagtgcaacagaatcaattccaaggagaagaacaacagaagctgcaacaggagtatcaagactaccaacagaagttggaggcacaaaaggctgaatataagaaggaacatccagatgtgaaagaaccagaagtcgaggactggtacgaatcggactcacaaagagagctccgtcagatattccaaggccaaaaccaaatctacgaggtactcagagaactgaacaaaaagattgacgaagtcgtcggacgacaagaaaggacaatgagtttgatatctcagcaagctagcatggtccaagcgggcggagcacctccaccaccccctggcgcagctcctgtgcaacccggtgaaaccatcagaaggcacgaagtggatgctttgttcaacaaccacaatcagattagtggttacctacaggaactcaagcaattcgtccttgaagtcaaaactcgagccgatacgattttgaacaaccaagcgaaacaaccgacagctcaagtacagtcggttggatacgatactcaatcattgatctcagaaatgcgagatggactcaaccatgtcaagcagaacatcgcgcaacttttacagaaaacgcc

SEQ ID NO: 2237 - DNA, 1256 bp, Diabrotica virgifera
  misc_feature (1078)..(1078): n is a, c, g, or t
  misc_feature (1105)..(1105): n is a, c, g, or t
  misc_feature (1114)..(1114): n is a, c, g, or t
  misc_feature (1129)..(1129): n is a, c, g, or t
  misc_feature (1179)..(1179): n is a, c, g, or t
aaacatgaacttggaggtgattttatttgtattttttggtgttgttttaaattacagtaccgccactggcggacttgccgacgatcatgatgtgatacacttccttactagtagtttacacccaccagatcaagtgcaacagaatcaattccaaggagaagaacaacagaagctgcaacaggagtatcaagactaccaacagaagttggaggcacaaaaggctgaatataagaaggaacatccagatgtgaaagaaccagaagtcgaggactggtacgaatcggactcacaaagagagctccgtcagatattccaaggccaaaaccaaatctacgaggtactcagagaactgaacaaaaagattgacgaagtcgtcggacgacaagaaaggacaatgagtttgatatctcagcaagctagcatggtccaagcgggcggagcacctccaccaccccctggcgcagctcctgtgcaacccggtgaaaccatcagaaggcacgaagtggatgctttgttcaacaaccacaatcagattagtggttacctacaggaactcaagcaattcgtccttgaagtcaaaactcgagccgatacgattttgaacaaccaagcgaaacaaccgacagctcaagtacagtcggttggatacgatactcaatcattgatctcagaaatgcgagatggactcaaccatgtcaagcagaacatcgcgcaactttcacagaaaacgcccacaacccaaggatgtccgacagtgagctgtatatctcttacggctgtactagccattgcggctgtacagttaggcataattttagcctataatatttatagggataacaaggacagcagtaacaagaaattctattagagtgtatgcggatagttcttgagattaaatttttgagttaacagtggcggggtaattaacttttttaggggcattttgacattttaccgaacgtatttattatgtgaacaagagaatcgtcttcctgtattttatagtttaacgttttttgacatgtaacaaatttttctttgtaatttccgttttctagcaatttacattgacaanagaaattacttaggacaagtggcctanatggaatgngttactttttagtanaggtaggaaatacctttaaaatgggtagatgtgactaaagaaattagtanatcgaagataaaagacacgttttttgacatgtttctgtttgcaggggcgtcgaaatcagtttttgttaccatatata

SEQ ID NO: 2238 - DNA, 1109 bp, Diabrotica virgifera
cggacgcaggtgcggtagtaaacatgaacttggaggtgattttatttgtattttttggtgttgttttaaattacagtaccgccaatgtcgtccacaaaagatttgagtacaaatattcattcaaacctccatacctagcccaaaaagatgggtcagtgccgttttgggaatatgctggaaatgctattgccagttcggaaaatgtgagattggcgccttctctaagaagtcaaaaaggagcaatatggacaaaaaaccccatcaatttcgactggtgggatgtagatatctcatttagggtaactggaagaggcagaattggagccgatggattagcattttggtacacccaaaataaaggctcagtcactggcgaagtgtttggttcatcagatcaatgggttggattaggtctattttttgattcatttgacaatgacaacaaacacaataacccatacattatggcagtgttgaacgacggaaccaagcagtttgatcatcaaaatgacggaatcacccaacaactggctggatgtttgcgcgatttccgtaacaaacctttccctactcgagcgagaatagaatattaccagaacaccttaacagtcttattccacaacggcagaacaaacagtgatgaagactacgaaatgtgtctgagagctgaaaacgtcgttctacccaaaggagggtatttcggtgtttcagccgccactggcggacttgccgacgatcatgatgtgatacacttccttactagtagtttacacccaccagatcaagtgcaacagaatcaattccaaggagaagaacaacagaagctgcaacaggagtatcaagactaccaacagaagttggaggcacaaaaggctgaatataagaaggaacatccagatgtgaaagaaccagaagtcgaggactggtacgaatcggactcacaaagagagctccgtcagatattccaaggccaaaaccaaatctaccgaggtactcaaaaaaatggaacaaaaaattgacgaaggcgtcccacaacaaaaaaggacaatggagttttttttttccacaagttatagtggctcaaaggggggggcccccccccccccccc

SEQ ID NO: 2239 - DNA, 838 bp, Diabrotica virgifera
acgttcccctacgatctctgttctagatcgcgtatgttcgtagctgatctgaccattgtttggtgatgccataatgaagacctccatctatgtatggtgttatttcgtttaattgttgtcgtggattgttagggctgtacccagtcctcatgtcatatcttgttcttagcagaggtagttttgaatgttttggatgctctaatttatatgtgtgattgtctgggatgtctatattaaagtactcaggtggacatgcaggtctttgagcatctaaaatctcttcgactacttgctgaccaaagaatacaaataaggcattccttccaatgtttgatttctgtccaatagcaccactaagtaactgatcactcagcaccaatggattaggtctgtcagatccagatggtaagtaggtaccatcttcataagcagctggccacctccttaataaaggtctgtcaattgcaccagaatctggccgggccaaattgttataccaaccatcatagcctggatattcaactgttttggaagtaggactaggtgtaaagttgtcactccaatttccatttagtaaccaatcgccgaaaatatgccttctctgtttgttcgtagtgtaattgcccacccacacactatcaggcggctttccaccaaacgtctgcgtgggagctggagttgttgctggagctggagtcggaactggattcgcaggtggattcacaggaatcgcaggctgttgcgatattacgggctgatgacacaaatggagaactcccaaaattagaaaaactaaatacattattacggttaattatgtgcgaactccacgcgtccg

SEQ ID NO: 2240 - DNA, 1741 bp, Diabrotica virgifera
atctatacaagcaactaaaaatagaaaactgtccttgtaaagcaaataaataatctcgtaacacaatttttcatcagattgtagtgtgcttttgcaatagtgatggttccgggacaacgaattctcctacactgtcatatttatagatcactccacaacagccttaatgataaaggagcaaacttctatgttataaaaaaatcgtaaattaactcgtacagaacctgtatatatataaaaaacaaatgcgataatgctctgtgtaaaacttacactttcagtagcgtcctctttgggttttttatcaagtttgattgtaccagacaaacacacaatgtcaacagtttattttggatttaactagtgtaatagctgggttaaaaaaaatgtaggcccactaaattattcagttgcgcttctacgtcaaatctagacgatatgaatcaagaggaagaaattaataacattaatagtaagaatgaggccgccgtcgggatgagtgttcaggatgaggctccaaaaaagcctgatactttgtttttgtactttacagtgttatcaggtaccataccgttatttgtaggcggtacgtcaatggtatggatgtctccagtgctgccaactcttttatcaaatgacacagatctcaatcctttaaataaacctataacgactgtcgaaatatccctgctagcagcgttgccttgcctagtaggcctcataggatgtttgattattccaaaattcgccgatttcatcggaagaaaatattttttgttactcatgggcgcggggatgtttataacctatctaggaaaaggatttgcccatcacgttattcttttattaatatacaggtgtatattcacggtttttctaaatggtgtagctgtgatattacaggtgtatatagcggaggtttgtgaagatcacaatagaggtaaatttatgtacctgaaaagtatattttaccccctcggaaatctatatgcttatgcgataggcccgcacttcaattttagagatttcaacttgtggtgcgggctgccgattgtgccatttttaatatttttttgtctagctccagaaacacctgtatattatttatcaaaaaataaaggagaagattgcagaaaatcgttaatgaggctacggggcaataaaacttacaaagaaattgaaaaagattatattaaaattgacgaaacactaaaaatgacaaaaagcatcacatctgcaactctgctctctctatttaaaactaaagaatcactggttgcagttaaattgactgtttttctctcagctttggggtatatttctggtgctacaagtatctcaacgttcctgggaccattgttaaatcaagcgggtaccagttattctgaaggtaccatgactgttgtggttggtattacacaagtctcgtctttatttttaacttcgttcgttgtagaaagaacgggaagaaggggactcttactaatttctaatttgggttgttgtttatgtatattaatattcggtttattttactacttaaaacacgaaaacttcggtattgttacccaggtacagtggttaccagttgcttgcattattgtatattttttgatctatgccattggtttaggtcctctacccattactatcatcacagagctatttccctctgatttggcatctgcggcactctcttttgccataaccgtcatgagtggtgtaatattcataataactt

SEQ ID NO: 2241 - DNA, 1005 bp, Diabrotica virgifera
gttaatgtatgattattgaataatgattgttgccaccaggacaccgcaagattggttttccgttgatggcgtccagatgaaagaagctgatatcggacaaccttgtacagaatgttcgaaatgcaaagatgggtacgaaccgcacaactggaaatgtcacgggcctgctacgactgtgagtgctgatttcctcggaaagtggtaccgctgttgtttttgatgttatcgaaacatttacttagttaaatcggtagtttttaagtgtttgtgctaaattggattacaattagacttaaaatatgatttctaatgatattagtggcgatttggtgccttggactggacttactctggcttgtgtaaggattctgcagctttactgtaaagtttttcagcaggatgtacaggatttcaataaacttaaggaaaaaacatgcaaacattgcaagtgctccagagacggacacgagatagtggcggagcatggggctcgatcgcgactcggcttcgtagcaacccatgatgggctagacgctagatccttaggatacaccttcgtgcctccaggtcttaccagtgctagacaggtagaccaatattattccactctgccttctgaggaagttccaaaactcgggtccaaaggtgaaaccaatcgttcccaaagaattgttagacaattacctaagcaagatttgtcgttgtctgcttgcaagtttgtcgagcctcagaaccaagctagttatgaagactttatatctggccgaaaccaagtagctctcgacgtaggcttagcaaaacccactccgcccaatagtatttgtgctcattgtcaaaaacctatccatagtcaacaaatcagtgtcgctgcccctagattaggaaaatcggtgtggcacccctcgtgttttaagtgtactaagctgtgatgatctcctagtggatcttgcttactgtgtgtacgaggataatatatattgcgaaagacattacgctgaaaaatga

SEQ ID NO: 2242 - DNA, 847 bp, Diabrotica virgifera
actagttctagatcgcgagcggccgcccatttctaattttcaaataaataaaagggagagaattttaaattcgtaaacatttaagttatagtaatgagtaatgatgtagaaagttcagaaaacactgaaggctctatacataatgaagaagaaccccaagatgagactgaaacgaaaaaaacgaattcagaagatagtgccctagacccaagtggaacagattgttcagaaagtggcaatgaaaatgaagacagtatttctaacagtgagtctataagaactgacgatacagaagggagtattactgataagttaagggagactataacatatcaacaaagtatactagaacaaaaatccaacaaaataagaaacctggaggtagattactcgaaagtactgcaaactgttaaagaattagaatctaaattagacattgctactaaaaagaaagatgcagcagttaaagaaaaagaggctatggttgtgcgatatgctgtatccgagaaaaacgttctaaaagagaaacaacaaaaagaagctgctgagaaaaagctaagcgaagctgttcgtgaaactgaacacatgcagtataaagttcggttgatggtcaatgagaaatctcgaatttgtcaaatgcttgataaaaaacaccatgagaacaagttgcttcagcaggattgtgagcagaaaaaagcagatttgacgtcaattgacaacaaactcaaacgagtccaaataaatctaaagacagagtcagagactgttaaagatactcaagcgaagctgggaaacatcacagctaagtatcaagaggtgggtagtacaatagaccaagttaagcgag

SEQ ID NO: 2243 - DNA, 1224 bp, Diabrotica virgifera
gcgggtcgacgcaagacgacccacgcgtccacaccgaggttgtaggtatcgataaattttgtgaacgttttatttgaggaaatttaatttcataagccatggctcgtacgaagcagactgcacgtaaatcaacaggaggaaaagctccccgtaaacagcttgccaccaaagctgcaagaaaatcagcaccctcaaccggaggtgtgaagaagccacatcgttaccgtcctggtacagtagctctgagagaaatcagaagataccaaaaatccactgagttgttgatcagaaagttgcctttccaacgattagtaagagaaattgcccaggacttcaaaactgatctccgtttccagtctgccgctattggtgctttacaggaagccagcgaagcctacttagtaggtctctttgaagacacaaacttgtgcgccattcacgcaaagagggtaaccattatgcccaaagatatccagttggctcgccgaatcagaggagaaagagcttaaattctttctttctgtttccttcaagcaactctgttgcttcatattcattgtagattttttcagttctttcatacattgataaatatatattccagctgtgtgtgtcaagtgaaaaacttatttatgttttcttgtcgtttcatgttgagacagagcatggttttatataaaagatatcaattccacttcttctgtttcctttgtttgagtaggtttttcattttcatttaatgaataaaaatgtgttcatgttttttgacattttttacttaatattactttcttttattataatacaactatcagaatagataagattttagtattacgttttactttaagtgttagataataatttttttaatagcatctgtaacctgatttagaataaatttatgtggatgtaaaaaaaaaaaaaaaaaaaaaaaaaaaaaaaaaaaaaaaaaaaaaaagaaaaaaaaaaaaaaaagaaaaaaaaaaaaaagaaaaaaaaaaaaaaaaaaaaaaaacaaaaaaaaaaaaaaaaaaaaaaaaaaaaaagggggggccaaccaaaagggggaagccttaggaacccttgaagggaacttaaaacgccgggaggggggcccccaaatttaatttcaagggcggttttttaaaaacttgtaaacgggaaaaacccgggggttaccaagcttaacccccttgaaaaaaatccccttttcccaaaggg

SEQ ID NO: 2244 - DNA, 1239 bp, Diabrotica virgifera
gccaaatttatcagttctgctatatcatcttacagaaatatttagccgaaaatagcgaacagtggacaaaaatttagctgcttatagtgttatttactttattttaagactgttttattaatttcgaaggagcaacatgaaggtgacactaaaaaatcttcagcaacaaacgtttattgtagatatagaagcgacaaaaacggttaaacaacttaaacagaagattgaaacggaaaagggaaaagattatccttctgaaaaccagagactgatctatgcaggcaaaatacttacagatgaaacagttttgtcagaatataacatcgatgaaaagaaatttattgtagttatggttacaaagccaaagcaaccagagaaaacagatagtggagatggaaactctactccagccagtaatacccctgctactccagcaacacaaccagctcccaccagtaccccagtcgcatcaggatactccaccacctgcctccgcccccaccactcaagctgcttctgaagcaccttctactataagtagcgtagccgaatccaccctgcttatgggtgaggaatacgagaccatggtgaggaacattatggatatgggatatgcaagagacgaagttgaacaagcactgagggctagctttaataatccagatagggcagtagaatatttgataaatggtatacctcttatggatgatcaggaggcagtcagtgaaactgctgatctctcaggtgtagacgaaagacagtctgaatcagacgaccctttggcatttttgaggactcaaccccagtttcaacaaatgagacaagtcatccaacagaacccacagctgttgaatgctgtgctacaacaatcggaacaaccaccctgctttggtacagttaatatcccagaaatcagagtcttttgtgaggatgctcaatgaacctgcccgcgggggagcacaacgactgggaaaggggatgtcccccaggggggggggggggtttattggggaattcccccggccccccggcggggcccccccccaggggagtttcccccagcccccccccaaaaaaaagggaccccccccaaaaagggtgagaaaccctttgggttttcccccaaaacccataaaaggggcgcggcctttttttctttttgtgaaaaaaaaagaaaaaactcggggggggactaacttttcttttcttttcccccaaaattttcatgagaaaaaaaaa

SEQ ID NO: 2245 - DNA, 1063 bp, Diabrotica virgifera
gcctctaaccgcggtccggaaccacgtgaccaaaaaaccgtagaactccccgcagacacggttgtggacagccttttttaacggcacgtggttaagaatggaaacgtttgtccgaggtaagcgcagcatttttctctaacgccacaactcaagagcatacattttttcggcgttcttcgtgcgcgaacagtgcaaacaaaagtttctatacggggcagaaacaaaagttatagaaatattgaaaatacaagtgcattcgccaatctcatcttgatcttttagagataactctgtctttccaaattttaggcgattgatcgcattatttgtaaaaccaatgcgtcttcgaacttctgcttcgcagttaccatcgttagttatactagattcgagatagttgaatctgtttactatctggtattcctgcaagtggttgctcagcgattagtgttgaatctgtcttatcaccattattttcatcttgtctttattaattttaagaccaactataatggttttccaactctactcttggcagaagatctagtatttattgttcatttgctaagtggagtgtcatcggcaaattttaaattgaagatttttccaccaccttcgttccgtaccaccattattgctaaagccatctcatgacatatttaccataaatattgaaaaagtcatgtgaaaaaatgcatccttgtctaacctctctctctctctgctctgcagatttttaatgtctgtaggtgtatcggtgcaccctgctgaaatggaccaaagatttattcagctgacacaatcaaatgccttcttatggtcaacaaagcatattgtcataggtacttatataggtaactgagcgctctgtgccgtaatttgaaatttgctagcgcgcacagtatgttcaggtctattcctattctggttcaactggtaacgctgtgaattatgttggagcaggaaaaacagaactgattatcaatcaacgtacgattcacttttaagtggcgcgttgtggtaccggtgttgccaagttgtttaatttttaagtaattaatgc

SEQ ID NO: 2246 - DNA, 452 bp, Diabrotica virgifera
agttcgttaaagtttgtatgatagcttccgttaatatacactcgaagatgtttagtacgttattaagagcacccatgaggttttttgacaccaatgcaagtgggaggattctgaatagattctccaaagatatgggatccatagatgaaatattacccagagtactactagaatcagtgcagatttttttggttctgattggtatattggtgaatgtatcgatttcaagtccatacgccattatagctatgttacttttgggaatttgcttcctaaaattaagatcttgttacctatccatagcgatgtcgttgaaacatatagaaggaaaagtcaaatcgccgatgttttctcacgtcaactcttcattgcatggaatggcaaccattagagcttcaaatacagaagatatacttattaaggagtttgacgagcaccaaaatgttcacacg

SEQ ID NO: 2247 - DNA, 525 bp, Diabrotica virgifera
  misc_feature (497)..(497): n is a, c, g, or t
gtccggtaattgaaaccagtgcggggtggtgatcaacatggcagacaagctaaaagatacagaaatagaaactggagagtttgctcttgaaacgtacggagacggagacggtaaactagatggttcaaatttaggaaaatttatgtattgtatgggtataaatcctagtctagagtatttaaaaggtgcaggaatgacagaaaaagaaggagaaaaaaaattaacactcgatgaatgtttaaacgcctacgcagaactgaaaaagtcaataaaagattttgggtgttacgaagattttattgaatgtttaaaattgtatgacaaaaacgagaatggttttatgttagttggagaattaagtcattccctattaactttaggagaaaaattaaatgacgctgaagtagatgaagtttttgaacaatgtctggatgaagagaatgatgatggggaaattccttatatacctttcctcagaaggatgtgcgagttggacncaccattgaaacccaagaaaaaataaag

SEQ ID NO: 2248 - DNA, 1032 bp, Diabrotica virgifera
actagttctagatcgcgagcggccgcccttttttttttttttggtgaattgtttattgcatcctatcttgtgtacacatatcatattcaagggagagcccaatttgtacttattaagccccttgaggtttaagattatacttcgtaggctggaacatttcttcgcatatagcatcaaccatttcctttaaaagactcgtaagctgacttctgtctctaatttcaggacttgcacatagctctgtatagtacttaatcttaggttcggtaccactggttcttaaagtgcatactaagccgttttcaaaatagaatgtgatcatctcggtatctgcagaaactggtaaaactgctttattatctggctgattattatcatatccggttgttaagtctctgacggatgtgatcttgtattttccatttaaaatagactctgggtaggtatttactcctcttttagttcttatctgtgtgaatatctctttaataattggcggttccgtgcaaatataatacgaattcaaagaaatatgccgcccataagcggcattaaatctcctttagttgatcggctactgttttctttttaataaaaacaaacaaaaccatccaagcaaggtgggcagtggaaatacccattttttgcaaggacttccgggctaaccaaaaaaccatggtttttttcaaaaaaaaaaattactttattcccttgttttttaatttcaaagtttttttttcctaaccccttaaacccgggggaaaggggcaaaattttaaacctttttttttttttatttgggtaaaaaaaaacaaaaggaggggggtttgaaaaaattaccccctaaagaggggaaaaagaagtttttttttttttaaaaataaataaaaccccccagccagggggggccccccccccccagcccaaaaaaattcccccttctccgggttttgggtcttttttttccccaaaaaaaaccaaacacccttttgtattttttaaaaaaaaatattataatttttttttcccccc

SEQ ID NO: 2249 - DNA, 1033 bp, Diabrotica virgifera
tgtttttgattttaatattaaattttaaaatataagcaaggtcttcaaggaaaaaatgcattattagtaaatatgacgtcttcaacatttgactgtaaacagaatattttcttacaggcttaagaacggcatgggggattgtaacttcgaccgttacagcaaggaagaaaagttttcttacaggacttggtgttcaatgtgtgaaagaggacctcaaaggagacgttctattagcgaaacgaatgagccttgtagaagaaaaagcaaagaattaaagactttaactccaaagaaatataatcgtagccaagaatacgaaaatatggaattcgaatatgaattaaagggccagtggcaagaaaaagatatgagatatgaattttcgagaattagatcaaatctttgtgaacttcctacctcctatatatcaaataattgtcaactttcaaacaatttggcagggcttccaaaattgtctaatgaatcaactggctttgagtgttgtaaaagtgcaggtacatatgaaaccagtgggaaattcgctgatattgatgatcaaatcgaaaatttaggtagcatgcaaggaaaagggaagtcgagattggagcctgtgaagatcagtaagattgaaattcctacgtttcagaagaaatctgaagtaagaagcccggataaatcaattaccagtcatagttataacaatacatctcccagaggccatttatacagtagaagtgatcttttagataaatatcctagtccaaacaaatttaaaacaagttcatcagcaagcccctattgtaatgagttttgttcatactcaaactttaagatgcatacactaagtaatcagattccagtgtgttttgacaccagcacttattttaataaacgatgtgaagccatcccagataaatacaccagagaaattcaggatttaagagaaaaattactctcattaaaagcactagctatatttgtagcgatagcttggtcttcatcctagtacagctgtgattaaactacagtacct

SEQ ID NO: 2250 - DNA, 1084 bp, Diabrotica virgifera
cggacgcgtgggcgggtgacgtttaaaattgtattttgtgtttgtagttgcgataactgatgtgtacttttttaattgttagaagtctgctagtattttattgttgtaaaagtctaaactaacttatttttttttaaaatgaagtggtacagtggagaaatagccgatgcggttgctttttctaaatcgaaaggagccgtttttgtagtgtatattgaaggtactgacgaaaagtcacaaaaaataacagacctcatcaataatggcgaccttggagaaaaactggaacaagatcactttgtagctatcaaagtaattgcgggctctacagctcaccagcagtttagcgaaatttataaagaaccgagtgtaccctcgatatattttattggtcagaagggtgttcctttagatatcattacaggaagtactaatttagaaacagtttctgctaaagtggatgatgtcttgaacagggcaggattcagtacagccccagttcattctatttcagctgaatcagaaaacttcctggcacatgaacaagctggtgagacacgacgagtcgaaagtgataataatgctctgaatacgtctgaagaaagtccccccgaagaagaactgagcccctccgaaacagaaattgaaaaatcatccgaagataaaccccccgcagagcaaccgagtccgtcagaaacgcatacagaaccagcaaaagaagaagaaccagcaaaagaagagaacgcagaaagtacgaaaggtaaagaagttacggtagccgaggaaaataaggaggacaaagaagttaaagtagataaagaatctgaagaagttaaaacagaaaaagaaactacagacactaaagaagaggcagaagcagaattgtcaggggaagaaaaagtaaggagagctaaagaactgatcgatttaatacggaaggagaaacagaaggaagaagaagagaatgcacgcttgaaggagctagagcgcaggaagacgggccaaaatgcacaaccactaaaaaaatggcaggaggctcaagacctaactcggctaattaggaaagggcaagcggtgaaggcgc

SEQ ID NO: 2251 - DNA, 1531 bp, Diabrotica virgifera
  misc_feature (1445)..(1445): n is a, c, g, or t
  misc_feature (1465)..(1465): n is a, c, g, or t
  misc_feature (1474)..(1474): n is a, c, g, or t
  misc_feature (1484)..(1484): n is a, c, g, or t
  misc_feature (1494)..(1494): n is a, c, g, or t
ataattcatttcatatttaaaattaagatttctttaaaatattgatttaagtgaacattttataagtactgaaatatgtaacgacattatattctttaatttatgtcgaatttaaggacaaatcattgaaaaattatagaataatccacaaaaagatgtcagcagtggatgactcagctgagaaggaagctagtgaagtcttacacacattgttatcagtagagagaattgaaaaacaagaggatgttgtagaaaaccaaacatatcaaacttcgaccagtgctgatggacaagaagaagctcatatacagtggcacacaccagtgtctatatcacattcattattttcagctattgatgcttcagggcacttcacacataatcttgatgagcagcaggtagtcatttgggagggtcacacaatagttgatccggagagtaatattaataccatttatactggccactctatagaagaatctgaaacaggtgatgaatccccaaaaggtccagaaaatgaaattaaaaaagaaaatccgaaggctaaaaaaaagatcacagtgaaaaaaaagaaaaaaatagttaatggtgtgccaaatgatccaacaaagatagaagaaagtgctgctcaagtaaaagatagatttaaaagaggttgtgaatgtcaggatgaaagctgtttcagaggtttaaatgccgaaagtgtctataaacatcgacttaatatagctgaacttacgaaaggtgaacacgacatgtatttaatgggagtcaccatggcttgtttagcaaaccctgatactacggtaagacacaaggaacgaaggaggttaagagcgcagtatgtgtatcaaggtagaagagtatgtcttgatgctttcttgtatttagaaaactgtacacattatcaattaaaaagaataagaaaacatgtaatgacacacggtgtcgctcctagagtacatggcaatcatggtaaaaaacctcataataccttctctctagatatttacagacatgccactgagtttttgaaacagtatttagaacagcataccggagaaaaagatatcgtaaataccaaacagcctatacagctcccttgggatgtcacacgaaaaaatctacatgattcttataaagaatatggacagattcttgaacctggtattaagttaatgggttattcaacatttaggcattttatgaaggaacaatttccacatgtaaaattctgcaaagttgaacctaaatcttgtaccccacatcattcaactaatcaaaacactactcatagcagtaaccaacagcagcaacaaacaccacaagttcaaactgttacacaaaatcaacaaatacaaacagttattgaaagacctcgtgaacagcaaattcaagtacaaaaatgtgtcatttaccaacgaagttcacaaggtgattccggntagtcgttgctccatctccnactgatacntgccatgctncacatcaccnaacaacctttttagtcatcccctgtacccgcagtagt

SEQ ID NO: 2252 - DNA, 867 bp, Diabrotica virgifera
caatccttcctcgcatttacaacctgtgcattatactatactgtgtgttatttgaccgtgaagcaagcaaacagttcggtttggtgacatcgtactccgttgttatactgtctttgtttcaacgtcatattagttcaatatcgtagaccaatgaaacacgcaataatgcatcattaatagttttcttaattactggttcctcgagtctacaattaataaaagaatggaactttctgacatttgatttcccgccacaattggcggctcataattttaaaccagaagctacagtgcccactggtattgagataactaacgacaggatattcatctctattccgaggttaagatctggagttcctgctacattaacctccattcccatcaataatccaaaagatataagtccggttcttcaagcgtaccctgattggactctacatggtgctgggagtggaaattataactgttctggacttatatcggtctacagaactagaatagattcctgtaatagactttgggtattagacgctgggactttggacaccattgaaaactttagaagagcttgtccaccaaagatattgatatttgatttaaagactgatcaagttgtaaggactattgtctttcctagggaggtaattcaggcagcctccatatttactaaccttatcatagatgaaagtattcaaggaaaatgtgactcggcttttgtgtatattagcgacactatagcaccaggaatcgtagtctacgatggctctagcgacaaaacatggagagtttcagacccgtcaatgtatcctaatccagattatgcgaacataaacatagcgggagaacaattttctctgatggatg

SEQ ID NO: 2253 - DNA, 1425 bp, Diabrotica virgifera
  misc_feature (1298)..(1298): n is a, c, g, or t
  misc_feature (1323)..(1323): n is a, c, g, or t
  misc_feature (1328)..(1329): n is a, c, g, or t
  misc_feature (1346)..(1346): n is a, c, g, or t
  misc_feature (1374)..(1375): n is a, c, g, or t
cgactcggaagttaagtgttgtaaaaagtgttataaagttgcacaaagtggtctattatgtgcgaattgtggaacgttatcccatagtggctgcctgaagcaactaaaatcaatcaaatatatcgatgatgagacagttatatgctgtgaggagagtgtgaggttaagtgatccaccaaacaaaaccttggatagtgaggctgacgatgaggatccgcgacaaactgaaatcaggtacttaaagaaaattattaatcagaatgaaacaataatatcaaatcaacaaattacgataaatttattaaaggaacaactagatttatttaaatatatgcaaataactgatcagtcgccatctacaaaacaaaatacgaattcaatcaaccattcaaacagagacccaaattttgaacgaccgaaacagtctagcagtaaaatatatccaaaagacgaaaacactacacccgcaaaaaatgttgctgtaaatgaaagtcttgttgttgataaagaaaggagttccccaacaaaaactctctttaaaaatagtaccaataaaaataaacaagttgtttccttaatcgaaaataataaacaattatcagctgatattttaagaatacaaacggaggcaaaatgttcagatatcattaatttaacaaacgatgagaatttgataaatactgagagtaaaaattcggttccagttccaaataataatgggcaagaatggaaaactgttaggtataaaagaaggaatggacctattgttattggcaataatgaaaactctgaaatcagtggtgtcccaaaatttagtcatcttcatgttactagggtaaaccagcatacaacggcagataatcttaagaagatgttagaaaaacactttccagaagtgatatgtacgtccttaacggctaagcatcccaacatatattcatcctttaaagtctcaatttttgaacaacattttggtttagcgatggacccaaaactatggcccgtaggctcttatgtaagcaggttttttatgaagcgtccaacacatactcaaataaaatgaaggatgaagaaacgaccgttaaccctccatcaaattttcaaaataacctaattcaacaaggcacggtaagcatgtttcatgtcaatttacagtgtatatcaaataaagtcgatatgatcaatgcttttcttgcggataaaaagttctatgacgtcatatgtttttcagagcactggcaaactgaagaaaatctaaaattaattaacatctccggcttttcactagctaacttttnttctgtagggttgaaaagaagcaanggtgnngcgtgcatttatgtaanagaaatcttatgtattcttctcttaatnnctaatgatataacgtagagaaacttttcagagttttgtgcaatttatata

SEQ ID NO: 2254 - DNA, 829 bp, Diabrotica virgifera
cggacgcgtggagagagtggcccacaagttccatatagttgttatcgttcttaaaaaatgaaattatttatccccatattgttaagtttagttgtgtatgtagggagtgaaaggaagcttcctcctgtcgtaacgcagtgctataggaatgatccgaaggtgaacgaatgccttttagataatatccttagccttcgcccaaagctagggcatggcgttccagaactgtttattccagctttatctccattgaaggtagacagagcagaactacaccctgacaaaagtttaaacgtagatttatataatattaatttgtacggcttagactcgtttaacctaaaaagcattgacctagacgtaaaaaccctgaaggccggcttggatatttcctgggattctgtagggctggttaccgattataaaatggtcggaaagttattgatcttggctatagatacagttggtcatggttttggaaatttgactaagatcaaggctgacgcaggtttagtcttagataaggagatcaagagaggaaaagaacatttaaagatcaataaaatggacatcaatttgaaaattggcagttataatatgtcatttgataaatttttcggggacaatgcagaattaaatgcaaaaggaaatgagttgcttaacgataacacctcacttttcttagaagaatttattcccgttatagaaacagttgttaaagatattgtaagatcacttttcacgactttgtttaaaaaattttcttatgacactttgttacctaacaaaactgaataatgtgtataataaagctttgttatttttgtat

SEQ ID NO: 2255 - DNA, 1678 bp, Diabrotica virgifera
ggtactttcaaaacacatttgagagtgcacactcaggaaaaaccttataagtgtgaaatttgttttaagcaatgtagtcaagcagctcatttaaaaaatcatttgcgagtgcacactggagaaaaacccccacaagtgtgaaatatgttttaaggtattttctcagggaagtgatctaaaaaaacatttgagggtccatactggagaaaagcctcacaagtgtgaaatctgttttaagcaatttagtgaagcaggtagtttaaaaagacatttgagagtacacactggggaaaagccttataaatgtggtatttgttctaagcgattttctcaatcagacagtttgaaaatgcatttgagagtacacactggagaaaaccctcacaagtgtgaaatttgttttaaggtattttctcagggaggtaatttgaaacaacatctgagagtgcacactctagaaaaaccttaccagtgtaaaatttgttttaaacagtgcgtcagaacagatcatttgaaaacacatttgagagtgcacacgggagaaaaaacctcacagtgtgaaatctgttttaagcaactttattggaacagattatttgaaaaaacatttgagggtccatactggagaaaaaccccacaagtgtgaaatctgttttaagcaattttttgaagcaggtactttaaaaagacatttgagagtacacactggggaaaagccttataaatgtgaaatttgttctaagcgatttcgtcaagcagtcactttgaaaaaacatctgagagtgcacactctagaaaaaccttaccagtgtgaaatttgttttaaacagtttaatagaacagatcatttgaaaacacatttgagagtacacacgggagaaaaacctcacaagtgtgaaatttgttttaagcaatttattggaacatatgatttgaaaaaacatttgagggtccatactggagtaaaccctcacaagtgtgaaatttgttttaaggtattttctcagggaagtaatttgaaaaaacatttgagactgcacactggagaaaaaccttaccagtgtgaaatttgttttaaacagtttaatagagcagatcatttgaaaacacatttgcgagtgcacacgggagaaaaacctcacaagtgtgaaatctgttttaaacaatttattgaaacagattatttgaaaaaacatttgggggtccatactggttgcgcactttaaattatatatataaactaaattaacaggtgggcccccggggggcgggggtatacgcccgctacctaattttcccgatatgccccggcgggcgtatacgcccgctatgcactcgacaaaattgtatgtctatatttgccagcgggcttatttagaatggttttagatacagaatacgaccgctgtggcatacaaggctcgcatataaatgcgagttatagaatggctagacaaatatttgagaaaactacaatttttatttattttttattttttaagaagaaataaaaggaaattctactaccccacaaaaacaaaggttacatttatattatgaacaaattaaaataactaagttggaatgaaaattaaaacaatcccaaacaaaagggagggtttggccttcgaaaaaatccgaaaaaaggtccccaacttttttttccacgaattttttg

SEQ ID NO: 2256 - DNA, 1666 bp, Diabrotica virgifera
  misc_feature (1616)..(1617): n is a, c, g, or t
  misc_feature (1631)..(1631): n is a, c, g, or t
  misc_feature (1637)..(1638): n is a, c, g, or t
gtaatcaaaacgtgcccttgtggaagatctcctcttaaaacccagagggtatcttgtctagatcctgttccatgctgcgataaggtgtgcgataaaattttaaaatgtggccaacccaactctccgcatcgttgtgaagctacgtgccacgaaggtgcttgtcctccttgtccattaactacagttgttaaatgcagatgtggtcacatggacaaggaaataccgtgtcaagaacttacaactaaagctgacgatgcccggtgtcagaaaaaatgtaccaaaaaacgtttatgcggcaaacacaaatgtaaccaactatgctgcatagagatagaacatatctgccctcttccatgcaacagattgctctcctgtggccagcacagatgcgaacgcacatgccactccggccgttgtcctacttgcgtcgaaaccagcttcgaagaactgtactgcgaatgcggagctagcgtcatctatcctccggttccgtgcggtaccaaaccgcccaactgccttaatccgtgctcgaggccgcggcactgtggacacgaagtcaaccacgcgtgtcacactgggccgtgtcccccttgcacggtactttgtaagcggtggtgctacggacatcatgaacaaagacctgcgataccgtgtcatcaagaaaacttcagttgtggattgccttgcgggaaagacatgtcttgcaaaaggcacaaatgcgttaaaccttgtcacgacggcccgtgtcctacaccctgtaagctgccgtgtaatgtacctagagaagtgtgcggtcatccgtgtggcaggccatgtcacgtaccaccctgtccggaaagtagttgcaagcagatggtaccagttacgtgcccgtgtggtcttcaaaaaagtacgagaccctgtacggaagtcgctgatgaattcaagaacatccaaatggcgcagctaaaggaaaagatgggaagcttgtcgacgagttccaccatcgatttgacagatatttttaacgctcccaaaaagccgactgttttaaagatattggaatgcatagaagaatgccgagttctggacagaaaccgtagactagcaataggcctacaaatccgcaatccagacttgagccaaaagctaacaccaagatactcagatttcatgagacagtgggccaaaaaggatccacacttttgccaaaaaatccacgacaaactttcggaactcgttcaactggccaaaaacagcaaacagaagagccgctcctattccttcgactcaatgaaccgtgacaaaaggcacttcatccacgagtactgcgagcacttcggcgtggatagcgctgcttacgacatggaaccaaacagaaacatagtagccacagccgttaaggataagtcgtggctgcctagtatgagtctgttggagattattcaaagggagaacggccagaggagggttcccgggccggtactgggggcacgaggccccaccagcaaaaccgaaacagtgtccttgaagttgcctagcagagtacaaaggtcgaacacgcctcctaatgaaattgttgataatttcagatcatcatagttatcaatatttttactttattttcagtttataannatgtatattatcgnaagcannataagatttttttgggtattttcatcac

SEQ ID NO: 2257 - DNA, 870 bp, Diabrotica virgifera
gttccgatacatttgttttgtttttgttgcgggtttggcatgtattcagtgtacgctatgtccagaacgtagtgtggaagtcaaaataccaaattatgtcaaagctggggatagtgcaaccctcgtctgcaattttagagcaagaaacgaagaagaccatcttattaatgtacgttggtataaagaaaatgaagaattctaccgatttacaccagtggaccatcctccaataaaagtatttagtctgcccggaataactgttgatgaacaaaaaagtacagctaaaacagtagtattgaaaaatgtgcaagaccagcttacagctaattatacatgtgaagtcagttggactgtaccaaacaccgcaattgttagaggttcgaaacggatgtttgtagttgatgaactacaaggtgatcttatcttaacagtggacaacgagtctcctggtcttggcgacaacctacagggagcatgtattacccctccttccaaagttgtaccaacttttacatggtttttaaacggagagaaggtttataattggttttcgccagcaacaagaagaaatagcaatgttccgaaaaggtttacctctttctttaacgaaagagttcagtttgttaatgaccaagccaacttaacatgtgttgttcaaatagagaatgtttacgaaacacgtaaatcagttatattgaaaaaaagtaataatcaaattagaggttactacctcctaagggaaaacgctatgggctggaagttcgagagcgaccatcaacttgggtatatttgcagctgttttggtgggtaaattctggtcattattctaaaaaaaacatgtactaaacaaacgcattaaaaatatatatt

SEQ ID NO: 2258 - DNA, 1416 bp, Diabrotica virgifera
  misc_feature (26)..(27): n is a, c, g, or t
  misc_feature (37)..(37): n is a, c, g, or t
  misc_feature (44)..(44): n is a, c, g, or t
  misc_feature (63)..(63): n is a, c, g, or t
  misc_feature (86)..(86): n is a, c, g, or t
cagatatacgccttttaagttgatgnncgtaggaatnaacgttntaagcgttaagcttctttntaaggttctctgccaatttgtgnatgaattcgaaggtctccagataatcttctctggttactttgctcatgcccttgatgcagatggccaaatctttggtcatgctgccggattcgatggtttcaacgcaaacttgttcaagagcatgggcgaacttattcaattcttggttgttgtccaatttggccctgtgaagaagtcctctggtccaagcgaaaatggaagcgatcggattggtggaggtttctttgccttgttggtgcattcggaaatgtcttgttactgtaccgtgtgcagcttcggcttcaactgttttaccgtcgggggaaatcagaactgatgtcatcagacccaaagatccataaccctgagcgactgaatcagattgcacatctccatcataattcttgcaggcccacacaaatccgccctcggatttcatagcataggcaaccatatcatcgatcaatcgatgttcataccaaatcttcttagcttcgtagctagatttgtattcgcgatcgtagatatcctggaagatatccttgaagcgaccatcgtattttttcaaaatggtgtttttggtactgaggtacagaggatatcctctctcgagagcgtatttgaatgaagaatgagcgaatgctacgatggaatcatcggtgttaaacattcccattgcaacaccaggccccttgtagtcgtgaactacatatttctgagtatcaccgctggcaccagtgaaaattaattccaatttaccagcactaggaatgataacatcggtagctttgtattggtctgcgtgagcgtgtcttccaatgataataggattgtcccatcccctaaccaacctagggatatttttgcagatgattggttctctgaagactgtacctcctaggatatttcttatggtaccattagggctcttccacatctgcttcaatttgaactcaatcactctgttttcatcaggggtgatagtggcacatttgattccaacattgtatttctttatggcttcagcacagtctattgttacttggtcattagttttatcacggttttctattcctaaatcgtatacttttagatcaatgtccaaatagggaaggattagtttttctttgatggcatcccagataatcctggtcatttcatctcctaggatatccacaacggtaccggccttaatttttcccattttagtatttttagtacaagtggaatacaacaaatacttatctgccgaatgtgtagactccctaagacacgcaaacacaaactgaatacgtggaaaaataattttgatttttattcagagcagcaaaaccaaaacccacgcgtccg

SEQ ID NO: 2259 - DNA, 1732 bp, Diabrotica virgifera
caaaagtaaaaatggggaaaaaaggtaaaaaaaaaccctataaaaaaaaaaaaaattttatttaccaacaatttttaaataaaataatacaagggtattgaaagaaaatttatttttttgcaaaattatatagtttatggttgcggttttgtaatggattattactgtattagtggtttcatggtgtaaaattagtgtaaaatgtactggaagttaatataaactaagacaaaaaaacttcgacaaatatgtacacaacaaatctatagttttatcgtacaataaatcaaataagtttcgttggtacaaaatacacaaaacaatctttttccattttccagatatacgccttttcaagttggatggcataggaataaacgttttaagcgttaagcttctttttaaggttctctgccaatttgttgatgaattcgaaggtctccagataatcttctctggttactttgctcatgcccttgatgcagatggccaaatctttggtcatgctgccggattcgatcacgtcaacgcaaacttgttcaagagcatgggcgaacttattcaattcttggttgttgtccaatttggccctgtgaagaagtcctctggtccaagcaaaaatggaagcgatcggattggtggaggtttctttgccttgttggtgcattcggaaatgtcttgttactgtaccgtgtgcagcttcggcttcaactgttttaccgtcgggggaaatcagaactgatgtcatcagacccaaagatccataaccctgagcgactgaatcagattgcacatctccatcataattcttgcaggcccacacaaatccaccctcggatttcatagcataggcaaccatatcatcgatcaatcgatgttcataccaaatcttcttagcttcgtagctagatttgtattcgcgatcgtagatatcctggaagatatccttgaagcgaccatcgtattttttcaaaatggtgtttttggtactgaggtacagaggatatcctctctcgagagcgtatttgaatgaagaatgagcgaatgctacgatggaatcatcggtgttaaacattcttaaaaaatacgttgttgaaatataagcactacacaagtcggtgagaattgcgtaaaaataaaatctcaatatactactccggaaactaacccacgcgtccgtaacatcggtagctttgtattggtctgcgtgagcgtgtcttccaatgataataggattgtcccatcccctaaccaacctagggatatttttgcagatgattggttctctgaagactgtacctcctaggatatttcttatggtaccattagggctcttccacatctgcttcaatttgaactcaatcactctgttttcatcaggggtgatagtggcacatttgattccaacattgtatttctttatggcttcagcacagtctattgttacttggtcattagttttatcacggttttctattcctaaatcgtatacttttagatcaatgtccaaatagggaaggattagtttttctttgatggcatcccagataatcctggtcatttcatctcctaggatatccacaacggtaccggccttaatttttcccattttagtatttttagtacaagtggaatacaacaaatacttatctgccgaatgtgtagaccccctaagacagcccaacacgggcagggtccgtggaaaaataatttccatttttattcagagcag

SEQ ID NO: 2260 - DNA, 1061 bp, Diabrotica virgifera
cggacgcgtgggcaagatggcactaaacttgcaagtaaaagtccatccggtggttttatttcaagttgtagatgcttacgaacggagaaatgctgactcccatcgagtcattggtaccttattgggtacggcagacaaaggagtcgtagaagttacaaactgcttttgcgtgccccataaagagactgacgatcaggttgaagcagaactatcctatgccatggatgtatatgatttaaatcgaagagttaattcgagcgagtcaattgttggatggtgggctacaggccatgaagtgactaaccacagtgcagttatccatgagtattattcaagggaatgtaataaccctgttcatatcacagttgacacaagtcttcaaaatggtagaatgggtctcaaagcatatgtatgtgttcccttaggagttccaaacggtaaacaaggctgtatgttcacatcaatacctgttgatgtagtctgttatgatccagaagtatttgctcttcagttatgccaaaaaacaatggtagcaggagcttccagatcaagaaatgtcaatcccatgcttgacttaaaccaagtatcagaagctggaagtaaaatgagtgtgctgctagaacaggttcttcagtatgtggaagatgtattggctaacagaatagcaccaaacaatgctgtaggcagatctcttttagatttagtcaattccgtaccacatatgaacaatgaacagttctcagaaatgtttaacagtaatgttaaagatctcctgatggtcattactttatcacagctcattaagactcaattgcaattgaatgaaaaattaacattgttaacatctttttaaataaaatgttactcatccgtttttcttaaataaaatattcttccaaccaataaattcatcttaattatatatttttatattaaattcacttagtagtcaaaataaaatgtagtgtaaaagtaaagccacataccctctgacagacttctctattaccagtttttatctattatatttaattataaaaaaaattttttatatgggattt

SEQ ID NO: 2261 - DNA, 974 bp, Diabrotica virgifera
ggttgtttgatttttatatcgataaacaatgaataaattcatttatggccactcgtagttaatgaaaatttctgaaatatggtggacgtgagtgtttctgccgacccgatcgtgctgtcaactgacgatcctgaaagacgagattgtgaactctgtggtataaaatatattcacataaatgacgtggagaaacatatcaacagtagaaagcataaactcaaccaaaggaaattaactgagccggaggcccagaacagatacaactgtaaggactgcaacaagaccttgaccagtgaagaattcttgcgaagacatgttgagagtaaatctcacaagaaagaagttgaaaaacatttacccaaaatcgaagaatataaggagaaaactcaatcaatatggatgcaaaaatggcagctacggtcaatgtcaattattgactctactatgtctccttccaaacttgacgaggcgaccgttacaataaatgaagcagaggaagaaacatttgatagaaagaaatataaagttcgcagtgacaacttggcgttcgacagacttgaaccatacgtatattccttggtgtcatacttgagtataaggttagcgttagacccaaatacaacagatttcaacatatcagtcaacaacagaaactggcccacatttggagacataatagtagaacaaacttttagtgataaatttgtgacttatgctatcagatgtaaaaatatatccgaaacaccccaaactatcgataatttaaaggatgcaaaaatatttctggaaaaggagtatacttatgttactcaacacaaaaattattcatcgacaaccttcttgatatttacgacatgcaatacaagctcggaatttccagaacaaatagaaattaaaccagaattgattaaacatttcataaaaccttcggaggagacacccccacctataaaagtaaaaatatttcccaatga

SEQ ID NO: 2262 - DNA, 1739 bp, Diabrotica virgifera
ccgattttctcctactcctactctgaatttagtgacaggttaatagcacatgagttgttgctcataaaatctgggccccctaaaaagaaacaattttgtaatataaagggggttcgttgaataaataccccgaaaatgtcaagtatgttaaatataattattaaaagtgtaccccgatcaactcttcggcatatactaaaatctgtagaaaagggtattcctgtggtaactgcaaatcatagatgtgttattcaaggggagcagataatccgaaaatatggtattaatattaatagttcccacactttaagatgcagaaagtctacttctagtagtagatattttcaaacatccaatgcctgctgggacgtacaacttgtaaaagtgccaccttttgcggactctataacagaaggagatgttaaactcgaaaagaaagttggcgactatgtcgctgccgatgaagttgttatggaaatcgaaaccgacaaaacagccatgcctgttcacgcacctgctgcaggtgtgatagcagaaattctagtcaatgacggcgacactgtgaaaccaggtcaacacttgttcaagttaaccgttggtgaaggagctccaccaccagcagctgccaaacctgctgcggctgctccagctcctaagcctgccgccgctcctgctgccccaccagttgctccgcctccacctccaccatcagcgccacctgcagctgctcccccaaaacccgcagctgctcctcctaaaccagcggctccgatgacttcaatacctgtcgccgccattcgtcatgcgcaatccttggaggcggccacagttaagttaccaccagcagatccaaccaaagaaatctctggcacgcgcaccgaacatagagttaagatgaacagaatgaggctaaagatcgcccaacggcttaaggaggctcaaaacacgaatgccatgttaactactttcaacgagattgatatgacgaatatcatggctttccgcaaagaaaaccaagaggctttccaaaagaaatacaatgccaaattaagttttatgtcggcctttttaaaagctgcagcatacgctttacaagatcaacccattgtaaacgctgtgatagatggaaccgatatcttgtatagagactacgtagacatttcagttgctgtcgccacaccaaaaggtctcgttgtgcctgttgtgagaaacgtagagagaatgacatatgccgatattgaattgggcatcgctgctttggcagataaagctagaaaaggtcaactggctgttgaagatatggatggcggcacttttactgtaagcaatggaggcgtatttggttctctttatggaactccaattattaatccaccccaatctgctatcttaggaatgcacggaatattcgatagaccaattgctattaaaggacaagctgttgtgaggccgatgatgtacatagccttaacttacgaccatagaatcattgacggacgtgaagcagtgctattctttagaaaaatcaagcaagctgtggagaatccagccaccatagtcgctggtctttaactgccggtaagagtaataaaatattactttaatttttatttttctttgtacgggtaaccgtatttttatttatatttcttactaattggatattaatccgccgccactttttttttcccttaattctttattaaaagtattatttgcccaatatttttatttaaaaa

SEQ ID NO: 2263 - DNA, 962 bp, Diabrotica virgifera
  misc_feature (886)..(886): n is a, c, g, or t
aataattactactattgaaccgataggaagtgaaacagaaacaacaacagaaattataatgttggaaactatattagtaactttgccatctgaaatatcaacaacagttgacttattaccacagactacacctacagttatatcaacacaaggtgaatcatttccgcaaactacaattacagaaacaacaacagacagtttaatagaagaaactacaacagaaccaagtttatccaaagaaacgtcaactgaagcttcaaatgaaggtgaaacattcacaccagctaaatctacagcaacaacaatcgaatctgtaacatttgatagtacattggtaccaactgagacttcaacagtggctgaatcattcacacaaactcaagttacagaaacaatcacaactgaaacaccagctacagaaattaaacctgaagtatcaacaaacactgaagcagaagacagtacaaaagaaatatctacagaaactgaatctgttccagaaacaacaactttactgtcatatccctacccagatgcatcaacaccagagatcgaaacgtctaaagatgttgatgaaaatgaggtttttgccagtgattccccaactttgcctgctaaacgaaaacgatcaaaaaatagcttcaagcagttaaatagttacaaacacagacccagatctacttacacctcggattataatgagtacctttctggaaagaatagaaaattagccagtggaataggagattcaaagagagatccaataagaagaacaagatccgtggtagactacgtaattgctagatactacgatgactatcactcaaacaaccatcataatttggaaccctatgtaccacaaatgagacccagcttcttaatacanggaaagtatcgagaaatcaaattgagttcatgaagtacgatacagtactaccgtttttctacgtatctcatctaaa

SEQ ID NO: 2264 - DNA, 734 bp, Diabrotica virgifera
ggtatattcaaatacaaatcaatatacacctagtgcggttgtgatatttggacggttcatttacgtatcattattcttgtattgttttttctgtctatcgattccgagatgaagaagtcgttaataatattgcctttcttactgtcaattggcctttgtgacgtacatcttcttgtacctgaagaacatacaccgccaccacctccgaagccatatgcgtttggatacgctgctggaaggttcccggggcacatagacagaacccactccgaagtatccgatggatctgggcttgttcaaggatcatattcctacgtagatcccaagttcagaatccgcaaagtagactatgttgccgataaagatggattccacgtcacatccaacgacgacgtaccagcccttccatcagatacaccagtagtggcagctgctaaaattaaccatctcagaaaatatgcagcaattgcagacgcacaacaagcatcacctggacaagtcttcgtgcctgctgatacagtggctgtgcaatatgccaaaaacaaacatttgtctctctatgaaaagattgcagcagaccacgcgaggatagctgcagaactggaagcggccaagcatgaggagggacatggtaatgaggttggcgatggattgtacggtcatgtttagtttttttgttaaagtgtatgtattgtaaaatatttatgtctatagttacttaataaatagattcc

SEQ ID NO: 2265 - DNA, 898 bp, Diabrotica virgifera
gagctgagcatgctaaaaattcaaccttctgaattaagttagaattgtagcatgctcagctcccctgcatagttgatttcataatcaatttcaaataccatttgcacatacaattattttgattttcagtttccatttttttaatgtgatcaggctacaatttcaactttctaaaaatttcttcaaccaagaatcaattttatctttcgcatggcaaatataagagccaacaacatatatttcttatgttatgtgtgatatccatgttgtctctttttattctacactgtcatttgctgtgatatccataggatgtatactaatattaatcattggctgattgtgcaggtattagattgccagacaagatgctgctggaatctaaggaacttcctcaactggaaccccctcagtggaaaaattagacaaagagttcagttcctgattcgacagatagctgctgttggtggtcacgctattctgatagatgcagcagtaccaggtactgtagctggtgtatgagtgcccaaaggtgaccctgaagatcacaacaatcagtccttgtccttatttgttgccacattcccataatcagttctccaggattagacaaattagtccttattttgctttaacatcctcttcgtattctccatgattacctatcagtggatacgaaatacagtatgtaactttgttgaatcttgtacagttggagagtatcattttcccattttcgactcattttcttcaaccttttctattttgttagaattgtagcttgccttatctacatctcttaatcacaaagctaggatgttccttcccttccgggttccccccccctatcctcaaacaggcttcctagctttacattggacaaaaatcccggacgaga

SEQ ID NO: 2266 - DNA, 824 bp, Diabrotica virgifera
gttcagtgtgtagctcaagtcatgaagttggtaatcgcttctgtgtttctcatagccgctgcttcagctgctgttgttccagttgaacataaccaacatgcagaaccaaactcacaaccatcatcattagttggtaaacgatcagcaggtttcggcgaacatcttgacagaccaaatcaaccaaactcacaacaatcagcaggtttcggtcaacatcttgacagaccaaatcaaccaaactcacaacaatcagcaggtttcggtcaacatcttgacagaccaaatcaaccaaatcaacaaccccaacaccccgctcattttggacaacataaccaacatgcagaaccaaactcacaaccgtcatcattagttggtcaacgatcagcaggtttcggccaacatcttgacagaccagtcactcacaaaacaagcaatgagtacaataattatgaaaaacattctaccaactaccacaatggtcaggaatcgagaattttacactatgaatcagaacaagatcccgaacaaggttacaaatttggataccacacaagtcacggtaacgaagaagttcaaagaagcgaagaagcacaaataagaagaattgacgaggaacatgcatcagttgcagtacaaggtgttgttgaatatgttaaccatgaaggcaaacgtgtaagatggacctacactgctgacgaaaatggataccacccatctgaaattacagttacataaataattttatgattgtgatgaaaaaagtacaaaaatataaaaataaaacttttaataattcctaaaaaaaaaaaaaaaaaaaggggggg

SEQ ID NO: 2267 - DNA, 1702 bp, Diabrotica virgifera
  misc_feature (27)..(27): n is a, c, g, or t
cccttctacgcggccggatgatcattnttgattttcaacaacattttgttcccgcattatcgctttactcttttcgtcaatatttagatcaaaattttgcacggcatgggattggctggagaggcagcatcgaatggcctccttggtcaccagatttgtctcttctggattttttgtaaaaaaataaaatctatagaacaccatgtatcttcagaagatttacaaataaagtactaggcctaatttaaaaattttaagattattatatatcggaaattgcaaggacctgagaggttattcttaccctggcttagaggtgaaagtaaagtaatcgaaaatgccgaacaaatgtgtcttcctttaatcaaaaattgacatgttgctgggtttttcaatagtgtcgtcgtagttcctgatcatgcctttgtttcgttttcttgtggccacccattcaggaacatagaaagcgggtatactaataaaaaatactttacagttgtttgggtcctgttgggttactcgttattacaagttttttaattggttttggttttaataatcagtagttaaaaaacgcttcaattagttacttttcgttaactcttctaattgtacaaaaagcgtaccctaaaaaaaaaaaaaaagggcggccgctcgcgatctagacccacgcgtccggaacgaagcgcgagccctcccaagcgcattatagactccccgtctcccacaagggagcagaaggcgcgacaggcagtagccgaagctacggcctctgcgggggcccagaagtggaaaatgcaaattgccggcagttcgggcaattccaggttcaaaaagaagcccgaaagagcgcctcctgcttctgattggcagtctgatagagacaaacgagagcgggagcgagaacgcgatagagagagggaaagagagagagaacgtgctaagagctcttctgcctctgacgattctccaccaccgaaaaaaatgtctttgcctccacttcctccagctgagaaggccgttagtgtgcgcaaggccatggcattgaaagaaccgccactcaaaaagcctgagtctcccaaaaagttaaaactgactccagctccacccttgccgaaaataccgcagggacaagttgtgcttgataaatttggaaacttcaggctgatttctccgcctgaattgaaaaagggagaaggaacgagttcaggtcgccgcccaccggagcccccaggtcgcccgcgcagcgacagccgctcgccgaaacgccgcagtcgcagccgttccagatcgtcgagcggatcgcgatctcgctcgcggtctcgctctcgaagctaccgctcgcgatcgcgcagctactacagcaggtcgcgatcgcgcagcggctcctactactcacgcagtcgcagccgctcgcgcagttactccggagaccggcgcaggtacaaccgcagaggcggcttcagaggcaggcatctcaacgacaggggcacgtactacaaaccgaggttccaaacgccaaggcataacggtcaaagaggtagaggttattataataataatcgggattccaggtatggcgatagagactatcgaggcagaggcagaccgtacgggttcaaaatagaggtaatcgagacaacagcgcggtagatatggttctagagggagggggaagatacagagaattataggggatcgc

SEQ ID NO: 2268 - DNA, 1832 bp, Diabrotica virgifera
  misc_feature (837)..(837): n is a, c, g, or t
gaaatttccagaaggccatcgaagatttcgaaactgctttgaagctgaatcctaatcatggaaacgctcgaaaatatatgggagaaactctcgtcgcattaggaaggagctacgaggaagaaaataaattagaggaagctagaaaagcgtaccagagctgcttgactatcattccttaccacgaagaagctcagaactctttggatttcttaaaatccaaagttcaaccaaaaaatcttattgaacccactgaacttctactgccaagtttgaacgttccctctaagcaaactgacatgaatgacgcgcttaaacaacttctaaagaccgaggaagaagacaaaaaagataagaagaagaaaaagaagagcaagaagcgcaagagtcgaaaacgctccagttctagctcaagttcgagctcgtcggcaagtggagaatcctcctcgagctcgtctagcagctccagcgactcaagctctagctcgggcgactccgactatgaggacaaactgagaaaattcctggaagagacaaaatggaagaaaggcaaaggcgaggacaaaaagaagaagaaaaagaaagagaagaaggccaagaaagagagcaagaaaaagaagaagaaggaaaagatcaagagaaaacagagcttcgatttgagcgaattggacgaccacaagaagctaagggacgccattaagaaggaattgagcaaagaaaagaaatcgaagaggcacagtttggcgtctgaagacgacgagtacatcctgcagaagtcgggttatagtaagaaatttattgatagtttaccggatttagaagagttagaatcaaaattanatgcgtattatgcattcgagaaggataattcaatgacattaaagaacgaagcgcgagccctcccaagcgcattatagactccccgtctcccacaaggtagcaaaaggggcgacatggaaatattctgcaaattgaagaaaatattgaatatcaaactttttcaaatgtcgacgcagaaattttagattctggagcaatggataactcgtctgattcagattttgacccttccagtctgactagagtatttagtaaaaagtctaatataattgaagtttctagtttccacgatggcgagtttaaagatttgttaaagttagactcaaccagttcagaagggacaatgaaaatgtcaacatctagtagcttagagaaaaaaccaatcatcttaagaaagaagctatccagctaccctatagaaaccgtcttcgaagaagaaaagagtattactgctcctatttcattaccagttgtacttaaggacggtaacatttacacttgtgttttatgtcaaggagacgaaacagtcgcaggagactcaaaagcgatagtagctcacgttaaagaagaacatggctttcgactatacatttgcgacgtttgtgggcaggatttttgtaaacgaaatcaattgtctgctcatttagatgaacatgttttggctgaagaaggggattttcagtgtgaggtttgcaatagaattttcagcaatttgaggttatttcgcatccataaacgcatgcacaatccacaaacgaaggcatgggtgtgtgatacctgtggtaaaaagtataacagcaagaatctactagatgaacacgtcaatacacatttaggagtccgtccgtacgtctgcgaagtatgcaataaagattttgccagcaaatatacatacaaagcccacgaaaaaactcacgacgtgcgaccgcgaccttttaagtgctccaatgtgacaaatcgttcctagtcaacccaatctaacgcaacacgaacgc

SEQ ID NO: 2269 - DNA, 1940 bp, Diabrotica virgifera
cgatttcaaccaacagttggtactggaattgtaaccatttcacttgaaaggtgccaaatttcgagaccggccacatctcgaaaacataccatacatttgtaaatttgtatttgccaccatgcatttcgttatttaccagttgttgataactcactctccgaaaacgtcaggagccaccatgttgaagtaagtgccaatcagtgtgtttccggagcaaaaagaaatccacagtttacagaaaatcaaaacaagaaaagagaagagaagacttttagtatttttttgggaaatatataatatggttcaaattgataagttcgacaccatggatagagtacaaccaccaaaacaattttttggaaagaggcatgtgcagtaccttctgctctttagtgtaaatgttttagcgtatggattaagaaatattttaaatgtagccgttatttccatggttagcaaaaccccgccagagggagtcaccacttatccagaatgggcaggcagcaaaaacgtgatgttatcctccttcttttggggttacgtgctaactcaaattcctgccggtcaacttgccgaacgcttcggtccaaaattatttttatccggagcaatggttatttgctcactattttcaatactcattcctatttgcggtgctcaattcggatatctaggagtaatgttttgtagaataattcagggactgatgcaaggatttatatatccatccattcaccatttgatcagcgcctgggtgccgctcagcagcagagccaaaattgccggattcgtatatgcaggtggtccccttggtacagtcattgtgatgcccattgtgggaataatttcaggatcaaaactaggatggcagactgtcttttacttattggggggcgttggttttacgtggacagcttgttggatcttcttgggattagacagtccccataaacacaagaatatctcccaagacgagcttaagttcattcaagatggcattgttaccaacaagaaaaaagagcaattaccgacgccatggaaagatatccttaaatcagttccattttgggcgattttggtgtgccacttcggcgatctctggggcttctggacgatgcttacagaaataccaacatacatggacaaaattctaaaatacgacatcgcatcgaacagtactttgtctgcccttccgtatctaatctattgcctgttgaatctggtgatgagtcctattgctgattaccttattaccaataagattacttctgttggtgctagtagaaaaatatttaacagtataggtgtattcataccgtctgttgccttacttactctgtgttttattggttcagaagaaaaagccttaacagtatttatgttggttatagcagtaggttgcaataccggtattttaattggtttccacgtgaatcacatagatatcgctcccaaccatgcgggtacactcatgggaattactaatgcaattggaaatgtggccgccattctggcgcctttggctgtggatatgtttaaacatgtgggtggttatgaagaaagtgataaagaactgtggaacatcgttttcatcaccgcggcagtactattctcgacgactggtctcttctacgtcttcggagcctccggagaaatccaaccatggaacgacaaacgaccaaaacaagaagatagcgttccagagaaagaaccgatgtaccaaaatggtacctgagactgtactgtcttttgttccggaatattcatacaaaatagttgataagccaaagtcgatattgctctgttgtaattgttgtctttgttgaaatgtcttatcaatatttttagatacgttttttacctatctatggacttacgaattaattcgataagggttttttagaacaactataatttatttattaaaccttttttaagat

SEQ ID NO: 2270 - DNA, 1006 bp, Diabrotica virgifera
  misc_feature (985)..(985): n is a, c, g, or t
tgaaatgcaagaaagtttgttgatttgatgctgtgattgtgataaattagggaaaaaccaaatacttttgtttcatttattatattcaatatattaatttgtggaataccaatcaaatcaaatggaagttaaacaagaagttagtgaacatgggtataaaatagaaatagataataatggggtgaatgacgctcttctggataccgttaaaactgagattaaggaggaaccccagactgaagttacacacgattcatttgattatttaaacttggaggagtttcctttaaagacagaactaaaatacgatgaagataaactgtgtccccttgaagttaaagaaagtttcatatgtgaagatacaccaactgatgaatgcaacgcattaaaagatcacgttgagaaagtgaatgctgcagaaaagcgttttgtatgtgaaatatgcaccaaacagtttttacacaaatctcacttgaaagttcatcagatgaggcacaccggggaaaaaccttttgaatgtgcgatttgtaccaaaaagtttacaagaaagcaagatttaacgagacatttgagaatacacaatggagaaaaaccatacttatgtaacatatgcacaaaacagttttcacaaagcgctcacttaaaggatcatatggtagttcataccgttgaaaaaccttttgcgtgcgaagtttgcggcaaagagttttcgagaagttctgatttaaaaatgcatatgattattcatactgaagaaaaaccatttggatgtcacatatgcgccaaaaatttttcacgcagttcttctttaaaagagcatatgaaaaagcacactggagaaggtcaatttgaatgtaaaatttgtagcaaacagtttacacgaaatcacgctttaacgacacatatgagaatacacaatgggggaaaaactatttgtatgtaacatatgcacaaaacggttttcacgcagatctaccttaaaggntcatatgctaactcattctga

SEQ ID NO: 2271 - DNA, 985 bp, Diabrotica virgifera
ttgcgtccggtgagatagccactacttatcaaatttataccatacattgttacaagaaataacagtcagataaagtcaatcaagcagagagtccgttttcgtttaatcatttaagtgtttttgtaattaaaaactcgaagatgaaacggcgaaggcgacaaatcggccagatatgtctcctagtcctgggcctactcctcattggagccggcgttttcatcttcgtgttcttcgaggctatctacgaattcattcttgctgaagccctcaaattcacacccgactcacgaccgtataaagcgtggcgcaacaacgaccctccactcagcatggacatcttcctgttcaattggacaaatcccgaacaaatctataacatttcggacaagccggaatttcaagaagtgggaccttataggttcaaggagattaaggagaagattaatatatcctggcatgaggataattatacagttagttaccaacatcggaagttatattatttcgatcacgaaaatagtcttaggaagttaactgatgtgatatcaacaataaacccagtgccattaacaattggttttaagaccagatggtcgagctggtttaccaaaagggtcgtatcggcagcgttatcgagtgtttctagtctacatgtaacgaagaacgtgtcccagatattattcgaaggttacgatgaaccaatattgggtacattatcgaagtttccctggttggacgtccaggacaaatttgggatcttttatggtaaaaacaatacgttcggcaaagacggagttttctcaatgcactataaaaacgacgaaaacttcggcagacttgtaacatggaacaacaaaaaccaaacaaatttctacgagggccattgcaatgacatcaaagggtcagcgggagagttttatccatttcacagacaaagacagaaagttatattgtattcagcagagctctgtaaatatgccgaatt

SEQ ID NO: 2272 - DNA, 1019 bp, Diabrotica virgifera
  misc_feature (9)..(9): n is a, c, g, or t
gggtcgacnacgcgtccgatgaacggccatctttaatacaaattgatttagcctcagcgcttagcggtttaaatataaattagtaattattaaataaatattggattgccaatataaaacatttattattttcacaattcgttctctaaacttcgtttctacatttaaatatttgatactggattattagttcaccggtttttaaaaaatggaggagacagaagcaagtactggcaggaaaactcgctctagtgcagcaaaaacaacgcctgctgttaccaaaaaagaaaaaccgggaccactatcaagaaaaacacgtaagaaggttgtgcttatggaagtagaagtttctgatgaagaagtagatgaaactgttcaagagcctgtaacagaaacaatggaaactactgaagaaagcaagcagagcgaaaatcagattgacgctgaaaaagttaacggcaaagaaaacaaacctaaatcaatagatgatcaagtgatattaaatgatgtgacagttttctgtgagatgcagacagaaaataataaaacggaagatacagaaaaaatggaggttgatggagatcttgaaatcaagaaaacagaagataatgtaagttcccaacaaactgacgaaagtaaggtaaaatcatcagaaaaattggacactaaacccaatgtttctgaaccagaagtagaagagccagccgaaaagaaaataaaacttgaagaaaaaccagctgatactgacagcaataaaaaagaggttgagaaagaatcagaaaatgatgccatcaaaactaataagggatgttcagaagaagagttgaaaactgaaagcgaaaaaatgagaaagaaagtaaagacgttaaggaaaaaaacggaggaagaaacagagaaaaaacaagatgtggcaaaagtagaagaaacagatgcaaaagtgaaagaaatacagatgcaaaagtaaaagatgcaaaagtagaaaatacagattcaaaagtagaagaaaatacagatgcaaa

SEQ ID NO: 2273 - DNA, 913 bp, Diabrotica virgifera
agataaataagtagctagacgtgtgactctgtttggttaaaaaatccgcgatggttctttctatggacagatgggtaggcaaagtagccattgttacaggggctagttctggaataggggcagcagttgcagaacttttggttgagaaaggacttttggtagtgggcgcagctagaagaaaagaaaacgtagacgctttagcacaaaaacttcaaggcaaaaaaggcaagctgtacgcagtgaaagcagacgtcgccaaagaagaagacatcaaagaactcttcaaatggacttcagcaaatgtaggtcctgtatctatcctaataaataatgctggttgccaccacaaaactggtctaataggtggtgatacagcagcatggagagccaccatcgatgttaaccttatagcagtgtgtatagcaacaagagaggccattgatattatgcaaaggaataatatagatggatatattattcatattaacagccttgtcggtcacactgtacttaatgttcctaacgtaaatgtctatccagcaaccaaacatggaataactgctttaacggaaacattaagacacgaactaaatgcacggaaatccaaaataagagtcacgagtataagtcctggtgtagttgatactgaactaatatccgatatcaaaaaatccgatgcatttgccctcattaaaaacgcaatgttaaaatctgaagacatagctgatgctatttcatacgttctttccacaccactacatgtacagatccacgacattatcatcaaacctcagggggaacttctttaaaatgcacttaaagaagtctcaagctgcttggaatatctagtgtgaataatgtgagcatatttttatatttgtaaatatctaataaacttgttttttttatttct

SEQ ID NO: 2274 - DNA, 2929 bp, Diabrotica virgifera
  misc_feature (2878)..(2878): n is a, c, g, or t
  misc_feature (2883)..(2883): n is a, c, g, or t
cggctttctggtgcaaaacctacaaaacttatcttaccttttaaaagttcttaagaaaatgtctggtcccggtcgtaacgattgtagaatatacgttggcaatcttcccccagatatacgcaccaaggacatccaggatctcttttacaaattcggaaaggtaacttttgtcgatctgaaaaaccgacgcggtccgccatttgcatttgtcgaattcgaggatccaagagatgcagatgatgctgtccacgctagagacggctacgattatgacgggtatagattacgagtagagtttcctcgcggaggcggcggccatggtggtggtggtggaggcggctttagaggaggtcgaggcggcgaaagaggcagaggctctaggggaccaccggctagaagatcacagtttagggttcttgttacaggcttaccaccatctggatcatggcaagacttaaaagaccacatgagagaagcaggagatgtatgttttgcggattccttcaaagatggctcaggtgtagtggagtttttgagatatgaggacatgaaatatgccatcaagaagttagacgattcaagatttagatcacatgagggagaagttgcctacatccgcgtgaaagaagacaaaggtggcagtgaaaggagatccggaggtagatcgagaagccgatctttctcaccccgcaacaggggctcgccgacatacagccctgtgcatagaagtttctcgaggagccgttctcgttcataatttccaaccgtggatattatgtacgtattgtgttattctattaggcatttccttgaagtatttttttatgtgcaaatatttccgttgattgtcgtgatcttagattgtagaagttgatattggctaattgacactatgaatgataaaaatttatttgtattcattcattgaatgttagtttccaatgaaaatcacctccagagtatgatccgagcagaaattttttaatttctaatttaactgaaccaagatttaccaattggctgcagtaggactgaaaaaacatcttcattgaaatatatttagttcacaatgcttttaattgtgacatttggaatcatggcgtaatattcgccatcttaagaaaacagatctttccatgtcagacattacatctagtaattcgatcttattctttgaaagtacagaatttcttctattctatctgactattaatatattttgatcgaaatttaacagtatttccggttttataagatgacagtagtatttttccaattttttttggaaatgcgtaaaattttgcacgaataattacttgaaattgttaggttaggtacgatactcttggaatttgcctaaaaaatagaatatagcttaagatattggtattgctattaatggttttttttatataatttcatttgtccatttgccgttctgtgtgttgtacattccgaattttttttttaattaatcacatgcaaagaaccaaggaagtaagtaatagtgattatttcttagaagtgttttgaaacgtttccttgtttcttggcactaatggattcttcaaacttaaattaattgattttttaaatactataagactctaggcactaatgtataatttttttttctgtctatggtacctttgctgaacctgtgtatcagcgatggacgattttggaaataaaaaagataaaactgacgtagaattctattaaacacctactcgtcaataggagggaagaggaatctttaatttgtcaaaaggatctcctcaagagatttgcaaaaaaaggattttaggagggatttattggattttggatatcaggagggaggaattgtttagctgtttcgcgggataggataggagagcataatacaggagggaggattttttaaggattaagaataatcaggatttggagcttttagagcatttgagtttatttcatggtaacagaaacagtgattacatatttttacagctttcttacaatttgtttcgccatttagattcagaagccgtaataaaacaacttatcttttcatccttcccaaaaactgcttattttccacacattttcgcatatcataagaacaacctcaatatctgcagctgcacatcagatggcgatagagcattaccaaactacatgccaacaagtatcatcagtgtatgttattcacaaaataaatcatccctcacttttcattttaagcttcaccttatcgcttgtaccgtttctacacaaaagaggctgtttctgtaacttgaaatacactcactgctctatcagcgtttttggatcgtttcttgcatcggatttgagcttaggaggatcttgggttcattggaaaaaatattgttggaaggattcaccatttatggtaaataaaaaacatcttatcatattttcataacatttcaaagcttttgttttaattcgaatgcaaatgtcaacaatgtctggcgatatttgatagtttttagttatttttttagatattgactggattttaatgcctggttgcaccaacagatcttaagctccagcttagctaagctctacttatagatagggcctccttgagtatcacttacgttgcaccgtaattttagatttttaccttattatcaattatatctattattatattatggtattctcattgtaatacattataattatattatattatttcttatgatattcttgacttaagcttaagatctgttcgtgcaactgggcataaatgttttttcatagatataaaactaatatcactgtcattttctaaaaaaaatatattgaaaacttttaaatggtatccatagacattgttgtagattgtatatttcatactaactgntttanaaagctgaattttttgtgtgggattcaataacaggaacaataaaca

SEQ ID NO: 2275 - DNA, 1049 bp, Diabrotica virgifera
tttttaaataaaactatcggagataatcgatagaccatattcggtgtgatgaccatttttttctgtatgtctgaaacactacataaatatttatttccatcgactacaaggtgtggcgtgatgatgcaataaaccaataatattacagaagaataccattactataattatgtaaaaagtagaagaagaatacaaagatttagaggccgaagagcaagccggcttccgtgctggcagatccaccactgaccacctatattgtgtaacacagttaatagacaaacaaatagcctacaattaagaatttcatttagtgtacatatacttaaaaaaaagcatccgacactgtgccataaagtaaactttgggaagccctcgaaaaaactaacatcaatctgaagctcattaaagctgtaaaaatctatactaccgcaatatacactcggatgcaaaaccaaccggacaccccaaaaatgggtaaccttcgatgtcccgcaactcccaaacccgctgtccgatttgagcgatttttcaacatgctacagccccactcttcaacaacatcgttccaacaatattgctgctacagttgagtccgcgagtccccaccagtgcgtcattaatacctggcgagataaaacacatactttttatctagcatcattttcttccacgcatgaaactcatgacaaaccagctgccgtttgttattaagtaaaaacacacgttatttttatgaaccatctagactcagtgcattgaaaagagataggtacaaaaaaagacgattcggtatgttttcatattttaagcacaatttgtttgacgtttctgatttgtttaattttgtggctgtcagtcagttgaactttttgcggtttttgtcgaatttttgcgttttgaagtttctttatacacaaacagttgttttcacaactaattttatattggacattcaaattttaaggtaggtaattatattttggcaattaatatttaaaacatacaaagataacgtcattcacacagtaaagaagtgattgtgttta

SEQ ID NO: 2276 - DNA, 867 bp, Diabrotica virgifera
ttatttttggtattgtccattaataggtatctatcagctctacaatgtttgttaagagttttcatagcataatttttcaaatatacaaattctttcttatatgttcaatgcgcttgcacatagtatgtcaaaactacaataaattaattaaaagatggtggaacagaggacagcaaactaactactaaatgcactaagttcatcccacaacataaaaatatgttatgttttatccagcttaaaataaattgatgaaattgcatcaacaaaattcagataatttgtaaagtaaagcataattagtgtaggaaaacctgtgttgttaaaataaagttgccattataatacgatcaaaaatactgtaataatacaatcttacaagggtatttgtattggttaaaaagttgtaacactaaaaataaatcgttttataagaactacccattaaaagttcccaaaatatattatctagttctcctagtctgtcttagtaataagtactgcaaaccactttatacaattgagtccatggttccttacccgtgagtcattaatacctggcgagataaaacacatactttttatctagcatcattgtcttccacgcatgaaactaaagaccaaccagctaccgcctgttattaagtaaagacacatgttatttttatgaaagctttagacttagtacatcgaaaagagatacgtggtggaaaaaagacgcttgggaatgttttcaacttgagtacaatttgtgacgtttctggtttgtttacttgtggctgtcagtttgttggattttttgctgttttttgtcctgttatgctgtttttctttagaagttatttatattacacaaacagttgtttt

SEQ ID NO: 2277 - DNA, 695 bp, Diabrotica virgifera
catcactcgtccggttgttttcacaactaattttatattgcagttagaaattttatgataagtttgtgttattttacgataaattttgacaacgtacaaataacctcattgttgatgcagttaaggaatgcttgtgggtaatgttccgccaaagtaaatagaataacaaaaagaaaatatgttatcgaatttttttataaattgtttatttttcaatgataataaaagaatttattaagctacttcaaatgtaactgtaattatgcaccaaaattttaaagcaaaacttaaatttgacattctatttatttgataacgtcaaattttatactataacccgtgatcggaataatacccactttctgttacttactgttgcgtcattaatacctggcgagataaaacacatactttttatctagaatcattctcttccacgcatgaaactaatgacaaaccagctgccgcctgttattaagtaaaaacatgttatttttatgaacgatctagacttagtgcattgaaaagagataggtacaaagaaagacgattgaggatgttttcacatattttaagtacaatttctgacgttttggtttgtttacttttgacgatttggataggtaacagatgtgcctgactctaggttaggctcctgctaaaaaggttatgaaacagcacatgccccaaaagac

SEQ ID NO: 2278 - DNA, 1098 bp, Diabrotica virgifera
gttaaaatttatgcaaaggtaaacactaatggtacaatgatattgatcaatcatacttagtatattttacaaaccgtccaaaatttttaaaacgatgtacttcagaataagttccgagacgtggttggtaatttttggaactttgttttcaatattgttaagagcatgcactaatctgcattcccattctggtgaggccactcctcctatgtatggtgattatgaagctcagcgtcactggatggagatcactacgaatttaccgataaatcaatggtattataatacgactaacaatgacttaaattattgggggctggattatccacccctaactgcatatcatatgtttatttgtggaaaagtagccaattatttaaatgaaaattatacaaaattgcatgattctagaggatatgaaagtgattctcacaaggtattcatgagatacacagttatgctttctgatgtattattatacataccagctctgattatttattaccaaacttgtatcaaggatggggaagtgctggagaatggagtgatgaaaaagaagccccagatcccaaagaagtttacaataaccaaaccgatgagctcttcactttgtactgttcttggtttgttgtatccaggtgttattcttgtagatcatggacattttcaatataattccatttcgttaggttttacaatattggctataacatatatactaaaagagggtgatattttagcttccatttttttctgttttgctttaaactacaagcagatggaactatatcatgctataccatttttcttgtacttgttgagtacttgtgtgcctaaacctggtcagagaaccttttggggaatatttaggttattcaaaattagtataacagtgatatctatgttttggtctcatttggctaccattcttgtttaactttgaagacttgatgcaagttctgcataggttatttccagtagctaggtggagtttatgaggataaggattctaacttatggtgtgtcttatatgttgtattcaaatttaaaactagatttaataattttgagatgatgagagtttgcttgtttactaca

SEQ ID NO: 2279 - DNA, 782 bp, Diabrotica virgifera
gagacactctcttaacatcccatagctagtcaaaattaaaattaattttacttcattacaaactattattgtataaaatgaatgccataattacaacagtagctggtaacctagttagcttctcagctggtacagcaatctcatgggcatcaccagaaatatcaaaactagctgacgcttccataacaaaatcggcaagtgaagagtcgtgggtaaaagctatttttctcctgggcgcagtttttggtacatttccttttggctggcttgcagataaaattggaagaaggataacgcttctatcgatgggcgtgccattagtaatatgtttttttattatggcgttcgttaaatcagtaggagcttttttagtatgtagatttattactggagttgttgttgggggtgtttttacagtaatgcctatgtacattggagaaattgcagatagttcaaacagaggagtgttagcaggactattaaatatatttatatgtttgggaattctattctcatatgcagtagggccttatactactattctcgtctttaatattattcttgccctttttcctgctttctttttgatattattctttattttttcagtagaaagtcctcgatatttaattggcaaacaaaatatatctgaagctaaagtgattcttaaaaaattacgtggagccactgcagatatcgacagtgaagtaacgtttatagaaaaagcactgaaggaggaagggaaagggggaattatggatatatttaaatccagcggtaat

SEQ ID NO: 2280 - DNA, 1712 bp, Diabrotica virgifera
ctagttctagatcgcgggcggccgcccacgcgtcgagaaacgctcttgtgagccagtgtttttaacacggtagtacgggtgcattttcgttaaaattcgaaaagccggtatgggcgattatcaagtaacacaagttcaacaagatgctcttggggctgtccagctagagttaggaggaaatcccaacactctagcattacgccggccgttcgaccctttggcccatgatttggaagctagtttcagattgacgcgattcgccgatttgaagggccgtggatgcaaagtaccccaagaagtacttaacaaacttgtagaggggctccaacaggattataattcggcagaacatgaacatgctcactttatgcatatggcaattccgcgaattggaatcggccttgattgttcggttacaccccttcgccatggaggactgtgtttggtacaaaccactgacttcttctatccattggtggatgacccctacatgatgggaaaaattgcttgtgctaatgttttaagtgatctttatgcgatgggagtcactgaatgtgataatatgcttatgttactgggagttagcacaaaaatgacagaaaaagaaagagatgttgtcattcctctgatcatgagaggatttaaagactcagctcttgaagcaggcacaactgtcactggaggtcaaactgttgttaatccctggtgtactattggtggagtagcaactaccgtttgtcagccaaatgaatacattgtcccagataatgcagtagttggagacgttttggtccttacaaaacctttggggacacaagtggcagtcaacgcccatcaatggttggatcagccagaacgttggaatagaataaaattagttgttagtgaagaagatgtaagaaaagcctatcaccgtgctatggattctatggctcgcctcaaccgtattgccagtagactgatgcataaatacaacgctcacggagctactgatattaccggttttggtctacttggccatgctcaaacattggcctctcaccagaaaaacgaagtatcttttgtcattcacaatttacctgtcatcgcaaaaatggctgctgtagctaaagcatgtggaaatatgttccagttattgcaagggcattctgctgaaacttctggaggactcttaatatgtttaccccgtgagcaagctgctgcctattgtaaagatatagagaaacaagaaggttatcaagcatggattattggtattgtcgagaaaggcaacagaactgctcgtatcattgacaaacctcgagttatcgaggtcccagctaaagagtagatttaataatacatatgtaatcaactttaagtattttttgacatactgtgggcagttacaagtctaagtatgatttcccaacagctttgtacatctaatacgttaattactttgtgcattttaatttgaaatggatccttttgtattgtttatgtcaaaattttttaatttgttttgatcatggtttatctccccatgaaaacttgaaaactttttttttgggtttttctctttataaaaaaggaatttttaaattttctggaacttggggttttttgggggaattaaccaattcttgctttttttgaattttttttttaagggaataaaaaaaaaatgttttaaggggaatttttggttaaataaatttttccccaattat

SEQ ID NO: 2281 - DNA, 945 bp, Diabrotica virgifera
  misc_feature (746)..(746): n is a, c, g, or t
cccacgcgtccgcccacgcgtccgaaacaaataaaaaatactctgtgggttgtgggttccagtttatcctttattttccagaattaaaaaacaaaacatggatccggaaaagaaagcagcaaaccctttcgtatatttagatatacaattcgatggacttaaagctggaagggtagtgatagaattatacaatgatcaagtgccaaagactgtggaaaactttagaaaactatgtacaggagaaaaaggaattggtaaaaagggaaagccactgcattacaaaggaacaaagtttcataaagtggtttctatgtgtatggttcagactggtgatattataaataacaatggaaccaatggagaaagtatatatggagaatattttgaagatgaaaatttttctgtaacgcatgataaggaaggtattgtgggcatggtgaataatggaccaaatacaaatcaatcacagttttacattacaacacaaccttgtttccacttagataacacaaacgtggcatttggaaaagtggtaaaaggtttaaatatacttgtagaaatgtcggatcaacctagagaaaacgataaaccgttaggggagttaatcatagccgactgcggagaatttaaagctgacgaaccttggaatataaaagaagatgatggcactgaggataaatatccgccttggcctgacgattgggaagaacaagatccggatgtgccattgatggaacaaactttanattacataaagagttctggtaacttctattttaataaacaggattttgcgagggcagaacgaaaatacgtcaagtgtttgaggtatgcggattggtatctgagcaagaaaaaacaacccactctggaaaaagtatacgattggacgtgatgatgaatttgccagtgcgaagttgaagaagaaataaatacaggaaccgc

SEQ ID NO: 2282 - DNA, 992 bp, Diabrotica virgifera
agttaacatcttttgacacgtaggaaataatttcctctcggatatcaagtagatccatattttgtaacatatttacatttgtattatattaggatagttattaaacatttatgaagttttatttataaatattccaacaaatagtttcaatataatggcaagtccaagaacaagacgtgttttacaagaattaaaacccagtaatgaaaacgataaatgctttgagtgtggaacacttaatccacaatgggtgtcagtcacatatggaatatggatttgtttagaatgttctgggaaacatcgtgggttaggagtccatttatcatttgtacgatctgttactatggataaatggaaggatatagaactagaaaaaatgaaattaggaggtaacagaaatgctcggatattttttgaagcacaaccagactggcacgatgatatgaccctacaacaaaaatacaattctaaagctgcagctctttacagggataagatttccactttagctcaaggaaaaccatgggatgaaaggaaatctcccgctcaaaattacacaagtaatttaattggaggcaactcattacaacattctagctcaaaaaccaatcacacttcttctgccagtacttaccaatcatcgtcttatgatacatatgagggtggttatcagaatatgaactcaccagagtttaaaaaccaaaaggaagcatttttctcaaagaaacaaatggagaatgcaagtagaccaaatgacgttccaccgagccaaggagggaaatacagcggatttggatatacaatggaacctccacctagaagccaatctcaagaatttgtagattcagccatatcatctctagctaatggttggtccttcttgtcctctttcagcacaaaactagcgagcaaagcgtcccgaaacgcccgtaaatatggaggatttagcagtcagaaggtggccgaacgtagctaaaaggtagggggaaagg

SEQ ID NO: 2283 - DNA, 956 bp, Diabrotica virgifera
  misc_feature (799)..(799): n is a, c, g, or t
cccacgcgtccggatttttttcttgttagattagctcagacagaaagttttgttgaagaaatttcattattaaataacggtaaagacctttcgtcaaagagtagattattacctttaacgccttttctagatgaaactggattattgagagtaggaggacgtcttagaaaatcttctaggaattatgatgggaaacatcccttactattagataagattcatgttttaagcaaactaatattgagacatgagcatgtgcaacttcaacatgcaggtccacaactcttgttagcgacagttcgtcaaaaattttggataattgcgggaatgtccctagctaaaacagttgtaaggaattgcattagatgctatcggtttaaacccaaacctggttctacgattatggctgatttgccagaacatcgtgttaatatatcacaaccttttttcataactggattagattacgcagggccagttacattaaaggatagaaaaggtcgcggatgtaaaacgtataaagcgtacatatgtttatttatttgcttcgccacgaaagcagtacatttagaattaattagttctttgacatctgaagctttcatggcaggccttagaagatttgtttttagacgcggtaaacccgggcatctgtattcagataacggtacaagttttgtaggtgccaaaaatgaactaaaaattttgtatgatttcattagaaaatcagaggatgaaattgtcacctcttgcgtagctcagaatattatatggcatttcattcctcctagtactccanatttcgggggattatgggaaagtaatataaaaggggtaaaatatcatttatctcgtattattggtcaaacccttctaacttatgaagaattctgtacatttttaattcagatttgaggcactttgaattcacgtcctttatatgctctatcatctga

SEQ ID NO: 2284 - DNA, 841 bp, Diabrotica virgifera
ttttattcgatatgtttttattttattttactacgtggtttattttaagttattaatttaaatagttttattttattcggtttcatatatatttgttttgttaatttaatgtttaaatcactttattttccgtcctatcatgacatcgaaacacttctgcttaaaatggaacaaattcgaatccaacattttgagtgcctttgaaagtctccagaacacagaggatctcgcagatgttacactgacttgcgaagggattaatatcaaggctcacaagtttatcctgtcggcgtgtagcccctatttccggacaatatttaaagaaaatccctgccctcatccaatagtaatccttaaagatgtagctcatgcagatctgatggcaataatcaattttatgtaccatggggaggttatagtgtcagaggaacaatttgcttcttttttaaacacagctgtggtactgcaagtattgggtcttatagataatgaagagactcatcaaaagaaacatccatttcctgctaaaaagctcaagaacatatctgattgtcaagaatctccacagaagaagcctaaaatgactcttcccaaacctaaaaaagtaattgcagctagttctggattggaggaaccaacccaaattctcaatagcagaattcatcttcaccttcacaatttgaggttgttgaagttggtaacgttaagactgaagaaggcagcctcaatgaatatgatgttagtgaaaatgttgaggttgtagtcgaaaataaaaatgagcagggttcaatattaaaagcagcgctggaagtgcgtgacaaacccgagcagtattttggag

SEQ ID NO: 2285 - DNA, 977 bp, Diabrotica virgifera
  misc_feature (857)..(857): n is a, c, g, or t
  misc_feature (879)..(879): n is a, c, g, or t
accacccacgcgtccgcccacgcgtccgcttaagtctgttcttaatctacgtacaggttcttatttttttcgaagtcatgagatagtgaattggtggtatagtttattaagagtactacaaggttgttatttaaaaattaaaaaggaacatggactactatttaggatacatcttaacagtattattaaccatatttagaacattaaagaattatatgagaactgtgattttggcttggaagttgccaggacccacagctttacccatattgggcaacgttcttattttaaaaaatcacacagaactaatatatctgggcaaccatgcccccaacatgtatggtaaatttttcagggtttggtgttccattttacctgctatcttcatcactgaaccgagacacttaaagcagattctttcgacgaacaaaaacaatgagaagagtctcttctatagggcattccacaattttataggagaaggtctgataacaaacaacggatataagtggaaaaagaataggaagatgatacagccctatttccacatgaatattttggagaagtttgtagatctattcacagaatgctctagcagatttgtaagcaaacttgaaggggagcagacagtgaaaattaccccatttatcaacgactgcgtgctggatattcttcataacggagtattaggagtgccctttgatcaagattctccatacaggaaaggtcaactgcaggcgatagaacgatttgtgagaccatggctactttttgattcaatattcgatagaaccaattctgcaaattatgaaaagaaacaaaagcataatctccattcatatactgaagaagttctncataacagaagacaggaaatanagaaaggaaccaaagaaccaaaacatgtttcctagacatgttcatagaaatagctgacaacaattctcagtttaccgaagaggatattatttatgaaa

SEQ ID NO: 2286 - DNA, 964 bp, Diabrotica virgifera
  misc_feature (936)..(936): n is a, c, g, or t
ccaaaccaaaaatgaaaaatctatgaaaaagagtttatgaaaaatctaaattcaaattcagatagaaatggctgcattaagatatatttccaagaatttgtttaaacatatatttcgatcggaactaaaggcaaatacggaaatttgtttaatttatagcaggctcttaaattattcatctattgaatatgatatcaaacatgatccagctccaaaattctttaataaagatatacaattattgcttcgagaaattacaagagtcgatttaactaaagtaaatcagaagataaaactgggaggcaaaggattggaagatcccatttataagtttatgactgatgatgagctaaaagaagctattgaagaagctaaacagaagtcccacgagttgttacaaatacctcccgtcgttgcagttagaaaacctatgacacatgttttatcagaggatcctgctttacaaggtttggaagaatcaaaactagtttttacagatattacttttggacttaagaatattgagcgtataattgtagtaagggaaccagatggaacattacgagaagcagattgggagttgagaaatagaatgaatcaactgtattttcctcaaaaggagagacatattaaaccccctagaatgttttttggagaattacttaataatttattggaacactatgaatacaagtttattcttgatcgagcttgtgtgcagtttgaacctaatgatcctgaataccaaagagtagtctcagttacatatcaacatgtaaatgaccatgaaaagtttgatttattgagatctactagacattttggagccctcacattttttcttgtgtggaataaaaatatagataatttgttattagaacttatagagacttctcagatttgagaaagcaatatactcttaaaattgtacacaanaatacatgatattacacttgaacaggga

SEQ ID NO: 2287 - DNA, 935 bp, Diabrotica virgifera
  misc_feature (831)..(832): n is a, c, g, or t
  misc_feature (841)..(841): n is a, c, g, or t
  misc_feature (848)..(848): n is a, c, g, or t
  misc_feature (877)..(877): n is a, c, g, or t
  misc_feature (898)..(898): n is a, c, g, or t
acgtcgtacgtaatttgcaggggttgattactgatctttatttgataatttgtttatttattttgcaacataagcaaaatgcgttcgcctcaaacctataacatgtcagaaggatcactccagacaatcatgtctggaggtgaatttccaaatcccattatgcaagttttgggtagcaaaaagataaacgccggattgggtgataaagaaagaattcgtattttactgtcagatggaaaatacactatttcttttgccatgctaacagcccaaattaatgatcgacttggtccaaatggtgtggaaacttttagcattatacaaatagatagatatgttacgagtatcatcaacaattctgggaaaggagaagcacgagtacttttaatcctcgatatgcatgttgttgtccctggaactgaagttacagaaaaagtaggctctcccattcccctaccaactgatgctgacgcagctaaaggctctactgccgctccagctacaaacaattccattaagaatgtaactgttgctaaaccaaacatcagtaatggcaatggcacaactgcaatgaatgccagtactaatgatgatatagccacacatatgatccatcctatttcaagtctcacaccttaccaaaacagatggactatcaaagcgagaattactaataaacctccaataagaacgtggtcaaattctagaggggaaggaaaattatttagttttgatctggtggatgaaagtggcgaaatccgttgcacagcttttaaagaaatggttgataaattctatgattacctgcaggtggataaagtatattacatnncacaatgtncacttanacaagccaaacaacagtacagcactctanaacatgagtatgaaatgactngtacgcatgatactgtcattaaagaatgccttgatgc

SEQ ID NO: 2288 - DNA, 1137 bp, Diabrotica virgifera
  misc_feature (236)..(236): n is a, c, g, or t
attaatttttatacgcatacaatacctacacttttgtggaattagttaatatgtttacttagttaatattaatcgatatctgtttatcttatctttaaaaatgtataaataactggtaggtctacacaagaatataataatatattgataaaatcaaaatcgcacctgccggaaacatgaaaaccgcttacagtatccaaactatattccaagatttgttaaaaacaattcaacanaacaacgaagtagacaacatctcgaaaatattctccaaaataactacgaaccatgaaagggtcgacttcgttattgaactgttaaaaaaatatcaaatatcgtgcgagtttgtgaaagataaaaaatgtgataaagtgtccgtaaacttgagggaacaaggaaatcagaagtttaagggaaagctattacaagaagcgctcgaattatatacgcaaagtttagcaaatgctgaagaaaactcggaaaatttttcaaaagcgttggctaataggtctgctgtattatttgaattggaactttatgaagagtgtttgaaggacatagaaatcccttgagaataactaccccaaagatctacaaccaaaattaataaaacgaaaaaccaacgccttatctcaagtacaatcggagaaagacagaaaaccgtactttaaaccagctccagacctaccaatagcctcaaagttatcatcgatagaatgttcaacaaatttactagaaatccaaagtacaccaacacaaggaagacatgtcgtagccaaagaaaacatcgaaataggtgatattttagcagtagaaaaaccattctgtcacattttagcatcggagttttacagccattgccacgaatgcctaaaactcagctacaatttagtaccatgtccgaattgtacgcaagtcttatattgcagctctgagtgtcaaaaagatgcccaaaaatatcacaaatacgaatgcaatattcttaagacattacgaagcttgaagctggataaaatgaagctactgcctcttaaattatctatgttggcgagggattgctatagtgaaatagcaggtataacgaattggagagtgttgacaaaaatacccatatagatctgacaggtacaaagaaat

SEQ ID NO: 2289 - DNA, 940 bp, Diabrotica virgifera
gaagtggccatcagcgaagatgagaccaaggtcaagttcaacgttggttgcattgttgtttttggttagtgttaaggccgaattctcgccttttgatattgtggacgaatatgtcaagcagttccgatcgggtattggaaatttgtgcaagtggtctgataactatagttatcagcagagaaattatgataagtcggaattcaatgcgaccttggcattaggaggtgctgaagagtacgacttcatcatagtaggtggaggaactgctggtttgacgcttgcccacagactatcggaagaaccaagatggcgaacactagttctggaagccgggggtttagaaactaccatcactgaagtaccggctatgcaacctcaactgcaaacaacagcttacacttggggatacaaaacatgcgtccagaagcatgcttgtttaggatcggttggcaacatgtgttctgttgtaaaaggaaaagctgtaggaggagacacagcgatcaacgacatgttgtatacgaggggacatccacgagactacgatctttgggcagatactgggatgaagggatggtgttgggacaatgttctgccatatttcaaaaacatggaagacgcttgtgtggaagatatggatagaaagttccgtcactatggtggtccaattcatctggaaaatctctatcccagtgatccaatcttagccgaacatttcctgaaagccggtttagaaagcggattggaacgtatcgactacaacggcaaagagcaccttggtttgggattacctcaggtgattaccaagcatggcaaacgtcacagtgtcgccaggctacctcaagcctattaaagaaagaaaaaatttggagctttccccctacaggccaggtactgaagttctcgtcagtccgattaccaaagagggccatggggttactta

SEQ ID NO: 2290 - DNA, 469 bp, Diabrotica virgifera
tacaaccctctagtttcgatacatattgctcgtagcagttttctcgtcagcttttgctgtcgaatttgaaattgtcaataaagaaattggtgctgtatgggtaggaatacaaggaaacgatggcaaggaagcgttagcaaatggtgggttcattcttgaagcaggagctagtagatcagtgcaagcgccaaaagattgggctggtcgattttgggcaagaacatggtgtgacataaatactcaacattgtgacacaggtgattgtggaaatagaattgaatgtggaggcaatggaggtgcaccaccagcatccttggctgaaatcactctaaagggatggggaggcctagactactacgacatatccctagtagatggctttaatatagccgttagctttgaacccgtaggtggaaacggtgacggaagtcagtacagctgtaaaaaatgtgcatgcggacgtaatttg

SEQ ID NO: 2291 - DNA, 1147 bp, Diabrotica virgifera
cggacgcgtgggttcaagaaaaactcgatttcgaagccaaagtgcaacgcgcagctaagagaaagcgctggttaagagccaacgaaactttgttacgcaccttattaagttactgttcgcttcatggtgctactggtggcttggcatccgtacgaatggaattaatgttattgctacaagaactacaacaagaaaaaactcatcaacaacttcttagtccacttccattccctacaagtctgccactcttagctgccagtgttgctagtagtaaaactgttgttgctgatcccatcagatatctgcagtgtttgacacatgacatgttacaaacattgatggagttacaacagccacatactggacagaatcagttactagtcataagagatctagcaatagcattatctgcttgcatttatcaatcactgtgtgattcagataccttcaaaaattctttgcaagaagctcaggagatcggcgccacattcttagtaggtcgaaagagacggatatctgttaacgaaggccattctataataaccattccatctaagtggccgggtcttacgagtttaagatctctcctggcgagggaaaaagatgacgacacccccaggctaactgttatcctctgtgaatcttttacagctgtgtatctgtccttagtattgtatgggctggtcacatatgattgtattattttgttccacgtaaatgcgcacatatttgattcagacgtgtggggaaaattatttggaggaggtatcaaaaagcttctacgcacagctagtctagccggaaatcatcctcatcaccctcagtatctttcccaacaaagtgtaaaaactccttctaccgatgaacctaatggacccgccacatggttgagtaaacaaagagtcaaactcaataccaagcttttgggacaacaaccatctaaaatgaaggaggataaaccaacttatagggagcaatttgttccccctgaaatgagcattttggcgtatttattacaaaagcctgcaaccattgattacattgaggaagtagaaagcgatatagaagaagaagacgaagacgaagatgtatttgatgctcctgtaactaaaaccattaaaacagttaaacacgagcattctgatcc

SEQ ID NO: 2292 - DNA, 1360 bp, Diabrotica virgifera
ggagtgtaaacggattttacactgtttaatgttctcttcgtgaaataattagtccgttctaaatgttgtattagtgaagtgttttaatgaaatcagctttcgatttctaaattggattagtcccagctagcaaaatggcttctggagacacaatcgaaactattcaaactatggatacttttcaaatgacaaatatgaatagctccaaggatattccaggatttcgtgaatcatcagatacggaagaaattgatgataaagacgataactcggtggcgttcaaaagcgtacaagacattaaccaaaaaaactcttccaagtgataataaacctaaaaatgaaagagaaagaaaaatcggacatcggcgggttggcgtgggtggtgagatcacgtacaagaaaattcagtcaacgcagattatgggttcgattcaattgggcattcagcatgctgtgggcggattggcatcgaaacctgaaagagacctcttgatgcaagattttatgacggtggaaacgacaaattttcctagcgaaggatcaaatcacacgccagctcatcattattcggagtttaagttcaaaaattacgcacccatagctttcaggtacttccgagatctatttggaatccaacccgatgactttttgatgtcaatgtgtaacacgagattaagagaattatcgaatcccggtgctagcggttccatcttttatgtcactttcgacgatgaatttatcattaagacggttcaacataaagaaggagagtttttacaaaaattgttagcaggatattatatgaatctcaatcagaaccctaggacgttattgccgaagttcttcggactttattgttatcaatgtaatagtaaaaatgtaagactggtcgtcatgaataatttattacctagtagcataactatgcaccaaaagtatgatcttaagggtagtacctacaaaagaaaggcttcaaaggcagaacgagccaaaagaaatccgacctataaagatctggacttcatggagcatcatcctgaaggtatatttatggaggcaagatacttataatgttttaacaaaaacaattcctaaaaaaccggaaaggattaaaaagttttaaaataatggattttgatttttttttaacaaaaacttaatttgggttccgggggcaaaaaaaaaaaaaaggaaaaaaaaaattccaaaaaaaaaaaaaatatggggttgaaaccctggggggggccgatagggggaaatcaaaattcccgcgctccaattttttctcaaaaaaaaaggggagaaaaaaaaaaaaaaaaaaaaaaaaaaaaaaagaggggggggagtgggtgcggggggg

SEQ ID NO: 2293 - DNA, 923 bp, Diabrotica virgifera
ctttacgcgtccgggcccaaggtttaactgggtttagcacaagtttataatttttagatataatttgtaaaagtgtagcaaaagtggcacacaccagaatcagaacagaaaaacaaagatcaggcattgtaattaaggacaagcatattggagaaacggttttaaaggatatcacagtaatcaacttacaataacatttgagaaaatgaagataaaaatccttccagccctttcagataactatatgtatttgatttcatgtgaaaatacaaaagaagccgcaataatagatccagtagaacctgatactgtgttggaggcagttaaagtagaaggagtcaatcttacaaagattttgactacacatcatcattgggaccatgctggtggtaatgaacaacttattaataaagcttcaggaaagttgcaagttttgggaggagatcaaagaattggtggtttgactcaagaagtaaaacaaggagacaagtttcaaataggagatatcgcagtggaatgcttatttacaccatgccacaccagtggacacatatgttattatttaactgcacctggacaagatcctgctgtttttacaggggatacgttattcatagctggttgtggtagattttttgaaggaacagctgaacagatgtattctgcacttgttgaaaaactgggaaagttacccgataacacacgggtcttctgcggtcatgaatacacattacaaaatctaaaatttgccaaatctgtcgaccaaaacaaccaagatgtactcaagaaaatagaatgggctgaagggcagaggaaaaaagggctaccaacggtgccatctacaattggagaagaaaagacctacaatccgtttatgagggtgactacaagcgtgatccaaaatcatgcgggctgtacatcac

SEQ ID NO: 2294 - DNA, 1261 bp, Diabrotica virgifera
gttgttcataaacaaccgtaatatagttttaatgatgttttactaacacttgagaatgtaggtgataagtagtgagaatggttggcttactctataagattaaaaaattatatttaaaatgtaagtgggtaacgcgtaattgtttgtttttttttatctttggttttactaaaataaagtacattatctcgtttaataacttatgtcagtcagttacttatgtcggtcagttatacatcccttctcggttctataatttatgcaagcataattaaatatatctcgcgtggtctgcatactgtatgtctgacttcgttactgatttcggtccgatatcctcagcaaatggatagccatggagcttagcatcattgtggtttctaccgcaacgttttggctttaccgtattcctcctcagttggtcctaaaactagttggtctcaaaaaaaaaaaaaaaaaaaaaaaaaaaaaaaaaaaaggaaacttttgtaagttttcctttttttttgcctgagatgagggagagtgtagcagtcacgttactaattaaattaattcaagtaaaattggatgaataatacccctccgtgacgcccatgatcgaattagaacgacttgttaccagaagagggctttcgttcccacgttgtcgatgtgatcgattttcgatacggacagtaggtcaggtagctcgccattgatacgtagtgatttttgataattgtggacgaatctgggaaaaatatggcatagaagttaaatattctacataaacatcattgaacaaccaagaaaagttaccagtaaatctctagagggtatttaggaagccgattgatataaaagaatgtaaaaatataccacgtggaatttgccgtgagagaggtagtttcactacgtatcatatcccaggtaatataattaaattatttattcttataacatcgcttttggaatacatataggtacatcatatttttttttgtttgtcaccaaacatattaaaatcgtagtttcatgtccttctatcattttttgtattcaatagccggtagtttttgtatcattttttttctaagtacaataaaaagttctagctttgggaaacggtatatacgcgcaagcgcaaaaatatcttgaagtgacactgactaaattgacaagtttgacaaggcataacctaatgtttattctaatatttattagtacttttacctaattagcactattacctaatgtttttgacagaaatgttttgttt

SEQ ID NO: 2295 - DNA, 937 bp, Diabrotica virgifera
  misc_feature (817)..(817): n is a, c, g, or t
  misc_feature (841)..(841): n is a, c, g, or t
  misc_feature (850)..(850): n is a, c, g, or t
cggagacgagtcatttgcggacatgtgtttgtcgagcaaaccggcattattttttcatgtagaattgccctttaaagtttttcatacttatttactaacaccctgtatgtgtcgacaacacatgtacaagtatgcatgcacaatgcgccattttaaacttgaacatcagtagttgaagcatccagtatcgtatgtctacacgaatggtcaaaactcaactgtattaaactttgtacaagtctttcacacacacactctcaattacacttgcgtaaaaaattaacaagtaaaaattacaaaatgttcacaagtctcttgccacttgtacagttaacgtacttgtgctagcattacccaacacccgttccagtatacttgtgcaataaacttgtgcatgggaacacgttgggaagaaaaatgtgtaaggttaggtcgaacacgttgaccattcgcaaaattaaattccaacagagggcgctcaaaatttcaaagatggacgacaactctaggaaaacaattcattttgtcatttgaattcacagttctaaaacgttacattaaaatcatttacaggagtgttttgccaaagtaaccactaagttttgcaactaagacatcttataagttaaagacgactcaaaattatgtttaaactgtatgcattcattaaaatttgatgctaactactgatttgtttttacctttttttcataaaaaaatctggcccccgataatcacacagcgttctaaaaattattaatctatcttaggatttctaattttgtttttaatttaattaataggtgcactacagttnattttacaccaacagataacaatntttaattanataaaaactggaaacttggaaactaagtaggtgaatttattttataataattgtgttctggaacattctatgtacagaatatatact

SEQ ID NO: 2296 - DNA, 420 bp, Diabrotica virgifera
gcatttcagtatttctttaatttaattttaataaaattaattcacattgtattcatttaaatccttagaagcaaaaatccaataatggccctatcaccatggttgaagtccccttttacagacttaacgggatctctagtaaatcaccagtggtacggagaatgtgctgatatggaattaaaagttttagactgtctagatgcctatggattggacaggggcttaaaaaaatgtgatgatctgattgaagacttcagagagtgtgctttaaaaacaaaacagttcaaaagaatgtacgccatgcgaaacgaaaggcaccgtcaacattttgctggtgagagaacatcagagaataaatatgccaaaggccctgcctatgacagttactaaataattaattattgtagatgttttagttgt

SEQ ID NO: 2297 - DNA, 1073 bp, Diabrotica virgifera
cttgtccggcgagcggccgctcgcgatctagaactagtcccgtcgcgtgggcggacgcgtgggttcggttgtgcggcgtgcggcaagttttagaacattcccaattctcaccggtgctggagtgaataggtgtttagtagttttcttttttgctgttgtcgaatttaatcaaaaatgccaagttacaaacttacttactttaacttcaccggaagagcagaaccagtcagagtactcttacgttatggtggaattccttttgaagatgttcgcgttgagcatgctgattggccaagcgtaaaaccaaccacaccatatggacaagtaccagttttggaagtcgatggaaagaaattcacacaaggaatacccttggcaagatacgtagccaatattgttggcttagtaggaaaatccaacgaagaaaatttggaaatagaaattgcagttaatattttatcagagattctaaaaactgcctatgaatcccatttcgaccctgatgaagaacaaaagaaaaaacacttgaaaaccctgcatgaattgcttgctaaatatttaccagttcttgatgaagctgctaaaaaaaatggaggccacattggctctaacaagcttaattggggagatgtctactttgtaacggcttatgaagatataagaaacatcctgggaaataaagacatcgtggaaaattactccgggttacagaacgtgaagaagaacgtactctcagacaaaaatattaaagaatatatccagagtcgaccaaaaataccaatcttcgtatacgatctgagaagcgaagcgtaatttttttaaggaaatgcagaatgaaatatatatttttgtcacgcacataaaacatatacgtattctcttaagtgtattgctttcactaaactatatgtaaaagtaccagatttgtattactattttattttttacttaataaaaaaaaaacttttctttttcatgtttcccaaaaaaaaaaaaaaagggggggcccgtcctctaaggatcccaagcttttctacaccggggggaatggaccgcccaaatatctttttttt

SEQ ID NO: 2298 - DNA, 1107 bp, Diabrotica virgifera
  misc_feature (21)..(21): n is a, c, g, or t
  misc_feature (34)..(34): n is a, c, g, or t
  misc_feature (113)..(113): n is a, c, g, or t
tttttgatgtttcaatttgancatcaaggtttancatcatatttatttcatgggtgatcataataaagttactacaatgttaattttgagtgagtacatctttccaatcattncagtcatttctggtcattcgtttctataactcctgcacctttcatacctatactttgctctacttttgaaatgtataataattaccagctgcttacatctagtatattcttaaaaattaattgattttattcctgtcaacatattttttaaattcttgctcttttttatatttattttttttttttttagtgccactcacagtcgtatctgctttttggtattggttttatctagttaggaaaaatattcgaagtgcattgcttttttaagctctctatttagtatagtataaagtaactttgattaattcgtaacagttcaaaaagcgtaaatctagtagatattagacaaagaaaaagaattttacaccatagttctatttaaaacagtttgcttgctttagtatttatgaaatacagtagaacgtcaataatccggattaattgggaccggtccccatcgggattatcaaattatccagattatcgaaattacctcaaaaaaaggccagtatacagattaaagtacaacaaacattttaaaattttatgttttctcttgtacagtaaagtgtctggaggtaaaattaatcaaaacatttttttttatgtttaaacactgtattgtaattaatttataatagcaccatgtgtacagtaaaagcatcagacactatttgggcttttaaaaaaacgtgtaaaatatttttgaactgcggcaaaggttcgtttttcgcagcgaagttcttaatttattttaaaagaatcagatatttttgctagatacaaatccggattattgacggtccagatttttgacgtccggattatcgacattccactgtaatagtgaacttgcacatttttttattacataataatggtcagggttgataaaaatgagaatttcccaaaatccacggtttcaaaaatcttaataacctaaaaggtcgagtttatagtcttctggaacttaaaaaagctcaaacggccc

SEQ ID NO: 2299 - DNA, 413 bp, Diabrotica virgifera
aaccaggcagcaccgtcgctatgtttgtaacgcttgtggtgaaactttcgtgaaaaataaagaaagcaagttgtcaaattgagaaagtagttttgatatcaaaggacacaaaacgtaatggatgaaaaatccgaacatggcgatcaaaccgcggagatacacgatccagtagtcgggtccttggacgaaggaatggatatacggatggacccggaagccgacgtttcggcagtggattcagcggaaaacgcgggaactagccaagacacagaaacaccagaagtggccgaaccaaacattgagtctgctgttgggaacgatgataatactctaatttctgagttaaatgatgttagtctgtctgctgcagcaacgagtaatgagacagattcctttttagactcatttacatc

SEQ ID NO: 2300 - DNA, 1601 bp, Diabrotica virgifera
aaattatatattttattcaaaattctaataaaatatttaatataaatattatatacttatataatataaaaaattaatattaaacagttatatttagttaaataatatataaagaaaaaacaatcgcgttactaaagaaaataaaaataaatagtatgggctcctcgtaaaaatatacagcaagaaatatttagacatttaaaatgttgttgacataccatatttgttgaaattgtcaaaaacactaagtggcagtaaaggaattcaactaaaagttatattaaaacttaagtaataaataaagctttataaaacaagttttttctacgagcgcgcaaaaatgtctactttcgcgcacgcgttttagtttagaaagatttacttttccgcacgcgttttacttttccgcacgcgtgttaacttagatatgttaatatggccttaaagtaattataatacatgcaataaactaatatttagatattatttactaattcatttcaaatatatcttattgtgttcctgttttaatgaaagtaacgcgataattcgatgaaataaaataattttgacataatattcgaaagtcgaatcagtagacaataacagtggttttgaatcgtcggcacggaaaccaagatcgtcgtcatgctagccaattatgctgaaagtttggatatgacaaccttgtctaagaattaatttgtgtatgtattttcatattaattaaattaattgattaagatttggtcattttttaaagactcgtagaaaaaatattgttcctaacgcttgcagaaagtctcttttccgcactcgactgcttgccgaactcccgcttcgcgtcgttcggcaaactgcagtcgcgtgcggaaaagaatgactttctgcacttgttaagaaataactattataatattctttctatttattattatctatgggacctatattaatgatagatagtttagtgtttttttactttataaatttgcatttactatggagaacaatttaaattttacaaatggagaatttttttattaaaatctaaatgtgattttgagaatattagtgtaaaatgtgattgattagataataaataaaaaaatcctagctagtacttagaaaacatttcaaatgctattcaaaaccatgtaacttattaaagtataacctaaaaaaaatattttctgtacttttagacaaaattatcggatttttttttaaattctcagcataaaaaattactcaaaaaggtaaattttaagtaggtacactttgtactaattcgtctaaattttatgctgcttttttttaattgcgtgttgtatttaaacatttccgaatgttttatcatgaattttcttattagccttatttgataaaaacacaccaaagtatgcgaatgattaaaagctgataggtacgtaatcttctgataacaaaactcatcagcataacttataaactttatgaaatgagttttaagttacatggtttttgctagtatgccagtgacaagattatttatgaatacattgatttaaaataaaagtattattaaaaatgttctaatatattaaattggtttatttatt

SEQ ID NO: 2301 - DNA, 456 bp, Diabrotica virgifera
caagattctggactgatgaacgttgcctaactttaaacaagattctggactgatgaacgttgcctattttaaatttgacgtggacgacagtacaggtgaattggatacaactcgacctgtgccttttcggttgactcctaatattattgaatatttatctacgattggagtgactggtcctcttacaaccacaatgatagccacttcaagatgtttcatatatcccaattttaaggtattgtcaattttgaaacctattatcagagatgaaatgatgttggctagagccaaaaaagccgaagacttaaataaccccgaaaaaatgaatgacgcctctgagcaaatcataaatatggtaaataaggcagtcacttctatttcaaacagacttaccaatttagcacaattcgaagggactgatagtaaggttgctacattggatgctgctgcaaacag

SEQ ID NO: 2302 - DNA, 885 bp, Diabrotica virgifera
  misc_feature (822)..(822): n is a, c, g, or t
  misc_feature (834)..(834): n is a, c, g, or t
  misc_feature (839)..(839): n is a, c, g, or t
acccggggcccccaattccccgggtccgccccccccccgccccccccgcgtccgaagaataagaagttcttcattatttttttgttttttataataactctggtgaaatcgcatagggatatagctgaaactgatgtagcacattcggatgtagctgtcttacaagattacaataaatggacaacagctatacgtagtttactagataataaaacactctccagcgaatgttcaaaacagtttgacgaactttttaagaatggccaagctgatctgtggaactttttcgacgccacttccaagtttccttggagcggtcttgccgtcagctcatatgctgactttggaaattatcctcaatgcatgcaaataaatcatatttactccggaggaagaataaagggaaaatactgtgtatttggattagcgataccatcctcgaaggcagatttaagcaatattaatgtggatgatttcttcaaattatcggtatgcatgccagacgcttgttctgcagatgatttcaataaaataattattttacctttatttaacgatcaagaatgtcatacgcaagatgatttagatgaatatactcctggagacaaagctatactcgtagtgctgtcaatttttgcagttattctagccgcatcaactagctacgatgtatatttggtgaaaactggtaaaaagagttcccatcctttatttttggccttctccgtttatacaaattgccgtaaaataataacaacaaccaaaaaaaatagggagcagattcaaatttttaatggaataaaatctattagtatagcttgnatcatcgctggncatgnatttaacggttggttagttaacgtagctaactacgattacgttaaa

SEQ ID NO: 2303 - DNA, 2881 bp, Diabrotica virgifera
cccacgagtccgcacacgcgtccgggttaattaggattaggaggaggattaggtggaggaggaggtggtggtgctactattactaccataaacagagcagtacctgttcctgtacctcaaccttatccagttactgtcaatagaccagttccagttccagtaccacaacctgtcgaagttccagtccccagaccagttcaagttccagttccagttgctcaacctgttgaagttcccagaccgtaccctgttgtagtaaatcgtccagtacctgtagccgttccgactccagtacgtgtaccagttccacaacccgttgctgttccagtgccacaaccttatccagttacagtaccacaacctgttccagttagggtaccccaaactattgtagtaccagttgctcaacccattgttgttggaggcggtggtggtggacttggaggtggacttggaagtggattaggaggtggaacaaatgaagtatttgggtatgttgttgataaaaacagagctatctgtgtacaacctcaactttatgccgaaggatgggtgaatcttcaaattgctgttaattccgaagcattcaagtggaaggggaagtattatgtagaatcacctgctagtgcgactcaaaaaatcttctttaaggacatgaaattacacgaaaaatctccgagcgaattaaaaatcacttgggagaagcagaatttgaccacaaacgacaacgctaacatccgaatttctctctggggttacagagaaacgactatgaaaccagtgtttgtttatatcaccgatatcgctgataatgttcaaaacattggagaacacacgattgttccttctcagtttagaactagagtcaatcaatatctgactgatattaagtttggattcctccaaattaatttaactgagtctatcacagttaatacatatactacaagccagagcagcatagaattaacaccggtaatatggagccgacccattccactcggttggtacttccagttccaatgggaaaaccagtacggtaaaaattggcccaaatatctatgtgacgattggctgagaacggacagatatctaaaaaacttcgcccacgaacttgctcaatgtccctgcaccgtcgaacaggctttagctgacaagggcaggtttatgccagacttcgattgcgacaaagattcgaacccgatttgttactataacaaccaagcacttcattgtgtgaaaactggatctcccactttagaaggctccgaacaacaatgttgctatgataaaaacggctttttgatgctctcttacgatcagcaatgggggttctagtccgaggcgttgccacaacttgggtaaaatgccttacaatgaagcgacaaaagtgcctactctctcacaatggtttaatgacatggtacccaaatatttgtgttgtctttggcaagacgagcaagctgtgggatgtgaaacactgagatttgaacggagacctacacaggattgtgtagcttaccaagcaccaggtgtagcaggagtctacggtgatccacactttgttactttcgacgatgtagaatatacgtttaatggaaagggagaattcgcattggtgaaatcagttacgcaaacggacaatctggaaatccaaggaagatttgagcaaatggaccctaacacttatggtgaggttagagctactcagctgacttctgtagtagctaaaggtaataacacaatagcaattgaagtcagaaggagacctctggattctagatggagatataggttggatgttatagcagataatagaagactttattttgatagaccctcactaaaattccagcacttccaaggtgttactatttacactccaagctacatccttaatcaatcagaagtcatcattatgtttgacaatggagctggaatggaggttgtcgacaatcaaggattcatgagtgcaagagtatttttgccttggtcgtttataaataaaaccataggcctttttggaaattggagttttaacaaagaagatgacttcacacttccagatggttctagagcagcaatagtgaataacataaatgacatggaaagggtttacaatgattttggttccaaatggatgttggaggatgtgttagatcctcaaaagggtagagcattgttccacagggaattcggaagaacttcagcgacttacaacaacaaaacgttcaagcctcaattcctaatgaatccggaagatttcctaccaaccaacagatctacagatcttaagcgaatatccgaaatatgtcctctaaagttgtacgaatgttactacgattacgctatgacggttgacagggatttggcgcattacaccaagaattataaagccacgatctatcaatataaagaaacgacaaggaggaaagttgtgtcttgcggagtactagaaacaccgagattcggacgaaagagtactttcctgttcgtgcccggtacgaaggttacctatgaatgcatccaagagttcgtgttggtaggtgatcagcggagagagtgtcaagcggatggaacatggaatattcctgaatacggatacacatattgcttacgtcaagaagaatattcttcacgtcaagctgccatcacttcaggtataatcctcgcaattatcataccattggttcttctattaggttacgttggctacaaaatatacgaaagactaacaagtaacaatcaaaactatgactacgacaccgtacaaaagactcaaaatctccaacaattcagtcgaaactttaagtccataccagagaaggaagacgaggacgaaaaagtatcctcaaagcgacactgattcactaagcagaaa

SEQ ID NO: 2304 - DNA, 609 bp, Diabrotica virgifera
atcagcctacttctaggaggttagggaaatcattaatctcagcaaaatgaaaattttgattctcctttcttgcactttcgcgatctctcaagcaggatttgcttcccactagaactattatccccagccccaggcagttataggacacgatggtcggcctgacgcgacgtatgaagttcaagcagccaaagctgcccattttgcagctcatgcagcagctaaataccagagtgctccttgggctcaatctggatacgcttctcacaacgctcttcccgcagatacacccgaagtagctgctgccaagttacaacactaccacgactacgctgtcgctgctcaaagaaatagcgttcatggttatgctccagctgtagctattggacatggccaaccagtagatacacctgaagttcaatacgctaaagctgcccattttgctgcccatgctgaagctgctgcccgttcctacggacacggacactacagaagacgccgtggaatctacgattttcacatccccgttattgaccacaatggtgttccagtagaaactcctgaagtacaagctgccaaagcccaccactttgctgaatattccaaagtatt

SEQ ID NO: 2305 - DNA, 1679 bp, Diabrotica virgifera
cccgggcccgtgggtacgaggagctggtaaagtaatgaaggtcaaccaggacaaaggatgacgtttgtatttcagtatcactgtttttgatttattttgttcaacaattttgaaaattcttagacgttatgtctatttgtactaaaatagcttgctgagattttgtgaattattgagaaaatatgaattatttaacctggttacacctggccagtgtaaacgggtttatttctgatttatatatgaagattttttaaaagtatttgtaataaataatatatatgagcaaaaacagcaagtttagcacacatttaagttgttttgtcgatattgggatccaaaaatttcaattaatttcagagtattgcaccatatgacgttaacatcgtaatccaatatggcgactagggtgcggttcgccatcttttcgagattcgagacgtagtaatagatcgatcgataggtacctattttattctgaggaggtttccaataagcatatttttacccaaaaactggtatgattcaaaataataaaatacttagaaggaagcttcggcttccattaggacctaaagccaatttagttggcatcttttagactttttgtagatacctattctattggttggcaagatggtcgtttattgttcagaagacttaagccccctttaagcgatctcttatagtacgggcgctactggcaaacttaggatggagttaaaaaatttacttattggttatctacccgagttttataaatttgtactaattttcccacgcgtccgggactgtaaacaacaacatattcttacactttttttttgtaaattagcgttctacattttaaaaactgtaacgaaatctattttgaaaacctactgtactagttattttaccaatttttgctgtcattttcttagacccttctactaaaatgataggacttttatactagttggcatttgtactgaaaaatcctcaataaatatattacaataatcattagtcttgtcggttattctttgaagttgaaatactacctactgctttataaaagcgagatattagtcagaatgtataggaaatcacaatattgtgggcttgaataaagctacctcaaagtaatagtttcaaactatcgcaaaatatttttctttatttgtgaccaaagtatgtaaatattaaatatgactcatattaacttatacaacaaaattggccgactacaaatatccatatgtagctttccctgtatattgaaacagtgtagcagttggtaaacagccaagaataatatatgttgctacatttttaattgcaatatactgcttttttggtatatttgaccagtaaaaatataaagttagggcaccaaatcgggaagtgtcttgtaacaacttctaaaggctacaatatgcttctgttagtaatacatacagccagtacaagttgtaaattttcgtggtagtctacaacgcaaagttgtatgcttgtccagttaattcaaaatttaactaattacaaaatttttatctaattttcaaaatttattaaatatggaaatatatcaacagtcacatattgtgaatatattttacattctgaatacatattactacatattatcaaaactgacttcgatatcacctgtaggagatagatttaaaaaaatcgag

SEQ ID NO: 2306 - DNA, 1187 bp, Diabrotica virgifera
  misc_feature (1069)..(1069): n is a, c, g, or t
  misc_feature (1086)..(1086): n is a, c, g, or t
  misc_feature (1143)..(1143): n is a, c, g, or t
  misc_feature (1163)..(1163): n is a, c, g, or t
atgactgattgttcaaacacagcatctggtggtgtactctatcaaattgttgatggagaagaacaccctatagcctacaccagcaggaaattaaataaagcccagaaaaattatacgacaactgaaaaagagttgttagccataattacgggtattgagcatttcagatattttcttgaaggtcgttcgtttacggtcataactgaccatagtagtttggtgtggctacagagtatgaagaacccatctcctcgtttggctaggtggattttaaaattggcacaatatgattataaaatcgttcatcgcaaagctgcaggtgtagtagtcgctgatgcactctctagaacttttgatattaatttgttagacttatctactttacaaccagatgattggtatcgaaaaatgttgtatgatgttcagaatgttccaggtaaatttcctgattttaaagttgagcacggtgttttatataagcatgttttaagttctatggatgccctcacgggaatgtcggagtggaagatagtcgttccaaccccgaacagagcagaggttttggccacttttcatgaccatcctactgcagctcattttggcttctacaaaactttccgtcgtatatctgaactttattactggccgaagatgcgtcaatctattcgtagctatatagctcgatgcaaaatttgtgctacgtgtaagccgacaaatcttcctcaaccaggtttaatgggtagttatcgacgaatcgattttccattccaacttatatctttagatcttattggtccttatcctaggtcgtatcaaggttctcagtatgccttagtagttgtcgattattttacaaaatttcctttggttcataccatgtctaaggcgactacttcagcgattattaagtatcttgagaatgaagttttcttaatttatggtgttccacagattgtgtcttgcgataatggaccccagttcacagctaaagcttttcgcgatctcttgtctaaatataatgtacaaaagatctggtacaatgcaaattatcacccacaagttaatcacnactgaaagagttaacanatcaatcgtgactggcttaagatcatattcatttcctgatcagagagcttgtgatanccatatccactctatagtancagctatcaggacttcttctcacg

SEQ ID NO: 2307 - DNA, 1080 bp, Diabrotica virgifera
ataagttgtttgtcctttacacgcataagcaaacttaataagtatttacaaaaccgattgacaaccaacgattcaaaccattatcgttggtattatatattattggttatacatatattattatcgttggttaaaatcgtcaagatgaagttgctttttgttttgtcttgtgttttgtttgttcaaagtgcaaagaaattgccttcttttgtcgaagtatgtcctcgagataataaggaggcatcagaatgtctagcacgaaacgtgaagaatctaacaccaatgcttgggaagggaataccggaactttttatacctccgttagcaccacttgtcttacagtcagctgaaatagcaactagtccaagttttacatgtagtttaaagaacgctaaagtataccacttggattccatagtaatgactgatgtcttcataaattttgacacaaaatcgtggggtgcggacgtattctttccggtgatagaagttgaaagtgattacaagatgaacggaaaaattctagtacttgaactaaacagcgaaggaaagagtcgaggaaatatgactaacatcaaaacgaatgtacttgttttctttgacgtagtgacaaggaatggtaaagaacatcttcacattacagatacaaagataaaaatggacatagaaaaatgcgcttttgaattcgatgatctatttaagggcaacgaagaccttactcaacgcgccaatcaaattttaaatcaaaattacaaagtgcttttggaggaattttcacccgtatttgaaaaaataatagccactcttaccgagaatgtcgttgaaagtatttacaaaaaatatccttttgatattttatatccaaaaaagaattaacccgaatcagttatgaggagaaggagaacactaacaaaattactgctatacgggttaactaacaaaatattgtattcattttttaaaaaataaatattttaaaactggacaacatgaaaaaatcaaagtgaaaaaagatacaaattcaccaccaacgaagaaaagaaaaaaaaaaagagacgacaaaaaaaaaaatgggggggg

SEQ ID NO: 2308 - DNA, 904 bp, Diabrotica virgifera
acgtaatatatccgagatattttaattttctggtttttattgtattgaaacttccgtttcaattcatctttctcaggagcctctttgtttgtgacgtgttctgttcatgatattttcagaattcttctatacacccacgactcgaatgattccagttttttcattgatgtcgcattcagggccgtagctttcattccataaaactaagttgagacaacgtagcaactagccaaccttactattagctctgcatagctcacaataaacattgtgtcatccaacctgttctctttaaaagtttaatggctcaggccagtcgaatcagtttcacggtaactgtcacctatcagatagtggtacgctgcaacagtttgaactaatatatctggaacagtttgtataaaataatagtactaatcgtaaatagtaaaaataaatggtgcatttgtaaaaattagatccggaggaaatgacttaagaagtcccatatttatccgtatttaatttttaagtacgttgtagactataccactacttaaacacttttttggtaaaatagtagtaaaaagagggttttgtacataataaaaatattttattatacaattaaaagttttatataggatgtaccccaaaataagttacttatatacagggtatctgtgtaaagtttatatatctatatactttgttatgaaacagtttagggaaacacttaaactctaaatctggtgatagatattttaaccagtcagaagagtacgtagattatttatgaatcggtcagatacaaaatattttgttaaggaacttaactaaattgtctagtaacactggcatttctgccaccttttagtcttcttattttggaaatgggttcgtttactgtaaaaaaagtttttta

SEQ ID NO: 2309 - DNA, 1025 bp, Diabrotica virgifera
agcccacgcgtccggcaaaaagtgaacatcctactcccgttctattcatgcgtattttgtattttgtattttgatgaatctaaaaaaatattaaagttaatgaattttggtaattaaacgtgtttaatgaaagtatgaactgtatggattagtagcattttggtatttaatagtcgttgagaatatgaatgaagcctcatcagtaggtggtcctacgggacctttaaccataagcaaggagcttatcgttaaggaaggatggttacaaaaaagaggagagcactggaaaaactggagaccaagatatttcatcctgctcaactatggagcattggtcggtttcaaaagtaaactagaagactactaccatgtcgaaccattaaacaattttactgtaaaaggttgccagatcatgtccatcgacagaccaaaaccttttacgttcatcataagaggattgcagtggaccacagtcatcgagaggatgttctgtgttgaaagtgaacaagaaagagaagaatgggtagctgctataaaaatggtatctgaaaagatatcagactgcgaagatgtagaaatgaatccagctaacagcgagactggcactatggaggacctatgcgaaaaattctccctccaaggtacttccatttctaaattgactggaaaacgaaaagttactctcgaaagctttgagtttatcaaggtgctgggcaaaggtacttttggtaaggttattttgtgcagagaaaagacaactgggtaggttgtatgccattaagattctcaagaaggaagttatcattcaaaaggatgaggtggctcatactcaaactgaaaatcgtgttcttagaactactcatcatccatttttgacttcgttaaaatattctttccaaaccaatgaccgtctgtgctttgtgatggaatatgtcaacggaggggaactcttctttcacttgtctagagaaacgggtattttctgaagacagaactccgtttctatggtgctgaaataatatctg

SEQ ID NO: 2310 - DNA, 912 bp, Diabrotica virgifera
  misc_feature (731)..(731): n is a, c, g, or t
  misc_feature (791)..(791): n is a, c, g, or t
  misc_feature (815)..(815): n is a, c, g, or t
  misc_feature (876)..(877): n is a, c, g, or t
  misc_feature (897)..(897): n is a, c, g, or t
  misc_feature (902)..(902): n is a, c, g, or t
tatttttattattatatattaaatacaatggaaataaacaggaaaatgattcattgtccaatataaatacaatggaaataaaagaggaaactgtttatttgtccaatataaataaaatggaaataaaacaggaaaacgcaatgtccaatataaaatgtaaaatagaacctgattgggaaaattatgaagatactcctgatttgattaaatatgaattgaagggagaaaatcctgatgaagattacagtaccactaatgttgacgattctggagattccaagattttcttgagccaaattaaatcggaaatatcacttgatgatctcaaacctgaaccaactctgaaagatgaaattttagattatactgaagagactcaaaaaagtgaacatggtttcctgaatgcggatatacaaaatgattcatgcggcttattaaacaatgaggatatacaacacagtaaccaaaatttaagtgtaggaacttcctatggatgtgacatttgttgcaagcaattttcagatcccaggcttttacgtaatcatatgaaatatcacaatggagaaaatgatttccaatgcaagctttgcttcaagcgattcgtatcaaattctcatttgcaagtccatacgcgatcgcacacaggagagcgaccttatagatgcgaaatttgcacaaagggatttcatcataaaagcgctttaaaaatccacatgcgtttgcatactggnggaaaggcctttccagtgcaaactgtgtttccaagaagtttctacaagcatgccatttanaaaaccatatcagaatgcacacgngtgagaaaccatacagttgtcatatttgctccaaacaattttcacaagcgactaacacagnncatatgctgtttcactctgnagaanaatcgctcag

SEQ ID NO: 2311 - DNA, 1585 bp, Diabrotica virgifera
aaaaaagtttcattcccaaagttgtgggaaatgatcgctggaagctcatttggccataatcgtttccaggatttgtttatagtaggttcaaaagtggccatttttttaagatggatagtctttgtaatagatttgttgatttaaagcaagaaattgcaaagggtattcccgaatggggcttcgttataattcagttggtgttagctctttcggaggccctgtagttcgtaaacaaaaatttttctgttggggttgcaaattgacatcagttctgtttgaattagttttagttttaacacttttgtatcaaaaaagacaataaaatttgacatacaataaatggggctgagcgaagaagttcaggtttatttgtaagcgattgaaactttcacccgcttggattaatataacaaaaagtgtaaccatgttgattttgccataattttaatatagttaaaaagactaccgtaccctttttgcaggaatcgtttttccaagggtgaattttgacaatccattattcattaaaataattaataaattcaaatctttgatcaaagtcgtttgcaatttcaatttttcttttatattttgtagtatctgtatcctccagttatttatttataaaaaactgttcttttaagttgtatcacttttagtgtaatgtactctcttcattaaataaaaaacaaaataaattgttccccctacggtatttgcagagcagaatgtgtttttgttttcactataagaatgttcataccaaagttctgggaatgatcgctggagctcattttggcataatcgtttccatgatttgtttatagtatgttcaaagtggacaatatttttaagatggatattctttgtatagaatttgttgatttaaagacagaaatgggtttatgagggtataaaacaatggatcatcaatcatagatacacaatctagaatctaaggaaatacaattttttggcacaagatcagccactacttgttgtgtattgttcttgtaataatttttattatgtgtttccccattagggatcattgtgttgatcgtggcattaaagtgttcagctaaaaatatggtccatttcaatgtaggtgaaattatccacagtattatgacaaccaatacgtaccctctaatatattctttgttacatttagaagtacaatgataaactgtgattttacaataaaaatgatatattagatggtttccgttagtacacaatttataatttcgcttacattacacccacaaaccacttccactaacagttttttctataaaattgttaactacgtttgacactttactcctgtcaaaactggtgtaccatatttacaacaaatatattaactacttattagttgtacttcattgtatttttaatgttaatatttaaatttgtgtgttcattaaatggacttgaggtttcatccttcatcagattgctctgtgttattttagggagaaggaaatagaaagcaatgtttgttttttatatctgataggaataataagggtctaagaagaattaaatttagagataaaaaaaaaaaaagccggaccgc

SEQ ID NO: 2312 - DNA, 964 bp, Diabrotica virgifera
aactgtgttggtgttgagttgattgttgatttggttgatttgggatttggtatttggtgttgattgatcatcaactaaaaaataaatcacaataaaaaaattttgataaataagaacattttaaataaatatttgtttagagaatcaagatatgtaaataacgtaacttgaatattagcaaacacaaaaatggtagtttgttcagttgagcatggtgtccaagcggatgtaatatttcttatagaaggaactgctgtaaatggagcatacataaatgatattaaaaccagctacataataccttctttggaatatttcaatcaggctaagatagatgatgcaaattatgtatctgaaaatgctaattccatgtatggcatcgttgtgttccatgctgcagattgcttgcctcatctcagtactgatacatttggtccatttataagccctacaaaactattgagtgcagttgataaattagatttggctggaggcaaaggagaatctcattcaaatatcgcagaaggattagctacagccttacattgtttcgaagaactgcagcagaaacgagacgtgaccacactagtgcagaaacattgcattttaatatgcaactctccaccatatgcgcttccggttctggagtcccatacctattcgggcaagactgcagagcagttagctgtaattttacaagagaaaaatatcaacttttctgtgatatctccaagaaaaattccgtcgttatacaaattattcgaaaaagctggaggtgatttgagttcttctcaaactaaaattatgcgaaggatccgagacatcttgttttgctcaaaggatttagtctaaaggaacgttctgtaagtccaccaccaggggcacgaccacagtcagacacaaatacaaatactggtatgccgacaatgacgtcattgccaagtccattgcagggaagtgacag

SEQ ID NO: 2313 - DNA, 3783 bp, Diabrotica virgifera
aatatccgaagccgtgtcctagttgttcgaaagcttgaaagggtttagtacaagccttgcaacagcatcaacagatactttcacaagctccaatacctcacaaaggaagaatgccccgtgctaaggctgacgctaggcccagaggccgcatgactgcttatgctttctttgtacaaacatgcagagaagagcacaaaaagaaacatcccgaagagaacgtcgtcttcgctgaattctcgaagaaatgcgccgaaaggtggaagaccatgttggacaaggaaaagaaacgtttccacgaaatggccgaaaacgacaagaaacgttacgacaccgaaatgcagagctacactcctcccaagggagagaagcaacgcggcaaaaagaggaagcaaataaaagatcccaacgcacccaaacggtctttatctgctttcttctggttcagcaatgatgaacgcggtaaagttaaggctcaaaatcctgaatatggtgttggagacattgccaaagaattgggtagaaggtgggctgaagctgatcaagaggccaagggcaaatatgaggctttggctgataaagacaaagccagatatgaaaaagaaatgactgcatataaaaagaagaacaatcccgccttgcaacaagtgggacacccagtacctgaggaagacgtagatgaagaagatgaggaggtagatgaagatgaagacgagtaaacctgtaagataacctctctcgttttaagtcgccttctcattcctctattgtaaatatacatgttagcaagtgtattaatcaagttctcattttttattttttacccgaaacgaaaatgtgtgtacttacaaaactgacagtgtgtgagtgaccgacagatatccgcctttcattcatatttttttatttttttaatctgtcatatcctcaagggcattagcttacattgtaataaactgatgtgtaacggatacttttttgtaatttgtaaaaaaagcaactagaccactgacttgtattttaacattcattaacgactgaactcagacgggttaattttgctgctgttgtgagcaaatgtcctaaatacatctcatccaacaatttccattttatttttttaacgaaataatacaagaatgtgtgtagtgtattttttatgattcgacatggaattttcttcctcagcactgtcgttattcaaaggatagtgcaaagggtattcccgaatagggcttcgttataattcagttggtgttagctctttcggaggccctgtagttcgtaaacaaaaaatttttccgttggggttgcaaattgacatcatttctgtttgatttagttttagttttaacacttttgtatcaaaaaagacaataaaatttgacatacaataaatggggctgagcgaagaagttcaggtttatttgtaagcgattgaaactttcacccgcttggattaatataacaaaaagtgtaaccatgttgattttgccataattttaatatagttaaaaagactaccgtaccctttttgcaggaatcgtttttccaagggtgaattttgacaatccattattcattaaaataattaataaattcaaatctttgatcaaagtcgtttgcaatttcaatttttcttttatattttgtagtatctgtatcctccagttatttatttataaaaaactgttcttttaagttgtatcacttttagtgtaatgtactctcttcattaaataaaaaacaaaaaaaattgttccccctacggtatttgcagagcagaatgtgtttttgttttcactataaaaaatggtccataccaaagttctgggaaagatctctggagcccattttggccataaccctctcacgatgctttttttaccgcttcgggggaaaaaaagattttaaaaatttataataaaaaaaaaaaagggtttggagggggaaaaacaattcaacaaaaaaatttaaaattctaagggaaaattttttctatacgacgccgaataggaaagtgacactgctcactacatgtgataagataggcgagatacatgctaaaaattgatagactcatctcagcactgaggcatttgatccatttataagtcctacaaaactattgagcgcagttgataaattatattaggctggagatcaaggagaaatctcattcaaacatcatataaggatgagctacagccttacattgtttctaagaactgcaggagaaaagagacgagaccacactagtgcagaaacattgcatataaatatgcgactctccaccatatgggcttacggttctggagtcccatacctattcgggcaagactgcagagcagttagctgtaattttacaagagaaaaatatcaacttttctgtgatatctccaagaaaaattccgtcgttatacaaattattcgaaaaagctggaggtgatttgagttcttctcaaactaaaaattatgcgaaagatccgagacatcttgttttgctcaaaggatttagtctaaaggaacgttctgtaagtccaccaccaggggcaacgaccacaagtcagacacaaataacaaatactggtatgccgacaatgacgtcattgccaagtccattgcagggaagtgacagtccaataccgggtactacacagccgaattctaacattttggttaataccactgctggggtaggggcgaatgttggacagaataatgtttatagaccacaaggaacccaaggtatgaatatgccaccgcaaaaaggagtaggtgtagtaaatgtaccaggaggtcgaatgatggccaataatcaaatatcaatgatgcaagttaacgctccgcctggttatcatgccacaggtcatgttaatattaacagaacatctccccattggccaatggcaccaccgattcaacaggtgagaccgtatatccctcaaacaaaccagcaagtaaatactacacaaggaagtgcgctcattgcgcagctgacgcagcccccgtcttcaatatctgggactggtgtaaatcaatttggtcaaatgactactaattctccaattaataagataaacatgcctccacaatcgaacgtacagacttcaatgccacagaatcaaatcgccatacagacctcaatggctcaagtatcgcaagcaaatgctattgcaacatctcaagcacagatttcacagaatatgtcccaaggagttcaaggtgtccaaaacgtccaaggtgtacaaggtgtacagggagtacaaggtcaacaacaaccaatacgagaaagacataccatttggcaaggcttgttagagtggatagaaaaaccaaaaaatgctaccgaacagaaaactacaaaacatgtaccttgtcaagtgtctgcaaactcaaaagatggagagccagagttgaaagctgatggttggccacaaaagcttataatgcaactaatgcccaaacagctcatcggtaatataggaggagcatatttaaagaactcgaagtcagtattgtttcatccacagaattgcgatgcccttgaatctctcactaaagttatgagctcaggattcgctggatgtgtacatttcacaagtgttgcaccttgcgacattaaagttcttatattgttgtatacatctgataaaaaggcatatttgggtttttataccaaatgatcaagtggcgttcgtagataggctaaggaaagttattcagcaacaaaaatcaacacagcaaatgagacagggaggacctggagctccaatattaatccac

SEQ ID NO: 2314 - DNA, 945 bp, Diabrotica virgifera
  misc_feature (827)..(827): n is a, c, g, or t
gtccgcggacgcgtgggtgtctgttcccggcgttctttgaaaaagttttcaataatactctaaaaaatggcagacgctgatgatctattagattatgaagatgaggaacagacagaacaaaccgcaactgaaacggcaactacagaggtacagaaaaagggtgtcaagggcacatatgtatcaatacacagttctgggtttagagattttctgttaaaaccagcaattctcagagctatagtggactgcgggttcgaacatccttcagaagttcaacatgaatgtattcctcaagctgtcattggcatggatattctgtgccaagctaaatccggtatgggaaaaacggctgtttttgtattagctacactccaagtaatagatcctacagaaaatgttgtatatgttctcgtcatgtgccataccagagagttagccttccagataagcaaagagtacgaacgtttcagtaaatatatgcccaatattaaagtaggggtcttctttggtggcttgcctatccagaaagatgaggaaacgttaaaaaataattgcccgcatatcgttgtgggtactccaggaagaattttagcattggtcagatcgaaaaaacttaatctcaaacatctaaagcattttattttggatgaatgtgataaaatgttggagttattagacatgagacgtgatgttcaagaaatatatcgtaacactccccacgaaaaacaagtcatgatgttcagtgccaccttaagtaaagaaattagaccagtttgcaagaaatttatgcaagatcccatggaagtatatgttgacgacgaagctanattaacattgcatggtctacagcaacattatgtaaaactaaaagaaaacgaaaagaataaaaagttatttgagttactagatgttttggagttcaacaggttgtcattttcgtaaaat

SEQ ID NO: 2315 - DNA, 457 bp, Diabrotica virgifera
ccacgcgtcagaatttatttaaatgtgcaattaacaattcttccaccgtccgatttccatctaattcatattttctatcattgcaaaagtccataaacgctttccatacaaattttttactgtaaacagtattctttggtatatttgattcgataatttcattaatattctcatcagtattacaaccaaatcgtgacattttgaaatattgaatatttgaaatgtcaaaatcgaaatgaaacgaaatgtaggtatccatagctacatgattgagtgaaaacagcccatgggatctgttttcagtataatgttggttttattggttgtattcaatcagatgaccacaaattaattgatttcattggatttctaattgagcaaaaaaatttcaaaaaaattatcagtagtaactgcacaagagctctaaaattctatattaattttagagttcgagtgc

SEQ ID NO: 2316 - DNA, 906 bp, Diabrotica virgifera
ataaccttatttttcaaccacgcgttcgcgtggattttgatggagtttgtttaatattttacacttttcttttgctttttaattaatgttttgaaaacttatattagtgtctatcagtcaaactaaagtaaagcttaaagtattatacctaccaataccatccctgggtataccaagagccaaaaatgagtttacaaaaagttgctgtggttacaggtggaaacaaaggcattggatacgctattgtcaaaggtctttgtgaaagattcaatggcactgtctatctcacttccagggatgtcaatagagggaaattagctgtagcccagctagacaaagaaaacaatctaaaacctgtgtttcatcagttggatatcaatgaccaaaacagtgttgactcgttcagggatttcataaaaaaggaacatggaggtttagatttgttgattaataatgcagctattgcttttaagtctgatgcaaccgaaccagtgggtgtgcaagcaagagaaactgtaagagtaaattattttggaacacttagagtttgtgaagctttgtttcctttgctgagaaacaatgcaaaagtggtaaatgtatctagttctgcaggacatttatttagaataccgtctgaagctcttagacaagaattttcaaaaagggatttgacagtacccgaacttactaagctgatggaaagatttgtgaaatcagctgaaaacgacaagacagtggaagaaggttggggaggttccacgtatgtagtgtcaaaagttggcgtatcggcattaacaaacattcaacagcgactattcgatgaagaaagcctaatcgtaacatatccatcaattcagtcatcctggatatgtaaaaacagatatgacgtctcaaaaaggagtttta

SEQ ID NO: 2317 - DNA, 927 bp, Diabrotica virgifera
  misc_feature (770)..(770): n is a, c, g, or t
cgattaatttcgttaaacgcggaagtatgaacttaatgaagttcatggcactggtttttcacaacctacgtggttgtgaaaaatcggtcactaccgtaagtggtactcacgcaccccttctgccctgtaaaggtgatctgatttttaaagatgagtttaacaatctggatttgaaaaaatggcaacacgaggtatctcttagtggaaatggaaattgggaatttcaatggtacacaaataaccgaagtaacagttatgttgaagatggtgttttgcatatccgaccaaccttcgtagctgacgattatggtaacgaattcctctattctggaacaatcgatgtcaatggcggttcccctgctgatgagtgtacaaatccacaattctatggttgttctcgaactggaagtgctacaaatatagtgaatcccattaagagtgctcgtataagatcgcttaattccttctcatttaaatatggcaaagttgaagttagagcaaaagttccagctggcgattggttatggcctgcaatctggttgctaccaagatataaccaatactctacttggcccgcgtctggagaaatagacatcatggagagtagaggcaacagacaactaaccaatccttccggggtaaacatcggcgtccaacaaattggaagcacccttcattggggaccaaatcctaactacaatcaatacgcacgcacacattttgaagaaaacttggaaactggctacgacaaagctttccataactaccanggtagaatggactcccgactacattaaatttgcgattgacgatgaggagattggaagagtaacgccacgggagggaggattttgggagttgggtgaattatcttcatcaggcttggacaacccgtggaaacgaaactcaaagatggctccttttgat

SEQ ID NO: 2318 - DNA, 918 bp, Diabrotica virgifera
ggcccccttaaaaaaaaaattaattccccaccccccctttttaaaatttggtctctttaaggggccccccccctttttttttttggggggtttttttttttttttttttttttttttttttttttttttttttttttttttttttttttttttttttttttttttttttttttttttttttttttttttttaatttacttctctagaatatagtgttcttaaaacagcaaatacataagattgaattatagatactgctgtttctaaaattaatagtaaaagttggacaataattaaaatatttaatatatagattgatattattggtccagtatttcctaaaagagttattaataagtgtcctgcgattatattagcagttaaacgtactgctaatgttccaggtcgaattacatttctaattgtttcaatacaaactataaatggtattaaaatcggaggagttccttgaggaactaaatgagctaatatatgaatagtattatttattcatccataaattataaatctcaatcataatggtaaagctaatcttaatgttaaagttatatgtcttgttctagtaaaaatatacgggaataatccaagaaaattattaaataaaattaatctaaatagtgagataaaaattaatgttcttccttgggatttataatttccaattaaaactttaaattctttatgtaatgttataataatctttattcataaataattataacgagaggggattaatcaaaatctacatctaattttaatttaccaataaactgattaagaacagtattaggtctattaattattccatctagattttgattaatcccctctcgttataattatttatgaataaagattattataacattacataaagaattaaaactttaaattctt

SEQ ID NO: 2319 - DNA, 780 bp, Diabrotica virgifera
ccccccttttttttttaaaaaatttttttttttttttttttttttttttttttttttttttttttttttgttttttttttttttttttttttttttttttttttttttttttttttttttttttttttagtgttaacttttattgtttacacctataaaaacatttatttagctttcttagacttaatcttacgaatgtagaattccagttctttaccctctaagacgtaaccatcagctctaccacattgtcctggccttgacgctaagcaagctaataaccttccagttgagaattgttcttctaatgcaggttctactttagctgttttttgcctagtttcatattttttctgtacttttttgctacgtttcttattgaacatttcttcatcttccgctgtcaattttgcccccttccggtcagggattgatctcccaaattacttccaatccccaacaacttgctcttgctctcacgagcttactacaacctcaacaacagaatccaccatcgttgctttctttgaatacatctcctggttataatcgggacagagattttggcagaggccgtgatttcagacgacacgagccttacagtaagaaccgtcaaggaggaggtttcaatagagatagaaagaggagtcaaaatcaaaaggatcagaagaaggacaaggaggatggaactgatggcgaagatggagaaaccaagagagactggaaagatgagaagagcaacagtgaaactcctgaaactgaggaagaagccaaggcaag

SEQ ID NO: 2320 - DNA, 837 bp, Diabrotica virgifera
ttagtagatattagaccatgacctttattaggagcttttagagcaatattaacaatattaggaataattaaatgatttcatttatataataataatttactaataattggattattaattacaagattaattatatatcaatgatgacgagatattgtacgagaaggaacttatcaaggccttcatactttagtagttactaaaggtttacgttgaggaataattttatttattacttcagaagtattattttttatatcatttttttgaggattttttcatagatcattagcaccaactattgaattaggaatactttgacctcctaaaggaattcaagcctttaacccattagaaatccctttattaaatactttaattcttttaacttcgggattaactgtaacttgagcccatcatggttatacgctatgtgcttctttctttgacttaccgtacctcccaacgaagcacatagcccatcatagcctaatagaaaataatttttctcaaggacttcaaggattaatttttacagtaacattaggaatttattttactattttacaaggatatgaatatattgaatcaccttttgcaatttctgattcaatttatggatcttcattttttatagcaacaggttttcatggattacatgtaattattggaacaaccttcttattaatttgtaattcgccattatttaaatcatttttcatcgacacatcactttggttttgaagcagcagcttgatactgacattttgtagatgtagtatgattattcttatatatttcaatttactgatgaggtagataaaaaaaaaaaaaaag

SEQ ID NO: 2321 - DNA, 943 bp, Diabrotica virgifera
gagtaacaaattcaaaatacttaaatctacggtagctcctaaattatcaatattcgataggaaacagtactcccgtccttcctttaaaaacttttgtaataatcctgagtcttggaagctgttgtagaaatctccgtgacctggagggtaccacgcttccaaattgttgtttactttggcatctttgggtactggcagaagtgagtctctgttgactcgagggtagcacgattggttgaacatgtgaatttctacttgcaggtttttgtattttcttatgattttctctgtgtcatcatccgtgttgaaagagttcattagtactagaggaacgttcactttgaaggttttgttaagagtctcgatctgttgtactgtcaagtccaaaaacgtgagatcatttctgacagtaatcacagactttggtccatggcaacccatcgaggtacccaaacctccattaagctttaccacgaccagtttgtttaacatttggtggactaagtctgatgttggttgttctaaggttttgtaatctctaacagcgtctccaggtaatttctcgatattctcccagttgagtgaaggtcccgtttcatcgaggaacctcgtgaatagtttagtgaagccatctaactgttttttgttttccgctaccttactaggttcactgctttggactattttctctaattctttttgtaatctattgagggcgtctcgtttggtggcttcgatgaattggctagagtcgctagcatttctgctatgaccacgtacttttttatcctcgtttacagttaacattcttatctaaaagtgatatgagattatttataacaaagatagtacattcacgtttttttttttattagactttattaagttattataagaagaggtccaggaaagtgattttataactcaatcaaaatagaaacac

SEQ ID NO: 2322 - DNA, 980 bp, Diabrotica virgifera
  misc_feature (919)..(919): n is a, c, g, or t
  misc_feature (941)..(941): n is a, c, g, or t
gttgaattgaatggccgacaggccggaaaattaattagaggataaaattgttttcaaaatatcctgtttaaacaattgaaatttatttaaaagacatggcggtaaatgtttattccacgaacgttacatctgagaatctatcacgtcatgatatgctagcatgggtgaacgaatgtttgcagagtagttttgcaaaaattgaagaattatgtacaggcgccgcatattgccagtttatggacatgctttttcctggatctgtgcaattaaagagagttaaatttagaaccaatttggaacatgagtacatacaaaatttcaagattcttcaagctagttttaagaaaatgcaagtagataagataattcctgtagataaattgataaaaggcagattccaggataactttgaatttctgcaatggttcaagaaattttttgatgcaaattatgatgggcggcaatacgaggccttggaggcgagagcgggtgtttctctcggtgcgggggccactaacaatggccacagcgtccagcaccacatcgctccagccccaaaaccccatatacagaacagacaggtgcccaaggtgaatgccgttaaaccaactgctgcgaaaccaatttcaaacagacctcaagctggtgatgcaggtaaaatagatgagctagcgaaccaagtcgccgaattcaagttgactgttgatggacttgaaaaagagagggacttttatttcggaaaacttcgtgacattgaagtgatgtgtcaagagtgtgaagatggaaatcctattattcaaaaaatattggacgtcctttatgctacggaagagggatttgcgcctccagacgaagttgaaggtgtgagatgaagatgaatattaaacgatgatcgccttgcggaattcgcttttagtanttaataagagaaacgaaaatcnagtttgtaactaaagcaacattgattttatttgtaaatc

SEQ ID NO: 2323 - DNA, 1121 bp, Diabrotica virgifera
attaaattgaattactctaatatttttttttattttcattttttatttatttaataatttaaactattttaactttaattataaaccaaaatattttaaaactaaaaaaactaatttaaaattcaattgaaaatgataataaatttattttcttctttcgaccctacatctaattttaatttaccaataaactgattaagaacagtattaggtctatcggacgcgtgggtgcgaatcacttcttttattttttatttctggttacgtatgctcaagccaaaaataatggatccttccccaaagactttttatttggtgtagctacatcggcgtaccaaattgaaggtgcatgggatgaagatgggaaaggagaaaatatctgggaccatatggtccaccaagttccttctccaatcaagaacaatgacacaggagatatagcatgcgactcctatcacaaatataaagaagatgtagatattttggaagacttgggagtaaatttctacagattctcaatttcttggtcgagaatacttccaactggctatccctccacggtgaataaagccggacttgaatattataagaaccttacgaaggaattggtaagccgcaacattaccccagttgcaacaattttccactggggatcttccccaacccctttctgagatagatggatggtcaaatcctagactagctgatctttttgtagagtactccagaatagtcattcaaggacttccggatgtaggagtatggataacttttaatgaaccgaaacaaatttgtcattatggatacggtgttggtactgttgcaccagccatacacagttcaggactacgagaatattggtgtgcatatactgtgctgaatgcccatgcaaagacgtatcatatgtataagtccctaaaccttaaagcccctatgggtattactatagactgtgagtggtacgaacccctgactgattcggtccaagacaaacaagcagccaaacggaacctaaactttgagtgcggactctatgctcacccactctttataggagattgggctgaggatgtaaagatgcgtatatacgaaagaagcatggcagaaaatataacacgagc

SEQ ID NO: 2324 - DNA, 1500 bp, Diabrotica virgifera
  misc_feature (1332)..(1332): n is a, c, g, or t
  misc_feature (1386)..(1386): n is a, c, g, or t
  misc_feature (1390)..(1390): n is a, c, g, or t
  misc_feature (1408)..(1408): n is a, c, g, or t
  misc_feature (1421)..(1421): n is a, c, g, or t
  misc_feature (1441)..(1441): n is a, c, g, or t
  misc_feature (1448)..(1448): n is a, c, g, or t
  misc_feature (1485)..(1485): n is a, c, g, or t
gcgggtgtgctaacgtggtgtacaattttcaattgtatttcctacactttctcaagttaggttcttttgcagttgcttactgtataatttcaagtaatttattgtgtttgtgcttataaagaaccgtcaaggaggaggtttcaatagagatagaaagaggagtcaaaatcaaaaggatcagaagaaggacaaggaggatggaactgatggcgaagatggagaaaccaagagagattggaaagatgagaagagcaacagtgaaactcctgaaactgaggaagaagccaaggcaagaaaggaaaaggaagagaaggaaggaccttattatgatatacccattaaattgttgagctgctttgtctgcaacaaagaaatgtgggatggagaatctatgaggaaacatgtgaaaggtcgtgcccatagacaaatgttagatagcttggaagaaagcatccacatcactgttaacattctaagggagaatatgcgtcttcttgaagagaaaaaacttattgagttgaaccgtgtacaacgtgttactaaaagatttaataagccagagcctgaaagtcattgcaacatgtgtgatctcaaattcttgggaaaaatcattgctcatcgcaagactgaaggacatcaacgtttgaagcactacttgcatcctaactgccgcttgtgtagtaaagaatttccctctagaatggaatggattgaacatcgtttgactcctgagcatctcagaaaattgagtaaaacacttgctgataaggttggaggtgccgatggcaatgatattgttgaagttgaggaagaaacaaatgatttggcattggagccaattctagatgagccattggaaatggaagctgagaatccaattcttgaaattactgaaaatatcaatttctcatttatgaatcttatgcctgcatacaaaccaaacaggccaatttctgtcaacagcttaaaaccattctctggttttgtatgtgagctttgccacagaagctttgttgatgaggaagtttcacagaaccacttgaaaaccagaagacatcatcttaaattcattgaagctcttaaacttaaattcaaggaacaacagcgaaaggagaaggaggccaaggaagcagaggctaaggctgaagcagagaagaatggagccaatgaagatggtgatttgtacaatccagatgaaccaacacaagaaggagatgctgaaggagatccatccatggatgtctctcaggaagatgctgtcaaggaagagactatggaagcggaagaacttgaggaagaaaagccacctgcaaaaggtgctgccgccaaggnggccaaggcagctccagctgctgcacaccagcagctgtaaagaatggagctggnccanaaagcaagaagctcgcanataagtttctgtngtttaatggaattccatatnattatgnaagaacccttttattgtctacattttagtctcttacnccatatttaaatttt

SEQ ID NO: 2325 - DNA, 1357 bp, Diabrotica virgifera
tgaattgaatggccgacaggccggaaaagtaattagaggataaaattgttttcaaaatatcctgtttaaacaattgaaatttatttaaaagacatggcggtaaatgtttattccacgaacgttacatctgagaatctatcacgtcatgatatgctagcatgggtgaacgaatgtttgcagagtagttttgcaaaaattgaagaattatgtacaggcgccgcatattgccagtttatggacatgctttttcctggatctgtgcaattaaagagagttaaatttagaaccaatttggaacatgagtacatacaaaatttcaagattcttcaagctagttttaagaaaatgcaagtagataagatcgtccccatagatagactggtgaaaggtagattccaggataattttgagttcctacagtggttcaagaagttttttgatgccaattacaaagggacggactacgatgcgttgggagcacgtgccggagagcaattggggcaaggaggatctaacgcccctagaggtcaatctttgatgttacgtcggccgaacgcgacgccctctgcgcacgtactccagccacaacagacttcgccgactaagccgaagcctgccattagggccatgcccaaggtgaatgccgttaaaccaactgctgcgaaaccaatttcaaacagacctcaagctggtgatgcaggtaaaatagatgagctagcgaaccaagtcgccgaattcaagttgactgttgatggacttgaaaaagagagggacttttatttcggaaaacttcgtgacattgaagtgatgtgtcaagagtgtgaagatggaaatcctattattcaaaaaatattggacgtcctttatgctacggaagagggatttgcgcctccagacgaagttgaaggtgtgggagatgaagatgaatattaaacgatgatcgccttgcggaattcgccttaagttattaaattaagagaaaacgaaaatcaagcttgtaactaaagcaacattgattttatttgtaaatcagttaagtttatgtaacaaatagtttttataagtgttgcttgcatttgtgtgtcatgatggcattaaaaaacgtgatttgattatataaaaacccattatatgttttacgaactttatttttgcaaacgttttttaagcagtttctagcataattcttgtatccagtaaatcattctgccaattacctgaaatacgttgaatgcgccatattatatttttttcttgacatacaaactctgttaatcaatgttataaaatttgatcgttttggaacagtatactgacaaaatgtattttaaataagtgtattatatttttatatatt

SEQ ID NO: 2326 - DNA, 1745 bp, Diabrotica virgifera
cggtcgtgaaaccggtacgataaaatatattattatctttaagtagagcactcacttcattgatttcgtgatttaacaacatatcgtcaacatgagtaaatacgtctaccgttcgcctttaaatgacgctatttgcgctcctgaaagggagcaaaagtgcccatggaatccgaaagttgacagatcgacctcaattcatacaaaggtcgattggaacgcacctaagccaaaaatattaccgaatgctttggctgcaattggtaatactccattgatcaagctcaacaggatacctcagcaggaaggattggaatgtgatatatgtgtaaaatgtgagttcttcaatcctggtggatccgtaaaggaccgcatggcaaacagaatattaacagatgctgaaaatgaaggcatcttaaaaccaggatgtacgattatagaaccatcttcaggaaacactggtattggtttggctatggcagccgctattaaaggatatcgatgtataattgtaatgtcagaaaaaatatcaaaagagaaagaatacgtaatgagagcccttggagctgaagtcataagatgccctgtaaccgccaattcgttttctccatatggaatgtttggaaccgtacatcgtttatcgaaagaaattcctaacagcgttatttttgaccagttttcgaatcccggaaatccactaactcactatgataccacagcagaagaaatctatgatcaatgcgacaaacaagttgatatgataataatgggagctggaacaggtggaacagttacgggtataggaaggaaattcaaagaaatctctcccaacacagaaatcgtttgtgcagatccatttggatcatcctttgctttaccagaagccattaataaaaccgacgtcactttttgggaaatagaaggaatgggttacgatttcattccctcaactttggaccgcaaagtcattgacacttggattaaagtaggagatgagaaggccttgccaatggcaagaaggttgattaaggatgaaggacttttaattggggctagcagtggagctatgatgtgggctgctattcaagcagcgaaagctaagaacttcggtcgcggtaaaaaggttgtcgttgttttgccagatagtattaggaactacttaacaaagtttgtgtgcgaccagtggatggaagaacgaaatttacaaccttgcgtaaatgttaataaccatccgtggtgggatttaaatgtctcccagttaggtcttccagcactacaaacggttccagtaaattctacctttgaagaggctttgaatttgatgaagaaacttggacttaatcagataccagcattagatggtcaagggggtgttgttggagtagtttccatgcagctaattattaacaagctcacatctggtaatgccaagctaagtgatccaatagcagattcgcttgaccgactttatcccaggcttgaaaaatctgccaacattggtctcgtctcaagggtattggaacgagaaccttacctggtaattttggatcctcaaggtaaaggtccttccacagtcaacaaacctgtaggtgtcgtaactcctttggattttctacagttcatacagaaacaaaattaagaaaaatataatagattaaggtttacatgtatgtaacaaaaataaataagttatattaactaataaataaataagtgttaaaatcaataattttattaaattgaattat

SEQ ID NO: 2327 - DNA, 760 bp, Diabrotica virgifera
ttttttttttttttttttttttttttttttttttttttttttttttttttttttttagggttaacttttattgtttacacctataaaaacatttatttagctttcttagacttaatcttacgaatgtagaattccagttctttaccctctaagacgtaaccatcagctctaccacattgtcctggccttgacgctaagcaagctaataaccttccagttgagaattgttcttctaatgcaggttctactttagctgttttttgcctagtttcatattttttctgtacttttttgctacgtttcttattgaacatttcttcatcttccgctgtcaattttgcccccttcttgcgtcctaaaggtaaaatatagtggctttcgtaccattgtctgaaaggggttgcgtcaataacaacgatggcattctttaccaatgttttggtacgtaccaattcgttattactggcattgtaaacgacatcaataatacgtgttttacgagcagtaccttcgctgccccatgcgaaatttcctttttcaatcctcaatgcacggtacttcaagttacctcctcgtgtacggacatagtgaattctacgtgctccaagtttggtatttgcggctggacgtcctaattcgaacttcctcttcttacggagaggcttcctcttgcctcctgtggaccttcgtttatgccaatggtctctactaatacccattctgaacgaataaactaaaaaaaaaaaaaaagcggtcaaaa

SEQ ID NO: 2328 - DNA, 1565 bp, Diabrotica virgifera
ttcatagggcgaataccattaaattgaattactctaatatttttttttattttcattttttatttatttaataatttaaactattttaactttaattataaaccaaaatattttaaaactaaaaaaactaatttaaaattcaattgaaaatgataataaatttattttcttctttcgaccctacatctaattttaatttaccaataaactgattaagaacagtattaggtctattaattattccatctaaattttgattaatcccctctcgttataattatttatgaataaagattattataacattacataaagaatttaaagttttaattggaaattataaatcccaaggaagaacattaatttttatctcactatttagattaattttatttaataattttcttggattattcccgtatatttttactagaacaagacatataactttaacattaagattagctttaccattatgattgagatttataatttatggatgaataaataatactattcatatattagctcatttagttcctcaaggaactcctccgattttaataccatttatagtttgtattgaaacaattagaaatgtaattcgacctggaacattagcagtacgtttaactgctaatataatcgcaggacacttattaataactcttttaggaaatactggaccaataatatcaatctatatattaaatattttaattattgtccaacttttactattaattttagaaacagcagtatctataattcaatcttatgtatttgctgttttaagaacactatattctagagaagtaaattaaaaaaaaaaaaaaagggcggccgccctttttttttttttttcggtgacaaatgtattttttttaaataacctacgaaagctttatacaaacattcaacttttgatggtatggttgaaacttgatggtattgaatgcatcatgacccgtctgagatggtaaaagatggtattcacactgaaatcagttctagagccttagtaaggggctccgtaagacccggatggtatcgaactaggtccgctggggtatcctccaaagcttggtccctgtgagatttggttgtactgggcaacttggatggcttgtttgattccctctagatcgattccaacgacgcggtattggtagctgggtactccgtattgaggagatggagcaccgtattgggaagatggtcctgggtatccaccaccaccaccatggccaccgccgctggaagagctctgttcttctttgagcagaatttgacggacttgttcgagaagctgtgggtctacggaagctccttcgctagtttgaccaccagacgatacagccgtgtatccaccaccgccggacagtccaccccccaaggagaggctgcttcccccgaaggagatgccgccacccccgctgggccggttgtagttgtagccagaaggtggttcggctacaacaacagcggccaatgcaaacgcaaataccacactgtaagagttcatgatgcttatgttgactgcggccgctcgcgatctagaacta

SEQ ID NO: 2329 - DNA, 2417 bp, Diabrotica virgifera
gctgctccgcctgcaggaccgggtccggaatcccctctccttccacgcgtccgggcgaagcgggtgtgctaacgtggtgtacaattttacaattgtatttcctacactttctcaagttagttcttttgcagttgcttactgcataatttcaagtaatttattgtgtttgtgcttataaagttcaaataaacatggcaaatagaagaatgggtggcggacctggcggtggccttcggggcaatcgttcttttaatcaaccaccatttcaaggaggtagtggtgttagcccctggcaggggtctaatagttccggtcagggattgatctcccaaattacttccaatccccaacaacttgctcttgctctcacgagcttactacaacctcaacaacagaatccaccatcgttgctttctttgaatacatctcctggttataatcgggacagagattttggcagaggccgtgatttcagacgacacgagccttacagtaagaaccgtcaaggaggaggtttcaatagagatagaaagaggagtcaaaatcaaaaggatcagaagaaggacaaggaggatggaactgatggcgaagatggagaaaccaagagagactggaaagatgagaagagcaacagtgaaactcctgaaactgaggaagaagccaaggcaagaaaggaaaaggaagagaaggaaggaccttattatgatatacccattaaattgttgagctgctttgtctgcaacaaagaaatgtgggatggagaatctatgaggaaacatgtgaaaggtcgtgcccacagacaaatgttagatagcttggaagaaagcatccacatcactgttaacattctaagggagaatatgcgtcttcttgaagagaaaaaacttattgagttgaaccgtgtacaacgtgttactaaaagatttaataagccagagcctgaaagtcattgcaacatgtgtgatctcaaattcttgggaaaaatcattgctcatcgcaagactgaaggacatcaacgtttgaaacactacttgcatcctaactgccgcttgtgtagtaaagaatttccctctagaatggaatggattgaacatcgtttgactcctgagcatctcagaaaattaagtaaaacacttgctgataaggttggaggtgccgatggcaatgatattgttgaagttgaggaagaaacaaatgatttggcattggagccaattctagatgagccattggaaatggaagctgagaatccaattcttgaaattactgaaaatatcaatttctcatttatgaatcttatgcctgcatacaaaccaaacaggccaatttctgtcaacagcttaaaaccattctctggttttgtatgtgagctttgccacagaagctttgttgatgaggaagtttcacagaaccacttgaaaaccagaagacatcatcttaaattcattgaagctcttaaacttaaattcaaggaacaacagcgaaaggagaaggaggccaaggaagcagaggctaaggctgaagcagagaagaatggagccaatgaagatgatgatttgtacaatccagatgaaccaacacaagaaggagatgctgaaggagatccatccatggatgtctctcaggaagatgctgtcaaggaagagactatggaagcggaagaacttgaggaagaaaagccacctgcaaaaggtgctgccgccaagggggccaaggcagctccagctgctgcaacaccagcagctgtaaagaatggagctggcccaaaaagcaagaaggctcgcaaataagtttctgtgttttaatggaattccatatatttatggaagaacccttatttgttctacattttagtctcttacccaatattttaaaattttggggtagaaggaaaaatatgaatcagttcgtagtaagtgtaaaaatgacctatctctgactgatttctattttttatctagagtgttgaacaaaaattgattttcttaacgaaagtgtgttggggaatttagttttaggtttcataatcattcataaattccgttttcaacttcattttaatcttaattattctacttttaagatatgtagcatagaaattttatttgcgtattttatagttgacacaaaattatgtattatctagtatgtatttactaatccatcatgtatcattaaataatatatttagattgattcattacatttataacatttgacgtagtttaccgaatttcaatgagaggaaaaccatgtagattactcacatttctaaacagctcacatagagattgttaatgtagaatttatattttggtttccttgatttttttaccacgcattttgacatagaaaaacttggtctcgtctcaataaaaaatatatataaagaaaaaaaaaaaaaaggcggcctcgcg

SEQ ID NO: 2330 - DNA, 2116 bp, Diabrotica virgifera
gcgagcggccgccctttttttttttttttcacatcacgagatttttattatacaacaaaacatgagaaaatatacattttttatataagatacaattttgtgcaatgtaaataaaaacaacgattttcataacaaagtagttaccaaaaaataacaacaaaaatatagtataattttttaaatatcgttcgcacaatcttttcaatctcatttaaatattgtatgacattaaataacaatcttaatttagaatcttataagttctatatcgtttaagtactcttgctggctatggctgtttaatgatccaatattctcatatttcctgaaactattttgttttccaaaatggcaccggcaggtatgtctattctgtcaccatggttggcaataatgatgacagtaccccttaaagatactcctttaccaaacgtaacatcaccagatactgtcaaatggtccaactccaaaatatccggaatgttggcgaacctggcaaggaactgctgaactttggagaagtggttgtcgcccaactttaccaaaggtgtggtagggaacatcctctgcggtgacattgtcaatgaaccgtttttgaaggtatataagttgctcataacgaggaaaagatcggacgttttcttgacgggcaagaatctgcttcttggtacgttgataccgataccaccttcgaatgatttcatggctgctcctacagctgtttctagttggattacgttttggccgttgtctaaacttttgttgtttacaataatttccatgctcaacaaatcttcttggagtaccctgtcgatagcatctaatttaacccacaagttattggtattgaagaatttgaaggttttgacagatttaaattcatctacgtgctctttgggtacttgtgcgatttcaagcagtcttaatttccctccgtattggattaaagtaccacccttaacatcagctctggtcttatcggttacttccataacaaactcatgctgcgcctgttcttggttagggttgagtaacaaattcaaaatacttaaatctacggtagctcctaaattatcaatattcgataggaaacagtactcccgtccttcctttaaaaacttttgtaataatcctgagtcttggaagctgttgtagaaatctccgtgacctggagggtaccacgcttccaaattgtcgtttactttggcatctttgggtactggcagaagtgagtctctgttgactcgagggtagcacgattggttgaacatgtgaatttctacttgcaggtttttgtattttcttatgattttctctgtgtcatcatccgtgttgaaagagttcattagtactagaggaacgttcactttgaaggttttgttaagagtctcgatctgttgtactgtcaagtccaaaaacgtgagatcatttctgacagtaatcacagactttggtccatggcaacccatcgaggtacccaaacctccattaagctttaccacgaccagtttgtttaacatttggtggactaagtctgatgttggttgttctaaggttttgtaatctctaacagcgtctccaggtaatttctcgatattctcccagttgagtgaaggtcccgtttcatcgaggaacctcgtgaatagtttagtgaagccatctaactgttttttgttttccgctaccttactaggttcactgctttggactattttctctaattctttttgtaatctattgagggcgtctcgtttggtggcttcgatgaattggctagagtcgctagcatttctgctatgaccacgtacctcacatatgagtttgttatatgtcatcacaaacaattaaaaattacttaagactgcacaattaattaataccgagaccgaagacacgccgatttttacgtatttcctggttacctggctatagcctcattaacaatttaattgacgtgaaaaagtgataatcttgatagtttattcaaaagttttaccataactgattaacgcgtagaaaacgttgaatttttaaataccagttctaaaattgtcaacaaataattgtattgataaatactcgtatgaggtagataaagtccgctataatgaagctc

SEQ ID NO: 2331 - DNA, 1287 bp, Diabrotica virgifera
tcttttttttttttttctaaattattgagataaaaaaaaataaactcaatctaaaaaaaaatattaaataatttaatgaaataggtaaataaccttttcatgctaaatatattaatttatcataacgataacggggtaatgtcccacgaactcacaaccacaaaaatctaattaatcctaacttaaaaaaaaatattaatcttattaaattagcccccaaaaatataaaaacacatattattcttataaataaaatatttccatattcagctaaaaaaattattgcaaatcctccacttctatattcaacattaaaacctgaaactaactctgattcaccttcagcaaaatcaaaaggagtacgatttgtttctgctaatccagaaacaattcatattaaacataatggaaaaaataaataaaaaaatcaaatatattcttgatatttaataaaatctaatatattcaaagatataattaaaaataaaaaagataataaaattaaagctaatcttacttcataagaaattgtttgagcaatagaacgtaaccttcctaataaagcataattagaattagaagatcaaccagccaatataattgtataaacccttaaactagaaactgataaaaaaaataataatgttaaattaaaagttacatttatagtaataaaaggtatacaaattcataaaaataaagctaaaaataaatttaaaattggagaaaaataatataaattaaaattagatataaaaggataaatttgttctttagtaaataatttaattgcatcactaaaaggttgaattaaacccaaaaatccaactttattaggccctttacgaatttgaatataacctaatactttacgttcaagtaaagttaaaaaagcaatactaaccaatacacacacaattaaaattaaactagaaataattattaaaattaaatcatttaaaaacaagtattatttgtaaaataattacatataaagattctaaatctatagcactaatctgccaaaataacaatatttatctaaatataaaaattattttatatatttggtcctttcgtactaaaatatattaataaattaaagatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaattta

SEQ ID NO: 2332 - DNA, 3363 bp, Diabrotica virgifera
accacgcatccgcccacgcgtccgcccacgcgtccgcccacgcgtccgattgaattactctaatattttttttttattttcattttttatttatttaataatttaaactattttaactttaattataaaccaaaatattttaaaactaaaaaaactaatttaaaattcaattgaaaatgataataaatttattttcttctttcgaccctacatctaattttaatttaccaataaactgattaagaacagtattaggtctattaattattccatctagattttgattaatcccctctcgttataattatttatgaataaagattattataacattacataaagaatttaaagttttaattggaaattataaatcccaaggaagaacattaatttttatctcactatttagattaattttatttaataattttcttggattattcccgtatatttttactagaacaagacatataactttaacattaagattagctttaccattatgattgagatttataatttatggatgaataaataatactattcatatattagctcatttagttcctcaaggaactcctccgattttaataccatttatagtttgtattgaaacaattagaaatgtaattcgacctggaacattagcagtacgtttaactgctaatataatcgcaggacacttattaataactcttttaggaaatactggaccaataatatcaatctatatattaaatattttaattattgtccaacttttactattaattttagaaacagcagtatctataattcaatcttatgtatttgctgttttaagaacactatattctagagaagtaaattaatgtcaaatcataaaaatcatccttatcatttagtagatattagaccatgacctttattaggagcttttagagcaatattaacaatattaggaataattaaatgatttcatttatataataataatttactaataattggattattaattacaagattaattatatatcaatgatgacgagatattgtacgagaaggaacttatcaaggccttcatacctttagtagttactaaaggtttacgttgaggaataattttatttattacttcagaagtattattttttatatcatttttttgaggattttttcatagatcattagcaccaactattgaattaggaatactttgacctcctaaaggaattcaagcctttaacccattagaaatccctttattaaatactttaattcttttaacttcgggattaactgtaacttgagcccatcatagcctaatagaaaaataatttttctcaaggacttcaaggattaatttttacagtaacattaggaatttattttactattttacaaggatatgaatatattgaatcaccttttgcaatttctgattcaatttatggatcttcattttttatagcaacaggttttcatggattacatgtaattattggaacaaccttcttattaatttgtttaattcgccattatttaaatcatttttcatcgacacatcactttggttttgaagcagcagcttgatactgacattttgtagatgtagtatgattattcttatatatttcaatttactgatgaggtagattgagtaaatacgtctaccgttctcctttaaatgacgctatttgtgctcctgaaagagagcaaaagtgcccatggaatccgaaggctgacagatctacctcaattcatacaacggtcaattggcaagctccacgtccaaaaatactgccaaatgccttgcacgcaattggtaatactccattgatcaagcttaacagaatacctcagcaagaaggtttggaatgtgatatatatgtaaaatgtgagttctttaatcctggtggatcagtaaaagatcgcatggcaaacagaatactgacagatgccgagaatgaaggtatcttaaaaccaggatgtaccattatagagccgtcttcaggaaatactggcattggtttggctatggcagctgctattaaaggatataggtgtataatcgtaatgtcagaaaaaatatccaaagagaaagaatacgtaatgagagctttgggagctgaagttattagatgtcctgtcacagctaattcgttttctccatatggaatgtttggtactgtccatcgtttatcaaaagaaattcccaacagtattatttttgatcagttctctaatcccggaaatccactgactcactacgatactacagcagaagaaatttatgatcaatgcgacaaaaaagtagatatgataataatgggagctggaacaggtggtaccgttacgggtataggaagaaaatttaaagagatttctcccaatacggaaatcgtttgtgcagatccaattggatcatcttttgctttaccagaaattataaataaaactgacgttactttctgggagatagaaggtatgggctacgatttcattccctcaaccttagaccgcaaagtcattgacacttggattaaagtaggtgatgagaatgccctgccaatggcaagaaggttgattaaggatgaaggccttttgattggggctagcagtggagctatgatgtgggcggctattcaagcagcgaaagctaaaaattatggccctggtaaaagggttgtagttatgttaccagatagtattaggaactacttaacaaagttcgtatgtgaccaatggatggaagagcgaaatcttcagccttgtgtaaatacaaacaaccacccgtggtggaatttaaatgtctcccaattaaatcttcctgtaccacaaactgtaccgataaattcttccattgaacagactttgaatctaatgaagaaacttggacttaaccagatacctgcattggatgatcaagggggtgttgttggagtactttcaatgcagctaattattaacaaacttacatctggtaatgctacactcaatgacccaatagcagatgctatagaccgactttatcccagagttgagaaatctgctaatattggactcgtctcaagagtattggaacgtgagccttatttggtaattttggatacacaaggtaaaggaccttccaagataaataagcctgcaggcgttgtaactcctttagattttctacagtttatccagaagcagcattaaatatagaggagactaatatttccaccatttaacaaaagtaatcaccataaagtgataaaataaataatacctaatataatagaaatattagaaataatagaaattatagattataataaataaataagtattataatcaaaaaaaaaaaaaaaaggggcggcgccccttttttttttttt

SEQ ID NO: 2333 - DNA, 971 bp, Diabrotica virgifera
  misc_feature (923)..(923): n is a, c, g, or t
  misc_feature (935)..(935): n is a, c, g, or t
  misc_feature (965)..(965): n is a, c, g, or t
atttatatcttttatcttatctttaaaataatttaaatctctctaaataataaaaaaatctctctcgaaaaaaaagtaaagaaaaattttctccatcggtagttaattgtatccgtcgagagaatctctctctcatctccttctaaaagaaaaaatctctctcttctcccgtacctccgtcgtatcagggatctcattaattaatcaatctcacatcatcttctccaccctcgaatctctcaaaagagctcaaaaaatctcaaaatttccccaccgtaaaataaatatctttcaaatcaatctcctttcgtaatcgaaacgttactcgtttctcaaatatcattctcaatctcttttaagaaaataaattaaatttaacccatctaacaatatatcttatcaattaaatatctctctctcatctactaatatctaaaatatctttccagggatcgagcttaaaaataaaattttaactaaaatttaatttttaaataaaaattaaggattcaaaaaatttttcatcttttcaaaatatcgttattaattcattttctcatcatctaataattttcatttttctaaattttttcttaaaatataaatttaaattatttaaatttagtaatgatgataatattagtattaaaaaattcgtatatttagtaaaaatatataggtttaataaaggaattcggcaacatttttttcacctgtttattaaaaacatggtcttttttgtattaaatataaagtctcgcctgcccactggattaatttgaatggccgcggtatttttgaccgtgctaaggtagcataatcattagtttttttaattgaaagttggaatgaagggttggatgaaaaaaaaatggtctttatttaatttataaagaattttatttttaagttaaaaagcttanattttttttaanagacgagaagaccctatagagttttataanattatt

SEQ ID NO: 2334 - DNA, 959 bp, Diabrotica virgifera
  misc_feature (884)..(884): n is a, c, g, or t
aagatatcaaggagaatcaagaagtataccatacagaagatgatcaagtcgacgataaaaacttggatactaaaatagataaggatgcagcacctaaactaaaatatgctcgtggtaaaaagattaagagtgataatgatgtgactgatgaaattcaaaccaaaaagtacaaatttaaaaatatagatcatgacgctattgatacaaaattcgaaaaactagataaaaaaccaaatatggagaatattgataaacatcttgatgtttctagtaaaagaagcaaacattacgtggcaagtaagaatgttggcttggatgatgatcaagttgataaatctgagaagttagtcaaacttgacaaaaaaactttgttaccaaaagataataacatagataacattcaagatctctccaataaaagaagcaaacatacaacgagtaaaaatattgatctagatgaagataaaattgataaagcagaaaaaataattagacataatcaaaaaacagttttgattaaagaagatgacgtgaacgatttccaagatacttctaataaaaaaatcaaatatttgagtagaaaacgttctccagaaaattttgaagctgtagaaaatacagaaagtaccgagaaacctggggtttcagttgaaaaaacggtgaaactagaaactaatattaaatatagccaaaaacccttagcagtttcccaaaaacgtgttcagttaaaggatagaagtcagatgaagaaatcttttgacgaagaatataatagagaaaataagcaacatgtcaaacaaaatataaaaattaatacagaaatttagacggaaaaagatgtttgatgaagaaaaagatgacgtagtagtagtagatcatcctanagaaatataaagaaattaatttgagagaataaattatggaagaccctgagaaataagtaaatcccacgacaaatc

SEQ ID NO: 2335 - DNA, 1165 bp, Diabrotica virgifera
cgcaggtagaaagggtgaccccgtaggtgaacagggaccagctggacaagatggtgctccaggagaaagaggaaaacagggcgcacctggtcaacaaggatcaaaaggtgatcgcggagaaatgggtttaataggccccaaaggtcatgctggcctaatgggtctgcaaggattacctggagcacaaggtgcacccggtgaacgaggacttcccggagaaaggggtctaccaggtaaggatggagagagtggatctatgaggtccaccaggcagggaaggtagttctggaccacaaggtccaatgggttccccaggttcaagaggtgaaagtggaaaggatggaagacctggaccccctggagcaccaggacccgctggacccccaggtcctccaggcgaaggaatgggttacgacgctgcaagcttagctgctttgttggctcaaggtcaaaataaccaaaaaggacctgattcgatgaatgatcaacctcctagaatatttggcaaagagctgactgcagaagaaactcgcgaactcatcgacaaagcttacgaacaacttaaatcgtcttttgaaaaattaagaaagcccaatggacagaaaaactcaccaggaaaaacctgtcgagatatcaaagctgcgtatccagactctcaaaatggacaatactgggttgatcccaatgaaggggacataaaagattctattctagtatactgtaacatggaacaaagggcaacctgtatactgccttctccagttagaacaccagaagtaaactataagggcagagaaccagaaatttggcttggagatgtaaatcacggaatgaagataacctacaaagcagacagtactcaaatagcctttttgcatttgctgtcttctaaagccagtcaaaacctcacataccattgcaagaaatcagcagcatattttgatgctaccagacatactttccgacgaggaatcaaactgctcacctggaatgatatcgaagttactccaaagggaaaactaaagtatgaagtactcagtgacgaatgcaggtaccgccgaaacacatgggaacaatcggttataacatactcaactgaaaagcctcaaagactacccatcgtcgatatagccattcgtgattgtggagaacagaccatttttct

SEQ ID NO: 2336 - DNA, 449 bp, Diabrotica virgifera
gcgggtcgatacaaacgtctagaacaacactaggtgttgacagtaaaataatactgatcgacttccttaaactcattcgagacgattcagaagaagtcttagatgctctagttccgaatataggacctattctggtcatgtttacttctgtgggtgttttgtcaagagataagacgactcaagcaacacttgatattggtagaggtctgttgaaatgtcaagtagagatctatagtaactataattggcggaggaggatggcgtttttagtacagttggaagatttgccgacgtgtatgccaagcgattttattcaccaacattttacacctcttgttctgaaattgtcactggaatcgagagcaagaccggtcaggacgcaggcagctaggacactactgatttttcttagatataacgtaaaagaaaatcacagaaagtggataaga

SEQ ID NO: 2337 - DNA, 1345 bp, Diabrotica virgifera
gtttattaaacgaagaaatcaatctgtgttaataataacgatacgcttaaaactagtgcaagtaatacgttcaaataggtaaaatgttaagactacataaatttcacagtattgtttcgaatcaaacgaaaacgcgaataattacatacgccaataaaaagtattttagtaatgaaggggatttgcccaaacaggcggatgttgttgttgtgggtggcggtgtcataggatccagtatactgtaccatctatcaaaactaggagtaaacgctattcttctcgagaaaaacaaattaactagtggaacaacatggcacagtggtgctttggtgtggagtttgagagcgacggacgtggacaatataatgttaaagaaaaccagagatcttctggcgggcttagaggcagaaactggcgttaaccctggatggacccagtcgggaggaatttttattgccaggactcctgagaggttagaagaatacaaacgttttcatacacttggacatttattaaatatagaaagtcatataatatctcccacggaagccaaaaaattggcatcaattctggacccaaaagcattctacggagccctctggtctcccagtgatggacattgtgatccttcaatgtattgtgcggcattaatcaaaggagcaaaaaatcggggagctcaggtatttgaagacacgggagtcacaaaagtattaaccgcgccaacgccaaacaatgaaaaaaaagtaaccggggtagaaacatcaagaggtgtgataaaaacaaatattatggttaatgcagctggagcttgggctcgacatataactcaaatggtcggtctggaccttcccttaactccgatgaagcattcttatgtagttacaggatccattccctcagcaaaaggtacacccagtattagagatcatgatggtaatctttactttaagtcacaaggggactcgattgtctttggaggttatgaaccaaatccggaaattcttcatgagctaccagaagttaaatttcatctttacgagttagacatgagtctttttgatcaacactggaaacatgcctgtgaactttgcccagaatttgaaaaagctggtataaaatccgacatttgtggtccagagtcatttacacccgatcacaaaccaatacttggagaagatccaaaatgtgtaggtttgttccatgcgaatgcttttaactcacttggaataatgctgagtgggaggtgttggagatcagctagctaactggatagtctccggtcgtcctgaattgcccctctacgctttcgacatcagaagattcacgccagtacaaagacaagatc

SEQ ID NO: 2338 - DNA, 928 bp, Diabrotica virgifera
atcgcgagcggccgcccttttttttttcccacgcgtccgctaaacaaaacaaggtgtttagttttgggtatttgtgaaataaaatatttaataatgcaagggtctagcgaagggcagttacaaattagattaataaccaaacaggatatatatgcagtcccagacttgcccctttcggtgcctcaagcaataaacgcgaactcattaaatgaattattaaatcaactgcttaaagaaagcaattccgattttctgaagccaaaagatttcgactttttggctattggagaacttataagacagccccttattgatcatttgcaagaaaggaatgtatctacagagaccactgttgatgttgaatatttggaacgtacacctgctcctgaacctaaagattcattgttacatgatgattgggtttgtgggattgaaacatcagacaaatggatacttactggatgctatgacaattctgtaaatatatggtcaacacatggaaaaataattacctctttgaaagaacatagaaatgtagtgaaggcagttagctggatagacaagacagatcctagtaaaggattcatcagtgtatcacatgatttaacgggactgatgtggtcttttgaacctggtactgataatgtagtaccccaagcagtgctaaggggccacgaaagaggtatagacagtgttggagttagtccaaattcgtcaagaatagcgacaggtggatgggatacaaacttaaaattatggccaacttccattgaagaagaacgaagtgaacctttgccaaaaaggcgtaaatctagaataatttagccactaaactcctcttaacacattgaaaggccccagggaaacaatttcgggggtgacttggattgacaattacgtagtttccactgtctctatggaccatact

SEQ ID NO: 2339 - DNA, 1271 bp, Diabrotica virgifera
agttcatggtgtaatataaccggtaattcatattttttgctatcagtgtttattaatttaataattagcgttctattcaccacatataaaagcagacgacagctattttcctcaaaaccagtttcaacttttgtaccatcagttctttttgtaacatacaaattcacaatgaagtttctcgtactttttgccttagtactctactgctctacacaagttttaggaggtccttgtgatggtgtacagtgcagtcctccaaactgtggacttggtgctcgtccagtagtgaaaccaggtgattgttgcgccacttgccaaggattcggtaacccaaaatgtgaaggtatacaatgcggtgtaccaaactgccctcctggatctatattgaagctcaaagatggtgcttgttgtccctcatgtgagccattcggtaatccactgtcacattaaggatagagattgttgtgcaacctaccaaccacttggtaggtaactaataataaatcaaggacgtattgcaactattggaaaaaatgacctatggaaaatgaaaaattactaataaataattaatatattattacagaactttaaaaaaaaaaaaaaaaaaaaaaaaaaaaaaaaaaaaaaaaaaaaaaaaaaaaaaaaaaaaaaaaaaaaaaaaaaaaaaaaaaaaagggaaaaaaaaaaaaaggggggggccgctcaaaagaatccaattttactaacgggggattggaacgtaaaactttttttatggggcccccaaaatcaaattcacgggcggcctttttaaaacgccgggatgggaaaaaccctgggttaacccaattaaattccctttgaaccaattcccccttttccccgttgggggaaaaaagaaaaaaagaggccccccccgaatcccccctttcccaaaaatttgcccacccctgaaaggggaaaagggaaaccccccccttagagcgggcaattttaaggggcgggggggggggggggggtttaccggcaagggggacccctaaaattttgccagggccctaaggcccccctttcttttcttttttttccctttttttttttcccccgttttccggggttttttccccgaaaagtttaaaaaaggggggttccccttttaggggtttccattttttggggttttatgcggcccccccccaccccaaaaaaattttttatttagggggggggtgggttccgcgggaggtggggccccccccccccccgataaaaaaagggtttttttcccc

SEQ ID NO: 2340 - DNA, 865 bp, Diabrotica virgifera
aatctccgcaatgtcagttggtgtttactcacaaacaaaatcagtttagaaaagaaatgtgtgctttggttgccgatgttcttccaactctctatgagtattacactggtggtggaatccagacgggactcaatgccgacaaaccgtacttcaccttaaacaacaaaaacatatccatctacagcggcgccattcattacttcagaatacccaaacgctattggaggaaccggttacgaaagctgagggctgccggttttaacgcagtcgaaacgtatgtaccatggaacctacacgaaccccaacccggttggtacgacttcggagcgggaggttcagatatgcaggagtttttgaatgtgacggagtttttgaaaatcgcacaagaggaagatttgttggcaatagtgagacccggaccgtacatttgctcagagtgggaatttggagggtttcctagttggtttttacgggagaagaatctaaaaattcgaacttctgaacctacttacatgaaatacgtcacaaggtatttcaatgtgctcttgcctattctagcaatgttacaattcactaaaggtggtccagtgatagcatttcaagtagagaatgaatacggtagtaccgaaagaacaggaaggtttgtacctgatagacagtatttaagagagttgaggacgctatttttgaataatggtattgtcgaattgttggtaacatcagatagtccttcgcagcatggggatatagggactctaccaggtgtttttctacaaactgccaactttaactttcagacgatgatagaattcggcgctttacagaagcttcaaccgaacgaccagttatggcgatggagtttttg

SEQ ID NO: 2341 - DNA, 1195 bp, Diabrotica virgifera
ttttaaatacgtgtggcttctattgtaactactcaaatgggaatgagatgtgaaaatattatcagtgaaatcatacatgcattaaaactaaattaagccaaggtcatgatcaactaatcttttttccattattattaaaaagtgccatcattctcacatttatattgaattttatgcacaaacatgtccctaagttcaacctcccaaattttatgtaaaggaacaactgccataatttcaagatgttttagtttacataaacttccagaaactcataagttacttcaaaagacttgtagggactttgcagaaaaggaacttaagcccatagctgctctattagatagagagcataaatttccagaacagcaaatcaacaaattaggtgaactaggtatcctgggtatatgtgtatctaaagaatatggaggtgctggttatgatggtctaggtatggctgtagctgttgaagaaatatccaaaggatgtgctggtacaggggcaatagtttcaatccataactgtttatatgccagtctgctggacagattagggactccacatcagaaagaacaatatttaagagcttttactaaagggactttgggatgttttgctctaagcgagccagatgctggaagtgatgtaggagcaatgtcatgtacagcagataaggatggagaccattatatattgaatggaaataaatcatgggtaacaagtggtttacaaggaaaggctgctgttgtatttgctactgtagataaaggactgaaacataaaggtattacggcatttatagttcctattccaagccaaggactgacattaggcaaaaaagaagataaattaggcattcgagcatcctcaacatgtaatttaattttagaagatgttaaagtacccaaagaaaatattttaggtcctattggtggcggttttagaattgcaatggaacaactggacagagctcgagttggaattgcagctcaagctgtgggaattgtgcaagctgctctagatttggctgcacgttattcgctacagaggaaagctttcggaaagaccattagcgaactggatgctgggaagttgcgcccgggagagatgggtcttcgttttgaatcagcaagaattctggtgggggaaagcagcagcccttttgagacgatccttcccctaattaacaaaagaa

SEQ ID NO: 2342 - DNA, 1018 bp, Diabrotica virgifera
tagaaatttaaaaatatttaaacatgaaatattttataaaataataataaattaacgcaatataactaaaatgtttaaattatgtaacaaatcgttggtttcacatttatgtagaatatcaaattttactgaaaattataaattttgtttagcaacatttaaattgccaattaataggagatttaaacatgatcaaaaagttaaacccaatgtaccagaaaaagagttaccagaccatagaaaaattggaagagaacaagaattattcttcttccatgagatgtctcccggttcttgttttttccaaccctatggagcccacatatacaatacactggtaaattttattcgaagcgaatataggaaaaggggatatcaggaggtgatttctccgaatatatacaatacaaagttatgggagacttcgggtcactggtcgcattattcggagaatatattctcaatagatatagagaacgataaatatgcgttgaagcccatgaattgtccaggacattgtttaatttttgaccaccgcattaggtcctggagggaacttcctcttcgcttagcagattttggtgtgcttcatagaaacgaactgtcaggtgtattaacagggttgactagagtcagaagattccagcaagatgatgctcacattttctgctctcctgagcaactgaaaagtgaaaaaagtgattgtttaaattttggggaaatgtttattctacatttgagttcccctttgaactaggaaggtgtacctcctctgaaatatatatggtagacgcattatgggattctggcggttaaaacggttaaaaaaagtcttggtctgtttggattaacctttgagagttgactcccggacggggggggcctttttattggcccaaaatttaacttattaataagggtgcgcttgggaagccccactcacgggggaaccctttccttttacttttcgcgtacccctttacggttttttttttttaagcacaaggtggaggggggg

SEQ ID NO: 2343 - DNA, 762 bp, Diabrotica virgifera
  misc_feature (2)..(2): n is a, c, g, or t
ancaagcgtccggcccacgcgtccggattagatatttttgaaaaaactctcattaaaaatggtttttaaagtatcccttttgtgtacactgctggtgttagttgcttattctagtgcatacgattacagcaattgtcctggaaataccaacagacaaaaaaatctgatatacagctctttactgccaccaggatatagcgtgaaaactcgtatcccagcaactggatattaccaaagacctatcacctgcttactgctaatcgatcaaaaaggaagcgccagctcaccaaaaattatagaaggtggatatctcgacacttttgctgtagtaaatatcacttccacaactgcgcaaccagttagttactatgcaatagtatttattgattagcctattgattagcctttagtagtatttagatatatttatgcactactattatttatttaaatgatatattttcgttgataaaataaaaaaattataatattaaaaaaatcaattttctcgtgtaattttcctaatataaaattttttaataagactatttgataatatgataaatcaagttgtatttgtatccaaatggcagaaaaaatataaaaactattaataatttaaacttcaaaactgtgtttagaaataaatccttgaaggggagctctaaaaactcataaaatgtaaatacatgtaaatatttgcaaatctctggtaatacaatgaatagatgatggtaattatgaagataaaatattcttaaa

SEQ ID NO: 2344 - DNA, 862 bp, Diabrotica virgifera
caatacacacccctctcgcattactcttttaaattcgaactcttctgatgtgtgttcgttaatgcgtatgtgtacctgctgtttataatatagattttttataattcaaaggtcattgtattgtaataattgttttgctttgaggacgtccattagctctttgtggcggtctttatcgaaaggcttgttgtaatctatgaaacagacgtacattcctggtttacatccaagcatctctggattagtagtgtaaatccaaagtgggttccttcaatatccatatcaagtgtttggcaaatgcgtttatgaatgatctttaaaaacattttaagtgtgtgagacatttttatacaaaacgtgtaacctacttagaaaactggagtacaaattttcatgaatttaaactattgaaaagcatagatctaaagcgggttccacactctcggcgaagttacttcgccaaagttgaccgaagttcaaagtaccctctctacacactcgttctacttcgcgagggagtgcgataccgacaaagagcggtgcaataccgacaaagatccctttgaccagaccgacagagaatggaagtagaacgaagtgaggcaaagttatatcaaggtggccgtctacactctcgtacttgttgaacctcgatcgacttcggcgagaatgtggagctcgcataagaagtgaaataacatggaacgatatttgttattctctcgaagattttaaattgtatatcaaggcaaccatgttaaacgaagatcaactctttgacgaactggaaattttgaaagacgtggctacaattaaaaaaattgctgagtggaacagagaaagaaaaatagtcagcatcgat

SEQ ID NO: 2345 - DNA, 1167 bp, Diabrotica virgifera
gtccggacaagtgaggcttgccttttaagcgatgcgataccgacaaagctccctttgactcggacgcgccagaccgacagagaacggaagtagagcgaagcgaggcaaagttgcacaaggtgtccgtctacactctcgtacttgttgaacctcgatcgacttcggcgagagtgtggagctcacataacattttttcatagagagtaataatgtaacagtttgtagtttctaccagttgtgatgtaacaggcgtaacgctatgttatttcacaatatggagaagatctactacttcttcatttgtgacgagatctaccagcgaaatttcaaaaattgtcctcgagatggacatttcaaacttttttaggttctatgatcttaatttaacttccatcaacaataagatttactgtttttgattaaatagttaatctagcaaagatagaccagcaggtacttccttaaatctagtaatggtcagcgtttacatagaccaataatagtttattaagcttttttcggtcaactttttaagtcttgtttttaaaggaatgtttgtataacattttaaacctttgtaaaacatgtaccattaatgttgcccttctactcctttataaaaataattgttaaaataacttataaaattaatcttgtttaatgactcgaaatataaattttaattttcgtataaggttcagatttacagtattagttatattataattttcagaaatttttcaatttcttttctaataactacacatacagcaaaaagtatgcctggtggtaacgttcataaattaagaagttgtcgttgcttgaaacttgtgaaaattttgatagtttttgctgtattgtcattattaaatatttaagttattttttttattaataaatattcattcaaatgatttgtggcaaatatactgggggaaaaaggcagaaagggcagttactctggtgtataatttgggaaaagggaaaaaatttataaactaaatttatctcatttttgttcataaatttatgaaatctatttattttaaaattttaaaaaatattgtttttttttccccccggattgtttttaattaaaaaaaaaaaatttttttggggggtttaaaaaaaaaaaaaaaaagggggggccggccttaagagggacac

SEQ ID NO: 2346 - DNA, 1350 bp, Diabrotica virgifera
atattttgttttctttggttaacactttgttttccaggtttttttgtatttcattctttagaaacgttaattgtgaaaatgttccacatgaacatatttcatatgttgttaatttacctggccaacctcctaattcaataggaagcatttctctgtctatctcttcactatttatatatttctttggtcctatgttatacgatctatttattaggtctcttaattccttccttactattattaacgcagtttctggtgccccaagcttttgtaatgaattgagttgtcctactgctccttcacagtcttttattaagtctatcttgtttattaaattatatgatgatatgcattctttaggccacacattaattgtcttaccattgcattcgtatttttgaatcacttcacccacaacatatgatagatatgatttttttatattcatttttagacagaacatcttctttccttcttgtataaaatcataggaaaactttatggcttcctcattattacaggagcaaaatactatactgtcatctgaattgattagataattaaattctattttaacatctttgaatttctttatactatttatattctcttttaaaagtttgcataagtaatctgttgccaaaatatgtatatatgttgatgatttatttaacataccttggacccatcctgcatttccctttataaataggttacttactaaaaattcaggtgtcaatcttgcacttttaggtatctttggaaaatgctgcaatctatttttcatctgatcaactgtatttaacattgtttctttaattccctcaataatcaaactactgttcttaatagtcaacttgaatttgtccatactatctgattctgagaattttgattgatcttgtacgaaagaagctttatacatcataccattcttcctacatatttcatccattgaggcactaaaattagatattttggcggatctattaatcctcctagctaacaaattttcatcttggtattctcctatacatccgaaggggtcatctaaaacatataacttttgttttgtataaggatcaggcgaacctataggccttacatcacctctttgttctttttcagatatattaaaaagcatttgtttatccttgtgcaatttgacgaaatttatgatttttgattcttctgtcttatctcctattattaaagattcgtttactattgcattcgatagagtaccaggtatcgacaatcctattttctttccgtttattttccatctttcatcactagattctcacagtcttctatactagatcccgtttcttctactatcatatccat

SEQ ID NO: 2347 - DNA, 447 bp, Diabrotica virgifera
tcgtttgacaatacaactccctaaaaagatatgcaaaaataatgaaaataataaaaaaattaataaaaagtaatcacgtaaacaaaaatgtctcttatataccaacctctcttgtaaatggttacttaaaatatgttttttcaactatataatgtatatttttttatgttaattattatttattattgccatatacctatttataacctacgataaaaacaacagtggtactttccccccttctttttaatttcacgaacgaaggacaaaacaccaaaataattcttttatagccaaatataatcaaaataatgttattttttcacatatcaagttaaatattataaaatatttattcctctttcctttccggatttgaataataaaaattcatagtacaatggtttatttaataaaaaaaattgtgttttgggaaacggacaaaaa

SEQ ID NO: 2348 - DNA, 967 bp, Diabrotica virgifera
gagattcagatcttctctcggttcatgttgacattctcaaagcggagatcggcttgccaaaggagcagctttaaatgcacttaagaggcatctgtgattttatcaaggttttggggtatgtcatgagctgacggtggacataatcaacgaagatgactcaccggcgggaagaaactcaggaatacgatgagaacacacttaaactgaaccgtcacgaagacatagaacttccaactttaacgaacataccaaatttaataaaccaaatatcttactcaaaacaccctgctcagtaccctgagaggggaacatggagtagtaaattagactttattttatcggtagtaggtttagctataggtttaggtaatgtgtggcgatttccttatttatgttacaaaaatggaggcggcgcctttttggtgccttattttattaccttaattcttgctggcattcctatgttctttatggaactggcacttgggcaaatgttgacaataggcggtttgggagtgtttaaaattgcaccaatctttaaaggaataggatatgcagcagctgtgatgtcatgttggatgaacatatattatatcgtaattttagcttgggctatattctatttttttatgtctttaagagcagatgtgccttggagaacgtgtaataactattggaatacgaggttctgcatcaacccttatgatcgcaaggcattaaactgttgggagaaatactcagttaataacactgtaacaaaggtctgccaaataagttcctacaatatttcagccgatgatctcactgatcctgttaaggagttctgggagcgaagggcgctccaaatcacagaaggaatcgagcatgttggttctattagatgggagctagctggaacattgctggtggtgtggtttgtttgtatttttgcatctggaaagggggttaaatgaaaaggaaagggaag

SEQ ID NO: 2349 - DNA, 1083 bp, Diabrotica virgifera
gcatcatgcatttaaaattagcagttttggcttttttgttgtactttgcaaataaaagggcaattgcatcccctttaagtgcaacacactacgaagacgatgatttaatagttgaattggagaatttaggcaaaattcgtggacatattcttcaaagtaacgaaggaaaagatttctacgcttttcaagatgttcactatgcagaatccacagcaggaaataacagatttaggccccccaaacctcgtgctccttgggaaggaatattgaatgcaacagaaaacaaagtagtttgtccacaagcagacaacccagatgcaagtgaagactgcttggttttgaacgtttatacaccagtaaaacccaattccgcgagaggccgccctgttttcttttttattcctggcggagcattcgtcactttcagtgcccaaatatcaaatttggacccaaagtatttggttgattatgatatagtaatcgtaacaatcaactatcgactgggatcatttggatttttaacaacacttgatgaaactatccccggtaatttaggactaaaggatcaacttctggcccttaaatggacacatgagcatatccataaatttggaggagatgctaacaaattaacgttaggtggacaaagtgctgggggtatgtctactggatttcatttgctcagtagagcatctaaaggcttatttaggagcgttattcaacaaagtggctcatcaatatccagtgtcttttatccaataaacgatagaaaactggcatttgaatttggtaaagccttaaacagttcatttacatcaacccactcaagagatttgttagaactgttgcaacaggcatctttttcagatctactggctctcaatactaagttcacctctggagtcacaactggttttatggatggcttgacgtttagacccgttatcgaggatgaccacgaagatgctattgtaaccgaaccaatgcaggctgctctatcgaacggccgttttaacagagtacctgttctcatcggcttcaattctgaagaatctttggctttcctaggactaattggagaac

SEQ ID NO: 2350 - DNA, 1108 bp, Diabrotica virgifera
  misc_feature (984)..(985): n is a, c, g, or t
tatttatatttttatcttattttaaaataataaaatatctctctctccgtaaaagtaaagaaaaattcttcatctctaacgatagttaattagtatccgtgagagaatatctcttcatctctctcatcaaaagaaaaattctatctttctctcgtaccctccgtcgtatcagagggttatctaattcaataattcatcatcatctctcatctcatcctcgaattctcaaaagagctcaaaaaattcaaaatctttccatctcgtaaaatcaaatcatctttcaaatcaattcttctctccgtaatcgaaatcggttatctccgtttctctcaaatatcatcctaattcttctctcaagaaatcaaaatctcaaatttctatcttcatctcaacaatcatcatctctatctaatctcaaatcatctcttctcatcatctaatctaatcatctcaaatcatcttcctccagggatcgtagctctcaaaaatcaaaatctttcatctcaaaatttcaattcttctcaaatcaaaaattcaaggattcaaaaaatcttctcatcattttcaaaatatcggttatctcatcttcactttctcatcatcattaatctaatcttttcatcttttcatcaaatttttctcattaaaatataaatttaaattatttaaatttagtaatgatgataatattagtattaaaaaattgtatatttagtaaaaatatataggtttaataaaggaattcggcaacattttttttcacctggtttattaaaaacatcggtctttttgtattaaatataaagtctcgcctggcccactgattaatttgaatggccgcggtattttgaccgtgctaaggtagcataatcattagtttttttattgaaagctggaatgaagggttggatgaaaaaaaaactggtctttatttaatttataaagaattttatttttaagttaaaaagcttaaattttttttannagacgagaagaccctatagagttttataaaattattaaatagttttttagtattaatttattatatataaattatttatttgggtgattaaaaataaatttacttttttatatatatttatat

SEQ ID NO: 2351 - DNA, 1724 bp, Diabrotica virgifera
cccacgcgtccggtaaacagcaaatacctattttactcacaacatctgcagtcccatctgaaggctttatcgacttcatcgaaggcatcagagcattaccaaacatggagaacgtacgaatcttctacaatctagacaaaactccagatcgggtaaacgaggtggtcaaacgagatatttcgcttatgattttgaataagggtcaatggtggacgtatatgcctttggacttgggcaatcaaaacgagaaacttatagacaggcagtccgatgcacctatattagaaaacaactcgataagttatctgggagtgaacctgaaagatgaggctttaaccccgaataataaggacaaaaacgaaatcggaaatattgattatgctggtctagctaagaatggcgaaagagttatgggtttggcatatttggataaagaaaattcgaagcttattgttgacgatgactttacttggaacatacctgcaggatggaacttcgaatcagctgctacagcaccacatgcatatacttctgcatattacatgttggtaatcaaaggaagggttaagcatggagacacggtgttaatccattcaggttgctcacctgttggttttgctgcaatgaacatagcttttagttacggttgtcaagtttttgttacagttaattcagaaagacaaaaagcgtttataaagaagcactttgtttacatgcaagctaggaacatattgaactacaccagtactaagtttgagactgatctgatgaccataacaggaggaaaaggagctgaagttatattaaattgtctttctgggattcttcttaaaagttcgttaaattgcatcgcaaattttggaagatttatccagtatggtaaatatgatatggaggaagggggtagcattggaatgtactgctttttaagaaacgtttcgttttactgtgtcgatttgaacaagatatttttcaaagaaaaggatattaaggttgagctacataagctcattgaagaaggattggctaattacacagtgcgaccgttgaagagggaagttataaagaaggacgacgttgcagatgtaatgtcaagacttcagaatcacgagaccataggcaagattgtagtagaaacaggcaacacgatgaatatcaacaaaataaatttcaaggatcccaatcgcttcatctgtaacgcaaaggactcatacttaatttggggtggatctgccaaccactggtcccacatcgcagaatggctcgtccatagaggagctaggaaaatagtaattgcaagcgaaagcaaaccgaaagatcaccatctcaaccgaagactgcaattcctccagacctattacggcgctgatttaataatggcacccagcagaattcagactaaagaacacgctcagaatttggtctccgacgttcaaaactttggaaatcttcatgctgtgtttgcactttcgcagtcgatgagtatttctgctactgagagcgagtctgttgaacttctcgaaaaggctttggaaagaatcgcgcctaaagctatattgattaattttgtaaaatcagcatcaggattgtgttatatcagaggacctgaatatcctacatacaatattaacgtcgagagtgaagaagatgttaaagacgctatagtttttctggataaagttttatgctaccagataagtaacctgtcgttaagaagagataca

SEQ ID NO: 2352 - DNA, 1306 bp, Diabrotica virgifera
aaaaaagtttagacctaagatagctgtatttaatggaaaactcatttatgaagtattttcggggaagaaggatttcaaattcggccggcaaccagatgttgttgaaggtacaaacacgcatatgtgggtgatgccgtcttcaagtgcacgatgtgctcagttgccacgagctgcagataaggttcctttttacgcggcattaaaaaaattccgtgattatttaaatggtctgataactgaaatcgatgagaatgaaatggtattttctgaaccaagtttaaagtcttgctacgaagcagaaccaaagcctgatgcattttctccggagctcactgacataagtaatgctgtgatccaaaatgaagatggtacgattataccatgtaaaaagaaaagaggtagaccgaaaaaaataaaagtagaaggagaagaatctccaccaaagccagtagttcggaaacctccctctactcagaatagtaactgtgattttccaaagaaaaaaagaggccggcctaagaaggttaaggttgaaaatatggacttaaatccaccagacaacaatacatcgaccaatttgtctcaatgttactcaaacccgtctccaattcagtctcccaacaatttttatcaaatgggccctgctatgacacctcctaatggggtgggaaatttatatgctccacaaccaccacagtcttatagccaatcgccacgacctccatacagccagtctccacgaccagcttacacaaattctccaagacctcagtatagtcagtctcccagaccacaatatagtcagtctcccagaccacagtacagtcagtctcctcggcccccatatagtcagtcacctcggcctccttacagtcaatctccaagaccccattcacaacctttcactcattcggacttaagttcagaaataagtgcagcaataagttctgaacagttaggttcgcctgcatcacccatcggtcctccagattttgaaccaccaactagtatggccgatgaggctgaatgtcgattaggcagtccagccccttctagcaatagcgaacagacacattatcattatcaatcgtacaacatggaacctcagcaccaaacagatcagtatgcatcgccaagacaaacacaagatattgctacaaaaagcctgtcaggattggaatcgttagtagatcaaattcccagcataactgaaggtgaagctccacttggtgaagcacctgaccaaatatgcgggtcagttcaataattataatgtatcatcttcatccagagctagtccattcca

SEQ ID NO: 2353 - DNA, 898 bp, Diabrotica virgifera
  misc_feature (881)..(881): n is a, c, g, or t
gtagagtgtaagtgtagtgtcaataaaatgattctgttggtcctactagtgttactcttgccgctgttgattagttactattttaaaaagaaaaaaagatatgaggaactatggaaatatttggatgttattcctgaaccgaaaagctatccgatactcggaactaattacaaaatacatacaagagaatcattatttgtaagagagagactaagagcgattgacttgtttcctatttataagttatggtcgttcgatatagcagcagtgattgtaatgcatcctgaagacgttgagttggtggtaaataattcaaagcacaatgacaagagtttgatatacagctttcttcatgattggctgggaactggtcttttaactagtggaggcacaaaatggaataaaagaagaaaaattttaacgccggcgttccattttaatatacttcaggaattctttcgggatgttaaacaaagaaacacaaatattggttgataatttgatgaaattatctgatgctcctcacatagatgtaactaaatatatcactgaatttactttatactcaattggagaaacttctctaggcgtttctcttcgagaagatcctaactcgcaaacgatacaaacaagctgtttacgatttcggagagtattattgcttacagacgtgttcgcccttgattgtacatttccattaatatatagattaagctcagtatataagaagactaaaaacacaataaatattctacatgactttttcacaaacgttatcaatgaacgtaagaaaactttcgttcccaatgataatttaagttattccgataggaaaaaggttggcctcttacagtggtgtcatggtgtggggaacgcgtggngaacgccgttcccgcac

SEQ ID NO: 2354 - DNA, 896 bp, Diabrotica virgifera
gtttcctagtcaaaagagaccactgtatacaaatttattaacaatgtcagaggattttactgagtatcctcaaaagctcctttcaggccttggaaaatcaacaaaacggggcattaaaaagtgtcctcgatgtggcaccttcaatggtactcgaagtacagtgtgtaagaacaaaaactgcaatgttgtaaacgtagatgcagtgaaactattaacaaacactgaaaagcagctgtattctgtgaaaatatgggacatggggcctaattatagagcctttgtacaactaccacttctgcaatcttcttcgaacgaagacccacacgtttactctgatgtagctctttgttttgtcgattcttgtaaaaactccttcgacaactcaattctaaagtgccatgaagaaggaaccgattcgaattctaaaaagcttctcttctgtactcatattaggtctgctctaaaaagccagagtaaagctagccccatggaacttaaaccttcagttctcacttcgttaaatgttacagatgatattaaggaaaaattgtgttctttcaactctgaaaaagaaggagtgtttgtacagagagtttccaagtctgtcatggctgttaaatgtcaagctagtgctaagcatcctttaggatacctacattttacatttattaaaggaaaaggaagggatgtatatgaaaagttctattgcagttgttcggaattttcagtgtcagaactttctggtgaaggatttgagagtgtaaaatacaaatgcatccactattatgcatgtatatgggccctagcaagtgatcagaaattaagcgaaggatttacaaatattctcagaaacgaatttttcatttgtagggttcaataataataccactcaaaat

SEQ ID NO: 2355 - DNA, 743 bp, Diabrotica virgifera
cccacgcgtccgcccacgcgtccgcccacgcgtccgcccacgcgtccgctttgagtcgaaggttctaaatctcaggatcctaagaaaagccaccatggttgacgctgcagttttggacaaacttgaaagtggattcgccaagattaaagattccaactccaaatccctcttaaagaaacaccttacccaagaaatcttcgacaacctcaaaaccaagaaaacccccactttcggttgcacacttctagatgtcatccaatctggcttagaaaatcacgactccggcgtaggtatctacgccccagatgctgaatcctacaccgtcttcgctgacatcttcgatcccatcattgaagactaccatggtggattcaagaagaccgacaagcacccccccaagaactggggtgacgttagcgtattcggcgacttagaccccaccggtgagtttgttgtgtccacccgtgtcagatgcggacgttccatggaaggatacccattcaacccatgcttgaccgaagaacaatataaagaaatggaacaaaaagtttccagcactctctctggccttgaaggtgaacttaaaggaacattctacccattgactggtatgagcaaagacgtccaacaaaagttgatcgacgaccatttcttgttcaaggaaggagaccgattcttgcaagctgccaacgcctgcagattctggccctctgtcgtggaatctacccacacgagaaacaaaa

SEQ ID NO: 2356 - DNA, 1045 bp, Diabrotica virgifera
tctttgcgtccgtaccctttgagtcgaaggttctaaatctcaggatcctaagggaatattgacctgaagaagtttttgtagttacgctcatgtctcaacaacagaaaattcgatctggtagagacgcgtgctaaatgagtcatctatcgattagaggtagcgaacagcgcccctttagcagacattgagtagagttagagctagcttgtggataggatactcagagtgtcagtggtgcggacacccggcaacaaatatacaatagttcaccggagacagtgctaaaatcagtggaaaactggaagggctatacagtaggtctgaaaagtgaccagaagggcgtcacctaacacacatgccaaaaggtcttgtcaagtatttacccgtagtgttaaatttttttatttagctagatattataatcaaagatgggtggttgtgcatctaaggaaaataaaaaggaaatacaggacgactctggaaaagccaccatggttgacgctgcagttttggacaaacttgaaagtggattcgccaagattaaagattccaactccaaatccctcttaaagaaacaccttacccaagaaatcttcgacaacctcaaaaccaagaaaacccccactttcggttgcacacttctagatgtcatccaatctggcttagaaaatcacgactccggcgtaggtatctacgccccagatgctgaatcctacaccgtcttcgctgacatcttcgatcccatcattgaagactaccatggtggattcaagaagaccgacaagcacccccccaagaactggggtgacgttagcgtattcggcgacttagaccccaccggtgagtttgttgtgtccacccgtgtcagatgcggacgttccatggaaggatacccattcaacccatgcttgaccgaagaacaatataaagaaatggaacaaaaagtttccagcactctctctggccttgaaggtgaacttaaaggaacatttctacccattgactggtatgagcaaagacgtccaacaaagttgatcgacgacca

SEQ ID NO: 2357 - DNA, 1244 bp, Diabrotica virgifera
actcaaagatttgttctaagcggcgcgttgtaattctcattgtcggttcatacttttgtgaagtgtgtaccctttgagtcgaaggttctaaatctcaggatcctaagggaatattgacctgaagaagtttttgtagttacgctcatgtctcaacaacagaaaattcgatctggtagagacgcgtgctaaatgagtcatctatcgattagaggtagcgaacagcgcccctttagcagacattgagtagagttagagctagcttgtggataggatactcagagtgtcagtggtgcggacacccggcaacaaatatacaatagttcaccggagacagtgctaaaatcagtggaaaactggaagggctatacagtaggtctgaaaagtgaccagaagggcgtcacctaacacacatgccaaaagaaaagccaccatggttgacgctgcagttttggacaaacttgaaagtggattcgccaagattaaagattccaactccaaatccctcttaaagaaacaccttacccaagaaatcttcgacaacctcaaaaccaagaaaacccccactttcggttgcacacttctagatgtcatccaatctggcttagaaaatcacgactccggcgtaggtatctacgccccagatgctgaatcctacaccgtcttcgctgacatcttcgatcccatcattgaagactaccatggtggattcaagaagaccgacaagcacccccccaagaactggggtgacgttagcgtatccggcgacttagaccccaccggtgagtttgttgtgtccacccgtgtcagatgcggacgttccatggaaggatacccattcaacccatgcttgaccgaagaacaatataaagaaatggaacaaaaagtttccagcactctctctggccttgaaggtgaacttaaaggaacattctacccattgactggtatgagcaaagacgtccaacaaaagttgatcgacgaccatttcttgttcaaggaaggagaccgattcttgcaagctgccaacgcctgcagattctggccctctggtcgtggaatctaccacaacgagaacaaaaccttcttagtatggtgcaacgaagaagatcatcttcgtctcatctctatgcaaaagggtggtaacttgggagaagtttacagacgtctggttaccgctgtcatgacatcgagaaaagaattcattctctcacatgaacagggcttggtttccctactttctgcca

SEQ ID NO: 2358 - DNA, 1090 bp, Diabrotica virgifera
acttttgtgaagtgtgtaccctttgagtcgaaggttctaaatctcaggatcctaagaaaagccaccatggttgacgctgcagttttggacaaacttgaaagtggattcgccaagattaaagattccaactccaaatccctcttaaagaaacaccttacccaagaaatcttcgacaacctcaaaaccaagaaaacccccactttcggttgcacacttctagatgtcatccaatctggcttagaaaatcacgactccggcgtaggtatctacgccccagatgctgaatcctacaccgtcttcgctgacatcttcgatcccatcattgaagactaccatgatggattcaagaagaccgacaagcaccccccccaacaactggggtgacgttagcgtattgcatgaattatacacgtcctccgcgaatcacattatgcttcataagctgctcttaggcttctaaagcctgcaaatgaaacctatgccatcaccgaagctgtacaaaaagctgctgcatcatataagtgcaagccagtggaaggaatgctgagccatcacctgaaacaatttacaattgatgctgagaagcccatatttcttttccccaactatgcacagatattacatcattatatatttgtattctactatcatgttcaatatgctatggatgctttaatcagcacaggtgaaggagtatgaaaagaagctgacactagagtttctcgtctattataaatcctatcatatctatctatcgatactcatagtatctgttaatgttctattctgaattgcgggacgaagtatggaaatatgtccttcaacttaaggaatttccaagatgagaacatagcaaaatgggagttgttgaatgagtaaataataagttgataaaacctttccaagtcttatattgaaaaccaggaaaaaatgggggcccccttcaacttccaaagttctgttaatgcctaacgggccccctaaaatccacggaccggccctgggacactgaatttgtcacaataaaaaaaattcattaagcaacccaaaaattaaaatccaaacaccccaacattcttgccacacccac

SEQ ID NO: 2359 - DNA, 1875 bp, Diabrotica virgifera
actagtcgtatacaggtaaattatggcggacgaaaaagatgtggtcgaaaaaacgattgccgaagacttggtggttaccaagtataaaatggcaggagaaattgttaacagagttttaaaacaagttatagacaaatgtatacccggtgcatccataagggaaatttgtgaatacggagaccagctactgcttgatgaaaccaataaggtttttaaaaaagaaaaggaattgaagaaaggcattgcttttcccacttgtgtatctgtaaacaactgtatatgtcacttttctcctgttccaagcgaatctgatttagttctaaaggaagaagatgtggcaaaagttgatttgggagctcagatagatggtttcatagcagtagtggctcacacaataattgtaggttcatctaacaacaaaaaggtcactggaagaaaagcagatgtcatcctcgcagcacattatgcttcacaagctgctcttaggcttctaaagcctggaaatgaaacctatgccatcaccgaagctgtacaaaaagttgctgaatcatataagtgcaagccagtcgaaggtatgttgagtcatcaactgaaacaatttaaaattgatggtgagaagaccataattcaaaaccccaacgatgcacagaaaaaagaacatgagaaatttgaattagacaaacatgaagtatatgctatggatgttttaatcagtacaggcgaaggagtaggaaaagaagctgacactagagtttctgtctataagaaaacagatgaaatctatcaattgaaactcaaagcatcaagaatgttctatactgaagtgaggacgaagtatggaaatatgcctttcaatttaaggaatttccaagatgagacaaaagcaaaaatgggagttgttgaatgtgtaaagaataagttgatagaacctttccaagtcttatatgaaaaaccaggagaaattgtggcacacttcaaattcacagttctgttaatgccaaacgggccccataaaatcacaggactgcccttggaccctgaattgtacaaatcagaacattcaatagtcgacccagaacttaaatcgatcctcaacagttctgccaaccctaaagctgccaaaaagaaaaagaagaagtctgaaagttcctcggatccacaaccaatggaagtcgaagcagctgcttagaaggatcactacaaaaataaatgaatttcagatttttataaatgctttttcatttcacatttcgattaccaaatggtttggttacacagaaaccaaaggtgtcatctactctaaatctcactggccaaatgccttatttgtcaaaggactgtgacctttttgtacagatactatttactaacaaaccacgggcagatttgtaacgttttacacctactaaaataattcaaaaagtttctcgttttctgtctttaaatcatgttttatcccaatataccaaatagacagtagtggttattttgattgtcaattatagcgtccgggagaaccgatgtcagctaaaattttattatcaatacagcactgttactcataaggatcggaacagcaagcgaattatagatcataatgatcaaaataagatattgtctcaagaagaaagggagctcaagttcaagttaaagtatacacatagttgtacttagggaccgttcaagtattacgtaacgccggttgggggggggggggtcaaaaatcttcaaaaattgcgttacgcaatagttaaactcccataagagtgcgttacggaggggggtaggggggttaaaaatcttcaaaaatcgcgttacataatacttgaacgctcccttaacactttcagctcggggccaatatacatacttatc

SEQ ID NO: 2360 - DNA, 2316 bp, Diabrotica virgifera
ctcgaagtgaggttgtctgtggtgtagatttaattttttaaatattataaacatcccttgaggatttaatttccaagatggtccaaaagaaacctaagaagaaggtaggaaagaaagtagctgcagctcctcttgcagtcaagaaaattgaacagaaaaaagaaattaacccactttttgaaaagaggcctagaaattttggaattggtcaggatattcaacctccccgtgatttatctcgatttgtaaaaatggcccaaaataccttccgtattcaaaagacaaaaggctgcactttcgtccggaggtgggagaggcggctcaaagatttgttctaagcggcgcgttgtaattctcatcgtcggttcatacttttgtgaagtgtgtaccctttgagtcgaaggttctaaatctcaggatcctaagaaaagccaccatggttgacgctgcagttttggacaaacttgaaagtggattcgccaagattaaagattccaactccaaatccctcttaaagaaacaccttacccaagaaatcttcgacaacctcaaaaccaagaaaacccccactttcggttgcacacttctagatgtcatccaatctggcttagaaaatcacgactccggcgtaggtatctacgccccagatgctgaatcctacaccgtcttcgctgacatcttcgatcccatcattgaagactaccatggtggattcaagaagaccgacaagcacccccccaagaactggggtgacgttagcgtattcggcgacttagaccccaccggtgagtttgttgtgtccacccgtgtcagatgcggacgttccatggaaggatacccattcaacccatgcttgaccgaagaacaatataaagaaatggaacaaaaagtttccagcactctctctggccttgaaggtgaacttaaaggaacattctacccattgactggtatgagcaaagacgtccaacaaaagttgatcgacgaccatttcttgttcaaggaaggagaccgattcttgcaagctgccaacgcctgcagattctggccctctggtcgtggaatctaccacaacgagaacaaaaccttcttagtatggtgcaacgaagaagatcatcttcgtctcatctctatgcaaatgggtggtaacttgggagaagtttacagacgtctggttaccgctgtcaatgacatcgagaaaagaattccattctctcacaatgacaggcttggtttccttactttctgcccaactaacttgggtaccactgttcgtgcttctgttcacattaaggttcctaaattggctgccaacatggctaaattggaagagattgctggaaaatacaatctccaagtccgtggtactcgtggcgagcacacagaagctgaaggaggagtctatgatatttccaacaagagacgtatgggtttgaccgaatatgacgccgttaaagaaatgtacgatggtatccaagaactcatcaagatcgagaaagagttataaatcgtctatcagtatgctttatcagttaaaagtatttataagcagtgatgtaaacatattttattttctacttctatttcaaatgccaaaggtattagcaaagtttacataagatgttttattcaatgaaacgttgtagtatgtaaacagttatattctagtcaacattttgttttaaacaaaaaaaattaaaaaactaaaagtcatattgggattattatctatttttaaataaatttttttataaaaatcctaaaaaaaatagtatatttttaaaaaaaagaagccgcctccattttttttttcttatggtaaaaaattttttaattttgtcttaaaaaaacaaaaaattttcttccaacaagccccgtccccctaaatttttttttttaaaagaaaaagagataaaggggggggcaaaaaaaaaaaaaaaataataggttcgtgcttcggttcatgtttaaatggaaacgtgtagtatgtaaatggcaaaattgcttaattttggaagagattgctggaaaatacaatctccaagtccgtggtactcgtggcgagcacacagaagctgaaggaggagtctatgatatttccaacaagagacgtatgggtttgaccgaatatgacgccgttaaagaaatgtacgatggtatccaagaactcatcaagatcgagaaagagttataaatcgtctatcagtatgctttatcagttaaaagtatttataagcagtgatgtaaacatattttattttctacttccatttcaaatgccaaaggtattagcaaagtttacataagatgttttat

SEQ ID NO: 2361 - DNA, 1155 bp, Diabrotica virgifera
ctttttttgacccacgcgtcacagcgactcgaagtgaggttgtctgtggtgtagatttaattttttaaatattataaacatcccttgaggatttaatttccaagatggtccaaaagaaacctaagaagaaggtaggaaagaaagtagctgcagctcctcttgcagtcaagaaaattgaacagaaaaaagaaattaacccactttttgaaaagaggcctagaaattttggaattggtcaggatattcaacctccccgtgatttatctcgatttgtaaaatggccaaaatacatccgtattcaaagacaaaaggctgtacttcaaaagagattgaaagttccaccaccaattaaccaattctctcaaaccattgacaaacaaacagccacccaattatttaaagtcttggaaaaatacaggcccgagacagcccttcaaaagaaaaataggttaaaggctaaggctgaagctaaggttgccaagaaagaggaggcacctgctaaaaaaccaaacacattgaaggctggtaccaatacagttactaagctgatcgaacagaaaaaagcccaattggttgttattgcacacgatgttgacccaattgagttggttctgttcctaccagccctctgcagaaaaatgggtgtcccatactgcatagttaaaggtaaagcaagacttggacttctagtaaggcgcaagacttgttcatctgtagctcttacacaagttgactctggagacaggtccaacttcaacaaacttttggaagtaatcaaaactaacttcaacgaccgtgttgatgaaatcaggaggcactggggtggtggtttgcttggatccaaatctgctgctcgtattgctaagttagagagagccaaggctaaagaattggctcagaaacaaggttaagaggaaggttttcttgttttaataacaggactttgtaataaataaatttattaagttaaaaaaaaaaaaaaaagggggccccccccgggactaaaaacagtttcatagggggggccgcctgccaatattccctgctcctggtccggggtaggaaaaccccagccggaaaacccctcggcccaaacccaaagggcctaggttaaaagagcccccccccctaactatacccccccccctccccccc

SEQ ID NO: 2362 - DNA, 1282 bp, Diabrotica virgifera
cgacgaactggagctggatccagaagagaagaaagctgaagctgctgcaggtggtggtgatggggaaggaggctgggacgttgaagatgaaggattggaaatacctgatttaggtccatcggttcctgttgaagcggagggcaattttgttcatttgcctacgcaaggtccatccccactggttacatggaccaaaaattcgcagttagttgccgaccacatcgctgccggttcatttgaatcagctgcgagattgcttcatgatcagttaggagtagtcgattttaaaccatacgaaagcttatttattagtttgtatagcagttccagaacagtttattcttggcagcaaaatataccgccatcatttagctatccgttgagaaattggaaggatgccaatgttaagaaccagttgcctgcttctggcgtgaaattgaatgaactagtcgccaaattacaggcttgctatcaactcactacaggaggcaaattcacggaagccatagaaaaatttcaaactcttcttctctcagtaacgttagtagtagtagagaataaacaagaaatatcggaagcacaacagttgttgaggatatgtagtgaatacatttgtggtcttcagatggaaactttaagaaaaacttttaccaaaagcttcacatgaagaacaaaaacgtcaatgcgagatggcggcttacttcacacattgtaaacttcagcctatacatcaaattttaacactcaggactgctctaaatatgttctttaagctaaaaaaattacaaaacagcagcatcatttgctaaaagacttcttgagctcggcccagaacctgaagaactcaacaagctaaaaagatctttcaagcctggggtaccaatcttgcccatgatttaaaatggaggatgatgaactaatcccttttcacccgggggggcctttcttatccccaattttaaaagaaaaacccaaaaaaaagggcccgtggggggggaactttttttttcccaaataaaagggaaaatttggggagggtttgcccgggggctgaaggtggggaaagggtttggtttgggcaccccaaaaaatgcgcacccccttttaaaaaagggtaaaggcgctttttgttttttggaaaaaagataaaagatattgaaatatttgtgggaacctttttttctcccgggcgaagaaagaaaatggttttttattattataattttttttttttttttttttcaaaaaaataaaataacgtggttggggaaattaacaatat

SEQ ID NO: 2363 - DNA, 896 bp, Diabrotica virgifera
  misc_feature (745)..(745): n is a, c, g, or t
  misc_feature (796)..(796): n is a, c, g, or t
ggcactttctttttcgttggatgtctttgtaggttttaaaaatgggagcctacaagtatatacaggagttgtatagaaaaaaacaaagtgatgttcttagatttttactgagagtgagagtgtggcaatatcgccaattgactaaactccacagaactcccagacccagtcggcctgacaaggctcgcagaatgggttacagggccaagcaaggttttgttatttaccgtattagagtacgacgtggaggacgcaagcgtccagtaccaaaaggtgccacctacggtaaacccaaaagccatggagttaatgaattgaaacctgtccgtaacttacaagctattgctgaggaacgtgtaggaagaaggtgtggtggattaagagtcctaaactcctactgggtagcccaagattcaacatacaaatattttgaaatcattttggtcgacccctcacataacgctattcgcaaggaccccaaaattaactggattgtcaactcagtacacaaacacagagaactccgtggcaaaacttcctctggcaaatcatctcgtggtttgggcaagggtcacagatactctcaaaccaagggaggatccaggcgtgccgcttggctcagaaggaactcactgcaattgcgcagaaaacgttaaaatttatttttttataattagaccaataaaatttacggattaaaaaaaaaaaaaaaaaaaaaaaagaaaaaaacggggcggccgcccgncgatctagaactagtcgtccagatcttcctccaggttatggtgggtgcagncttatttgacggaacctcctccagaacccatcaagtgggtttttacccagtgcggacccgccatcttttggaaacttttcaaaaaaggggaaaaagtcgg

SEQ ID NO: 2364 - DNA, 1614 bp, Diabrotica virgifera
  misc_feature (59)..(59): n is a, c, g, or t
gaaatggatttttgagaagagcagcaggaagatctagaagaaaaatgatcaccaacgancgcattagaaaataacagaaggaaagagaaacgaggtagacgagaaaaagtttgagcgaaggaattaacaaagagctgagagaaagagacatagaagaggcggaaaacgttataaactgacatgtagtagtagtagtactagttaatacatatggtatttaactaccaataagacagaaaataatcgattcgtataaagcactatagattggtatcagtttgttggattgtatgacgaattttttaagttgctatgtattaacggctttggatagatcggacagaaagatatgtcaaatccggatgacaggaaagaataaacgtcagtggattattttattctcattctgaaatattcgcggttaaaaagtctttcatattcattagacgacagataagatagtaaaatagagctagagagaatagggggtgagtcgcactagtctttgtagacaaaatcagcataacgcctggtttcataatcaacttaaagtgaacattaacttaagttcactttaaagttgacatttacccatacgaattgcattgacaaaggtaccaacttaaaatttaaaatccactttaactgattatgaaaccgggcgtaaatatggtcacctataattctgtggactcgctttttttagctatgaagagattatatttacgtataaaagtgttaagcaatattaattactagtttacgtattaataagtggctagaggaattgttttcttcagtctcgttcaaaataaattttaacatatatatcatagcagatagctacacaaataaacttaaaatggtttaatacagtataaaacagaaattctgaattgacaaaaaatctagcggacaaacattttgatattcagaataatttcgccaacaaacagaatttttactgaatacctcactcaaaggtagtgtataatttgacccaacatattatcgcaccctcagtaatatagaggcacaattcaaaaaagtagatttttgggaaatcgcgtttaaagattctggtttccacaacctctggattctggtattttttcaaataacatgcttattatttaagttataaatgtgaaattcggcagatttgttatttgataattgcactataaacagcgatgagaaaaaacattaatataaataaattccattaattacatgtaattgaaaaaaaaacactttctcaagttagttccatatagtacaaaaaacataacagaaataaggaactgttaagtttgatcccttatattattatgtcactgtttatgcaaaataacgatctattatgaattagagccatttatttactatattttgcacgatataacggctcaactaaaaactattctataaaatacagaatgttaaaacacaaactaaccaggattttccaaccattcatgttctttttctccctctgtcaatgctaaccggtagagaatttcattttgtgcccatatcattcaaagtcaaaattaacacaaattttgagttgagcccttatattactgagggtgcgatatatttcagcgattt

SEQ ID NO: 2365 - DNA, 1368 bp, Diabrotica virgifera
cacatatcgacttgtgcaaatcatttgtccttctaacatgtgtataaagcgacgtttgttgagtaaagacagtatatgtgattactttattcaaaacaatctgcgtatgtgctcaagaaaagtgacacatttatcacttatttatctttctttttgcagtacatattttgtgtttaatgttgttaattgtatttcaagttacatcattaaaaagtatagtctctgttaaccagataataataatgatattatattctgtatgcaagtgtcacttttgataaataatatttcgtaaatttttcgatattttatctgtaggtatagtgtcacaactcaaaaaaaaaatgtttttttaatatacttaatacgctattttctagagcttcaaaaaccattgtaactgactaaaatagttattattctaattttaatagtttttgaattaatgttgtagaacaaactttaaacgtcgttttctcgaaactttgcttttttgacttatcgacagtctttgagcggaggtgcgatatctgttttgtgtttttcgatgtttatctatggaaatatgtacaataattaacgatttgatcccaattaacctaacataacctaaataactttttaagcctgagcaatctcttttatgagttttattttgtatttccacatgagtcatgtgagttattggactaacttctcacatttgaggtgagaaaacccttaacaattccttaaatagatgtattttggtttttttgggtaaattttgactctctttaaatgtgtaaaagtgatatttttggtaaaattgtttgtaaacttccaataccagttatttgcttctagataagttttgtatgtatatagagtaaatattatgtattttgcaatttttattgttaatattattataaatgttatacaagaaccacactggtggttcttttagtgaagcactgacactaaatagtcaataaagttttttttcttcccttaaaaagttgtctaaatctaaaaattcctttaattcttacacagtattaaaaacaatcagtagtgacactctcgccggcgccattgaagtttttgaaatctcgttttgtagaggcagccatcttgttatctgtcatatgaggtaaaaagttacgaccggactggctcaatgaaaaatctttctggtaaattactaaatgccctattgtaggacttacgcccggtttcataatcagcttaaagtgaacattaactaaagttcactttaacgttgacatttacccatatgaattgcattgataaaggtaccaacttaaaatttaaagtccacattaactgattatgaaaccgagagttacggttagaaatattgga

SEQ ID NO: 2366 - DNA, 3146 bp, Diabrotica virgifera
aatccttagttaaaatatcaaaaaatttattaattaaaagagaaataatgtttgtttcaattcccccttccgttaaattttcattatcaagacaaatatttattacagctttcactatatattcatatctacatcaattcaaaagaactgacaacataattctatagttaaaaatttaacttaaagcttaccatgagcaacattgtacattacaaaatacataaaaagattacaaagaaatatatttaaaatatttgagattcgacagatacatataaacaacacataaagtcatttttattgtgtattagagtcatttaattttttaacattaaaatatgtattaaactatacagtacaaacatttataaaaatatgtataaaactatggaaagcaaatttatgacaggatatattggaacatttagttaatacatacattattagacaaaaccataagagggagaaatagtttaggtagaaaagccatcacaatgttaaacagcattttatgggaccaatccatcagcaaagaaaataaaaagaggatatatgagacactagtgaaaagtatcactctatttaaaaagctgtgcatcatggccactaaaataacgaaccctggcaacgatgagaacggaaatggatttttggagaagagcagcaggaagatctagaagaaaaatgatcaccaacgaacgcattagaaaaataacagaaggaaagagaaacgaggtagacgagaaaaagtttgagcgaaggaattaacaaagagctgagagaaagagacatagaagaggcggaaaacgttataaactgacatgtagcagtagcagttaatacatacggtatttaactaccaattagacagaaaataatcgattcgtataaagcactatacatagattggtatcagtttgttggatagtatgacggattttttttaagttgctatgtgttaacggctttggacagatcggacagaaagatatgtcaaatccggacgacaggaaagaataaacgtcactggattatttcattctcactctgaaatattcgcggttaaaaagtctttcatattcattggacgatagatagtaaaatagagctagagagaatagggggtgagtcgcactagtctttgcagacaaaatcaataaatatggttacctataattctgtggactcgctttttttatctatgaagagattatatttacgtataaaagtgttaagcaatattaattactagtttacgtattaataagtggctagaggaattgttttcttcagtctcgttcaaaataaattttaacatatatatcatagcagatagctacacaaataaacttaaaatggtttaatacagtataaaacagaaattttgaattgacaaaaaatctagcggacaaacattttgatattcagaacagtttcgccaacaaacagaatttttaccggacgcgtcactcaaaggtagtgtataatttgacccaacatattatcgcaccctcagtaatatagatattattaaaatttgagttttaaaagttcaaaaattacatatttttacgggtacttttaagtccccttatttatattttataaattataaaaaaaatcaatttttgttttttacgtaaaaacattccttagtatcatagaagtactatcctaaaatgttattaaaaaattcgaaattgaaacaaagttgtagctgaatttataacggtacctgcctgagataaaacttttttgtacacaacaacacgcgcgatgcctgacctatgcagctgcaacttgatagtttagaaaaacgagcacgtgttttgtattattgaaatttatcaaaagttattgttttgaaaatcggaccaaatacctggatcttgtggtcatttaaaaggcaaccgaactaaagggatgcatcgaaataggcatagtattagtaaaaataaggtttgactgaccatttacagcttttattggacagtgtggcacccaataggcacgaggaatcgctgattacagagggaaaaaaatgaatagtatcaaatctgtttgttggtttaaagtaaaaactacataaaatttctaaagattaacaataataatggaaaaactccagtaaaaaattatacgtgcagattattagtattcgccaatgagtgccagtaaacactttttgtaatgtccggagcagtcgcccttaatagcatcagctaaagattcaccgtatttggcctggtattcgctcttaatttcaaccatgtcaatttcagacctcgttactaccagtcgaatcaactgtctatcgttggttcctagcccttttatgctcttattcaaatatttagcaaagaacgccgcttggttctttatggacctgataatggctaaaagagcatcttccgagtctccagagaactcatttttgacagctttctcgatatcgtggccggtgatcttctggtactcttggaaaacgagctggagctgggcgtagtttctttggcataaaaccatgttgaaggtggattcgtctgtgcccaaacgaagctctccggcttggagtagagcttgggcgtcttgtaaagctctttgtggatcggtgacgttgctttcgtccctggatgcgttacagagagagaccatcaagcgcttgaatgtgccagcggtgtcgcctttgagatcgctttctaacgatctgtaatataatttgtggtacgcttccctgatgaccataatttccctgttggacatggtacacatgacctcgatgaggacgtcttcatcagttccaacaccgctcatagcatcgtgcaattctttggcgtagtattcgggaagaggagtcatcatagccacgatgcagttttcgaagtttccgctgagttcactcttcaagtccttgatcaaatcctttccgtacatagttttaaacgcagcagcaatatgtagtctctgttcattggttcttcttgccaagcaattgataatggccttctcatcggttccgaaacctttcatcgctgttctaagaacttgagcatcatcattggggttgaatggttgggcaggtctgacggtgggagtcctcatttttgctgcttcttttagcgaacagaactagccggacgcgtggg

SEQ ID NO: 2367 - DNA, 946 bp, Diabrotica virgifera
tcctcgtccgaagaaagcaaggaaagtgattaacctgaatgttggtggtgatctgtgctgaaaaatacaattttttcgtaaaaaaacacaaagtgaaacgatgtgatgtgttaataaccttaaaattgtagtgttagtacctgagaattcttggaaaatgctttccgagccctcaagaagaccaattcgggatcaggaattggccatagatagcgttgtggctacacaatcagaacttgggcccagcataccagatgggggatatggatgggttgttttcatcgcaactttgttttttcaggctttaattccaagtttgcgagtcagttttgggatatttctagcaatgtcaaggctccaattatatacaaaggacgatcaagatccaaagctatgggacgatggattcatgtatgcacctgtcttatttgctgctgtttgggcaatattcgatcctacctcgagattccttatttcaaatagcacatggccgcgacttgttgctactgccggcacttgtttgacatgcgcgggtcttctttttttatggatgggcctggctgaatattctggaggaatattgtttccgctggcgggaatagtttgtggtattggagcctctatagaaatagctcaatgtgaaatactgctggctcaatatttcagagtaaagcacgctattttggctaatgtatgtcaaggaatggcatcttttggcttcgttatcgtccccgttgttataggacacaatgtgttaagttctagtctattgcacgtagtgttatggtatcaggctattattttacaaggtttgatatgtaacatggtgttcaaaaaacctgcttatttaaaatcgagacaacgagaaacatataactatataacgtccaatccagatgatcaaaaagactttttatccaaaaactccagagagctccagattaaa

SEQ ID NO: 2368 - DNA, 900 bp, Diabrotica virgifera
  misc_feature (831)..(831): n is a, c, g, or t
  misc_feature (882)..(882): n is a, c, g, or t
gagttctacaaggagtccaagttaaggttcgattctgatgaggactttaagaagagagcttatgccagtgttgtcaagttgcagtcttttgaaccaaaacataaaaaagcttgggaattaatttgtgatgtttcacgacaagagtttcaaaagatatatgacaggctggatgtttcaataatcgagagaggcgaatcattctaccaaagccgtatggaaaaagtagtaaaggagctagacgaaagaggcctacttgagttagacgaagggcgtaaagtaatgtggggtggcacaaccatcccacttacagtcgtgaaaagtgacgggggcttcacatacgatacctcagacatggcttgtataaaacaacgtctcgaagaagaaaaggctgaatgggtaatatatgttacggatgccggccaagccacacactttgaaactctggttggctgtgccgaaaaagccggaattttgaaccgagctgttcatcgtgtgtatcatgttggttttggagttgtgttgggtgaagataagaagaagtttaaaactagatcaggtgataccgttaagttgtcggccttgctagatgaaggattgagtcgagcgttggataagctaaaagagaaggaaagagataaggtattaactcctgaagaattaaggaaagctcaagaatccgtagcatacggatgcataaagtacgctgacttgtcgcacaacagaaaccatgaatacgtattctctttcgacaagatgttggacgataagggtaacactgccgtctatcttctgtacgcattcacccgcatcaggtctatcgctcgaactgcncacttcacatcagagaaagatcaagaactgagtaaaacaaacagtatcacngtggacccacgaaaggaa

SEQ ID NO: 2369 - DNA, 1534 bp, Diabrotica virgifera
tttaaaaattttctttttgttggttaggttctttgagcctttatgtagtttcaatttatttattaatttatttttgtctactaagaatcaatataggtattatggatcaagatctcgttagatataatcttgaggcagatactgctctggaacaaattaatttgatgaaagaaagtttaaaaggcatcaaaagtagtatcgacggagtgtctcttcaacctactaccagtgacgggcagttgaacaaacttattactgaaaatattaagcttaaacatcgtttgtcaattttaaacagggctattgcagctcaatcagcgaagaaagctccgaacctaccaatggatcaaaccagactgcagagcattactgacatactcacttacatcttttcaaatgctatttcaactgcatttccagatattacagatgccccagttgtaattgctttatccggcgcaaaccccaaatttggagactaccagtgcaactcagcaatgcctatagcgaacatctacaaacaactaggaaagaaagttgtgccaagagatatcggccaaaaaattgtagaaaatgtgccttcccatgaccttatcgccaaaatggaagtcgccggtccaggctttattaatatatttttgaacaaaagctttgcggttaagaacttatctcgtatttttgaacatggagtcaaatctcccgaagttcctaaaaaaatgagggttttagtcgatttttctgcacccaacattgcgaaggagatgcatgtaggtcatttgaggtcaaccatcattggagaaagctattgcagattattggaatacctcggtcatgatgttataagaataaaccacgtcggcgactggggtacacagtttgggatgctgatcgcacatttggaagataaatttcccgatttttatattaaatcacctccaatctctgatttacaagagttctacaaggagtccaagttaaggttcgattctgatgaggactttaagaagagagcttatgccagtgttgtcaagttgcagtcttttgaaccaaaacataaaaaagcttgggaattaatttgtgatgtttcacgacaagagtttcaaaagatatatgacaggctggatgtttcaatcatcgaaagaggcgaatcattctaccaaagccgtatggaaaaagtagtaaaggagttagacgaaagaggcctacttgagttagacgaagggcgtaaagtaatgtggggtggcacaaccatcccacttacagtcgtgaaaagtgacgggggcttccataccatacctcagacatggcttgtataaaacaggcgtctccaaaaaaaaaagggtggatggggatatatgttacaaatgcccgacaagccacacccttttgaaactctctttggttgtggccaaaaaaaccggaatttttaaccaagcgtttctttggggtggtttatgttgggtttttggagtttgtgctggggggaaaaaaaaaaaaaaaatttaaaacacaaaaaaagggggaaaccgttaaa

SEQ ID NO: 2370 - DNA, 961 bp, Diabrotica virgifera
accacgcgtccgcccacgcgtccgcccacgcgtcggcaggatagtgggtttgtagtgtgcctaaatgctcagccatggcaaaattattgcgtagaaccaccatgtggacaatttgatcctacacaagataagttatatgatgttattgaagacctttatggtgacatgctggcccaatttgaaccagaattatttcatatgggcggagatgaggttgcctttcaatgttggaaaagcacgccaaaaatcgtcgagtggattaaaagtaaaaattgggaaaccacaacggatgaaggctatttcaaattatgggagtactttcaaaataatgcattggagagactttataaaaaagcaggtaaaaaaattccagccattatgtggacgagtcatttgacagaacctcaaaatttaaggattttaccgaaagaaaaatatataatacaagtttggactttgggcaacgattcacaaattaaaaacttattagaaaaagggtacaacataattctaagtaattacgatgctttgtacttcgattgtggatttgctggctgggttcaagatggaaataactggtgttctccttatattggttggcagaaagtatatgaaaataagcctgaaaaattagcaggaaataaagttagtcaagtgcttggagctgaagcagctctgtggacagaacaggctgactccgcatcagtagatactcgtttatggccaagagcggcagccatggctgaagtactctggtctaatcccgcaactggatggaaagaagcggagcatcgatttttggtacacagggaaagacttatatcccttggaatagatgctgacgcaatagaacctgaatggtgcctgcagaacccagaacaatgtaaaataggtgccgcttttatagtccaaaaattgactttaaatgtattgttcgtataattaataaaataattattgt

SEQ ID NO: 2371 - DNA, 1307 bp, Diabrotica virgifera
tataaagtgagcgattaattttttcccacgcgtccgctatttttgtggacgaattatctatatatggattaatttcttgaaaggtgttcaacagaaatatggctggtcaaggatttttattcaaaacattcaatgttttcaatagcagaattatatctgcaaataggttaaatgtggcaaatttccaaacccccaccaggaccataaaaacagagactaaggaaagactcaaatccttaaatattcctgaaaagccgaagaaacctttaacgccctatttacagtatgttaatcaaaagcgaagtactatagttaaggaaaatcccaatatacttcccaaagatgtattaagaaaactctcagaagaatggaaacaagtgactgaagaagaaaaggagaaactgaaggaaaagtatcaaaaagaagcagagatatatgataaagacatattaaaatttaatacagctttaactgcagaacagagagaaatcttgcagatagctaataatgaaaagaaagaagacagaaagaaaaggaagattacgaagttattaaaagaaactcacaaacccaaaaaaccacagggtccttatctgttatacctccaagaacaaagtaaaattagaaatgttcctcttaatatcctgataaagactgtaaagaatgactgggcgcaggtatcagacagccagaaggagaaatatagagctcaatacgctaaggaacatgaaaaatatgagatagaattagaaaattgggagaagaaaatgatcagcgaaggccatccagaattagttagagtcaagcacagagttccagaagagaggccatctaggattctagacctgaaggggaagaagcctagtaaacaataggaattcgagtgtcttcactcagattcatctgccgctactgcgggtgaagacacgtttcatattgaaacaaagaaacaaactgagaaagaatgtctcgaaaatatgaataaaaatcaacaaaactcgataaattcagaaaatagtctcatcaccgggaaccccataaattcagaaaataatgtcattacaggggccaattcccagggatctatttctgataataatcattttaaaagaagtgaatctgtaaaagattctaaagatcctgataatttaagttctcgttctgtttcttttgatcggataaatgaagtggcagagaaaaccagctcaaaggctaactattccattaaagaggaagataaaccaacaccttcagagttaccggaagataagaaagataatcaagaaaaaaaaaaaaaaagggcgaca

SEQ ID NO: 2372 - DNA, 1018 bp, Diabrotica virgifera
gagtagccaagtaatggtatcaattttttcaaattattttgagaatacatcaattttagatgtaattcaagtatattacagcagtattattttatacgtatcagatttttttgaagttgcccgtgacaaggaagtatttacctacttggaaattgtgggaaatatatttgatgattttcagtggaaattcttacagatcttattcggattaatactgtttaatctcatatcgattctcattgtctggaaatatttcggtgactcaatttatgagcggttcatgtccaatcctacactacgagaaatcgaagagcttaaagccagtgtttcaaagttaaaacttccaaaagaacatacacctaggatttaaaattcctattaatatggcggagaaaataaagaaattctttgccaagaaaaaggcagatgctaagttcaaacttgctggtccggggcataaattaactgaatcatcatcaactgcatcaaatcagagtaagccaagcaagggtgcatatgtgccacctaaagttgaacctacagaagctgcaagacaagctgctgaagctgcattgtttcgattacagggacagaggaaagatacagctttcaatacgtcgtttgcagcaattcaagctaaagtaagaaaagaattggaggcggaaactaaaaatcaaaaccaaccgcaagttcctgggtcaccaacaaagagtacagatgattatgagtgttcccatcacatggctgttaaaggtgtatatttcaagtgtccattaattagtgatgaagtgttgcccaaagaagaatgtgaagtaaaaataaaagaattttttgttaatacattggaagaggaaagaggaatgacatctgtactgcttatatattctttgcattacagcaatactaaggtaaccgaagctagtgatgttttatcgtacctcatagtctacatacttctctatttcgtctggttaaataggtacccgcgtccgaaaaaactttcaccttgcgacctttt

SEQ ID NO: 2373 - DNA, 1326 bp, Diabrotica virgifera
agaatttttagcctagcgaccggtaatattgttttctttttgtttaaaaatggtttagagctaatctccaaaaagtgctgactttcggcgtacactgttgcgcttgaaattttagtatttgttgtgatttttattcttcccttagtaataaaagttcatgcaaaaaacaaagaatactgtattcagacaagaatgtagtacaatgatcaaaatgtttaagacaaggcactaagtcaattcataaaatctatacacatagagcattcagtccacacatgcacatacaaggtgaatattaaattactcatgaaagcagtgacacagactaaaatttgtgttgccattctgcttattgctctttcaaaacgtgtaacaacgccgataaaagaaaaatatattttttacctaaattataagcgctttttaatcagtagcgtcaattttacatatttatctgactttaattttgcagctcaattacaagcctttttttaatcaatagcgtcaattttaccattcgtttcgttgaatttaataactcaatatatttaagagggtgatcaaaaagttcctggacaaatacttaaaaaatcatctaaaaattaaataaacactctctatttgcttaatttactacattataccctttaagagactccccttttgatgaatatacatttccgacatcgtttctatagtcgaaaagactagtttggttattttagaatccattgttttttttttcagttgattctgaaatgctctcttgagcttgagaatcaataaatagtctacagggataggcttggtgaataaggaggttgccttatcacaaacaagctattttccgcagaaattgggaacgagcaacgaagaatgaagtgttgcgttttttcctacacctgttacgcttttggcgatgtaattgattgacttttttttaagtgattgtcattttaaaaagtccacctatgattttgcgttttactgattccccttaccatttatccctggttccaactaataacttgcctgaaccctattttttccccccccacaaaaacccccccaaaaaaaaccctgaaaattcaggggggggggtttttgttcttcaaaaaaaatttatttgtcttaaagggttttattttctttttttattttaattcttttgtgcgcctttcttatgtcccgcgtctctttgtgtccccttttcatggaactccctcctcccttttttctcttctccttttttttataattacaccaaggaccaattctctcttttcttttttatttcctcaacaaaatctctatacccgccccccc

SEQ ID NO: 2374 - DNA, 1175 bp, Diabrotica virgifera
aacacgcgcgtccgcccacgcgtccgcccacgcgtccggatgaaacatgaacaatcgaaagagcctgacagcattggaccaaatttgagaagtattgtaactgtagtaatcctattattgttaatgttgtttgccgtccattgtacttgggttacaagtaatgcttattcgagtccaagcatcgtgttggcttcatacggaagtgatggatctagacaaattcttgatgacttcagagaggcctacttttggctttctcaaaataccgccgacgatgccagagttatgagttggtgggactatggttatcaaatagctggtatggcgaataggactactctggttgataataacacgtggaataacagtcacattgctttggtgggaaaagcgatgtcatccaacgaatctgctgcctacgaaattatgacagctttagacgtcgattatgtattagttatttttggcggtgtcatcggatattcaggtgatgatattaataaatttttgtggatggtccgtatcgctgaaggagaacatccaaaggatatcagggaaagcgattacttcacggaacatggtgaatttagaatcgacgccgaaggttctcccacattgttgaactgtcttatgtacaaattgagctattatcgatttggagaattgaaattagactacagaagtcccgcaggatttgaccgtactagaaacgccgtcattggaaacaaagatttccagctcaattacttagaagaggcttatactaccgaacattggctcgtaagagtatacagggttaaaaaaccagatgaattcaacagacctagaatccccgttgcaaacagagtagttaaaacgagtaactacgtatcaaaaaagaatactaaacgtaagaagggtagcattaaaaacaagcccattatagttaaaggaaagagactgtctacaaaacaatagattaaaatctataaaatagttatataaattaatattttgttgttctcgttattgttttcttttttattagatttttcatttacattacaaaagatttttattcagaagagggagttacatatgtttcacatttttaaatgttttttcagaaaacttaaaaaaattctttgttcactatgtgataaactgtaaaaaatgcaaatacaattctaaacctt

SEQ ID NO: 2375 - DNA, 1148 bp, Diabrotica virgifera
actagttctagatcgcgagcggccgcccgcgatcaaatttcttttccaggtggattttataaaaattagtgccaaaatggcaggtcgtagcgcaaatccaaggagaatacccgaaaatgaatcaacaattcaatacgttcaagccgatggattggctgtaatgaagatggttaaacattgccatgaagaatctactaccaatatggacattgcacaaggggcacttttgggattaggagtagataatagacttgaaatcaccaactgtttcccattccctaaacaaactgatgaaaatacagatgaagatgaatatcagctagcaatgatgagaagacttaggagagtaaatgttgatcattttcatgtaggatggtatcagagtgctgatgtgggcaattttttaagtcttccgcttcttgaatcacagtttcattaccagacatccattgaagagtctgtagttgtaatatatgatacacagaagtcctctagaggtttcttaactctaaaagcatacagattaacaccacaagctattgaaatgtgtaaggaaggtgaatcaactccggaagctcttttgaaaatgaaagttggtttcgagaacctatttgtggaagtaccttttattataaagaactctccattgagtaacattatgatgtcagagttagcagacctagttccagaggaggaaggttccaaattcttggacttgggaacagcttcagtattagagggacaattaaggtgtttaatggacagagttgatgaattaaatcaagaagcaatcaaatttaacagataccaacagcttgtaagtagacaacaagacaagcatcgttatctacaaaagagagcacaagagaatgcagctagagttgctaaagatgaaccaccattgcctgaagaggatatcacaaactgttcagaccccatccagtacctcctaggctaaacccattgatcatagcaggacaggtgaatacatacagcaaagccatttctcagttctgttctcagtctttggctaagctgtacattacgcaagcactacaaaatggtaaagaagcaaactctaatttgtgagaactatctatgtaagttatattatactttatgagcattaagagtttgtattcatcttt

SEQ ID NO: 2376 - DNA, 973 bp, Diabrotica virgifera
tgagttcttttgtttgttgctgtttgcacacatttatttttatcttcacattttgtgaagaaagaaaggcgtagaaattaaattaagtgatgaatattactagatttataggctataatgtaattttaaaacctgcaacggtcgcaaaactacaaaacaatgggttaaaaatatgtttaaattcaaaactaccaagtaacaaagagacctcttacttaagacagagtcatgtcaagtttgtttctacatatgaggtaaaaaatgagcaaaaaggtgagagttttctcaagaaagctttgaagaagattccttttattaatgttgatcgagtgaaaattaaaggtagggggtacatcttgtatgaagaaatagcagataaaattgactatcttgaattttttaaagaatttgaattgttagatactttttactcatggttcacagtaactgagttacatatttggatgttgagtctaagagctatggcagaaggtgaaaatgggaaggatctaaggaatgctatcgtagaagctttgtggactgatgttgcacaaagggttaaaagattagggtcaggcagtccatctatgttaagaaaccaaatagtagaactatctgagcaaatgcaagctgcattcatatcctatgatgaaggtattcaatctgatgatatagtcttagccggagctatatggagaagattttataagatggaacatgcagacccctctaacctagataaacttgtgaaacacataagaaaacaggtttgtgttttggataatatgtctttctgaaaacttatttaaggagacaccaattcattggttaccagtcaaagaaagttaacgtcattatactaatttaacttgatatagaataattatatttgtacatagttgttgtattgtatttattattggaataaattaacactaaaaaaaaaaaaaaaggcgggccgttctaaaggatc

SEQ ID NO: 2377 - DNA, 541 bp, Diabrotica virgifera
agctaccaaattaacatcaaacatgaagcaaatcgtttgcgcatttttctgccttttcgtcgcttttcaactagctgatgcttttgctcaattccaactgcgcgaagggaactgcttaaacgcagttgcagccgatttggttcatcaggagcacgtgcacaaaagtagagtaccttttgtcactagatcaaccacagccaagtattatggtgacaagaaaatctactgcatcatagctactagtcagaaggatgcttcaaagggttcaacagtcgaaatcaaggatggtggtgttaaccataacttcgtgaactttgaattcaactccagtaaaaaccatggtttagaatacaacgtacaagtttatgccagatatttttaatttaagttgatttttttaatttacagattttcatttattaaattttttataaaataaaaaaaaaaaaaaaaaaaaaaaaaaaaaaataaaaaaaaacaaaaaaaaaaaaaaaatacaaacacaagaatgaaaaaaaaaaaaatacttcaatagagaaaa

SEQ ID NO: 2378 - DNA, 556 bp, Diabrotica virgifera
cgcctctggttcatcttgtttcaaaatagcgccttgaattgaaatgtttgagagttaacctctaaatttagtcaatctgtttaattttataagcgaagtgatattaatttcttatataattatgaataaaactgtagatattgataactaaacaactcattctatagattatcgtgacttagaaactatcgtgacaattactaaggaattaactagtttattattattgttttgttgcaacttgccaaggttcgttcgtaaataaattaacagagcgcacaagaaacaagtagtttcaaatcggtagcggaaaatgtcttttctaaagaaaatcgtgtttcctttgtatgtcgggtttgtgatattaaatgtctattctttgagactgcaactcgcgttgaatgaagtttctgagaggcctaacggggagatgttcagccatctgaaggtgtaccactattttttcctgaccaattggaattttatgctccaaatcttcttcatttcgctagcgggcctatatgaactctcaaaatttctgagcttaccattaaaa

SEQ ID NO: 2379 - DNA, 1365 bp, Diabrotica virgifera
ccaacaacaatatcaacctccccaaaaccaataccaacctccacagagtcaaaaccaattctctaggcctacagctcaggctgtacccttccaatatccttctgaacaacaatatcaaactcaatctactcagcaatatcaatattctcaacaatatcaatcttccgaacagagttaccagtctcaacctcagggttatcagtccgttccacaatcttctcaagtgcatagtgttccaatacaggtacaaagacaaacttcaaaacctgtggaacctcccccatctacaatcactctccgtcctcaggctccagtgagccaggctccaccaccagtttacacttctcaaccagccacggcgaccctaaaaggtggaaaacatctccgaggagatatgaagtggcctccagaaaacgtcaaggtccaagccgaagaagagaacaggctacgtcttgaattagccaaaggacctgtttgtaggccacgtaaagtgcatagggattacacagagttctttgatcagcatgctctaaattccagttatcccggatacaaaatccctccaggcactcagttctatagagccgaataaatatattttaggtcttttgttattttctaatttaatatgcttatttgtaagtctcatttgttattaacacatggtctgtataagattaactatctcgttattcgaagaggatgcattatctttgaatctgcttgtacaaaatataaaaacctactcaaaagaacgctcattcaaagataataataatttacaaagatttttcttatacagaagctatgtaaataaatataagccgctacgtttgtgataataacaacctgatgtacctacacttgattttaaaactaaatttcgctttttaccaaaatgagacagtaaacgaacagaagaatcatatagttctagtgaagattgtaatagagaagaggtatggtgtcatttatcaattgtcatatgtcagttgtcaattgtcacatgtcagtcgtcaattgtcatatgtcagttgtcaattgtctaaattttctgttcgtctactagacaaatataggtacaaaaggtacttaagctgaactgatttttgagcaaataactaaatgtattatacggaaatgtattttgcaattgtataaagataataaaaatatgtaaaaaaattcgattttaacctgccgcttaccgaaccctaaaattggtcgactcgactgcttgctattgattgcagcaactattatgtacattattatataataactaggttttaattacttataatgtataaaaaaattatttgtactgtgtacggcagcaaaaattttaaataaaggctaagcctc

SEQ ID NO: 2380 - DNA, 1081 bp, Diabrotica virgifera
  misc_feature (1058)..(1058): n is a, c, g, or t
  misc_feature (1071)..(1071): n is a, c, g, or t
  misc_feature (1075)..(1075): n is a, c, g, or t
tacaaatgttcgttgtacgtttggccggctgcttttaggagttcccaggtagtatgttaatactaaactggtattagtgaaattcgcaatggggacgttatgaaaagaacaccatcaaggtttacctctcgttaaacttgatgtatgtatttgtctaagaaagtgtaaatttgtgcaatttgtgcctcgtttttattttctccgggtttttggtggtacatatacggaaaagttaatgtaaaaaggaagtcaaaatgcatttattgctaatagctggtgatttatcactttttcttggcacagtatattttgtattaagtatattcgtggaaaaatcatataatggtatctctgccaaaacgcagttgctctacatgatagtctgtactacaagatatttcgatgattccagcttgtttgtatgggttattaattttttctcaagctttgctttctttttatcctttagaatgaaagagacatacgaaaagaaatatgatagtttctggacagaaagtcttctaattccgcttttgattttagcagttttcgtaaattacgatcactctcctttcggcatactaaatgctttcagtgattatctggaatcagtggcattagttcctcagctgtacatgatctggaataaaacaaaaattaccaaacacattaaaatctacctctactatatgtacgcgtatatatgcctaaagatgttatattggttccacgtctattatgtgtatggtacattcaacattatatctcaagttgctttggctgtagaattcataattttatctgtttccatagtgactttacactgtaaaagcatgatgaggaccagctacgaagtaaaggttacaaagtctcaaaacatctttcttgtcaattctggattactatcccttaccactgccaaagctgatgaggttccattaattactgatgaggttacattagttaatgaagaaagctgaaaagctcacgataattagaggggcataaaaataaaaaaaaaatttatggtattggttacatattttgaaaaaatatanaaccaaaaatttngagntttttg

SEQ ID NO: 2381 - DNA, 1015 bp, Diabrotica virgifera
cggacgcgtgggatttttaggtgtgattataaaattattcttagacattacaatatttcatataaagtatttatttaaaagatgtatttgtgactggaaaaggaaattagagccctatacttacagttaaacgcttataaatttgtagcaagtattttatctttacaaaagaaagtttatttcttaacattgtagttttatatttttattacaaatggcaactggaactactttgcaaaaagccattgagttagtcaccaaagccaccgaagaagacagaaacaagaattatgaagaagcccttcgtctatatgaacatggagtagagtactttctacatgccattaaatatgaagctcagggtgacaaagctaaggagagcattagggccaaatgtgtacagtatctagaaagggcagaaaaaattaaagaatctgtaaggaaagggaagaagaagccagttttagatggaggttcttcaaaggaagacaaaaagagtgatagtgatgaaggtgacgaagatgatcctgacaaaaagaagttacaaagcaaactggaaggggccatagttgtagaaaaaccacatgtcaaatggagtgatgtggcagggctggaagctgccaaggaggctttgaaagaagctgttatattacctattaggtttccccatttgttcagtggaaagagagtaccttggaaagggattttgttatttgggcctcccggtactggtaaatcgtacttagccaaggctgtagctacagaagcaaacaattcaacatttttttctgtttcgtcgtccgatctcgtttccaaatggttgggagagtcagaaaaattagtcaagaatcttttcgaattggctagagcccacaaacctagtattatattcattgatgaaatcgattctttatgctcatcccgttccgacacgaatcagagtcagccaggagaaatcaaacccgagttttttggtcagatgcaaagtgtgggccacgatactgaaggtatcctt

SEQ ID NO: 2382 - DNA, 1265 bp, Diabrotica virgifera
  misc_feature (1015)..(1015): n is a, c, g, or t
ggttaaaaaattgaagaaacacattttaaaaaaacagacaaaattttgatattttattcttgattttatttcatcgaattaggtatatagtttagcttgtgtaattttcgtgtaaaataaaaaaatgggttcaattttttctgcttcgtgtgattctgaagctagattagatggtaaaaatgcagtgatcactggtgctaacactggaattggtaaagagacggctaaggatttttatgtaaggggtggtagagtaattttggcatgcagaaatataaaaagagcaaatgaagccatcgaaaaaatcaaggcggagtgtataggtcaacaagacttgggagaactactagctgtatgtctcgacctctcgagtttaaaatctgtcagatcatgtgctgaagaattgctcaaaactgaaaaacaaattcatatattagtcaataacgctggactatttggaattccatatggaaaaagtaaagaaaactatgaactgaattttgcaaccaatcatttggggcattttttatttactttgttactactaccaataataattaaaagtggtcctgccagaatagttactgtttcttcaagattgcatacatcggcatccagcctggacttcagtgacttacattatgaaagaagaacatacggtgccataaaagcgtactctgaatcaaaactggcgaatattttatttatgaatgagttggctaggaaattaaaagaaaagaatataaataatgtaaatgtctattcattgcatccaggcctagtaagatcagaggtgggcaggaatttagatgacgcatggtttccaggaagttattggatctggtcgaatgtacttggattgtttgccaaaagccctaaacaaggtgcacaaacatcaatatactgctcagtagatgaaaaatgtgcaaacgaaacagggctttattatgcagaatgtgcaccagtatctccatcgcaagctgcaagaaatgaaacagcagcaaaagagttatgnggaggtcagttggaaattggttggtttaaaagaagactttaatccttttagaaagttatgaatttgatttaagaagtatatgtacttattaagttaagtggtacccgctcctgaaaaaggaaaataattcttccttatcaactattttattcttcgagaatatttaacatttatatttatttgaatccatggctattaattgaaaaaagtttctggaaaaaagggaaagcctaaataattttttttggat

SEQ ID NO: 2383 - DNA, 819 bp, Diabrotica virgifera
  misc_feature (756)..(756): n is a, c, g, or t
  misc_feature (782)..(782): n is a, c, g, or t
taccaacctatgaataccatgtgagaaattcatatttaaataaataaatttttataaaattaattaatatacattgacaacagaaagaagccggtattattttaaaaatgagaaaaatataattctaaatttttgttacatcaatacctaatattttgtgatattttataaaacagtgtccacacgatacaatcagtagttttaccccaaaaacattacgtaaaatgtgctcgagggggattctgtccattagaagatttacaacagatgcaaagagcatacatttttttactacacctatttattatgttaatgcaagtccccacataggccacctctacagttccttaatagcggacgctgctcaaagatggcagcagatgtatcgaaagggatctttaataaaattttcaacaggtacggacgaacacggttcgaaaattcaacaagctgctaataaaaacggcacttctgctaaggtttactgcgataaaatttcatcccagtttgaaaaattggtttcggagttcgatatcggctgcaccaattatataagaacaagcgaggatagccataaaaataccgtggggaaattttggaaaatccttgacgaaagccaatttatttataaatcaaaatatgagggatggtactgcgtctcagacgaaacatttttaaccgaatcccaactaaacgaaattacaaaacaagatggtaccaaagttttggtatcatctgagagcaaccatccggtgnaatggagtagtgaagaaaactatatngttcagctgagtcaatttagggatgatcttaattatt

SEQ ID NO: 2384 - DNA, 1058 bp, Diabrotica virgifera
aacacttgtttgtattttggatgtcattgatactagaaaccatcaaatataaatgctgcatttatatagttaatcttattaatttgtttggtttaaaaagttgcttctaggatattcacatgtcctcagacaaattgttgttttgatatattaagtcatatactttaggtgatttaatatactaaaatgactgtttgttgtaacataaaccaaaaaatttgtttcaatattaatgtggcatggacatttcatggtttcttggttgtagaatgttatgattgtttgacagctgtttatttatggatttaaaacaattgaaaacagaatagagtattaataggtaaagaatattagaatgctgttttatgttttgagaacaataattgtacgatttgaaaactaattacctttagtttttttctaaatgtgccatttcttagtgatattgataactccactgacccaatgttaacataatcaggagtctatgtccaatactattttaattttagaatagcttctatccttgaatcacatttgattcatggacatacatattagggacacattaaggttcttgaattatatagttgattggatagtgaagttattaaatattaactaaaaaagtacaactattcataatacttcattaaacagatattatttgagatagacaatagaatcagtaagaattaaatcttcaacaaaaataattatttagaacgaagtaattaacactcgctgatttctacttctaatacaggagtgtacagtaaagaaaaaatcattttttgaaaatctcttgaaaataaactgcaaattttaaaataaactattattatgcacttttttacctctagattggtaaccattttgaaagaatacaatgttttaattgtattttgtcagtattttccaatctgaaagtaaagtagttaataagagttttttttcatttgtagtcaattcaaaaagaacttacaattaaataagaaataccattaaaagtgccacattatttgtttttaaaaaattgaaaaagaggtttaaattat

SEQ ID NO: 2385 - DNA, 1125 bp, Diabrotica virgifera
  misc_feature (1090)..(1090): n is a, c, g, or t
  misc_feature (1099)..(1099): n is a, c, g, or t
aacacgcatccgctcacacgtcagcccacgcgtccgcagtcgtcaggtggattaaataaataattcatgaaagttaaaaatacgtgtattattatttcaagctgttggtaaatcaaaatcaaaatagtaataattattctgaataatgatcgtgtccagttggtattgatgacaagtaaaaagtggcataaggatttttctagaatcataaataaaaaattacatcaggtgatctaaaaacgagatgaccattattgaggggataggcgacgaagttacacatttttttattgcattgtttgttattgtcataggaactgttgcttggtggactactaacatatctgaacaaaggtatattaggactgtagtgttactagaaagaagaagacatagagcccatcggcgattaacaaaccatactgaatctgttactattactgaaggatcaagtagtacctctcagactgaagaaagtacacctgacctttctgctgaaacagatgcagcattagaacgagctcgagctccaaatggcaataaaccccctgagcctagatcagaagaagatttaatcgctcccgatattcccagtactatattagaagatagtcgaggcgaagaagaagaaagtataattgaaaccatggatgctgatgctaatatcgttaggcaaagaagattagctttttatactggtttttcaaatgaaaatcaagagccaactagttcccacacagaatcgtttagacaaaatactagttcgccacaagactctagtacttcttcagaagatgtagagcctagtgcccctccaacagaagaaagtgtgcctcccaaaaatgaagatactactagtaatagaataacagtgaaattaaaatacataaacgacgatctgaaattagtggaaggaaatttaaatgaatcccttggagaatttaaaaagagaaatttcgtgccagaattatcctccaacaaattgatacggttgatattcaacgggcaggtccttcaaccagacacgcaaaccctgaaaaattgtggactgtttgacaattgtgtcgtccactgtttgatacaccagaangagtctcanccgaatcggtctagtggtaccgaagc

SEQ ID NO: 2386 - DNA, 963 bp, Diabrotica virgifera
  misc_feature (835)..(835): n is a, c, g, or t
  misc_feature (844)..(844): n is a, c, g, or t
  misc_feature (869)..(869): n is a, c, g, or t
cacgcgtctagattggggcggatgttgttacttgtgtatctgtcatttcgttactagtttagtgcagtagatagtattagcagaattaatagtaaacttataatactcatttaataatatactcagacttacaaacagtatttataatgattcggttcatcctcatacagaacagagctgggaaaaccagattagcgaagtggtatatgaattttgatgatgatgagaaacagaaattgattgaagaagttcatgcagtggttactgttcgggatgccaagcatacaaattttgttgagtttcgtaacttcaaaattgtatatagaagatacgctgggctctacttctgcatatgcgtagatgtaaatgacaataatctgagttatctagaagcaatacacaatttcgtagaagttcttaatgaatatttccataatgtatgtgaattagatttggtttttaacttttataaagtatatacagtggtcgatgaaatgttcctagccggaggaatcagagagacttcccaaacaaaagtgttaaagcaactgttgatgttaaactccctagaatagccgtttttgttgatattcggaatggatgctgatcaagtagcgtttgatcttctgtaaactgaacctttatgttggatgtgtgttattgtatctacctaaattatcattttactgatagttaatgcagagctaaaagctagatcaggttaagataagtgtaaagtactctatgacatacttagtatcgaaatattccatattattatgtttttttaatgtttatgtttagtttaaggaacaaatatatttttaacgtctcnaattgttanatgaagagatattttaaaccaattnttattagataaaatgtacacaaaatggaatatctccaaatttaatgaaatacatatataaaactataagacaaataaaatgcttcatttactat

SEQ ID NO: 2387 - DNA, 1365 bp, Diabrotica virgifera
  misc_feature (1193)..(1193): n is a, c, g, or t
  misc_feature (1221)..(1221): n is a, c, g, or t
  misc_feature (1246)..(1246): n is a, c, g, or t
  misc_feature (1301)..(1302): n is a, c, g, or t
ctgtatcacgcctactgtgtgattcggctgattaggctgttttttgttttttttttatatatgtatcaactcttttgcgttcgggtattttaacggctagtttctatacctacctgatcttaaccatcagatactgcacttgctctaaacatattttactcgtatataaataatttattcaagcacgatacaaccttgacattgttgaaattgaaattaagtctatcttccacagacgtggctcaacaaaaacagctgataagacgataaaaaccgtgtgtaaaacgatactcaacattattattattatattttattactctcagattcaacaatttttataagaatttgatttattgatcgtagtggatactgtctactgtaaaatatggctcttcctgaaacctttgtaccgggttttcatgatgaagcagcggtgaggaaaatgcaatatactaaacttggaaacactgatatgcacgtttcgaaactgtcattgggtaccggcggattttcttatttttatggtgattacgatattgaagaatgtaagaaaactgtccatgaagctataaaaagaggtattaattacatcgatacaggtccgtggtacggacatggaacatcagaaacgatattaggaaaatgtttggaaggaattccgaggaaagcttactacctagcaacaaaaattggacgttatgagcaggatccaaagttaatgttcaatttttctgcccaaaaaactcgagaaagtataaatacatctttgaaaaggctgaaagtagactacgttgatgttttacaggtacatgatgtagaattctctcctagtatggacaccattctaaacgagaccttaccaacattagaagaacttaagaaggaaggaaaaactagatatatcggtataacaggttatcctgtctctaccttagtagaagtaatagaaaaaagcaaaatcagtattaacatgatattgagttactgtagactgaccatgattgacgataccttaagatcatttattccaacgttacaatcaaaacatgttggaattgtaaacgctgcagcgaactctatgggactcttgagcaactttggtcctcaaaattggcatccagcatccgaacacataaaagacatctgcacagaggctcgaaatttatgcaaggaaaatgatgtggaattgngaaagctagcaatatactatagtctgcnagagaaagtactgaaactataatgntaggaatgaacactccaaaacttgtagacatcaatctggaagtcgtctaacatgnnttaactccaaaagagcaagaaatttatcaacaggtttttaaaaatctttgaaaaagcttactg

SEQ ID NO: 2388 - DNA, 942 bp, Diabrotica virgifera
catttcgcgtccgagttattttaaataatttattataaaactctttattcaatctaaacttatcactattttcaatgtttcttccttttggaattttatttaagattctcacttttccacaagctaaagattgtaaagttcttctcaactccccatcttctatatttgtagccgtttttatgtctccaaaactaatttcttcatactcattaaataacaaaattaccaaagtttggaacaacgatacaactaattcttttttgccagtcttaaatgttgctttcagtatgcagtgatgtaaggcaggttgcccattggagttttcttccactgtatctactcaaataatagttattaaatgtgtcttgaaattttgtgaattgttctggaaagataacatccatagtaagatatgttggccagaagcccatagtaagaatattcactgtcatatctatgggagctaactgtagatcactgcttttaaggtaaaatttaaaggaagaatttatatcattgctaagttccatatctttaaacataccttctaattttgaagtaaacgctccaccacattcctgctttaatttactaagcatactcttttcggcatctacacttgctgatttgcctacgagaagtcttttagccagatcttttttgtagaaggcttcaaatacatctttgccatgaataaaacggaaaagaaccattgttttgtctaaaagatggtccaattcttcttctgtggcagctttgttccctgcacgtagcttcgaatcaacaaattttgcagtaagttcagctagtttatttgttctctgattaacaaaatattcaaaggcttccttaagggcattcataaacttatcacttttatcaaagcatacaatgactacattgtctaaggaatctttaaaatctagtaattcttgtacaatg

SEQ ID NO: 2389 - DNA, 1049 bp, Diabrotica virgifera
ggcgaactataccagggcctttattagttggggggtcatgaatactgcctacgaacacctcaaatctatggttaatgaagtttaagattataaacgtttttgtgatgtgataaaatttttaaaaggcgcattaaatgaagtattttttcgctgatcgaacaacaatattaacaaaacgaaaataactggaaatatttatttctgcgttttgtggaaataaatagttcctaattaatatcccagtgcagttttttacaaataacttgtaaaactaaataaggtgaacatagtatgtatttttcaatggaacaatcgatcagcgaaaaaataatatgtatatctcgtggtaaatacaacatttctgatatctggtccttggttctgagtaatcttcttgtcacagaacgtacagtgcaccacgtcatggatcaaggggattccatcccaaaaagagatcccaaagacaccgtagaatggcaaagacttttccaaaagatgatccttcaaaatatgtcaactaacggcgttcataggttacaatgcagttatgactcacctggtaagaatggcagagagcctcattataatctaaaacattttcggtcgcattcaggaactcatagactccagagaaccaccttcgggggcattcttcaacaatgtgacgagacagtctgtcgttgcgcaccacattcagaagtaagggcttttccccatctatgtaagctgttagcacttctatcagtgtttattcttattatgttcaaagttggcatgtattgcgaggcagttcgaagacaaacaggttgtgatcaatacaggcattttgtgtacttccttgggggagaacaatcccattgtcttctccagcggttggggaggtgaaacgttgttattttgaaaaagggtcctttaacattggaggaaatctggaaataattcttccttttccatataaagtttgccatggggggtggggttttccccccccgccccccatgtttcggtaaaattaaaagggttcttaaaaactttattcaggtttaatt

SEQ ID NO: 2390 - DNA, 1107 bp, Diabrotica virgifera
ctcctcgcgtccgactgcaacgtgcaggtgcagtaaaaaacgaattaatcagttgatagttaggtaattgcgtagtacgagtattttactggtttttttagatatacaaagcagttctagtcagatgaaaacaattattcctaaaatattaatagcctgtgaactatgtcctttataattattcctttaaataggaggataggagttagaaactccagttgcatatggtcaactattaggctcttttcatcagagacaacaagctcagatgaacaaggagatgataagaattatgaggaagatattcgtaataagatactagaagcttcgttacctcacgtacctgaactaggatggtccaaagaagcgatagccaaaggcgcacaagccgtaggttatcccggggttacacatgggatgttttctagaggaggtggagatctactacactattttcaaactagttccaattctaagttagtccaatttttaaaaaagtataaagaggatatgaaggagaaccctattccaccggccgactttgcggaaagggctattcaagaacgtttaaaaatggtcggaccgtatgtaggaaaatggccacaggcactagccattatggcattgccgcctaacgtaccaaattctttagcgactctattaacaatggtcgatgatatttgttactatgcaggtgatagatcagtagatcataattggtatttacgtagaataggcatagcaggtgtatataaagcttcagaactgtatatgattcaagataagtcagaggaatttaaaaatacgtgggtgtttctaaataagagattactcgaagcagtccaactggcagatttattgttaaagtcagaaaatggtacccagatggctaaagatactgtccagtcagtgtttgttacagccccgcaatatattaaggattcaattggaataaataggaatatgggtggaagggttcatcctacccgaaaggatttagggaggttaattattttttttattggcttttcttcggaaaaaaaattaaaattggaaaatttggggatttttttaatataattaaacaccaccggggttttagtttct

SEQ ID NO: 2391 - DNA, 930 bp, Diabrotica virgifera
ctttaacttagtttgggattaaattaatctataaaaatatctgccgacttttaattttacttcagaaatacgaaaatctttcaataactataaattatattcaagatgtctacaaaacatttatcagttggttctgtagagcctccaagaactgagggccttctcagggtctattctatgaaattctgcccttttgcccaacgagctttattagtcttgaaagcgaaaaacattccacatgatgttgtaaatcttaatttgatcagaaaaccagagtggtacagcaaaattaatccaaaaacattagtaccagccattcttgatggtgataaaattgtgatagaaagcctggatattgctgattatctagatgaaaagtaccctgaaaacccactatatcctgcagatcctgcagccaagcagcagattaaggatattataaacaaggcaggtgttgcacaaggagtgcaacaaaaactcttagcgtcaaaagaagaacatacggcagaagaatgggctaaattgttgctggaagctcttcaacctttggaagaagcactttcacagaggggaacgcctttctttggtggagataaacctggcatggctgattacatgatttggccatgggcagagagagcaggatgtatagaaattaaattacaacagaaacttcctttgaaagactcagacatcccacttttaaggaaatggagaaaagatatgatgcatgaaccagtatgcaaggagttatatattagtggtgacaggttttggaagattgcaaaagcaaaaattgatggtgtagaaccagcgtatgatgaagtataaaatggattcttaaatcgacggaagtcatataaattacatgcaaaaattttcaaatgaactgatagaatatactgtttactctgatgttttataccatac

SEQ ID NO: 2392 - DNA, 1283 bp, Diabrotica virgifera
atcgaagcgctcgactaatattagtaccgtggaatacaagagcaataatggaaaataatggacttatacatttgataaagaatacttatccacaaataatagctgcagtttcaggtacactctttgcaatatcagatggtatgacctatggctggagtgcaccatacattccatatcttattagcgatataagtcacatccagacaactaaacgtgaagccgactttttagaaactgcatttttacttggatcgttttgtggcttacccttcactgtatatctcgttaacaaaattggaagaaaaaagtcactcctcctagcgtcattcgttgtattactagcatggttagcaataggattagggaaccagatggtgtatatttttgtggccagattcttttgtggaatgtcgggaaatatggcattcgtagcagcaccatgttttattgctgaaatagcagatcctcaaataagaggatttttgtcaagtattatttatgtcatgatgttattaggttgtttaatagtgtattcagtaggacctttcttacctttttacgtcccgtgtataatagggggcactgtagctattattgaaattttggtgttttctagagtaccagaaagtgcgctttaccttctttctaaagacaaacctgaagctgccttacagtctataaaattttacaaaccttatattgatcccataaaagaattagaacaaatttcaaagtcaatagaggagcagagacacgagaaaggaagatttttagatttgtttgtagtacccagcaatagaaagggaatactaattatgacagggggtaaatggtgggcaaccttctttgcggctaattcagttattttaatggactttacatctaatttctttgaaaatggtggtaataaattaatatgaaaagggctcctggtggttaaattaatttggtggatttaagggttgaaccccagtcatatttgctttcatttcaaaattgaaaaggatggggcaaaaaagttttacctaattttttcttaaaaaattaaacccgggggttggcttttttggagaatttgctgggttaatttttaaccaaaaaaaaaaatggggaattaaagggtaaaaagttttaaatcggaaaccaaattggttttttatctatggttttaccccggtgtgagtttttaaaaaggggggcggttgtgaaatttgtaccccccttcgctttacaacctcgtggtaaaaaaatatttccccaaaaaaaaacaccttataaaaaga

SEQ ID NO: 2393 - DNA, 461 bp, Diabrotica virgifera
ctcgcgggtcgacacacgcctctaaacacacgcctcgtccatcacaagtgcagtggacatcagtgaaaatgagaaaattagtgttagtgttgttttttgtgatatgtgcttatgcacaggacaatttcgaaaataccggcgttagattagcactgaaaatatacgatgactgcacaaaagccgatggattatcaccgtgtttaaaaagaaaagctatcacttttctagacagactgagccgtatggataaattcgcactaactgacggagttacggtacaaaaggcatccgatgcagtcgctgaaggtccagcccttaccgaggaacaacttgacaacacacttccaaggtcctctgacgccaaagatgcagctttaacaaacatgctttttgaaaaagttggcagctttatcggatccagatcgcttgaagtaactcttccaaaaattcaagcatcggac

SEQ ID NO: 2394 - DNA, 924 bp, Diabrotica virgifera
  misc_feature (892)..(892): n is a, c, g, or t
aaagataaaccatttgatgatttaattaataaaggtaaattacaaagtgagtaccaaattttaagcatctttagtcgatacaatggctcttggatcgaaaaagcgtattatcggtagaaacaaaaaatttatcgaaagaccctcctcccggtattagtgcaacacctgatgaatcaaactgcagatactttcatgtagtcatggcaggcccttctggatccccttacgaaggtgggttatttaagttggaattatttttaccggagaactatccaatgtcccctccaaatgtgaggtttctgacaaaaatatatcaccctaatatagataagctaggaagaatatgtttagatattttaaaggaccagtggtcgccagctcttcaagttagaacagttctcttatctgttcaagcattactaagcagcccgaatcctgatgatcctcttgcaaacgatgttgctaatatgtggaaaagtagagaacaggatgcagtgctcaaagcgaaggaatggacaagactggatgctatggaataatctccaataatgtcacaagactgactgtgatactatgtattaacatgttaaatgttataataatatattttgttttaatgtgatgtttcttcatattgactataaataagtagtgttttttaaaaaaatttgtatcatttagtgacttgaaagttgttttgggtggaggagactaacagatattcttatttacatcatattaagtaagtaaacctctgtaactcgtttcatatttcagaagactgtagaatttaaaatttgttaacacattcactgccactgtcgccaaaaggcatagtcaggtgccactggacaccttttggtggtcataaattcataaccctgtggaattnaatagagtcttttcgtattggctccatataaa

SEQ ID NO: 2395 - DNA, 1098 bp, Diabrotica virgifera
ccttaagggggacgatctagccatgctggaagggaaggttgacctttgctcaactgatcaaaagacaacttccgatgaattgaataaggcagaacgagctttatcaaccagaatttcatcttcagcaaacgatattaagcaattaaaagattcactctacaattatgtaaatatgtcaatttctagtctaacaaatgctaacaataaggacttttctaaggagcttggtgatctaaaaaggagcctatcaggcagattatccaatgatgaatctcgtttaagcgacgtggagaaaaatgtacaaaagcttaggagcgatttcaaccagaaaagtaattctcttgacgctactatccagggcattagaaaggatatattagtcttacaaggccctaacgatgagctagcgctaacagtggaggcgggcgttttggctaaagttatacccttactaaaccctactcttataacaaaaaacgttagccgtgaattagatgttttaaaagatgaagttgccgcacaattcgccaattctagtaaaacaataaaagatcttaaaacagaagtagattcctgcaagagagtttctggaaccaagttcaaagaaaatgaaaagaaaataggacagattgagaataatttatctagtacacaaatgaatctaaatgatctatcagaaaagttgaacaatggtgttctcaatgaagtcaatactagagtaacatctgctctcaacaaaagcgccaaatgtgaaaccaaagtaaagcaactacaggatgagattaataagttgagaaatgattttgaaacgaccgtggccatgcttagagaagaacataaagaatttagaaagaaattggaagcagaagacgttcaagttgtgtaatttatataatacccagatataaagtgcagattacctacatcttattattagtatttttcttttattctgatacctggttttcgatatctgactattgcttatcgatcttttatttgctctttcctttttatatgttaatctacttaaaccttatgcttcaaattgttcaaatattttattatcatattaatcgtcgaaaacacaatccaagg

SEQ ID NO: 2396 - DNA, 978 bp, Diabrotica virgifera
cttcgtccgctatgtattgtggtgcatctagtcatcatattcattgtgaaaattttgaatttaaaagtggtgaaaagctactcttttttggaagagatgaagttgataataccaccacttggttagatttgaataattgcacaggaataattacttcagaaacgttcaacctgttcccggctctagattatgttaatttcaaaggatgtactttggaattttctgcaaaatcatttgcagctataaagaatatacgagccatagatataagagaaagtaaagtttctatttcaaaggagatttttgaagactgcgaaacattggagtccatgcatttaaaagatttgaaattaccagatcaagattgtttttcacctctaaaaaagttaaatatgttgacaatagaagagtgtcagttcgaaaacagtaatagtaatatttttagagagttattttctttgcaatatttgataatcgaacggtgtgaattgccaattttcggtgatgtgtaccaagatttcaaaaatttggaaatgcttattctcatgcataacaaaattggagagctaaactgtgatggcatatttaatctacagaaattaaaagacattgcaatatttaacaatgaaactatatctgttatagactacgaaaggtttcaaactatgcctttgctggaaaccatactttttgaaaataatgtatacaaaactttggatttgcgtgcttttcctagtttaaaacttgtcaaaatcggtaccttaactgatataccaacaccaacagatgaggagcttttcaaaaagtttgatgatatgaatataacataccagtttacctttttgggggaaaatccaaattgatatgagtaaaggttgatttgtgcataaaaattctgtttattttacccaacccaaagaccccacttttttaattcaaattgcaaaaaaaataaaagtaaattagaaggttttcttt

SEQ ID NO: 2397 - DNA, 923 bp, Diabrotica virgifera
  misc_feature (13)..(13): n is a, c, g, or t
  misc_feature (18)..(18): n is a, c, g, or t
  misc_feature (20)..(20): n is a, c, g, or t
  misc_feature (846)..(846): n is a, c, g, or t
tttttgtgggtgnagagngnagaagatgtatttgttccggtgatttcggaaaataaaagtaattcgtggctcgatcagttttggaaaatttgatgaaaaacagtaataattatgtatcttctttataaagtacttgtgctttcgttcgtagttggggcgttcaccgacgagcacaatcacatttatgaagataatgaagaggtagtgctatggatgaatactgttggaccctaccataataggcaagagacatacgcatacttctctctaccattttgtattggatccaaagatactatcagccattaccatgaaacactaagcgaggcactccaaggggtagaacttgaattcagtggaatagaaattgaatttaaaattaatatgtctagaggagattactgtgctgtacaacttgatgaagaaaaatacaaagcgtttgtatatgcagtgaagaaccattattggtaccaaatgtacatcgacgacctgcccatatggggtgtagttggagaaatgaaggacaacagctactacatttggactcacaagaagtttgaaattggttacaatggcaaacaaatcatcgatgttaatctcacatcggaagaaaaagttgagttgaaacctactacccagttaaagtttacgtatgaagttatttggaagaaaacaaatattaagtttgaggatagatttgacaagtacttggaccataatttctttcaacataggattcattggttcagtatatttaacagcttcatgatggtatattcttagtcggtttggtatcaatgatccttatgagaacacttaggaaagattatgctagatacagcaggnatgaagacatagatgacatggaacgtgatttgggagacgaatatgggtggaaacagaaccacgggggatgttttccg

SEQ ID NO: 2398 - DNA, 724 bp, Diabrotica virgifera
  misc_feature (715)..(715): n is a, c, g, or t
gggtcgatacacgcgtctaaacagatgctgtatagggttaaggtcgggtgagcaatcaggccactccataacagtgatagcttctgcttcaagaaagtgtgtagtcaatctgctggtatatggaggtgcagtatcatgcatgaaaattaaattttctcgattgctcctctccagaacctaactatatgttcgagaaccaaatcaccatacctgcgagttgttaaaattgattggatgaaaattaaatttttttacagatcataataccgtcccagaatatgacacttcctcatttatatgtgtggacagatctggtagtctccgtcctttctggtcttccacatattcgaaatcttgggcacgaatccttttttattgttttcactgaaacacttacccctgtatcttccaaaaactgcctttggtgctgtagatgagaaattgttgggtctcttttagcttagctgtttggacaatgaaacgatcttggtgagccgttgttgctttttggcaacatttgcaaaaatctttattattcgcaacagtaacaagcaggcgcggatctagaaattcataataggggggtcaaacttacctccaatattatattttctaaatttagccatacctacgactcacacttactctaacgataaaatacactatatttataatcccagatacctacagtatcaaaaagattgagctctgatgngattctttc

SEQ ID NO: 2399 - DNA, 711 bp, Diabrotica virgifera
tcgtgggccgatacaagcctctatactgacgtcgtgctaaatctcaacagctcaacatgaacgcaatgattgctctcacttttgccgctatggtagcaaccgcttccgcatcccaccttggtctaggttggggattgggacatgccggtatcgtcaacccacacgccctcagcccaattggaccctctggaatcgtcactggagccggcgcagctggtccctctggagtcgtaactggagctggagctgtaggacccgctggagtagtcaacggacatggagctgtaggaccaactggtcccaacggacatggtgctatccttgctggtcccggagctttaggtttgggattgggtgttgctggtcatgctcttagcccagtaggtccttctggaatcgtcaccggtgctggagcagctggtccctctggagtcgtaactggagctggcgctgtaggacccgctggagtagtcaacggacacggagccgtaggaccaactggtcccaatggacacggtgctatccttgcccctgctgccttaggtttgggattgggattgggacatgccggtttaggtcttggacttggcggatggggacatggagctggacatttgggtcttcatggttgataacaaatagcatttcctaggaaataaacttttattgatttttgcaatgaactgagattatttatattaaaaagaaaaa

SEQ ID NO: 2400 - DNA, 894 bp, Diabrotica virgifera
actaaacacatgtgcttgtaaaggtatttaaaagaaaataaacaaaccaaattaaaatgcctaaagttaaagtagacaaaaagaaaaagtcacaaaatggagttgtcaagcaaggtattctattcaacaaagattttggtcaacatattttaaaaaatcccatggtaataacatcaatgttggaaaaatctggtctaagacccactgatgtagttcttgaagttggtccaggtactggtaacatgacggttaaactattggagcaagtaaaaagagtgactgcatgtgaaatagatcacagattagttgccgaattacaaaagagagtccaaggtacacctctgcaatcaaaactagagatccaggttggagatgtcctgaaaagtgatcttccattttttgatgtgtgtgtagctaatgtgccatatcagatatcttcacctttagtgtttaaattgcttctacatagaccattttttagatgtgccgttcttatgtttcaactagaatttgctcaaagattagttgcaaaacctggtgataagttgtattgtagattatcagtaaacacacagttgttgtcaagggttgatatgttgatgaaggtaggcaaaaataactttaggcctcctccgaaagtagaatcatgtgtagtgagaatagaaccaagaaatcctcctccaccaattaattacacagaatgggatgggctgactaggatagctttcacaagaaaaaataaaactttaggaagtgtttttcgacagactgctgtattagctgcattagagaagaattataaacttcattgcagtttaaataataagggattacctgatgactttagcataaaaaaaaaaaaaaagggatattactttaaaagattccagctta

SEQ ID NO: 2401 - DNA, 1200 bp, Diabrotica virgifera
caaaagccttcaaatctaaatcggcattttgatcatcaattttgtggttttttattataaattcagctgttaggttgaaaaatatttcagtctaaaaattacgttataaaagacatcgaaatcttcgatcgattataaccataaaagcattttagtttgtttgcatttttacataacttaacctctcatagtgaacttcacatgtaaagatgtctgcagctcaaattttcaacagaatcggccaagttggtctaggaatagccctcgttggtggagtagtcaattcagcattgtacaatgttgatggaggtcacagggcagttattttcgacaggttcgccggtattaagaaacaagttataggcgaaggtacacatttctttataccttgggtacagaaacctattatctttgatgtacggtctcgccctagaaatatcccagtaataacaggtagcaaagatctgcaaaacgtaaatatcacactccgtatcctcttcagaccagttccagacgaattaccaaagatctacacaattttaggccaggattatgaagaaagagttttaccatcaatcactaatgaagtcctaaaagctgtggtggcacaattcgatgccagtgaactgattactcagagagatgtagtttcccaaaaagtcagtgaagatttaactgaaagagccactcaatttggtgttatccttgatgatatatcattaacccacttaacctttggtagggaattcacacaagctgtagaattgaaacaagttgcccaacaggaagctgagaaagctaggtttttggtagaaaaagctgaacagacaaagaaagcaactgtaatctcagcggagggtgatgcccaagctgctgtgcttcttgccaaggcttttggtgatgctggagaaggtttagtagaactgagacgtatagaagcagctgaagatatcgcataaccaactatcaaggtcaaggcaggtttcctacttgcctggaggaaaaaatttgttgttgaatgggcccaccccccgggaaattaaatgggataaagtaacaaaaaaaaattggggggtagttgattaatttgggtcccatggaatggaaaaagagtggcccctttttagctttttttgggggttttttatttttttttttttataaaaaaggtaaaaaaaaaataaaatttggggagtgttt

SEQ ID NO: 2402 - DNA, 941 bp, Diabrotica virgifera
gttgagaacgtaacgatttccggctccagaggagactattatcagtgagttctacaaacattccaaaagtagttttatatcgtatcaaggaatgtatcgtctatcgaacatactcgtccagtaacatttaacaactcagcaacctacatctttttcggtaatattaaacaaatagaggaatttatcaagtttcaagaatattcagaatcagatgaagtagatgccatatttgtacctctcgatggatctgttccaacaggattgcctgaatcaagtttcgttatcataccacctcatcatccagcatcaacgaagtataaaactagagaaaatattctcccatcaccaatgttcctatcgacggctaaatccattcttacgttttcgaaaaacatcgaaaaatacgtagaaaagaattgtaatgatacgtcatacaaagtgaattgcctaagaagcaaatttaatagaaaataccgaccagtattaatgtcaccgaatggtattctagatattctaaaaattgaacctctaacttcaaactttgtctatgatatttacagagtggaaaatgacacctcaaatatcagtgtgctggctctaaggaataacttccttcagccttacacaaaaatattttcgtacaacatattctacgacaatattacactagttgaccaatctttcgaagatagatctccaaacgtttcgataaatgaagccagtagcaactgtctaaattattttaaggaaaaacgcttcacatttcttcatagataatatttctaacctttcgtttagatctgaagcttgggtctatgcctttctctctttatctcttctaggaggaataatctggatggtccttaataatatttctactaatatgtatttgcccaaaaagatatttttggaaggaaatccaaatttctcaccgatttccc

SEQ ID NO: 2403 - DNA, 1015 bp, Diabrotica virgifera
gtaagatataagagaataacacaatttgataatatatttcttcggttaccattcgtacttaaatatacactcgttctaatattatttttcacctaacctttactaacttctatatctagatccttatccgtcaaatacggcaacttaaccttttcgtggagggaaataaccgtagtcgctaacacttttcggtgcccggtagatggttaaatacaaagaggacttgtttaggtaccgttaattatcgtaaataccagtaaatgattcatttaggattaaaattacttgctaaagtaagctgagtaagttttatcggtgataatattacagccttctagtttgtcaacgatacgccatctaggttttcaaagatatattccaggacccggtataaaaccgtgggagaaataatacccaccttgatgtattcctcgatttacggtgttttgtctgcatctatccagacttcatccaaataccatcactttcatgtatgtacttgataaggctcgaatgcctggagtcaaatcttgcttaatccagggccttacaaattgaccaaatttccaagacttttcggttctacaaatttaatctacacaattaagtgtatggatacattgtattctgcgtaatatttctttattacagttcttattgcataaaggtggttagtaatatttaacgcgtttcaaaaacccgcctgttcgacagtgaagagtgatcaattcaaatagcacagacctataagtgatgtattggcaaccgtaaactatatttgttataatcaaatcaataattttataagctaaatcagggtagttctcggaagttggctgtataccatttagttaaaaaactttcaacatcaaagtaaaaaaacttctgttgtaatttgtgaagtattaaattaaaaatccaaacggttagaatagttgttcagaacaaacgttttcggacttatcagtcgtcttcagtgaactttgaagtgcttgagcttaataacagcacaact

SEQ ID NO: 2404 - DNA, 1067 bp, Diabrotica virgifera
  misc_feature (824)..(824): n is a, c, g, or t
  misc_feature (862)..(862): n is a, c, g, or t
acaacaccctgacgtgagtcgtattaaagatggactgatcgtggatcttttcacctaacatctacagtgtgttgttttcgagtaaaattccttcagtttgtggtgagcactacaccatgcatggtatattgcaagtgtcgacttacgtttgtagcttaatgttattgttttgtgatgaattattagtttggttttttagattttcacgccaaagatagaaatgatgaacgagtcaacaatagacatcctcaatgaaaccgaatatgaaagcgatcaatttgcaagtgttccagcaattgaaggccaattcccaaaatccctcaacggcttaggctactacctcctggtcattacaataatcaaactcttcgtagtccttgctgttttaatcattaacatatttctagtcattgttattctccgatttagaagacttcatgctataagatccaatatctacattctgaatatgagtatcatgaatatcatcttctatttgtgtactccattgttctatattatttgtcatcttgtctctgcacatgagcaacagtctgttttgatcttgcaaacacaaagtacactgttgatactgtacttaacatttgctgttgctatgagcgtggattggatccttacggtgtcaaaaccacagttgatgaagaggttcgaacatcgttgtaaatatctcatctttgggatttatatcctattttttatggaatggatcgtagcttttatatactctgaagtggaacatatagccagagccaattcctttactatattttatgtaatatacgcagctatattaactgctttanacgttttcaaaaatcgcgttgaaatcagacatgaatcntaaaataccgaatatgctttgacagtcggtaacatagttgtttattcgtatctcccccgattcttttttcatctacttctgctaattcctttagatttcttagataaaattttattatttttgaaatcattcctgattttatagagatcggtcatccgaatcgtagtatctacatgttgtgggaggtcgaaacaatatttttaaa

SEQ ID NO: 2405 - DNA, 1389 bp, Diabrotica virgifera
  misc_feature (1322)..(1322): n is a, c, g, or t
gcgagcggccgcccgcgatcttgggaaactgtactgtcagactgtcagctgaaagctgccctaactttttataattgcatggtggaaatataaaaatatacaatatttaatagcatggctgcagctctaggccgaattactaatttaacaaaaacacaagttggacaatttctccccgcgatatgtaacaatcaaattgtcttttactctggaccgcccccaggtactcctccaccacaaactaagacgaagtttgggccccttgctgatgaagacagaatttttaccaacctctatggcagacatgattggaggcttaaaggttccatgaaaaggggagactggtacaaaacgaaggagattctattgaagggatcagattggattattaatgaggtaaaagtatctggtttgagaggtagaggaggggctggtttcccatctggtatgaaatggtcttttatgaacaagccaggagatggaagacctaaatatcttgttgtaaatgctgatgaaggagaaccaggaacatgcaaagatagagaaatcatgagacatgatccgcataagcttgtggagggatgtttgatagctggcagggctatgggagctaaagctgcatatatttatattagaggagagttttataatgaagcttcaaatatgcaggttgctattgctgaggcataccaagctggatttttaggtaagaacgcatgtggttctggctatgattttgatgtatttatgcacagaggtgctggtgcatatatctgtggagaagaaactgctttaattgaatcaattgaaggtaaacaaggaaaaccaagattgaaacctccattcccagctgatgtaggtgtatttggttgccctacaactgtaactaatgttgaaactgttgcagtagcaccaactatttgcagaaggggaggaacttggtttgcttcatttggtagaacccgtaactctggtaccaaattatttaacatttctggtcatgttaatcgtccatgtacagtagaagaagagatgagcataccattgaaagaacttattgaaatacatgcaggaggtgtcactggtgggtgggacaaccttttggctattattccaggaggatcatctacacctcttataccaaaaaaagtatgtgaggatgttttaatggacttcgatggtttagttgcagcccaaaccagcttgggaactgctgctattattgtgatgaataaacaaactgatattgtaaaagcaattgctagacttattatgttctataaacatgaatcttgtggacaatgcactccatgcagagaggnggtgaactggatgaacaaatgatataccgttttgtagatggtaatgcaaaaccagatgagattgata

SEQ ID NO: 2406 - DNA, 852 bp, Diabrotica virgifera
  misc_feature (728)..(728): n is a, c, g, or t
  misc_feature (736)..(736): n is a, c, g, or t
  misc_feature (752)..(752): n is a, c, g, or t
  misc_feature (761)..(761): n is a, c, g, or t
caatcataaaatgtataaaaaaaataaaaacttgcatttgggattcgaacccgcgtgcttagacataaaatccacttacacacacccgtcatccgtcttgaccacttacacatacttgtcatgtgggaaggtaggctaactgaacgttttactctgacagttctgaatttaatcaaattagtttgatttttgtttgtgtgtgtgttcacaaagggaattaaaatattaaaatacaacaaaacatagagtaagaaaacaataggtatattagatgaagagtggtagaaattttgttggtaatcaaattatgtaaatcaaaccattacctactataaatagataggtacatacattttccaaataggtaagtacctacctatgtaatttttaattacagtactgaaacatttacaattaagtacgtacctgttgcttttaaaaagttactacaattataaacttgcttttgtctgtgtcctcacaacaataaaaactaatatacaatatttgtttatccataacctccatattgaacaattattgtcatgtcatttgaacacccaatcagagcaaaggtataatgcgtctgcgccggggaacaaggtttttgatgaattcgcgcatattaaatttcactcccatcgcgcctaaagcagtataacttcaaaaactttgcgaaattttgttatctttattataaaaaagttataacaataaaatttcactanaaagttgngaattactttgtttanatctcttantaacaaatgaatacgctttttactagattttttagtgaaatttttaatactaataattctattaatttagtaataattattataactttta

SEQ ID NO: 2407 - DNA, 945 bp, Diabrotica virgifera
cctttcgcgtccgtgacgtctatcatgatgttaaccttaattttttatttatttaatatattttaaaaattataaaaatgatttcagaaactgttaatgaatctgacacaaatataagtatgcaataccaaaatcttagtatatatgacaatggtccaccatttgaagtctttcaaaatgaagaaacaactaaaagccccaatatcgatgagaaagccttacggatgatgcaaaaaatgggctacaaagaaggatctggtttaggtaaaagtgaacaaggaattactaaaattatagatataaactatcaacatggtaaaagaggtttgggactaaaattaaaacgtattgaagatacactcaaaacgtggaatttctcaattgaggaggtgaacataaaggaaaatttgatttggctaaaaaatgaagcagcttcagattatacagaggaagaactgttaacgtggataaaagaaggagagcatgttacggatattaaaacccaaactgaattttgtgatgaagaaattctcaataatgttgtgaatgcaaaagacatatttgaagaaatggacattattgaactgtgtcaagccagagcaaaatctaacccctttgagacaattcgttcagcattttttatgaacagagcagcattgaagatggccaatattgatgcagtgacaaattacatgttcacggatgttgacaaaaatgaaaattttcaaaatcacgaaggtccttattatttcgcagatgtgtgtgcgggtccaggaggtttttccgaatacatcctatggagaaaacagtggaattttaaaggatttggtttgaccttaaaagatgaaaacgattttaaactgggtgattcaacttgcgctgtcctgcatcgttccaggctttgtatggtaatgatgatggacggaaatgtttgctctccggaaa

SEQ ID NO: 2408 - DNA, 781 bp, Diabrotica virgifera
atcgacatgttaatctgatgtttttattactttgtttatgttattaaaaagctgtttgtgtacctgcggcatcgcagctgtatgatcgtctatgaaaagaataataaataggaaaaaactactcatgtttccgtcttttacatcgaaatttatagtgtattgttcccatagagtctgctaaagctgtgattgtaggcttaactaatacctcaaaaatattttggtgcctaaaaattattttttatacacttggtctttttgtaaaaacagtttttattgataattgataaatggttaccgtttgtcttgatgttaacaacacagttgctgttaacattattacaaaatatatgcgtgtttcataatgcaaataatgattagtatgcacctaaatgtaattgaagttgaatggtaaatatatctattagtagatccaaccgtcatttgtatcatggttacttttttgttcttgcattatgaactaactgcttagatgttcctctttatatttatatagccgaggcggaatatcgttgttgaccataacattatcgttttccatgttattttaataataattatttttagattttttatattgtagacgttatttattttttgaaaaattatgttgtaacattatgatttaaaattttgtaaatggtagaattttctgataaatataagtgttttatttttgtgaaagtcattcacatggatcaattcttgactattttgttaacatgtcggatttgatcataaatataattttatttcatat

SEQ ID NO: 2409 - DNA, 844 bp, Diabrotica virgifera
cccccggacgcgtgggcttagaagtgatcgacttaagctctaaatatcgcaacatgagtttcatcggttcaagcatcctcttggcgctagccctaggtttggccaacgctggttacgaacatggacatcaagacctaggcagccatgatttaggaggcggccatgatctcggaggcggtcatgaactcggaggacaagattacagcggttatgggggtggtcacggcggctggcaaccacatgttcaagaacaccaccaacacataccaactaataccattgagcatacccaagcggttgcagtacctgtagttaagaaagtaggagtaccagttccacatccagtaggagtaccagtacctcaggtcgtaaaagttccagtacctcaaccttacgccgtacatgtgccagtaccacagcccattgccgtaccaatctacaagctagtacctcaagaaatcgaaaagaaagtaccaatcaccgtcgaaaagttggttcccgtctacgtcgacaaaccatacaaaatcgaaatcgaaaagcaccacccagtctacgtcaatcaaccctacccagtccacgtgccagtatacaaacacgttttacacacatccaaacatggtggcggtgaagaacaacacggatggcattaaagcttttcgattttctagggtagtatccatctcatctctcatctagttttcacctcaatccattatctaagtcatcttaagcagactgtaatttgttgacctgttattgttgaatgttgttatgttttgttaataaacttgttaaaaaaaaaaaaataaaaaaaaaaaaagaaaaaaaaaaaaaaagggcggcc

SEQ ID NO: 2410 - DNA, 1047 bp, Diabrotica virgifera
  misc_feature (994)..(994): n is a, c, g, or t
  misc_feature (996)..(998): n is a, c, g, or t
  misc_feature (1013)..(1015): n is a, c, g, or t
aaggttttagtcttagtattttgtgaggttagaaaactttattttgtttagatttttaaatgattcctgcatttaaagtatctatgaaattcgctaattaatttgtaatatgcgtaaatataataattgtcgatgggtaagaaacatcttaatttaaatactgcccagtcatgttaaaattatcaaaaattttcaatatcactaacatcagattttgttccaatgctgctacaagaaccattttggaacccttaaaaaatagatcgcttatacatgtaagtggaaatgattccacagagtttttacaaggtctagttacaaatgatattaatcatttaagtcaaaattttcattcaatgtatgcaatgtttttaaatacaaaaggtagagttttgtatgacagcattatatacaaattcgagactgataactcatactttatagaatgtgatttagaaattgaaaagcaattagagaaacatctaaaaatgtatcgagtacgaaaaaaggttgatgttacaaatgcatgcgataagtatcaaatatacgtattatttaaaaacaactgcctgaaaactgaagatgttcagttagagaagaacatagtagatagcactgctgcacaagaatctgcacctttgcaaacaactaaaaaaatgtttatctttaaagatcctagagtggccgatctaggctatagaataattgctaaaaatgatgtagatatcgagaaagaaatttcgtcttcagttattacagaatctcccacgcctgaggaaaattataagtatcttagatattccctaggaataggggaaggtgtcaacgatttacctgtaggtaactgttttcctttagagtccaactgtgattatttacatggcgttagttttcataaaggctgttatattggtcaagaactcacagctagaacgcatcatacaggtgtagttaggaaacgtttaatgccactctttgttatagaaccctcaantnnncttactagtgatatnnngtctaaatctgatcaggtaaatcttggtaaac

SEQ ID NO: 2411 - DNA, 769 bp, Diabrotica virgifera
actcggtgtacttgggtgacgtgtagacgtgtagtgaaaaatagaaaataagaaaaatagtcaaaatgggcaaaagtgtaccatatttctcaatagcaatattttttattctctttgaaatctcttcggctttatatttccatattggagaaactgaacgaaaatgttttatagaagaaattccagatgagactaatgtcatagtaaattacaaggtggaactgtacgatccaagaagtggaggtttcatgccttcttctactggtattggtatgcatgtggaagtcagagatcctgatgataaaatcatattatcaagagtatacagtgcagagggcaaaatctcctttacttcccatttacctggtgagcatgtcatttgtatgttctctaacagcacagcttggtttagtggatctcaactaagagttcacttggatatacaagttggtgaacatgccattaattacggagaaatcgtacaaagggaaaaactttctgaattacaattaagggtcaggcagttgattgatcaagtggaacagatcacaaaggaacaaaattaccaaaggtaccgtgaggagagattcagacacactagcgaaagtacaaactcaagagttctttggtggtcaatcacccaaactgctgtgcttctagttatgggaacctggcaaatgagacacttaaaaaccttcttcgaagccaagaaacttgtttaaattcttaatttctttgttattattttatttaaataaattttttatag

SEQ ID NO: 2412 - DNA, 1292 bp, Diabrotica virgifera
gttcggtgtaaattagtgcaaaatgaactacctgattatttgtgcaatcttggctgtagcttttgcagctccacaaggagtgaacgaagatgatggccaatatcaccctgacaacagtggacaatatgccgctgatggtgctggagcatatagaggtattccaacttcagccttgggttctctagtttctcaataccgccctcaaccaaaagcagtaaattattatccaggtgtaccaacccaatataacaatggccaaaatggtcagtacagatctgacagtcaagatgatggtcaatatcacccagatcattccggagattacaatggagatggttcaggagcatacagtggtgacaattccggtgcttacagtggtatccaaggaggagcttacagtggcaaccaaggaggagcttacagtggcaaccaaggagttggcgccagaaactacagatatcaaggtgctggtcaagggcaagtaaccagacccgtagtgcaaccaaccgtacgtgcacaacccgtatctagataccaaggtaacgcagctcaagctggtgcacaatctgcatatcgtaacaacggacaatacagcaataatggacaatacagcaacggtcaacacaatgtacaacacaaaagccaagatggatacaacaataatggacaatatagaatcattcgtaaatcagaagaaattcttgaagacggatatcattatttctatgaaactgaaaatggtattaccgccgaagaagaaggtcatctcgtagaaagaggaactgaacacgaacatatgtacgttaaaggtttttacacttacccagcccctaatggtgaaaaatatactgttgaatacacttctgatggtgtaactggatttgtccctgttggcgcccacctcccaactgctcctgaagctcaacaacgctctgtagttcaacaacaataaatatattttgtataaaatatattatctacgttatacgtagtaaatttgtaaagttaatagaacccaatataatttaatctttggcatgcccgacctgaagcagcatgccgaattggctcgattggcggacgaacgtggctttcgagcgctgtgggtgcgtgatgtgccggtctatgacccgaacttcggggatgcggcccaagtgttcgaaacgttttcctacctgggttacctggccggtatcacccgcaacatcatgctcggcacggcggccgtggtattgccgctacgccagccgtggttgaccctcaaggcggccaatagcatcgacgaactcagc

SEQ ID NO: 2413 - DNA, 1330 bp, Diabrotica virgifera
aaagtattcaaaaaattgaaaaatttgacaagttgaaaacagggttcggtgtaaattagtgcaaaatgaactacctgattatttgtgcaatcttggctgtagcttttgcagctccacaaagagtggacgaagatgatggccaatatcaccctgaaaacagtggacaatatgccgctgatggtgctggagcatatagaggtgttccaacttcagccttgggttctctagtttctcaataccgccctcaaccaaaagcagtaaattattatccaggtgtaccaacccaatataacaatggccaaaatggtcagtacagatctgacagtcaagatgatggtcaatatcacccagatcattccggagattacaatggagatggttcaggagcatacagtggtgacaattccggtgcttacagtggtatccaaggaggagcttacagtggcaaccaaggaggagcttacagtggcaaccaaggaggagcttacagtggcaaccaaggagttggcgccagaaactacagatatcaaggtgctggtcaagggcaagtaaccagacccgtagtgcaaccaaccgtacgtgcacaacccgtatctagataccaaggtaacgcagctcaagctggtgcacaatctgcatatcgtaacaacggacaatacagcaataatggacaatacagcaacggtcaacacaatgtacaacacaaaagccaagatggatacaacaataatggacaatatagaatcattcgtaaatcagaagaaattcttgaagacggatatcattatttctatgaaactgaaaatggtattaccgccgaagaagaaggtcatctcgtagaaagaggaactgaacacgaacatatgtacgttaaaggtttttacacttacccagcccctaatggtgaaaaatatactgttgaatacacttctgatggtgtaactggatttgtccctgttggcgcccacctcccaactgctcctgaagctcaacaacgctctgtagttcaacaacaataaatatattttgtataaaatatattatctacgttatacgtagtaaatttgtaaagttaatagaacccaatataatttaataagtaaaaaaaaaaaaaaagggcggccgctcttttaagaaaccaggtttaccaagccgggggtgggacccccaaaatcttttttttttgggccccccaaaatttcaattttctctggggcccgcgccgtttttaacaatgcggggggaggggggggaaaaaaaacccggtcggggtttttcccacccctttttttttcccttccttttcatgaccccactctttccccccccc

SEQ ID NO: 2414 - DNA, 838 bp, Diabrotica virgifera
aatttattgtagaggttgctatggtaggacttttggtcctaggggtgtaggttttggtatgggcgctggacccctcactatggcttgatctgcgcactttatcagcaaactttcttaatcaatgccacctaagggatcagtgacaatctagcagcaattcgtcctccacagaaatcgtatattttgggtcgtgtttgtaaacagggacagaaacagaaaataatataaaaaaaataaaaaaaaaatcgtcaacatcgtgtcccaaaagtgaattcctttttgtgctaaaagacagaagtcttgaaacattccaacgtatatgatttctgttattttaaaatattggttaagactgtattcaaagtcgagttgatttgcaattatatttatgctttggagcgcatatttttgacatattttttgaagaagataatttttattccattttttgaagaaaggatgtacgacgtagatggatctgttccaaatgccagcgaaagtccgatttttatattcgtttcgaccatttttatatacgcactaagtaacattttgtaaataaatcaataaatacctactaaaaataagactttggattggagcaagatggtcggcgaatatacaaatcggttgaatttttggacgaacgaccagggaacgaatcctgggattttttttatatatctacatcggccacgttgttggtctatcgatagcttcgcgcttttgccatattaatgttagttaagttttccgctgatatattgactataccaaaatttttgtctagttgtaattaataaagttttaataaaacccacgctgatttggccgcaaa

SEQ ID NO: 2415 - DNA, 2441 bp, Diabrotica virgifera
  misc_feature (9)..(9): n is a, c, g, or t
taccgggtnccgggaatcccacgcgtccgagtggttgtagtgaggacactaagcccttatccaccacacttactcgattccgaaaagaacgaccatcaactaaatcaaaatgcctttcaaaccagcagacaacccaaaatgcccaaaatgcggcaaatccgtatacgccgctgaagaaaaagtagctggaggatacaaataccacaaatcctgcttcaaatgcggtatgtgcaataaaatgctcgactccaccaacgtaactgaacacgaagctgaattgtactgcaaaaattgccatggacgtaaatacggacctaaaggctacggattcggtggtggagctgggtgcttaagtatggacgatggagcccaattcaagggcgatgaagactttgtcaaaagccgtgctcctttgctgcccagagctatcgctaaagctcctgacggcgaaggatgtccccgatgcggaggctatgtctatgctgccgagcaaatgcttgcccgtggaagagccttccacaaaacttgcttcaaatgtgctgactgtaacaaaggtttggactccgtcaatgtagctgaaggtcctgacaaggatatttactgtaaagtttgttacggaaaacgatttggacctaaaggttacggatatggtcaaggaggtggcactcttcagagcgactgttttgccgtcagcgatcaagcccccaagacaactctcatcgataccaccagcatcaaggccaagcccggccaaggctgccctcgttgcggtggtgtagtctttgctgctgaagaggtcctcgccaagggacgcccatggcatcgcaaatgctttaagtgcagagattgtaccaagaccttggactctatcaacgcttgcgacggtccagacaaagatgtgtattgtaagacctgttacggcaagaaatggggaccccacggttacggcttcgcttgcggatccggtttcttacaaactgatggccttaccgaagaagaaatttctcaaagccgacctttctacaacccagatacgacttcgattaaggctcctcctggccaaggttgcccaagatgtggaggaatggttttcgccgccgagcaacagctggctaaaggaacgatgtggcacaagaaatgtttcaactgcgccgaatgtcaccgaccactcgattcggtgctcgcctgtgacggtcccgacaaggaaatccattgccgcgcctgttacggaaaactgttcggacccaaaggatttggttttggccatgctccaactttggtatgcgccgatggaactgctcccgcagttcacgatccaaggcccaacagtggacctaaagctgcacctgggaaaggttgcagacgttgtggatatgctgtttatgctgctgaacaaatgattagtaagcacggacagtggcacaagaggtgtttcagctgtgctgactgcaaccgttctttagattctaccatccttaatgatggacccaatgggagaaatttattgtagaggttgctatggtaggaactttggtcctaggggtgtaggttttggtatgggcgctggaaccctcactatggcttgatctgcgcactttatcagcaaactttcttaatccatgccacctaagggatcagtgacaatctagcagcaattcgtcctccacagaaatcgtatattttgggtcgtgttggtaaacagggacagatacacaaagtaatataaaaaaaataaaaaaaaaatcgtcaccatcgtgtcccaaaagtgaattcctttttgggctacaagacaaaagtcttgaaacattccaacgcatatgatttctgttattttaaaatattgggtaaaactgtattcaaaggccgaggtttgttaaattaattttttttgcttttgggggcgcgtatttttaaatattttttttttgtaaaaaaaaaattttttttttttctttttttttgaaaaaaaagggggaaggtcgagttgatttgctgttatatttatgcttgggaacggatattttggacgtattttttgaataagataatttttattccattttttgaagaaaggatgaacgacgtagatggatctgttccaaatgccagagaaagtccaatttttatattcgtttccaccatttttatatacgcactaaggaacattttgcatataaatcaataaatacctactaaaaataagactttggattggagcaagatggtcggggaatatacaaatcggattgaatttttggacgaacgaccagagaacgaatcctgggattttttttatatatctacatcggacacgtatgttgagctatctatagcttcgcgcttttgccatatgactgctaattaagtataccgctgatatattgactatatcagaatttttgtgtacttgtaaataataaagatttagtaattgggaacaa

SEQ ID NO: 2416 - DNA, 830 bp, Diabrotica virgifera
aactgcatttgtgaccatagtttttccgataggaacgcacatgtttttcaatcatattttctttttctttctaattctttgaagttttcattaatttgtttataaaaaaaactatttaaaaaaataatagttaaatcacaaaataatttgaataaaatataaattaatgtagaaatatataatttgttcaaccattgtttaagtggttgtagtgaggacactaagcccttatccaccacacttactcgattccgaaaagaacgaccatcaactaaatcaaaatgcctttcaaaccagcagacaacccaaaatgcccaaaatgcggcaaatccgtatacgccgctgaagaaaaagtagctggaggatacaaataccacaaatcctgcttcaaatgcggtatgtgcaataaaatgctcgactccaccaacgtaactgaacacgaagctgaattgtactgcaaaaattgccatggacgtaaatacggacctaaaggctacggattcggtggtggagctgggtgcttaagtatggacgatggagcccaattcaagggaacacaataattttaagaaggaatcaatgtgaagatggcggccaaaaccacaccaactgtcagcggtcgtcagttctacccttttccatcccccactatacactaatgtaatatttttagatcttaaattacagacttagttttaatttataaattttcgtatgacacgttataaataagaattcggttattttgtaataattgaattaaataaatcttatttaagaccaaaaaaaaaaaaaaaaggcggccgctcgcgatcttttactagttgatg

SEQ ID NO: 2417 - DNA, 937 bp, Diabrotica virgifera
  misc_feature (905)..(905): n is a, c, g, or t
gtatttttggatttcatcagtttataaataattaccaaaattttcgatgattcataattaagcaatcaagaaaggatacctctcgtgggcaaggtcaacattcaagattcaagtttagctttaataatgttaggttattaaacacgttatttgtttaccactcgttgttaagtgcacaatttatacgtttggctagtttttatttttcattcagtgtcagttcatgagtcgtgtgttaaattacagttgaacttaatcattaattattgtacatacaccatagataaactcgttcagtatcacgcataattcaaataatacgacaataatcacaatggagatggaaactgaacaagtggaatctgagttaataaatggtgggaagaacggttgttggaccaaattttcagaaaaacgactggcacaagtagaaaaaactattttgaatgtattaaaaactgcttatcgtacttggttcgtaccaattggaagccaactcggcaaagaagacaaaatatggaccatcgctttaaacgaacaatccaaaaagactccgctagttatgctacatggtttcgctgccggactgtgcttctggattcttaattttgatgaattgtcaaaggataggccagtatatgcgatagatctattaggatttggaagatcatcacgaccaaaattcagcggtgatcctgaagaagcagagaaacaaatggtagattccctagaggcatggagaaaacaaatgaaactagaaaatatgatcctcctggggcatagctttggtggatacctggcaacaagttacgctataaactatcccgatagggtaaaacatttaatcttagccgatccttggggattcacggaacgtccagcaaaagtagaggcgccattttggnttaaacttataatttttgctgcatatcctttt

SEQ ID NO: 2418 - DNA, 657 bp, Diabrotica virgifera
  misc_feature (12)..(12): n is a, c, g, or t
aaagttaccagntgtgctgttaccaatttaatttttattcttttaatttgttagcgttaagcgtctgcagaaaagatgccgctgagaattgattcaagagctgacgatgtcgataaacatgaacatgatattaactgtttattgtttaacgaggggaagctgtatagtggagctgatgatggaactatcaaatgctggttgccagatctgaccaaaaaatcagagataaaagccaattcatgttcggtatacagcttggcaggcgataacaattgtatttactcatgttcaaacgaaggaagtgtcgattcttatgctttggatacattggaaaagaagtcagtcctgctccacaattccgaagtagaatattggagagttcgatcagttaatggagtgttgtattctggagataacgaaggatttgtcaaagtatggaaaaatggaacactttatggatcaataaatatctgcgaaccagttaaggacatggttatttttaagaacctcttaattactgcaaaccatggggattgttgcaactgatcttaaactggaaggcgaacatattcagtttggagtaaaggatttactaggggtcacatttcctttgactttaataagactagaatccgcagctaaccttccctaagaacc

SEQ ID NO: 2419 - DNA, 981 bp, Diabrotica virgifera
  misc_feature (707)..(707): n is a, c, g, or t
  misc_feature (714)..(714): n is a, c, g, or t
  misc_feature (726)..(726): n is a, c, g, or t
  misc_feature (746)..(746): n is a, c, g, or t
  misc_feature (780)..(780): n is a, c, g, or t
  misc_feature (811)..(812): n is a, c, g, or t
  misc_feature (833)..(834): n is a, c, g, or t
  misc_feature (883)..(884): n is a, c, g, or t
  misc_feature (892)..(892): n is a, c, g, or t
  misc_feature (899)..(900): n is a, c, g, or t
  misc_feature (914)..(914): n is a, c, g, or t
aaactttcccgtccagtgccagttgacagccattcattatatcggtctaccattaaagctttagtcagtgataacagcttagatcgttgtctcgtcatatacttcccagtgtatttaattggttaaaatgttcataacctcacaactttctcacatttctgtggtctgatcttatttttccttctccctttgtagtgctttggtgcttaactgttaaattttctcggtattgttatatagtgtagaggcatgtacgctgacaatcaatgcaagaataaatcgaaggcatttgacacataggtatcttaaaataataaagtagctatccaggaaagactccaaatgatgaacaaacgaaaagagttgttaattaaaactgcagtatctgtactaaaattgccctgaagttagctaacatttatcgcgaagatgacacttgaagaaaatgaaggttttctgcaatagcctctttagtgcactaatcaatctctataataataactcttgtctgttttttaacttacaagggtaatttctagtgtattaaagtcttggggcatatgagaaagacaatagttgtactcttcaagctacaatattattcctggatttgatccaaggggtttagttcgcaggctgtgcagacttgatacctatagatttttttacaaacacctggatgattgacaaaattgatggaaatttgngagtccncagtgatcgtanaccatctctaccaggtcctncaaattttttaccatagtatttttattttacttntgtttatatacgagcacgcatggtatatgtnnctatagtgctacaagagctgnntaatgtattgattctttcagtacttattatttttttattatattagaannatcagaangataatnnctgtaatagggttncttgcagctactttgattctatttggtttgtatttattttgatatatatatttccatccaccacatc

SEQ ID NO: 2420 - DNA, 1026 bp, Diabrotica virgifera
tacaagactcaattgtaggttatccttttactcaaacttgccgaaatttcatcatttgttgcccaatttgtttcaatattgttctgattttatttaaaagcggcacttaaacatagtatataaccatggttgagaacagtacattaactatagatgaaaaatttcacctaatatccagaaacctgcaggaaatattaggtgaagatagaattaaagcagtattgaaagaacgtgatttgaagttgtattggggcacagctacaacgggtaaacctcacattgcctacttcgttccaatgtccaaggtagcagactttctcagagctggtgtagaagttactattctttttgctgatcttcatgcgtatttggataatatgaaggcaccctgggaacttctagcgcttagagttcagtattacgaacattgcattaaagctatgcttcaatctattggagttcctttggacaaacttaaatttgtgaagggaacagattatgaattgtctaaagaatacacactagatgtttacaaaatgacttcagttgttactgaacatgatgcaaagaaggctggagctgaagttgttaaacaagtagaaaatcctttactaagtggtcttctatatcctagtttgcaagcactggatgaagagtaccttaaagttgacgcacagtttggaggaatcgatcaaagaaaaatctttacgtttgcagaaaaatatttaccccaattaggatacaaaaagagggcccaccttatgaatccaatggtgcctggattaacaggaactaaaatgtcctcgtcagaagaagacagcaaaattgacttacttgactcccctgccaatgtaaaaaagaaattgaagaaagctttttgcgaacctggaaatattgaaaacacggccttctttcttttgctaagcatgtatatttcctttattaaaacccacgcgagaaattcgtgacttaaaaaaaaaaatggaggagacggaaacttttctggaacttttccgaaaattgaaa

SEQ ID NO: 2421 - DNA, 1185 bp, Diabrotica virgifera
  misc_feature (15)..(15): n is a, c, g, or t
  misc_feature (22)..(24): n is a, c, g, or t
  misc_feature (31)..(31): n is a, c, g, or t
cttaaagcgggaaangctaggnnngaagggnattcaagggaccttatatcaagcatcgccaaaatagttggtttcgaatttgaaatttatgttgttgaagataatcattatggcttctatcatgaagaaacagatacttggaatgggttaatcggcgatgttattaatcagaaagctcacctggggattgcagatcttacgataacacaagaacgacaagaagtcgtggacttcagtttaccattcatgactttaggaatcagtgttttatacagaatacccgattatggtgaaactcgtacatttgcagtattaaatccattttctcgttctgtttggatgtctatcgtttatgcttatatctttatttcacttggattatacattatactaagattatcaccggaggattgggaagtaagccatccctgtgatgaactcgatgatacaatgaaaaattattggaatctgaaaaattgtttaacggtggcttttaagggccttacatctcaaagtaatgatatattaccaaaaggtcaatctgcaagactggctatcactatggtggatgtttagcttgttaatctcaagtatgtacatagcgaatttagcgttgatggttaaccaagcaaatatggagccctctatagaaagtgttgaggatttggcgactcaaacaaaagtaaaatatggttgtctacacggaggtgctactcaaaattttttgaagactgcgaattccacgatttaccaaagaatggatgctactctggagcaatctccaagtttacttgttaatactaatgaagaaggtatggaaagggtactagaatctgaaaatggtctatatgcatttttgatggagtcgactcaaattgaatatcaaatacaaagacactggtgaactacgacaagttggaggatggctagataatagagcatttggaattgccatggccaacagatgctaattatagaggtgcaataaatagagccattttaaaactacaggaagatggatcactcaacgatttaaaactgaaatggtgggtggaaaagaatgaaaatggaggaagatgaaacggagccttgtcaatcagaagatcctgtctcgactggagagttatcgatagaaatggtagaggacggtcataattttacgtattgggataggcattgcattcg

SEQ ID NO: 2422 - DNA, 815 bp, Diabrotica virgifera
  misc_feature (748)..(748): n is a, c, g, or t
cccacgcgtccgtatttgtcgcatcaactgaagacatgagaaaataattttttacaacataatattttcagatattaaatcaagatggtactagcggatttaggtcgtaaaattacgaccgccttgcagtctttaagcaaggcaacaattattaatgaagaggtcttaaatggaatgctaaatgatatttgtcgggcactcattgaggctgatgttaatatcaaattagttaaatctctcagggaaaatgttaaatctgttattgactttgatgaaatggctggtggtctcaacaagaggaggatgatccaaagtgcagtatttaaagagcttgtcaaattggtagacccaggagtaaagccatatcaacctgttaaaggcaaaccaaatgttattatgtttgttggtttacaaggttctggtaaaacaaccacttgtaccaaactagcttatcattatcagaaaaagaactggaaatcatgtttggtatgtgcagatacattcagagctggtgcctacgatcaggtaaaacagaactgtacaaaagctaggatacccttttatggaagttacacagaagttgatcctgtagtcatagcccaggatggtgttgatatgtttaaaaaggaaggttttgaaattataatagtagatacaagtggtagacacaagcaagaagaatctttgtttgaagaaatgttggcagtttctaatgctgtgagaccagacaatattattttcgttatgnacgccacaattggtcaagcctgcgaagcccaagcaaaagcctttaaagaaaagtagatgtaggatcc

SEQ ID NO: 2423 - DNA, 1011 bp, Diabrotica virgifera
  misc_feature (995)..(995): n is a, c, g, or t
ttcgtccgactagtttggttagttttcaacgccaactacatcccttatctacaaaatctgattatttgtcaattctttaaaatgacacaaaatgataaatccaatggtatggtccccaaaatgttttcacaaaggcacaaagttaaattcaaagacgtctcataaatttttccaatctctgttttttataatacgatatcaaaagaacaacttacaaaagaatcttaaatggaatattaaggcagaagtttgcccattgcacaacattcaaggcaaaggttattttgaaagtgtcctaattaacgtagcacacgttccccaggttgtattccttaaaaagaaatcagtaaattcgcttctaatttgagtattcaaataaaagattcaaaagtactttaacccgtacctttttgaatatttatacgaagagttttgtatacaattgcactgcccgttttttttaatacgatatcaaaaaaaatacaacaaaaatctaaaatgacacactaatacaaaggtttgacaattttataatgtcgaaggtgtaggttatttcgaaggtaaaattacggtagaattatttcgtaatttgagaaaacattgaagaacatgtaaaatattatgttcagaagactgtattttcgtccaaaattaaatattccaacgtttcaactactttatgataattatttgattatttcaagatatccaatttactaaagactagatataatctaagaaatatacagttcccatctagtttgagtaatataccaaaatacttgcgaatctataaaaggttgatggttaaaatttgtggtattgtggtccaaaaggaaatctttccaaaataatttcaatatctacgatgcatgcatttttcgaatgccttagttttttcattctacgtaaaaaataacagctataagtgctggtttcgaaggggtcactaagtttgggtagttttcaacgccaactacatccctcatctacanaatctgattatttgtc

SEQ ID NO: 2424 - DNA, 1090 bp, Diabrotica virgifera
ggtacctaacaggcataagtaggtttcctaccgcagaggtcaaagtagtactactttcggatttaaaccgcgcaatttagtgtgtttactaaagtgttgagttggtgtttaaaaatgaagtttattattggcactgtggtgtttattgctattttccaaaaagccttcagtctccgttgttggagatgttcgagtgacattgattcatcctgcagagatccctttaacgactataattctcgatccgggtccaattcatacgtttcgcaacaaagctatcaacaaagaccgtacgaaaatcaaaggcaatacgactacaataacagacaatatgacaataataattataataggcagtatgaccctaattacaacagacagtacgaccagaactataataatggcggatataatggaggatatcgaaatgatttaaatagtagaccgaactacgagacttgtgatgacaacgaagcaaggaacaggcgaatgaagaatgtttgtctgaaggaaattgtaagaggaagcaactacgtaagtgttgttcgacgatgtgaactggttccatatgaacaaacagtaggaacatgctcccaaagcgtcagccgaggactaaccctagatttctgtgaatattgcgattgggacggctgtaactccgccacaggacacaaaactaacctcttagttggaatgatatctttaattgctgtctttttatatcattagatacttacaacattaattactttaattaattaagcagtgatggtgcgaaaactaccagagggactcttaaatcatcacaaaccatcgttatagatgtagttaataagtaaattagttgtttagtaacaaaaaaaatgtacaaaaactttattattgttttatttaattttactaaattgtggatacgaggctttttcaattgaaactcatcctttgggtcacaaaccattttattttgtagggtaggtacttggtttctacatttttttaataatttaacacctttaaatgaaaaaaacttccccgcatttttttcctccaaccgaaggtaatatcatggcttaaaaaaaattttttgggg

SEQ ID NO: 2425 - DNA, 425 bp, Diabrotica virgifera
caagaagcagagatgtctgctcacaaaacttttatcatcaagcgaaagcttgccaaaaaacttaaacaaaacagacctattccccaatgggtccgtatgaggacaggaaacacaatcagatacaatgccaagaggcgtcactggcgtagaaccaagctaaagttgtaaattgtttttatattcaattgacctttatttactttagttaataaacattactccataaaaaacaaaaaaaaaaaaaaaacaatatcagggtgcataataagcagtgtttgagaacaaatatttaattgctaatcaacaattattaagctcctaaatattcctaaagaggtcattttttccactacaatagcaaatagacaaaagtcacaattaaatgtgtacacttacgatcactgaatagtttacaccttaatttt

SEQ ID NO: 2426 - DNA, 3077 bp, Diabrotica virgifera
gtccgaatgggcatcctcctcaccgggacatgggaaaaaaatggcatctcctaccggacaaggaaaaattctctctgggacacaaatttccaaggaaattaacgaacaactgaaaaatgtcgtaaacgaaattaaaacaaggttaccaaattttcaaccaggcttagctattgttcaagtaggagatagagaagactcaaatgtatatattcgcatgaaaatacagtctgcttcaaatataggaatcaaggctcaacatatcaaattgccaagaagcataacagaattagaagtattaaacaaaatagaagagttaaacaatgatccaaatattcacggtatcatcgtgcagatgccattagaatctgacaataaaattaattccaatttagttactgatacagtatcgcccgacaaggatgtcgacggtttaaacaccatcaatgaaggaagaacagcaattggagaactgacttctttcctcccatgtacgcctaacggtgtaattgaactgattaagagaagtggcctacctattgcaggagctaatgctgttgttctaggaagaagtaaaattcttggaaccccatcagctgaattactcaagtggaatcacgccaccgtcactgtgtgccattcgaaaaccagagatttaccagcagtgtgcagacaagctgacattctagtcgtaggaataggtcaaccagagctagtcaaaggaagttgggtgaaaccaggagcagttgttattgactgtggaatcaacgctattcctgatcctaccaaaaagagcggccaaagactcgtaggtgatgtagattatgcagaagctagtaaggtagcgtcttacattaccccagtaccaggaggtgtaggaccgatgacggttgccatgttgatgaagaacactgtacaaagtgctcaaaaagctgcagagaaattgctgaatcgctcatggaacttaacaccattgcctttaaagttgcaggctcctgtaccaagcgatatccgtatagcgagagcacaagttccaaagaacattacacatttggcagaagaaataggtgtattccctaatgaactttcccaatatggacctaagaaagctaaagtttcgatatccgtgttggaaagactaaaggatcagaaaaatggaaaatatgtagttgtagcaggaatgactccaacacctctgggagaaggtaaaagtacaactcttttgggattggtgcaagctttgtcaacacatttgaaaaagaatacatttgctacaatgaggcaaccttctcaaggtccaacatttggtattaaaggaggtgctgctggtggaggatattctcaagtcattcccatggaagatgtcaatcttcatctcacaggagatatccatgctattacagctgcaaataaccttttggcagctcaacttgatgctaggattttccatgaagcaactcaaaaagatgcagctctatatgatcgtcttgttcctaaaataaagggtgcaagaacattctcaaagattcaacttagacgccttaaacgattaggtataaacaaaacggatcccgaaagtcttacaccagaagagagaactaagtttgccaggttgaacattgacaccaacaatattgtttggaatagagttttggatatcaacgacagattcctccgagaaatcactattggtgaatctccaaccgaaaaaggtatgaccagaaaggaaggcttccaaatcagtgttgcaagtgaaattatggccattcttgctttagcaagagacatggctgacttcaaagaaagattagcaaacatggtggtagcgttcgacaaaaatggtaaacctgtcacagccgatgatttgggagccactggggctttattggtattgctgaaagataccatagaaccaactttattgcagagtttggagggatcaccggtattcatgcacgctggaccttttgctaatattgcccatggttctaactcaattattgctgataaagttgctcttaaattagttggagaggatggtattgtagttaccgaagcaggattttcatctgacgttggtatggaaaagttctttaatatcaaatgcagagcatccggagatgttccaaacgctgtcgtacttgtttcaaccataagagccttgaaaatgcatggaggtggtcctgcagtaacaccaggagcacctttggcgccgcagtatactgaagaaaatttggacttgcttcgtaaaggacttcctaatattctcaaacacgtaagcaacgcggtgaaatatggaatcccagcggttgttgcaattaatcatcgcgaaaccgacactgaagctgaactggaactcttgagacaggcatgcaaaaactctggtgcattcgacgcagtagtttcaaaacactggtcacaaggtggtcaaggtgctctcgatttggctaaagctgtcgtggcagctacttctcaacccagtaacttcaaatttttgtatcaacttaaccgaccaattaaagaaaagattgaaattatcagcagagaaatgtacggcgctgcaggtgtgtcctatagtgaaatcgcagaaaagaaaataaagcagtacgaggaacagggatatggaaaccttccaatatgcatggccaaaactccgctatctttaacggcagatccttcaattaagggagcaccatctggtttcgtcattcctgtgagagacatgtccatatctgtaggagcacaattcataattccatttactggagaaattacccgaatgcctggattgccaacaagaccagccatttacgacatagatctaaacattgaaactggagaaattgaaggactcttctagtagcattattcaatgtgaattcctcttctacatattattatgtaatacctattgaaaattaagtgaaagcgtaatacattgttttgaccagatttttaaaaaattcaaatatttttttttatattttaaaaaaatgttttacatattcttaagaagtatctcgcattaggttttaaaattttgtatattataattaatatgtatataaataatttttaat

SEQ ID NO: 2427 - DNA, 1894 bp, Diabrotica virgifera
cggacgcgtgggatggcatctcctaccggacaaggaaaaattctctctgggacacaaatttccaaggaaattaacgaacaactgaaaaatgtcgtaaacgaaattaaaacaaggttaccaaattttcaaccaggcttagctattgttcaagtaggagatagagaagactcaaatgtatatattcgcatgaaaatacagtctgcttcaaatataggaatcaaggctcaacatatcaaattgccaagaagcataacagaattagaagtattaaacaaaatagaagagttaaacaatgatccaaatattcacggtatcatcgtgcagatgccattaaaatctgacaataaaattaattccaatttagttactgatacagaatcggccgacaaggatgtcgacggtttaaacaccatcaatgaaggaagaacagcaattggagaactgacttctttcctcccatgtacgcctaacggtgtaattgaactgattaagagaagtggcctacctattgcaggagctaatgctgttgttctaggaagaagtaaaattcttggaaccccatcagctgaattactcaagtggaatcacgccaccgtcactgtgtgccattcgaaaaccaaagatttaccagcagtgtgcagacaagctgacattctagtcgtaagaatacccacgcgtccggtttatagtttagatcagtactgtcatgaaaccatttgattaaatatacaattattctattgcaaagatcctaccaaaaagagcggccaaagactcgtaggtgatgtagattatgcagaagctagtaaggtagcgtcttacattaccccagtaccaggaggtgtaggaccgatgacggttgccatgttgatgaagaacactgtacaaagtgctcaaaaagctgcagagaaattgctgaatcgctcatggaacttaacaccattgcctttaaagttgcaggctcctgtaccaagcgatatccgtatagcgagagcacaagttccaaagaacattacacatttggcagaagaaataggtgtattccctaatgaactttcccaatatggacctaagaaagctaaagtttcgatatccgtgttggaaagactaaaggatcagaaaaatggaaaatatgtagttgtagcaggaatgactccaacacctctgggagaaggtaaaagtacaactcttttgggattggtgcaagctttgtcaacacatttgaaaaagaatacatttgctacaatgaggcaaccttctcaaggtccaacatttggtattaaaggaggtgctgctggtggaggatattctcaagtcattcccatggaagatgtcaatcttcatctcacaggagatatccatgctattacagctgcaaataaccttttggcagctcaacttgatgctaggattttccatgaagcaactcaaaaagatgcagctctatatgatcgtcttgttcctaaaataaagggtgcaagaacattctcaaagattcaacttagacgccttaaacgattaggtataaacaaaacggatccccaaagtcttacaccagaaaaaaaaactaagtttgccagggtgaaaatttgacccaaacaatttgtttggaaaaaagtttttggaaatcacccccaaaatccccccccgaaaacaccctttgggggaatttcccacccaaaaaaggattgaaccaaaaaggaagggttcccaaaccccgttgcaaaggaaatttatggcattcttgtttttaccaaaaaaacgggcttggctataaaaaaaaaataaaaaacatggggggggagggttcccgaaaaaaagggaaaaacccttccccacgcacgcgtgtggggggggcccgggggcgtgtttttttttttttttttttgtaaaa

SEQ ID NO: 2428 - DNA, 1762 bp, Diabrotica virgifera
cccagcatccggtggttgcgaaggtaaaaacatgaaggcgtttttggtgtttgtagcctgtctgggcttggctgtagccagtaccgcagacgctaagaacaagaaagtcgaagttgaggaaaagaaaatctcaaaacgtcatcatgaccactacagcaccctaaacacctacggaggagatctcgctagtcaaagcctttcaagctatggtggtgacctctccagccactccagtggtctttctgggtacggtagcggtctttcaggatacagcagtggagtttctgggtacgatagcggcctttctggatacagcagtgaaggcggttacagcagtggatcgtcatctgaatacagcagcggatcccaaggatacggtagcgatttttctggatacagcagcggatcccatggatatggtggcgatctgtctggatacagtagcggatcccacggatatggtggcgatttgtcaagctacagcagcggatcatatggatatggtggtgatgcatctggatacagcagtggcttaaacggaggtctattaggagattcaggttctgtatcctatggataccactcagtagctccagtagtccacaacgtccacagtacccacgaagttcgccgcatcacccaaaaagttccagtaccagtccctcaaccttaccctgttaccgttaccaaaaccgtccaggtaccacaaccagtgcctgtggaagttccaaaaccatacccagtacctgtcaaggttccagtgccatacgaagtacccaaaccatacgaagtcaaagttccccaaccagtggcagtccctgttaaagtgcacgtacccgtggaagtaccaaagccatacccagttcatatcaccaaaaccatccccgttccagttgaaaagaaaatttacattaagcaattggtacaagtaccacatccagtaccacaaccctaccctgtgacagtaaccaagtatgaacaagtaaaagtacctactcctgtttacgtaaaagagcgaaaagtagtacacacttattccaactcataccaaaacttgcctgagaagcacatcgttctcaaacctcaagtttctgcacaagttccacaatattcaaatgctggttatgatgcttcatcatatagtagctctcttggaagttatggatctggatatggatctaattatggatctagttatggatctggttatggttatggaggtcatggcagctcaagctacaacttaggaagctatggagacagctataattctggtgtaagcggattaggatataacaatttgggaggttctagctcaagcggtttaggatatggcagttatggaggttctagctcaagcggtttaggatatggcagtttgggaggttctagctcaagcggtttaggatatggcagttatggaggttctagctcaagcggattaggatatggcagtttgggaggttccagtggaagctacagcagttggggaagttccagcttaagtggtcttggtggttccagcggtcacttaggaggtcatggaagttctggtcatggactttatggtcatggatcacactcctacggtttgggtgactcaagttcacagtacagccatagctacggtcacagccaagccttcggtcatggtgacgactacagtggtcttttaaaatcatatgttccaagcaagttaggtggttataataacaaatggtgaaattgtaaatagtttttcaataaaataaagttttaaaat

SEQ ID NO: 2429 - DNA, 1005 bp, Diabrotica virgifera
tcgtgggtcgatacaagcctctaaactgacgtcctagtaaaatctcgtaaaaagtgcagtgttagtgaagaatattttgggataagacaaagatatggactccaattttgaagccataatatgctgttcagatcagcgataaaactgttgattgtattatgtttggtggtgaaaaatgtgacgactttcaacccaaacgatgactactatgaccctcctaagtataacgcagaagtattcctgccagtgcctcagtacataggagaagatcaatctggttgcatatgccgtgaagttcctaacgttttcacactatgtttcggcatcaccaagtgcaacgcactacccataacactgaatataagtactccagtgcttagtattataggaacacatgtgtcagaaattcatgctggggatctcagtaatttatgttttttaaaagattttaagctcgaaggcaactttaacttaacatatattgctccaggtatatttggagaaagtttcgataggcttgaaaacttgtctataagttacaacagaaacttaaaaacgttacagccagatacttttattggtctaataaatctcaaacaggtgtttttgatcaaaaatggttttacaaacttatatgacattacagtaaatttgtcaccaaatatactgccaagtttgaggaaactgtctttaaatgaaaacactttcaccactattttcgaaaactccttttcgcagatggaaaactcttctttagaggaactagatttgatattatgcaacttgcagtacgttcatcctaattttttattaccgttaaaacacttacaggcactacgtattggagaaaactttttaaacgaatctgtcattagcgactctttagtacccgttattaaacataaactgcctttaaaactgctcaatttatattcaactggtttcagggtacatttgccaaagcaactactagaaatcatagcttcatcaaacatcacaaatctt

SEQ ID NO: 2430 - DNA, 860 bp, Diabrotica virgifera
agtgactgtgaaagagtaaagttcatttatcgagctacttttcgaatacgaatgctttttaaccgacttttaccctgtgtttgactatttaagtgcttttttaccctattatcgtgtcgtaacgaacgtttataaagtgacaatcagttttccctttaaccacattgaacaagaacttacaaaaatgtctaagcaacaaaattttccagatacaagtgcttcatcagccagcgaagacaaaaaggctatctactacgaatcctccaagactgacagcgggttcatatcgggagaaatatccgaggaaatcctagattcgggtttaatcgaagacgtcgacaaacccctcaacaccacagcttcttttaccgaggaagaggaaaagaaagttgaacccatgcttctggacagtggcgtgtgccttacggagagcttttccaagataagcattaaggaaatcgagtctggagtgaacgatctgaacaatccgacgaaaaaaccaacggcacctgttgattcctttaccaaaaagcaggtcaagcctgccgaggctattccatggaagatctactacgagcaagatgaagaaggagacacacatcttcacatggcgatcgcccaaggattcctcgaagtggccgtagcactgatccgtgccgtaccccatccgaagctcctagacaccgccaacgacgacaaccaaactccactgcacctcgccgtcgagtcaggacaatggaggatcgtcagatccctcatcgtagcacctgcgatacccttctccaggggtccgcacggtgattccacccttctcgtagcagctcggaagaatgacagcaggagcgtgagggctattatcg

SEQ ID NO: 2431 - DNA, 1035 bp, Diabrotica virgifera
ctgcggtcccttcggtgaataccgatctcacaatttttaataaacgttgagtttttttgttagcaaagaattaagttttttttattatttttgtaggataagaaaataactgagatataaatgtttaaggcctatattttactgctaaaaaccatgtaaccgggaaaaaccattttctttagaaaataagggatttaacatattaaatttaatacgattttatagcacttggaatcacctttcaaaagtttttttgatcaacctgatatcataaaaattaacggagttattctaaaaaaaaacggaaaaatttttggagcataaattttaatgctatcaacttcttctggagctcagaacacatgttctgataatttgtggtactggtttacgaagtatgtgttataaaatgcatcgtttttcccgtgatttaagcatgaatacttgttgtcacttttgtttcttgaagtatcgtctacccactcaccaattttcatgaaaatcgatggagctttaccgaaatcggaggtattatgtagttgatttttaccttcatacaccaaatcaagtgttggtaaagtcccactagacatcagaaagatctgtgattttattttaacgtattgtaaaaaaatgcattaagatattctagtatcctacatttgtttccttgcaagctctgctgtttgttgatttcttgaaccttcaaccttgtatcagtaataagaaaaagactgattaaaatgagcacatttgttacaaaagacaaagtcaaaaaggatatttttttaaaagtgtgtcttcgtggcacctgtttttctctcatatattttgttcataattcttatcaatttttttttatttatattatgtcaagttgaaagttgctttcaagatacctcatttaaatcagtttttaaaaatagaaaagtagaaattagttctttaatagttaccatagttaaagtttttttgataattaagaatttctgtttgttacatttgacatttatttttttattaataaaatcttaa

SEQ ID NO: 2432 - DNA, 1789 bp, Diabrotica virgifera
  misc_feature (1450)..(1450): n is a, c, g, or t
  misc_feature (1703)..(1703): n is a, c, g, or t
gcaaaagagtctatatttcaaaaatatgacgatttgagcggggtgtacggaaatgggtgagtcaaaaagtttcacaaaaaaaagcgaatattttgcgaaatgaacgtcagattgaaaaactaaaaactatgtgtttaatgtttttcaaaaatctatcgaaaaataccaaacatgacccccacggagaggcggggggggtaaatttaaaattttaaatacaaatcccgcgatcttttgcaaaataaatatcatatcgaaaaactgcaaaaacactttatcaatatttttaaaaaatctatcgaatggttccaaacacgacccccacagaggtgaggtggggggcttactttataatcttaagtggtagcccccatttcttattgcagatttggatcgtttgtataaaaataaacaacttttattcgaaacaatttttctaattatggatagatggcgctgtaatcggaaaaaagattgtaggaaatggaaaattaaattaaaaaatgggaagtccccactaaaatggaaaattttacttaactttttttggttttaggacctaataatcacagcccaatagttccccaaagcgctcgagtgactgcacatttagcatactttgctcccctaccataatatatctgcttgttcctacaaccagaaacaaaattagagaactataggttcttccacgttgtgcgttacctttttcgttttccggtgacacaattgtaatgtatctgcttgtttcaactccgttgctgcaccaggagcgaagttagagaactattggctcttccaagttgtgcgttacctttttggctttccggtgacccaattataatatatctgcttgttccaactcagttgcttcaccagaagcgaagttaggaaactataggctcttccaagatgtgcgttacctttttcgctttccgacgacacaattgtaacatatctacttgttccaactccgttgcttcaccagaagcgaagttaaaaaactattgggtcttccaagttgtgcgttacctttttggctttccggtgacccaattataatatatctgcttgttccaactctgttgcttcaccagaagcgaagttagagaactattgggtcttccaagttgtgccttacctttttcgctttccggtgacacaattataatatatccgcttgtttcaactgcgttgcttcaccagacacgaagttagaaaactataggttctccaagtcgtgcgttacctatttcgctttccggtgacacataatatatatctgcttatgaatatttttttgatattgataactatttccgaagtgaaagtcgagaagtcaagtaaacttgatttcaaactcgaattgtggcttatgcccaaataaaatagtaaatcttgtttttaatacacgttacttttagtacaacaatgaactgacattttttanaaaggtccgcatgtacatttttttatttcagcttctatttccgttcagatcggatttaagttgtttctaagttaaatggttctttattgaggatcccacaataatgattttccacggtaaacatcaataaagtagatatttccttccgacagttccgaccattccattactaacaaatattcaactcatgcgcgcccaaaaccacaaaccactcgcaaacccgtccaaatacgtattgcgaaccatcaaagcngttgttgaaaaaccgacagaatttagatcgtggtggcgcgtgtgcgagccgtttgtgcaccacttgaaaacacgtactaatctgac

SEQ ID NO: 2433 - DNA, 1704 bp, Diabrotica virgifera
  misc_feature (1003)..(1003): n is a, c, g, or t
cctaaaaaattcgaaagggttcgcatattttcatcataacttgcttaattttgatgctattaacttcttctggagctcatttgataggtattccgaagtaatgtgacaattgttttgtaggtatattttataaaatgcatcgttttcccgttacttaagcttgaatacttagatttaagtactcgtcgtaaaaaatatacatttaattacccataacttactttgagttaccattagtttgaagtaaagattgtatttcattttgtattatcttcaattttggtagtaatagctttttttgtaaaagctcatagtttttaaattatacgtgaaaaacagctttaaaacatgtatttttttacgaaaaaatgaaatatttgatctttaccagctcaaaaagtattaatttatgttaataactttatataacaaattttgctaagaatttgtccctctatcgatttgaggtattatttgtaataaaatagttttcacccccgaaaaagtatggcatccacccccagggaaaaagcgcaagttgatattatgtcaactttgttccttgaagtatcctctaactgctaactaattttcatgaaaatcgatggaagttcaacgaaatcggaggtgaaaaccttcagtgactgcactaatgtgcttctaccatatggcttttaacagggaaattttttaacgggagcccgaaaaaaaaatctatccttaaaaatattcgaaattgtcagattaagataagttaagtatgtacatgcaaaagagtgtatatttcaaagaatttgacgatttgagcagggcacgtaaagaaatgggtgagtcaaaaagtttcacaaaaaaaggggaaatatttcgcgaaatgaacgtcagatcgaaaaactaaaaatatatcttcaatattttttaaaaatttatcgaatggtaccaaacatgacctccacgaaaaggggtggggtaaattaaaaattttaaatgcaaaccccgcgataanttcacaaaaggaacattagatcgaaaaactgcaaaatacactttcaaaatgtttttgaaaaatctatcaaatctataaaatggtatcaaacacgacaccctcatggaggtagggtcgggggttactttaaaatcttaaatgggatccccaaatttttatttcagatttggattttttacgtaaaaataagcaactttcattcgagacatttttgagaattatggatagatggcgctataatcggaaaaaacgattgttggaaatggaaaattaaattaaaagatggaagtcttttaggacctaataatcacaacctaataggtccccataacgctcgagtgactgcaaatttagcatattttgctcccctaccattggcatcttatcgtcactgtctgactgacaatattctgacaatactctattcgactcagtgcgttgtatgacaaagatagatttggaaaatattacctcggacattgttttcattttttcgaatcctaaaacaacaataaatgtttttgaaaaatttaaatgcagaatgaatgactaaatcattaccgagggccgaaagtcccttagaataaatttaataaaaagtatattttgaatgagatatttgaaattaaaaatcacactaaattttctcttaggttttcacccctgtaactaattaaaataaacattatagaagatctcag

SEQ ID NO: 2434 - DNA, 2235 bp, Diabrotica virgifera
  misc_feature (35)..(35): n is a, c, g, or t
atttaaagctcgtttgattaaacacaacaatattntatgaagaaacacaataaactaatttttcctcaaattttaaaaattatttttaaaaagagccctttaataaacggaatttttttaattctaagttattttaaaataactgaaattttgattatatacaatttgatttgatttattatcgactgattttcatttctattttataatttcaaaaaatgagttaaaaagcgttgaaatgcaattactttttagaagtaaatagatattttttttaattaagacctttttatttatcagtacagatataataaacagtattttctttacctaaaagtagggatagctttatttaatgatacatagtaggtattgttaccctctatatttatctgccttataatatgtactatcgatttttggacgtaatcctctccttgtctcttctactggtctgtatccaatactatcgtcatctatccagttccaatcttacctaatggtaggagagctcaagcggggatttttgcagttactaaagcgcgtcagatcatcatatggggagaaacctagtaccctgcaaatgtacctctaccaaatattggctcttaacacaggggagttcgttaagggcggcccgaaaaaaatctatccttagaaaactcgaaattgtcagattaagataaggtaagttaagtacatgcaaaagagtgtatatttcaaaaatctgacgatttgagccaggcgtaaggaaatgggtgagtcacaaagtttcacaagaaaaaagcgaatatttcgcgaaatgaaagacagatcaaaaaactaaaaaatatgtgctcaatatttttcaaaaatctatcgaatgataccaaacacgacttcccggacgagaggggtggggggtaaattttaaattttaaatacaaatcccgcgatatttagtaaaataaacatcagatcgaaaaactgcaaaatacacttatttaatatttttgaaaaatatatcgaatggtaccaaacgcgaccccccacggaggtggggtggggggctactttaaaatattaaatgggagcccccattttttattgcagatttgaattctctgcataaaaataagcaacttttattcgaaacattttttcgaattatggatagatggcgctatattcggaaaaaacgattaatggaaatggaaaattaaattaaaaaacggcaagcgcccgctaaaatggaaaattttacttaactttttttggttttaggacctaataatcacaatccaataggtcccaaaagcgctcgagtgactgcacatttagcgaactttgctcccctactataagagagaatgcacctttagaatctaacgatacaagtttggatttagaggttaatataattgaaattttgaaggataacagccaattgtgacagtatcgctaccaaatcgtatgtcagatcatcgattacatgatctatgatcatgcaattttacaataattggcattcgagaaacccatcactggttaacagttgatcaaatctgacagccgattagatgatcggagatttgaataacgtttcggaaaccggctgatagtatagcacattatagttgttattattattatattataggtatatagctaaatataaatgtacattataactttataaaatacgtccaccgataatagccatttcctatttacaatgacagtaggtacaaatttgtacttataatttttcggaaatgaatataacttgaattgactattccttgttgtattttttacaatacataattaagacaccatttgctaatagtaagcaaccaattattcagccatgtactattggtaaacaaaattcatttttgtagattataattttaatctccagtggttgataattatatttttttactaattaaaataaaaaaaggtcgtagaaaaagaataatattctacttgcatgctatggctattactcactctgatgaattacgacactcgtctacagcttgtgtcacaaacttcatcatcgtgagtaatagccagcattgcatgctcgttgaataatatgctattatctcatcttgtgtattgtgattatactgtataatatttaatcttgtagtcaagtgctttactatgctttaaatgtagtcctaataaaaacatggacatctagtcaaatatgaaacagcctcttaattaaattattttttaaca

SEQ ID NO: 2435 - DNA, 1642 bp, Diabrotica virgifera
  misc_feature (1497)..(1497): n is a, c, g, or t
  misc_feature (1550)..(1551): n is a, c, g, or t
  misc_feature (1554)..(1554): n is a, c, g, or t
  misc_feature (1561)..(1561): n is a, c, g, or t
agggcctactcttcacaacccaataggtccccaaagcgctcgagtgactgcacatttagcatactttgctcccctaccatttggcccatagcgacatatgtttcaatacctaaacaaaaattcaattcatgtgtggaaagcgtttttacattttgtttttgttttttaatacaattttgtttttcttatcgaaccacaaaatttgttgaaagttaatagtaatattgtatattcctatcagcttattgctataagttgtcgaagtgactttatcgagagtaatatttgtctcaaatttagcatgtcttattttgtgataatcaccgatacattccatatacatctagatttagatgaccagagtagaagagtagaaggcttgatcatacctttttgtagttataattaacttacctatttgatattcttatttgctcaacttattctaacgcatatcacttgttatatttagaactaatatacattcaaacaaaatcaaaagtacaaccttcttgttacagttttacattgtttattaaaaaaactgtgtgaagaaatggtaggtaaagcatagtgtgcacgtatttcttaatggctcaaagaagagggcactagtatcagaaggcaaaacaaaagattaatcttattatagaacaatgattctaaaaaggttattcatgagttctaagtacactaaaataaaagctgttacttgatgtataaaagaatttttcgaaaaaattgttatacagtcggacccgcttattcgagtagccttcgtgacaagcaaaagtattcatataaccgggatattcgaataaccgatcgttagtggctagtcaaacattccggggcctcaaatttctattctttaaaccgggatattcctataagatgtattctaatgcgcaggttcgactgtatttaggattttctaaattagtattctgacaatctgacgaatactgataattttgttatatttgggatatttaaaacaaaaaggtcaaaaaatctgtcttcacaattatttttaaaatattttttgtactatttactcctcagctatatgaactaccatgatctgaagcaattttttcagttattttaaaatacttgctcaataaatgctcaattcggtcgcagtatttatagaaatcactaaaaaataatctagaaatattaatcatctttaagttatcgtttatttgaaacttgtgtaaaaatttataaactagaaatattttcgtttttaataaaaatgttttgtaattattttttgttttaaatatcctgatgacttatagtctaagatttgaatctaggtcgatcttctcccatctgtttaacggacgaaatatttttttattgaaatatgtatgttttgttcgggggggggggggggttttgaaaatcattatctcaagctatttttttttgattttttttaaaagtgtgggcagcatttattttatttttacaataaataccatattncgttgtcttattttttcgatgtttttcctttgcattttttttaatattccttnngantatactngaatatgcttttctttatttaaatacaaaataaattttattctgtcatattttaaaaaaatattcacaaaaatctgcttga

SEQ ID NO: 2436 - DNA, 980 bp, Diabrotica virgifera
ctcccacgcgtccgaactttggacatgcttggtccttgaaactaaaaattttatttatcagatttgatttttcaaagatttgtttcaattaataccgtgaaaatgaactgtaaagtgatttgtgtggtgcttagcggattgtttctgtttgaagctgccctcgctagtcctgttgtcgatgattctacaaataatcatattaattcggttcatccagaaaaatcaaccattgaagaatcacttttcaagaaactcaacgtgaaatgttccaatcaagatatcagttcctgcatgatgctgaagttggtaaactatttcaacaggctactaaagaagtcgtatattgaactaggtgacattgaaatcacacagacctccactgaaaccgttaacgtagaatcgtccagaggtttaaatgaagttgagaaaatgggagaagaagaacaattgtatgaagtattgatgaacaaagcttttaactttattaaaactagatccctgaaatggaaggtgctagatggagccgatcttgttttggccggcggatctgacaaagatggaagcctcaatctcggtctctccttgaagcctaatactgccggtattgaagaaggtcgtaaaaagaagaataaggatggtggaatgaacgctcttatggctgcagctgtgatgaagattggtctgttgaaggctttagcttttaaagctttagtgttgttggtcggaaaagctctgcttgtaagcaagctcgcccttgtattggccagtatcatcggtttgaagaagcttctcagtggaggcgagaaacacgtcacatacgaagtagtcgctcaaccccatcacgagcaccacgtcgaacacagccatttccgggggaggattcgacgcccatggtggaggcggcggaatggggaaggaacttcgatgcccaagctgctcagaacttagcatacagtgcccatgttccatctaattaaatt

SEQ ID NO: 2437 - DNA, 1176 bp, Diabrotica virgifera
  misc_feature (963)..(963): n is a, c, g, or t
  misc_feature (1066)..(1066): n is a, c, g, or t
  misc_feature (1077)..(1077): n is a, c, g, or t
atttcgagttttgaccaaccctgtatattgttattagacttggcgctgtattgttgatgtttaacagtggtagactgtattaagggtggtttgaacataaatggaggctttgatgtcgaatcgctgcagttctgcagggtgtgagtgttgctgcgaaattggcaatggaacgtaattgtcttttggactgcctcgtatgatatcacaaaaccccatattttgggaaagaagacatcgaggagggtccaaggatgtaaaaggatacagagggtgttccatttaaaaaacgtgagtttgtgtcaccctgttaatacgggtgaccctgtatgtctgaaggtgtttttaaattgtggttttgtccgtgccacaacttttgtgtgaataactttttttcgtgtctcttacacaaacgagtgattggactttgtcacactaatgccccaccctgtatataattccagcggagggagacctgtgatagcctctaatgatgccattcctgtattattcaaggctcctgtataccaaagtaatcaaccataagtaactgtcagtcgtatcagtaatggtatttcttttttgtgtgcctatccgtgacgaatatggcgatcataatggtaatatttatcttatctgccgcagagcggaaaagctgcacagatgttatgttgaaccagattctaaagttcttcatctaggatgttcttcttcttcctggacctcgctttccaaatattttccttgcaggacggcttgtaggagggcacatttagatattataaataaagaagagcaacgtgttcatttagctgattcgcaccaaataagaaaagttgctggatgcaagttccttgaaagagtaggaaaaaagaccaatgaagatgaggtccgaaatatttagaataattctgtctgccaagaagttatatattggcatgactgaagacagaaactgacggaganatgaagagaagtatgactgagtcctttcatactccacccctcatataaaaaaaattaccacgatctcacaaatatggctcctgcgtatgttgaacatatgcgncaatacaattngcactatcgatgttgttattgtggacatttatttacttgatctagtatagtacaaaatcataaagttataccagataaaaatatctaagcagtttttgc

SEQ ID NO: 2438 - DNA, 1139 bp, Diabrotica virgifera
  misc_feature (1120)..(1120): n is a, c, g, or t
cacacgcgtccgctggctttataaagagaaaattcccaatccaaaatccaaattttccaattgactttgacatttatgtcattgtgcgtgaagtattcaggaagtactcgaagtattaaactgtaattacttgatttgtaaactgagaataacgtgttcatttttcaaaatgaatcatttaaagttattattaattctaagtacaattattgtatttaaattatctatggtttatgcaagtaaaaatgatggaactatgagtatcgaacttagacgaaagaaaagccctagacaagagttactggaaaacgaacctacccttagaaaatatggatacagactggaatttcttaaaaacagaagaattaaagaaccccgaacaaacgattctatcgctttatacagatatttggacaacgagttttatggcacaatagtcattggccatccaggaaaaacatttgatgtctcttttgataccgcatggggcctttcatggttattgtcgtcaagatgtgatacgagcctaactccaggatgccgtggccataacttgtacgatcgttacaaatcttcaacttttaaaaagaatggtacccaatattttatacaagatggagcttttaatttcactggagtttattcatacgatgatattcatatcgcccactcaaatgttacatcatttttgtttgttgaaatgtctattgtaccggattcaatgcagtttgacaaggctgatggtgtactaggattaggacctaaaagtggcgattatgaaccatttttctacactttgtatagagaaaagaagattaagaatcctatattttcaatttatttaaacagggaccgtaattctaacagaggaggtaatgttatgttgggattctttgacccaaaacatgtgcataaaactagttatccgaatggatcaatcattcaggatactatagtctatttaaacgctgatactgcagaatattggcagttcaatgtagagaaaatgatttacacgaaagatcccaaacacgtttctacgttttgccaaagtggttgtaaagctattgctgacacaagtacaaatgaaataaatggtccatcaaaagaagttaatcanattcatgagattattaatg

SEQ ID NO: 2439 - DNA, 942 bp, Diabrotica virgifera
gtcgctcgagaaaatatctgccaatatgaatcaaagaaatttttcgattattttgactttgtttttgtgtgcatgtgtgggacatacattgcaaagtgaatttgccagaaatcctttaattcctgatgttgaatgcggccgttcggttgagggcccttcgtcttcacttgttggaaataaggagtttccctgggcagtcagaatttcatttagcaaacgtcccgatctatttgcatgtgacggagttttgataaaccaaagatatatcctgactgctggcttatgtgtagaagataagactttaacacgtcaaggaaatatagacaaaattcgcttaggagatcacaactgcttacccggtgaggaaaattgtgacagtaaggattacgttgatgttgaaatcgaaaacgtaattttacatccagcctatggaagccaaaatcaagttaaccatgatgacatcggtttaattcgattaaaagaagatgttaaatttactgacaatatttcaccagtgtgcttaccaaaacctaacgaagcagctaaacctggggagaaagtatttgaagtaggatggtctagaaggagtattgataaactgaaagcagagattaccatcagcgaccaacaaaaatgttttgaaaattactcgaaaaatttcaatttcaacttaactgcttctcatttatgtgcaggaggctatcccgatggcaagtgtgcaagttcttcaggtggtggattagtcagattgaggcaacctgaagagaagtggttgttagaaggtattacatcttttggaccatctgtgtgtagtacagacgtacccagtatcttcaccaaagtggaaccttattcttattggatacacgaaaacgttaaaaattaataaagatgctgtattgatcgatgagcgtttctaataaaatttttatacgtaatagg

SEQ ID NO: 2440 - DNA, 1248 bp, Diabrotica virgifera
aataccaatagttacaccttaatctaaatttagtgtgtgattttgccaagacacgagtcatggcttcagcaaatttatatttgtgtacttttatagtaatttccatctctcaaatatgtgtaggggactatagagcagctgtggtggaatatcagccagcagaatcagctaatccaaatactacaatggaaactaatactaatcaatatcgttcatttgtagaacaagccaagaaagagggagctgtgataatagtgtttccagactatggaataacaggttataatcccaacgtgactgcatatgcacttgaaattcccgatgtaggaactaaacctaattccactaacggtttgatcttagaaaaacttgccgacttgtcacgaagcttcgacatgtatgttgttttaaatttattggaaaagaaaaccaataataacaataaaactctgtactacagtacaaatttagcatttaatcccaacggagaaattgttgcaaaatcacgaaaaacacatctttttaacgaagcaaatttgacgcctggaaaaccttccgaaaataataatacttttgaaactacatttggtgttacatttcaattattctccacctacgatctgatttctgaaaaaccaaacaccaacgttaaggatatcgtttatccatcatcttggatctcgactctacctttctatcactctctatcaatgcaacatggatacgctgtggcgaacaaagtgaatcttttggcggcaaatttgaataatccttctgtggcacttgggggtagtggtatatttggatcaaatggtaccgcctaccaatcctacatttcaggaacaactgcttcaaaaattttaatagctaccgttgtcgatactgtcattaatgcttcagctactagacactttacaaataaattctttaagggtggtcttggaagctttgattttgatgatgataaaccagaaattctaaagtaccaaagtaatagattatttgaaaataaaaaatatacaatcaaaacacttgatttttcccaacataatatcaaagaaaaaatatgccataaaatctttttttggggtaaatttaaatttaaaagggacaaacaaaattctcaccccaggggtgttttatccaaattggtttgtgcggaataggggggttttaaataaaaattttttttcagaaacccacaaaaaagaaaaaaccccccgaagagggggggtttctccccctttt

SEQ ID NO: 2441 - DNA, 942 bp, Diabrotica virgifera
  misc_feature (854)..(854): n is a, c, g, or t
  misc_feature (916)..(916): n is a, c, g, or t
ttataggtggtcgtgtggggtgatcttaagtagtactcgtatactaaatttccattccaaaaatgagtaaaaagcagaatttacttttgctctttgatcgacctacagaaccaatgatcctaccaaaagggtctgaaggcgtcaactttaaagttcctaaccagtatttgaaagatgaataccaagatttgggaccccaattagtaactacattcgcaaacagagttggaggtgatgataacgatgttaccgtcaaagatatctctttgccttcattaggagaaataactgatttagggagggacgaaaatttctctttatttattcctaaacacagaagacttgctggaaaactaattaatatattcatgggaatgaaagatcctgatgacctaatggctgtggcaatatacgctcgagagcgtgtcaatcctgttcttttcaactatgcattttcagtggctttgatgcatcggcatgatactagagatttagaattaccatctgtactgttttctttccccgacagatatatggatagtaaagtgttttcaagaatgagagaagttgctaacgttgttccagagcctcaaaggactccggttttgatacccagggattatacagcatccgatttggaagacgagcatcgcttagcatacttcagagaagatatcggaataaatcttcatcactggcactggcatttagtctatccattcgaaggcccaatgggaagttgtcaataagaatcgcagaggggaactgttttactacatgcatcaacaaattgtggcaaggtacaattttgaacgcctttccaacggaatgaaacgggtggaaaggtttaccanttttatgaccccatgcccgagggatattttccgaagctggacagtttggtcgcaaacagaangtatccctgccagagtccccaacatg

SEQ ID NO: 2442 - DNA, 953 bp, Diabrotica virgifera
  misc_feature (866)..(866): n is a, c, g, or t
aaaacatttctaatttttttacaacatcaaccgactttcgtcaaatattaaatgattaccatattatagattttttactgtaaccggttgttttattagcctacacccatttaattttcagttctaatttagttgattgtaatgaccacgatttcattaaaatgagtaaaatttgaggttatattgtatatgatgtaaataaagtttcctatactttgaactccattatagaaccaagtttgacgtaattaattatctactgttctatattctgcttgctgtttgcacttcaacattcttctgagagatattttctttttgatcgttttggtgcgaaggtatatttgttttttttttaattatattcttcatatccttcgatttgatatatcacactttacttttcaataaatctgtcagatgaaaagagcaggaatatttgacgtttgatagatggcagatgaaagcttaattgttacaggtatcatgacaattgacagcttactgatctattatttttaaacatggacatggttttatatcgtccgataatagtggggcaacgttccaaccgactcttataaatttatatagcagaatgtctatattgagttataggttttgtgcaacatcatttcttaaaatgtcattttctcttcatcatcatcagatgacagtgcagtcttttgttggcgttggtctgtctcaaataatatttccctgtcaatagcgtatcttctccatcccctatgcaatactttttcaagtctttctccgtatcatcgtagtacctgagattaggtcttccccttcttctttcgaccgtcttgtttaacataattatttcagcaaggttttctaaatantaactaaacctattatttacggttaacacgtctaataagaagtgctgatgtcttctgcggtaatatgttttcttattgccatatttc

SEQ ID NO: 2443 - DNA, 438 bp, Diabrotica virgifera
ttacaacaccctaaagtaataagatgactactaaagtatcagtaattttgtttttgtgcttaataatatggaaggaaaacgccgttgaagcaaataagaatttaccaggtaatctgataacctatggggacagtcagtactatattgatgataaatttaatcattgttggtgggaggcatggagacattgcaaatctcttaacatggatctagttagtattgaaacacaggcagaaaataactttctttaccaaaagttgaaggaacgatatggtaacggacccgaatattcgttttggactgctggagccaaagaagggaacggatgggtatggaaaaatacaaatggttttgttaactacttcaactgggcacccggtcaaccagacaacgctggtctaacccgtatagaaatgagatataattgggcagctggac

SEQ ID NO: 2444 - DNA, 779 bp, Diabrotica virgifera
gccaaaggtatccttaacgtttccgctaaagacacaagctcaggcaaatcacgcaacatcaccataaagaacgacaaagggcgatcgacacaacaagaaatcgacagaacgttatcggaagccgaaaaatacaaagaagaagatgaacgacagaaagagaaaataacaacaagaaaccaacttgaagggtacattttccaactaaaacaagctcgctcaagaatcgggagacaagctatcagctgaagacaaagctgctgttgaacgagaatgcgatagttgcttgaaatggttagaccgcaacactttagctgacaaagaagaatacgaagacaaacaaaaaggcggaagtatgggttgcagtccaattatgtccaaattacaccaatctggaggtcaaggcaacactccttatggtggagggatgccgggaggttgtacaggacaaacggctggtgatggttatggaggaaaacaaggagacggaagtggaccaaccattgaagaagtagattaaatttatcactttttcgatatgatttctttttgtaagactgattttttagttgtaacatatttctataatttttctacctcatatactcatgtactttgtttttaagtaattattaaataaacaatgtttaattataaaaaaaaaaaaaaaaaaaaaaaaaaaaaaaaaaaaaaaaaaaaaaaaaggaaaaaaaaaaagggggagccccagaaaaaaaaaaaaaaaaaaaaaaaaggggaaaaaaaaaaaaaggggggggccg

SEQ ID NO: 2445 - DNA, 956 bp, Diabrotica virgifera
  misc_feature (913)..(913): n is a, c, g, or t
cgcgaagggaataacttattctactgaaccgtctgtgaagtaaatctcatttaacaatggctaacactctacctcaacatattcaggtgattcttcagaagatattcaacgacagcatagaaaatttaactatagacgagcaggagggaaacaaaaagggggatggttatttgggcgatctggtcttccttacagttgcttacaaaaaagataacgtgcctcataatttagttattaagcagtgtgttgcgggtgtttatcccgaagagttcgttactgctacgtatctgaacgaaataaatttttatacaaaaagatggcctgctatgaccgagttccagaaaaaacatctgggcgaagaagatcccaacttcgtgaagcacatagcaaaatgttactacaccgacatcacaaagggagcggaaaaaatcgttctagacaatctcaagttcaaaggtttcgaacttcatcccaaatcgatacccttaaattttcgtcaatacgcaagtatttttaaactatacgcaaaataccacgcaatttcatttgctatgaaacaattagaaccagaaaaattcgaggaatttactaaggatgttccaaataactgggagcgattttttatcactaaccccggaccagtgggcatgactacagcgaaaatcaaaatgacttttaacccaaccacagatcaaaagctagctgaagcttttggaccatatcacgataatggcaacgacatactaattgcaggtatgcaatatgatggaccttacaaagtttatcttcatgctgactgttggagtaataatattatgtttaaatataacgattacttagaaatagatgatctcagaataatagattttcaaatgtgcttcgtgggcacacccgtgtacgacttaccctacangttattttccggcgcaggcaaagaagcactagatagaactgac

SEQ ID NO: 2446 - DNA, 456 bp, Diabrotica virgifera
cccacgcgtccgcaaaatcagtaatgagcagtaatgagtaatgtaatgtttataaaagttttccagaaattttaaaagcatttttttatagttgtgagttactgaagaagatttctggatataacctaaaaatgccgaaatactactgtgattactgcgatacttacctaactcacgattcacctagtgtgcgaaaaactcattgtactggcagaaaacataaagacaatgtcaaattcttttaccaaaaatggatggaagaacaagcccaacatttaatcgatgccacaacggctgccttcaaagctggtaaaattgcaaacaacccatttgctcaacctggaaagggagtagccattccaccaccggcacaacttaccatgggtcagagaccacctggagcacctggaggtccgggtatgatgccaccagcaggtatgggtccaggtccaggcc

SEQ ID NO: 2447 - DNA, 412 bp, Diabrotica virgifera
cccacgcgtccgcaactccttcaaaccacctaattcgctgtcggtttctgcttcttattcctaaatgtgttcctgtggttagctttttaacaagtgtgttgtctggcattcgtattatgtgtccagctcatctaagtcactgttttaatgaacgttatgacatctggttcattaaagagttggttcaccacgagtccagagtataccctatttgtaaggtttattcgtcttttaatttctttgcttgttttgttaagggtagtccctagtgagccaaggtatgtaaagctgttaacatattcaaagatatgacttcccaagactgttttccattcctcatatactatagtgtcatatactagaagttgtaaggacatgtgcttggtttacttaagcttatacatatgcggtt

SEQ ID NO: 2448 - DNA, 1091 bp, Diabrotica virgifera
acggacacgtgggcggacgcgtggctagtttttggacacgtgaagcatattcttggaatcttcacaatcccaaaatgccgctgtcgtgtcgattttataaagaaaaataccccgaagtggaagatgtagtcatggtaaatgtaagggccatcgctgaaatgggggcatacgtccatttactagaatacaacaatatagagggcatgatcctgttgtctgaattgtccagaaggcgtattaggtcaattaacaaattgattcgtgtaggaaaaaccgaacccgttgtagttataagggtagacaaggaaaagggatatatagatctttccaaacgtcgtgtaagtgctgaagatgtagaaaaatgtacagagaggtttgcgaaggccaaggctgttaattcaattttaaggcatgttgcggaattactaaagtatgaatcagatgaacaattagaagaattgtatcagaagactgcttggtatttcgaagaaaagtataagaaaaataaagctagtgcatatgacttcttcaaacaggctgttttagaccccagtattttagcagaatgtgaattagatgacaaaacaaaagaagtcttgcttagtaacattaagagaaagctaacatctcaagcagtcaaaatcagagctgatattgaatgtgcttgttatggttatgaaggtatcgatgctgttaaaactgctcttaaagctggcttggctctttcaacagaagaattgcccattaaaataaatcttatagctcctcctctctatgttatgactacatctacacctgaaaaacaagatgagttttaaaagttttaggagatgctatagaaaaagtcaaagcgacaatcacgcaattgcggtggagtatttaatattcaaatggctcccaaagtggtcacagctactgacgaactcgaactcgtcaaacacatggaacgagctgaactcaaaaaccaacaagttgctggagacgaagaccaccaaaagattagggtaccctctacagcgaacatgacacccacgataactaaaattctggtgaagaggaagatgaggaataatatttttctttgcgattca

SEQ ID NO: 2449 - DNA, 518 bp, Diabrotica virgifera
cggacgcgtgggttttaaggttatttccgcgtgtacagctttcgaggtagtaattggcagaatatgttggggacacgtccgcccaagtcctctgcgaatttttctaggatgtctcccctctcatttctgactgtattttatctccagctccaaacttggcactaaaatctctcataatgatgagaacttcctgtcgtggaattttctgtatgatctgttgattttctgtttactcaattactttttattcctctttatctgtagtgggagcatatacttggatattggtataaagttagtaaagtatttggcagccttagatgatacgattactccgactccatattcatgtgctcttatcactttttcccgtttaagaatcactatttcccgcgatcactttgtgatcttccacttcctttctccagaatctgggcatctcatttctgctattctcatgatttcaacatgcattctcttcatctcctgtattgcattggggatttttcctgctttgt

SEQ ID NO: 2450 - DNA, 1011 bp, Diabrotica virgifera
gacaagcgacaagtaggtggctggctagagccactggccagaattatttatttgtattttgtaattttgtatgatttgtatcctgtctttactgtgatttgtatcagaaatggttcattttagttgcatataatatacttccacagttttaaattacaaaaatctataatatgtctgcggtcaacccaagtaaagattcttttacttgtatatcatgtagagtcgccttcaaagatgcagagttgcaaaggaaacactacacaacagactggcacagatacaatttgaaaagaaaagtagcagagttacctccagttactgctgaagaatttcagataagagtgttgaatcagagaaaagctgacgaaatagccactcaggataaaagtgtctactgttccgtatgccgcaaatcatttggaaaccaaaatgcttatgataatcatttaaactccaagaaacacaaagataatgaagaaagtagaaagatagaaagcactgacgaaaacatagagatcatacctacaaataaaccaacaattgatgttgaagatgaagacatggaaactgaagaagtagattcagatgagtgggatgatgtatccgaaaatcccattgataacaatgattgcctgttttgttcacatcacagtggtaatttttacaagaatttggatcatatgaccattgtacattccttcttcattcctgacattgaatattgtagtgatcttcaagggttgttgagatatttgggggaataaatttcagaaggtttcatgtgtttatggtgtaatgaaaaagggaagaccttccacactgcagaagcagctaaacaacatatggttgatagaggccattgtaaagatgattcatgaagggggtagctccttgctgaatatgcaaattttttatgatatattccaacatcctatccttgatgaaaatgaaaaaaatattggatgctggaggaagaaggttacccgttcccacaacctacaatggttaaag

SEQ ID NO: 2451 - DNA, 1894 bp, Diabrotica virgifera
aacaaaggaaacaatttaataagttaaaggacaaattttcaagaaatatatcgcagacaatttaataactccgtttattcattttggaaatcataaaggagaagctcgaaaagagtgcagatagtttagttttacctcaacatagtggagttcataaagaactcgtatccgtatactgaattgattcatcggattaaggtaatggataaacagatgtatcgaatctttaaaagaaatttatactagttctttaggaaaactttatgacagagatttgaaaaatctatttagtgtaggaagggaaaaaattgcagtgtatggaaatgtagtttcacctaccacaattattggcgttgacagagatcagtggacactggaaaccagtactaaagatagagaaagatatgatttagttttagagcaagtactcactcagctagaacctgtgtttatgcaagaacaacagttttgctttaagttcttccagttggatgtaatcagtagtcccaaagccttggattatagcatagaaagtgatgctgtaacagctagaaaaattgaaaaacagattgatgaagacattaagaatatgatgagcagtctatttgcatgtttaaaacccgaacttgatatgttgattgattatattaaaaaacaggataatttttattgtatgtatgttttggtacgtctcaaccaacacgtaatgtctgcacaaagctcattcctcagcaacacctttggctcattgcttatcgaagtcaaacggtctttggatcaattcatgcagcaacagatcgaatcgattaaagaatgtagaatgtcgaagaaatcaaaatgtggaatactaccctatgtactcaatttagaaatattcgccaaaaatgctaactgcctgttgaaaagtgatcgtgcagcagatctcgagaaatggtacacacggttggttgatacaatgttggaatacatcgcagtgcatgcgattgatcataaaacacctccacaggttattaaaatggaaaattatcatcatctgtattcgctattgtcgcaattgaaaatctcagttttggatagtcaacgaaaggaagccaaacagaagtataatgatgctcttactgcttatgtcactttatattttggaagaccattggaaaaattgaatacctttttcgatggagtacaggcgagagtcgctagtggaataaaagcttctgaagtcagctatcaattagctttcagcaaacaagaattaagaaaagttattaaccaatatccaggatcacaggttaaaaagggtttagagtctctatacaaaaaggtagaaaaacatttgtcggaagaagaaaaccttttacaggtagtatggagagcgatgcaagaagaattcatcagacagtacaaaaccttagaagatataatacatcagtgttatccgggctccatgatctcgttagaatttaccatcgaggacatactaatgttcttttccgatattgctcaatctcattgatagttcaactatgtaaataacaaacggactacatatatgtatagatatatctttgttcttttggatatatttgactgggtcattatatgacaaattttactccatttaacacaaaaagtattaagttatcgagtgaatcaagtaacaaaaacgggatgtggcgttccgggggtgaccgagtaagggaagcctagcttccttatcgtttacgcccgtagcgatggtctttaatttattttagtttatttattttatttgcttttatttaattttattttattaagaaacacgcgtgagcctgcgtagtctgtgttgtagtactgatcgaatgcgttcggtctgtatctcgcgatctagaacgagtctagttctagatcgcga

SEQ ID NO: 2452 - DNA, 917 bp, Diabrotica virgifera
  misc_feature (829)..(829): n is a, c, g, or t
tgccattgttagtaaaaaagatgaatcggatggttacaaatcgtcacctgtaataatgaggaaaggagtatcagcttccgatactagtagtagtagctcaaacttaaaacctgatagaaaatctggtgttgagttcgaagcctactccagctcaggagaaagtcactatcacagtttcgaaatagacagtagtaaaagtagaccatgttcttccgatgtagaaggtctagtagctgcaggatcttcggagtacgaaagcgcacttacatcacaggattattctgctagatcacacattacttcaacagaatatcaaacagcagtcagcagtatgagttctaaggaaagtatgaaaagcttagacagtgaaagctcaggtaacttagcaagtgttgaagcttcggaacattcagaaacattggtaccatcaacaagcgatttagacgatatattagactctgttgaccaacaacttcttgatgatatagagcaaagtccagcctggacgacacatccaccaacaatgaggcagagtactgaagtgagtgattcagaaattctctcttacactggcgttggcgaatctgttgatatttctgaagaagaagaaataaaagctcctgatactcaatcaaaaatgaaaagatcacatgaaatgactttccaaccggaacctagagtactggttcctgactctcctcaaggtgaaggtgaagaaagactgggaaccagtattgacgaaggtagtttactgagtgtaagcgtttctagcacatcaagtactggggcacaaagaactgttatagaactttctagagctgattcctanagaggaagcttaactgtctccggaacttccgaacacctgagtctagacgatgtagaaaatttttacgaagggagtagagagagtttat

SEQ ID NO: 2453 - DNA, 1436 bp, Diabrotica virgifera
gcctgtcgtaccatgttgtttgatcaagacggaaaatacttggcatatgtgaatggacaaacgttatgtgtgctacaaactgaaaattggcaaacattggccaccatagagaacgttaaagcctatcagttggcattttcaccaaaaggaacttttttaatgagctgggagcctttcacagtcagtaacgccaaccctcagggtactccaaacttaaagatatataaaactgccaatggggaacttgtcaagaccttcgtacacaaaaaacaagctaattgggaacctcaatggagtcatgacgaaaaacttttttcgaggatagtaaacactgacgttgtgttttacgaagatctaaattttgagagaatagtcgctagaattaacagttcaaaggtctcgtcttataagatttcacctaacgttggtgtctattttgttctttgtcacacactgggcagtccgggacaaccttctcttgctagattatttaaatacccttcttttgataccacgcaagcgattgccaatagaagttttttccaagctgataaagttgatattatgtggaatgccaaaggtaacagtgcatttgttaacatctacagaagtcgacaagacaggaggatcgtattatggaaaacaagggttatatttcgtgggtttaaatggagagacttcgataataaccttaagtaaagaaggtcccatttacagcgttgaatggtctccaaaaaacaacgagttctgcgtcatatacggtttcatgccagctaaagctaccatcttcaacataaaatgtgagcctgtcttcgagctgggatctggccccaaaaacgctatccattacaaccctcaaggaaatattcttctcttaggaggttttggcaatctaaggggtcaagtcgagctatgggatactgcaaattggaagaaaataagtagttgtgaagcaccagataccacgctgcttcattgggccgctgatggggagcactttttgactgccaccacggctccgaggctgcggatcagcaatgggtataaaatctggcattatacgggagttttgatctttgaacaccctcataaggaacctgaagaattgtatgatgtagcttggaagaacgtccccaaaggagtgttccgtgatccagttatttcagccaaaaaagttgaaggaatagctccaagtcagccgcaagcttcagcgcaagtttatagacctccttctgctagaaatcgtcctacggttaactttaacctgcacgaagatgaagaaactgcacataaacccggcaaagattctgctccatctaaggcttccctgaagcagaacaagaagagggaagccaaagaagggtaaaaaggtggaggaaagcgaacgtaatccgaacccaaaacgccagcggcttgccgcagtgttaaaataaatt

SEQ ID NO: 2454 - DNA, 1166 bp, Diabrotica virgifera
gagctagaaacacattggacatccaaaaagtgtccaaaaacagaactctatcctcatactccattgaactacaatattcccacaaaaatgtataagaagacgtgattttaatttgtctctgacaaattatttttatttagattatacatttctataaaagtaacgtttttcaagtacatttgagacattaattttgttcaatcatggctatccccattgcagctcgtagttcatcaggaattactctctatgaaggattacctactcctggtaacaagccaacatgtccaccaattcagagtaaggcctgtcgtaccatgttgtttgatcaagacggaaaatacttggcatatgtgaatggacaaactttatgtgtgctacaaactgaaaattggcaaacattggccaccatagagaacgttaaagcctatcagttggcattttcaccaaaaggaacttttttaatgagctgggagcctttcacagtcagtaacgccaaccctcagggtactccaaacttaaagatatataaaactgccaatggggaacttgtcaagaccttcgtacacaaaaaacaagctaattgggaacctcaatggagtcatgacgaaaaacttttttcgaggatagtaaacactgacgttgtgttttacgaagatctaaattttgagagaatagtcgctagaattaacagttcaaaggtctcgtcttataagatttcacctaacgttggtgtctattttgttctttgtcacacactgggcagtccgggacaaccttctcttgctagattatttaaatacccttcttttgataccacgcaagcgattgccaatagaagttttttccaagctgataaagttgatattatgtggaatgccaaaggtaacagtgcattgttgttaacatctacagaagtcgacaaaacaggaggatcgtattatggaaaacaagggtatatttcgggggtttaaatggaaaaactttcaaaaaccctttaaaaaaaaaggcccttttaccggttgaatggctcccaaaaaaaagatttgggtttatagggttttggcccataaactaccttcccaaaaaaaggggcccggtggttttctttttttttttttttatttttttcccaaaagaccaataaaaatttttttttttttttt

SEQ ID NO: 2455 - DNA, 1139 bp, Diabrotica virgifera
  misc_feature (990)..(990): n is a, c, g, or t
  misc_feature (1090)..(1090): n is a, c, g, or t
  misc_feature (1126)..(1126): n is a, c, g, or t
tcaaaagttaaacattttaaagaaaaagaataattgttatgattattaagatttcatctattaatactaaacatattaaagtataaaaatggcagatttaatagacgacctttttgactgtttcgaagacgagactccttcccaggaaacgataaagacttccgatacatttaaaaggaaaagtgaccaacacgacgatgaagaggaggagcccacgcgtccggccgaaacgagttaaaaacgatgaaatcgtgattgacataaattttgaagaattgaaaaatagaatagtggttcacactatagatacagttgattcttgtacccacgaagtggcttgtcctccaggccatgactacattcccctacaacctgccagaggagagcctgtcaaacagtatcccttcaaacttgatccctttcagaaggaatctattttgtgtgtggaaaataatcagtccgttttggtttcagctcatacttctgcaggaaaaactgtgatcgctgagtatgccatagcaacaagtttgaagaacaagcagagagtaatatataccacacccattaaagcattgtcaaatcagaagtatagggaattttttgatgagtttaaagatgtgggattggtcacaggtgacgtcacaataaatcctagcgcttcatgtctaattatgacaactgaaattttacgtaacatgttatacagagggtcagaaatcatgcgggaagtgggctgggtgatattcgacgaaatacactacatgcgtgataaagaaagaggtgtcgtatgggaagaaactttaattttactgccacacaatggtacattttggtctttttgtcagcaacgattccgaacgctagacaattcatcggaatgggtgtctcatttacatcagcaaccttggccacgtcgtttataccgattacagacccactcccctacagcattttatatatccagctgggaggaaatggaatcaacatggntggtagatgagactggcacgtttaaggatgacagctacaacgtggccatggcagtgcttcaaaactcaggcgatgctggccaaaggtgatcagaaggaanaaaaaagggggggttcgccaacaaggaccccactcnaactgatattttt

SEQ ID NO: 2456 - DNA, 1542 bp, Diabrotica virgifera
  misc_feature (45)..(45): n is a, c, g, or t
  misc_feature (54)..(54): n is a, c, g, or t
  misc_feature (1463)..(1463): n is a, c, g, or t
agaagtttacatattcattatcttcaagtccaataggtacgtgtntaaaccaantaaatttatattgaagctaatgtctgctaaaggattactaaatattttggcaagacagtatttttatgttctgtagaactgacagatgataccgtgagacaaaatctgctgaacaactccaattactactaaacaaaacagtttctgtaaaaaatatggactaaaatgaattagaaaaagaccagatacctgataataactaagaaaacaaatatagaaacaaacctacatttgagaactgtatcgacaaatagcgttgataaatacaaatacctaggaacctgcatttcagacaataatgatcaaacaacaaaaataagggcaaggatagaaatagcaagaaatgcgtttgtaaaaatcaaaaattttctctgtaacggagactttagattagaaatgagagatgctacgtgtttttgctactgcattatggacttgaaagctggacattgaagcaagaacacattcataagctacagtcatttgaaatgttgtgttacaggaggatacttagaatagcatggacatagaagaaaacgaacatggagatattgcgggaaagaatacgaaataataaacataataaaaattagaaagttactatttctgggacaggtaatgagggggcagcgatatgaattgctaagactgataatacatgaaaatataagagggggaaggagtataggaagaatgaggagtcatggctgaagaatttaaggggctgacataaattcagttccatagaacccttcagagcagtggtagatagagtaaagatagtgatgatgatatccaacctccgattttgtacacagcacttaaagaggaagaagtagaattgaaaggcagcctgaaataattatttttttaatataaggatttttaacatatttcgacgcttcgagtatggctaatggttccgccgagaagattgaaaaatcattgcacgacaatttgtccagaatatcagccaatatccatttctcggtataattgatacagaagtactaagtgtgtatggtgttggttcttcctagctggcaattactattaaaattttactattttcgcatctaaactactattctaaatcaggtttgtacatacgatcacaaactggaaaatcaagtgtacaatagaagaaaaagagcaaggcacgatggtcgacatcattaacatcgttttttgaagatttaataaaatattgaaataaaacgttccggggcaaacttttttgaaaaatttttacaggctgagaaaaattaaaacacatacgcacatacgtccattttatttggattttaattctactttatctaactaatcaaaccataaatatcaggattcacgaatagaagaaaaagaccaagcacaaagtcaacatcattaaggtacctacatcgttnttttgaagatttaataaaatcaatacaaacgttcttggcaaacttttttttgaaaaatttttacagtctgagaaaaatt

SEQ ID NO: 2457 - DNA, 676 bp, Diabrotica virgifera
gtcgaattaagttacgaaggtagcccaaatcctctttcaaatgagcttataaactatatcaatagcaaacaaagcacatgggttgctggaaagaactttgatgagaacctttcaattcaagagatcaaaaatttattaagagcaaaaaccgagagattaggagtcgctaaagaatttttacacagtgaaaatattcaagttcctgattctttcgacgcaagagaaaactggaaagagtgttcagatgttatcagcactgttgcagatcagtcgtcgtgtggatcttgctgggccgtcgctgcaacttctgcaatgagtgacagaagatgcatagcctccgagggaagacgccaagtacctgtttctgctgaaaacctactatcttgctgcggtacctgtggagatggatgcaatggcggatatccaatcatggcatgggtttattggcaacagaacggaatttctacaggaggtctttatggcagcaaccagggctgtcaaacttattctcttcaaccatgtgaacatcattctaatggtactaaagtacaatgcagcactttgcactacgatgcagcttcttgaaaaaagcaatgtgacgatcccacactttgaatatgaaggccgagatactccttgcttcccgtgacatgaattacttcaagtaaaatgaaaa

SEQ ID NO: 2458 - DNA, 743 bp, Diabrotica virgifera
agaaaaaatatcaattttttattaattgtttagtgcaaaaacataattttcttaacattattattgtatcaataaaaataaagaggaaactttgacatttaatatatataatatttattgcttaacatatattttaatatatatcattataaatgataatatatattacatatttcaatcttcgtatttattaagaatgctcataattttctcgtaaataagctttggagcatcctttccaaatagatagtccatgtggttccatgtcgggataggaacccaaaacttttccctaacactcttcaaatgttggtacaagttttcaacatccgtttcatgcgcgagccaatcattagagctgtagataagatgaacaggggccttaacgttaaatagattataatcgggtggtacttcagatccgttgtacaatttcttgttcttaattttgcccaaatcgtatttgcgagaaacttacgaccattcttaataaatacgaagattgaaatatatagtatatataatatttattgcttaacatatattttaatatatatcattataaatgataatatatattacatattttaatcttcgtatttattaagaatgctcataattttctcataaataagctttggagcatcctttccaaatagatagtccatgtggttccatgtcgggataggaacccaaaacttttccctagcatgaaacggatgttggtacaagttttcaacatc

SEQ ID NO: 2459 - DNA, 951 bp, Diabrotica virgifera
ttgcaactgacttgaagtaatgcgctggacctgaagcaaaggttaactcggacttataattaagtgtgggatcgtcacattgcttcaagtcagttgcaaatattcaaaaggaaatagtaaagaatggtcctgtagaagcaacttttgacgtatacagtgacttcctgaattacaaaagtggtgtttatcaacatgtcgctggacatatgtaggagggcatgccgtcagaattttaagttggggagaaaatgatggagtaactttagcacggtcaaaatattcatggaattcaaattaatcagaggacaggatagactttatcttcgatacaaaaatgacatgtttttcgggcactggggtaaagtcgctcctgcatatattcaatcctacataaacaaacatatttattactataatatacagattttgcataatagcaaatactatcatcattatctagattgaaatatatatatgatgtatatgtttatatgagaatagattagaaatataaataactaaattatataaacatattgtaacatatattaaattacgcaaaatattaattataactattagataaatattaaatattaataatattctattattatcctctgtcgtcaaagtcgaacactatcattaacttggattagacggaagtctcacgatatcgtttatgtgaagaggaggattaatcctcctcacatgtcctctggaagtgtccggcattggattatcagaggtgacagatcctgggatcggcctttatgcagccgagccaggtgagggagtttccgttagtgatgatgattataaatactttcgagtattcgttacaaatcgttacttttgtataaagtaatcatttacagtattcgtcactttgattactatgattacttttgtatttgagtagcggtaatcatatcgagaatcgcatttctc

SEQ ID NO: 2460 - DNA, 1103 bp, Diabrotica virgifera
gcttttattattacactattactacctgttgtattaagttacaaaggtagcccaaatcctctttcaaatgagtttataaactatatcaatagcaaacaaagcacatgggttgctggaaagaactttgatgagaacctttcaattcaagagatcaaaaatttattaggagcaaaaacagagagattaggagtcgctaaagaatttttacacagtgaaaatattcaagttcctgattctttcgacgcaagagaaaactggaaagagtgttcagatgttatcagcactgttgcagatcagtcgtgttgtgggtcttaaagcaatgtcactggagcacacttaattataaccagaagttaacctttgcttcaggtccagcgcattacttcaagtcagttgcaaatattcaaaaggaaatagtaaagaatggtcctgtagaagcaacttttgacgtatacagtgacttcctgaattacaaaagtggtgtttatcaacatgtcgctggatcatatgtaggagggcatgccgtcagaattttaggttggggagaagagaatggagtagcttattggttggttgctaattcatggaatgaagattggggagacaagggattgtttaaaatacttcgcggagaaagtgaatgggggttcgaggatggtgttgttggctcacgtgcataggtactttcgagtattcgttacaaattgctattacttttgtataaagttaatcaaaaatacagtattcgttactttgattactatgattacttttgtatttgagtaccggtaatcatatcgagaatcgtatttctcagtaggtaggtattttgtataggtattccgatataataacgaccttcacgaagtacgaagtaatcagagtaatcaaagtaatcaaagtagatacaatagtcgttactagctatgatacgattgatacgaagtaacgacgtaatcagagtaatcaaagtaacgatttgcctctctgtatagtaatcgttactttcggtattcgtaagtaatgagtactttgtaacgaatagttactttttcaacatcactagtcattagaccaataatgacatacgcagccgaaacacg

SEQ ID NO: 2461 - DNA, 892 bp, Diabrotica virgifera
  misc_feature (667)..(667): n is a, c, g, or t
cgatatgttcggttacgcaggtgaattacggtcaagtacgcaaggcaaaggagaattcacgatggagtattccagatattcgccttgcttgccggaagtacaagagaaacttattgtcgaatatgaaaaagctatgggaattttacctgacaaggataagaaaaagaagaagaattaacgagaaaattccttattaaggaaaaattatttattgtccagtgtaagttaaagcatgtttgatatatgtttgtatacgctctgagcttcgctggtggcgctcctagcggattactaattcaactttcgccggtaatttttaaatttattatttaattgttatcgcttaacatttacaacgcaaaaaagtaattaaattgtaatcgatttttttaagattttgctaatcattttgacgttctattgataaaatatgaatttcttacttcgggtatactttcacaattatcgtgtagatggcgctaagatttttagatttaattataattacatattacggaacattaaaaaaacttaaattcagtatttaaaacgtaagtatatttaaggtaaaaatatataccacagctttgaccaactaatattttttataattaatgattttaattttaattttaaattaatcactttgacatttatgtcaaatttnccggtaaaggtttacagacttgccactactggcgctcgcgaatttctacatatcccctctacgtacgagctcacagcttgtacgtaatttcaaatcgtaccaaaaaccttaaacctttgtatttgagtaccggtaatcatatcgggaatcgtatttctcggcaggtaggtattttgtataaagttatcatttacacaatttacagtattcgttactttgcttagt

SEQ ID NO: 2462 - DNA, 1164 bp, Diabrotica virgifera
attatgtattgtcttcatttattgagaatgcatttttaacatatataccgaattaaaacactgcattttcaggcaatattttgtttcaaatcgtagatacagatgtaaatttagactttgttacatatacatatgtactttttgaggacaatgagttatctagagagaaacaataagcaattataaaatatctttttttttaatagcctatacctagtatgtattgttaatcaccgttgctgatacgtttaagttacctttctgaaatcacattgtatacatttatttttcttaaactcagtatattcgtaagtacaaacataatgtcaattacaaacggaactaaaacgtatttttcaaaatatcctgcgaaacaaccacgcacaaccaacaagaattactaaactattacagctttctgaagattattatttaagtacggcaacactgtaaagtatcgatcttagtaaaatctctttacaacgctaatattattatattaatttataattacatattacggaacattaaaaaaacttaaattcagtatttaaaacgtaagtatatttaaggtaaaaatatataccacagctttgaccaactaatattttttataattaatgtttttaattataattttaaattaatcactttgacatttatgtcaaatttccggtaaacgtttagagacttgccactactggcgctcacgaatttgtaaatatcccctctacgtacgagctcacagcgtataacccaggtatttttatatcaatggtataacccatttcggtatgaggactgacagtttataataaattaataattgtttcattttgaaatgtcagttgcatagcctatggttacccttttgtagtaccatgcgccattgtagagcggaactagtgctacactgtgttgtatatttgtaatcaggaggtgcagggctactcaaaactacaaaaaaaatacagggtgtcccattttaaatatttgggatgcattttgttgggcgctccctgtatacagggtttggcctgttgctacactgttggtcgataccgacggaatagcacaacttttatttgaacttttttttgtattcccgaaattgaggagggtgcggggaggccaaaatataatgagaagccctgtacagtttcc

SEQ ID NO: 2463 - DNA, 1241 bp, Diabrotica virgifera
attgaccaaaatgaaagcggcttgtattattacactattactacctgttgtattaagttacaaagctaacttaaatcctctttcaaatgagtttataaactatatcaatagcaagcaaaacacatgggttgctggaaagaactttgatgagaaactttcaatccaagaaataaaaaatttattaggagcgagaaaaaggagtttaggagatgtaaaaggatttatgcacagtgaagatattcaagttcctgattttttcaatagaactaataactggagaaataagattaatatttatttattaacaatatattatataattagatatttttatattattaatattaaatatttttacggatgagcttacaaataaaattttattaaaatttaatttttaatataaaaattacgattagaaattttcatattttaaaacaagatattatttatttttatatattactatttttacctcagagaagccaatctgtacggatacccaatttggttcaaactttacagcgccagacaagcttttgggctggaagcattacggccgacagattgggatgaacttgttaccaaaatgacaaacgatccaaagctatttgaattattctacaagtattattacaaagccagttctgtgcgacctagctgtgatacagcatgcaggaagaagatattatgtgatctacattctggtagatcgcacgataggaaaaatctgtgcgaaactatcgaatctaggatagattcaacttccaacgtcagttggaaagactggttatacaataccatatcagtttcaatgtcagtactgatgtcaattccacgactaaccaccaaatacgtactcggactaggataagatgttcgttatgtagttttaagcataaacacaatgtgtggagtccggagaagagagtggagtcccttattggttggttgctaattcatggaatgaagattggggagacaagggattgtttaaaatacgtcgcggaaataatgaatcaggcttcgaggactctattgttgctgcacctgctcaagtctaattttaaacgaaatattagtgttacgtttaatatgttttattttaaataaaaaaattatttctaaaaaaaaaaaaaaaaaaaaaaaaaaaaaaaaaaaaaaaaaaaaaaaaaaaaaaaaaaaaaaaaaaaaaaaaaaaaaagggaaaaaaaaaaaaagggggggcccgctcaaaagaa

SEQ ID NO: 2464 - DNA, 1383 bp, Diabrotica virgifera
atttgtttataactatgtatattatcaaaatcggctgcagcaaacatataggttattaatataaatgtccatactactcaaaagccttctttgagttttcgttaatttacaataagaatcttaatctttatattatttgcatttatagatcacctaactcttccgtggaactattttttcagaacctgctaaatttgttagatgacctgccccataaaagtagaaaaattttatgcggggactttaacattgattatgctgctgctagtgctacacaaatatccttggtcaacatatttgaatcgtatggtctaacaatgcacgttgattctcctacaaggattacaaaaacttcatctaccataagtgattatactgactcagatgtttcgcctcgtggagtgcggtctagaatactacggatgatatatctatgtctgatggcctttttggcaagagtcgtaattactacaggaggggctttaccaaatgtaggtagggaaattttatattctttcaaccttgctcatcatacaatggtactaaagtgcacagcagcacttttcattaagcaaacctcttgaaaatgctgtagaaggaaaaaattctaatttttccaataaatggctgctatgcctccaaaaggtaagttgccataagctaaagctctaaccaacggactgaccaaatgttgcatgaaggctaccggagctaagctaatgtgtgccttgacttttcggttatattctggtttttcagaggtcataacgtaaaatgaagttgtcccttgtgaatgcccaacatgaaatacctgcgattttcctgtggttttcaaaatataatctatcatggtcggtatgtcgtaaatcccaatttcattccagctgaagtcccagaatgcatcagcatctttgtccggattgagtgtcgtgtgatttctagaataagtattacctctaacatttcctagccaaacgtcataaccctcatcagccagtaggaacgagagactcttgtttggaccgagaattacccaatcagccgatgagcataaaagtccatgttgaaggtaaacaggtatattttttttagtcttgttagtgttaccatgtggaatcctatgcatatttaaaatgtatccatctggtgtagttacataatgactttctgactcatatccagcttctttgataaattctggaataggggttctctttggcggcgaatcaaagctaaaaacattgttcatagagtccttgacgaaatcggatccaccatgtataagatcttggcggagtccaatatgttaataccagaagttgaataaacacaccaaacgcacaataaaaatattactttatacttcatattgactactacacg

SEQ ID NO: 2465 - DNA, 1824 bp, Diabrotica virgifera
gttcccgtgtgatacattaggataaaacaatagggcttttcattcacagtcgcatttgtttcaagcttctgtcatgtgtcacgtaatatggatatatctacgtcatacgttatttgtatacgctctgagcttcgctggtgtcgctcctagcggttactaattcaacttttaccggtaatttttaaatttattatttaattgttatcgcttattatttacaacgcaaaaaagtaattaaattgtaatcgatttttttaagatttttctaatcattttgacgttctattgataaaatatcaatttcttacttcggatactttgacaataatcgtgtagatggcgctaagattataatagattatttataattagatattacggaacattaaaaaaaacttaaattcagtatttaaaacgtaagtatatttaaggtaaaaatatataccacagctttgaccaactaatattgtttataattaatgtttttaattttaattttaaattaatcactttgacatttatgtcaaatttccgataaacgtttacaaacttgtcactactgcgttcgcgaatttgtaaatatcccctctacgtacgagctcacagcgtatacgctgtgtgcttcgctggtgtcgttcctagcggactactattcaactttcaccggtaatttttaaatttattatttaattgttatcgcttaatatttacaacgcaaaaaagtaattaaattgtaatggattttttaagattttgctaatcattttgacgttctattgacaaaatatgaatttcttacttcggatactttcacaattatcgtgtagatggcgctaagattaatggattaatagattaatagaacattaaaaaaacttaaattcagtatttaaaacgtaagcatatttaaggtaaaaatatataccacagctttgactaactaatattttttataattaatgtttttaattttaattttaaattaatcactttgacatttatgtcaaatttccggtaaaggtttacagacttgtcactaatggcgttcgcgaatttgtaaatatcccctctacgtacgagctcacagcgtataactgaacgacaacgaacgaacgaacacgaacactgaacacagattcacagatagcgcaggcaatcattagagctgtagataagatgtcagggggccttaacgttaaatagattataatcgggtggtacttcagatccgttgtacaatttcttgttcttaattttgccaaaatcgtatttgcggaaatggccagaaactacttcttgtgtataatgtaagatttgtctagtagcagcaccagctggatagtgagcatatataacagctgtatctttggcgtccatttcatttggactgaaaccagcgagggcaaatatagaaattttacaatagactgctccaactcccacaccacatatggcgtcattaagcaaaactaaaaatgctgtagaaggaaaaaattcattttttccaataaatgtctgctggtttccaaaaggtaagttgccataagctaaagctctaaccaacggactgaccaaatgttgcatgaaggctaccggagctaagctaatgtgtgccttgacttttcggttatattctggtttttcagaggtcataacgtataatgaagttgtcccttgtgaatgcccaacatgaaatacctgcgattatcctgtggatttcaaaatataatctatcatggtcgggatgtcggaagcccctattccagaatttatctaagaaatctggatatgagtcaaaaagacattatgccactacaccagatg

SEQ ID NO: 2466 - DNA, 1559 bp, Diabrotica virgifera
cccacgcgtccgcacaaatttattattgtgtttaggaattacatttagtagttaaatagttagataatctaggtcaatatatgaaatatagtcatagtttaacaccggacaggcctcttttctcacttcagtcatattttggaaagttggtatggaaatcatagctttaaaagctacttataaaaacatatatgtaagtctataaaacgaattagttactacctaaaaattaaaatcaatgtttaatatcaaagaagtataaataatattgaaacattattccaaaactaccggtactgaggacattaaaaactcatgttatgtatgtacagttacggtcattgaatagtttacaggcttacgtatctaggagctgattttttaaatttttacccatagagttaaatattagcatagagagagcgtcattcagagcgaagtgacgaccccatcttttttatttggattagtgctgtttcactcttacgcatagtaaagctgctatagttatcctcctcttccgtgcctatattcacactgaatgtcattatagattctcgatacaatgtgttagaaggagatgcagcaaaccagtcccctgagatcttgtcgccaggaagcgcggaaggtaggctccctctatgttaatatatacctctatgtttttacctcgtttaaacgcaccttttacgtcaacgtgacgttaccagtggcgcgagcggccgcccgcgatctagaactagtcagtgaattaagttacacagctaacttagttcctcttacatatcgttacataaactacatctatagcaaaccagtattcgttactgctgttacttttgtatttgagtaccggtaatcatctcgagaatcatatttctcagtaggtaggtctgtataggtattccgatataacaatgatcttcaccaatctgtttaagagataaaaatgatttgattacttttgtatttgagtaccggtaatcatatcgagaatcttatttctcagtaggtaggtattttgtataggtattccgatagaataacgaccttcacgaagtacgaagtaatcagagtaatcgaagtagatacaatagtcgttactcgctctgatacgattggtacgaagtaactaagtaagcagagtaatcaaagtagatacaatagtcgttactcgctctgatacgattggtacgaagtaatcagagtaatcaaagtaacgatttgcctctctctatagtaatcgttactttcggtattcgtaggtaacgagtactttgtatgaatagttactttttcaacatccctagaacatacaattaaattgatattgtataaggtttgttcctacaaagaatcacaaactaattcatgacagtttctgactgctgcacaatacgcatgtgcgaattcaaccagccgcgaactagtttgtgatttttgttggaacaaatattctaccgagctggcaagttgcctagtgcccagagaaaagaaaagaaagaagaagaaagcattctggaaaacgagggaaaccaaaactttaaccttactacttt

SEQ ID NO: 2467 - DNA, 1720 bp, Diabrotica virgifera
ccttacgcgtccgcagggattattaattaataattatatatccattattttcgaatttaaaagagctaaaaaattaaaatttttattgtaaaataaatattttaaataatttttttgtaatgaaatgttattcgtttttaaatatatctaattttttaagaaataaattaaatttatttattaacaatatatttataattaaatatttttatattattaatattaaacatttttatgaatgatattataaataaaattttattaaaaatcaatttttacataaattttcacaataaaaattttcttacaataaaatattttttgatatatccatatgtaatatgacaaatacctatacactctgatcttcgctgataggagctcctagcgtattactgaaattatctttcacgtataatttttaaatttattatttatttgttatcgctcaacatttacaacgcaaaaaattaattaaattgtaatcgatttttttaaagattttgctaatcaaacaaatgaaatagagaatgtggaaaaatcttttgatcactgaatgtgtttcaaagatctacatcttttgttttttcataaattttgctaatcattttgacgttctattgataaaatatgaatttcttacttcggatactttcacaattatcgtgtagatggcgctaagatttttagattaaattataattacatattacggaacattaaaaaaacttaaattcaatatttaaaacgtatgtatatttaaagtaaaaatatataccacagctttgaccaactaatattttttataattaatgtttttaattttaattttaacttaatcactttgacatttatgtcaaatttccggtaaacgtttacaaacttgtcactactggcgttcgcgaatttgtaaatatcccctctacgtacgagctcacagcctatacgctctgagcttcgccggtgtcgctcctagcggattagtaatgcaactttcaccggtaatttttaaatttattatttaattgttatcgcttaatatttacaattcaaaaaagtagttaaattgtaatcgatttttttaagattatgctaatcattttgacgttctattgatgaaatattaatttcttacttcggatactttcacatttatcgtgtagatggcgctaagattaatagattaatttataattacatattacggaacattaaaaaaacttaaattcattatttaaaactaagtatatttaaggtaaaaatatataccaaagctttgaccaactaatattttttataattaatgtttttatttttaattttaaattaatcactttgacatttatgtcaaatttccagtaaacgtttacagacttgtcactactggcgctcgcgaatttttaaatatcccctctacgtacgagctcacagcgtatacggtcaatacgaactgcagtgccttaaattttttaaagcactagtgccttaaagtagcatttttaacgctcgtatggagtgctagtattaaatttcagaaaaaataaattatgtttaacttcatgtgtttcgtttttttttaattcgcacgaaataagaaatatcaggtgattccatataagtttgggtgtgtgtatatatatagatttttaaatagttctaggacaaaaatgtttttcaagttttttaaaaaaactgaataaaatttctaaaagatgtatgt

SEQ ID NO: 2468 - DNA, 1798 bp, Diabrotica virgifera
acgaaaatgaaggcggcttttattattacactattactacctgttgtattaagttacacagctaacttaaatcctctttcaaatgagtttataaactacatcaatagcaaacaaagctcatgggttgctggaattaagctttgaggaaaaccggtaataccaataaataataatataattattaatatcgaaaataaaatagctatatgattaaaatttttattgtaaaataaatatttgaaataatttttttgtaaggaaatgttattcgtttttaaatatatctaattttttaagaaataaattaaatttatttattagcaatatattgataattaaatatttttatattattaatattaaatatttttagggatgagcttaaaaataaaattttattaaaatttaatttttaaataaaaattatgattaaaaattttcatattttagaatatgatattatttatttttatatattattatttttattttttataaattttttataaaaatataaatttaaattatttaaatttagcaatgatgataatattagtattaaaaaattgtatatttagtaaaaatatataggtttaataaaggaattcggcaacatttttttcacctgtttattaaaaagatgtctttttgtattaaatataaagtctcgtctgcccactgattaatttgaatggccgcggtattttgacccgtgctaaggtagcataatcattagtttttttattgaaagctggaatgaagggttgtatgaaaaaaaaatgtctttatttaatttataaagaattttatttttaagtaaaaagtttatatttttttaaagacgaaagacccctatagagtttataaataattaatacttttttttaagatttaaattgacttcgaatgaaattaccaaattggggggtctcgctctgatacgcttgcacgatagtaacaaagtaatcagagtaatcaaagtaacgatttgactctctctatagtaatcgttactttcggtattcgtaagtaacgagtactttgtaacgaatagatactttttcaacatctctagttaccgttgaaaaaacttgtggcttcctgtgaggccataaggttgctgaaggattaacgttcggggcggcatcggcaggaggagctcagaattgcagcccctgctgattctgacgtgacatattatgagcagaaaggccgaaggccaggttcgcccaggatctggtccgtaagataggggtgatacaatggaggccgtagcatccgccgtaggagggctaagtatctgaagggctcataagtgggccctgccccgatgtaccgtaccaaaaatttttaatagaaatctgatagtcggttaggtgttcgtgtaattgctgaaaatgtgggaattggcaaggaatgcgtaatgacgattttccactacaaggacagttttgagtttatgttttatttgtgttttctagaactcgaaaaacaaaaacaaaactgaaacaaaaccaaaactctcgttttcattaagcgaactacattttgttccagttttgtttttgtcggcccttcctattgtttttcatgaggaagcccaagtattcttttttgcttcaataacatatcaacatgtttagagaaggttttttattcttggatgtgtctggtcgatactgaattccttggaaaaagggatttttcttatgcatacaattcattgcattatgaccaaaccacttgggtgtaaaattctgttttgcgcctagatttcttaattttttatacttacttc

SEQ ID NO: 2469 - DNA, 1699 bp, Diabrotica virgifera
ataatgagccacgatggtcgaccattttccttcatgttagactttggtgtcaaaatggatataacttgactatacggtcaaacggagaagttcttggaactggtgatgattctgatcctgatagcatgattgaaatttcttctggtggagacgttagtctagtaaggcttttgggcattaatagccagctgtatctatgttttgatgataacggacagttatatggagagaaagatccgcttaacccaggcactatcttcgtagaagcttttagtgcgtcatattcaacattccaaagcacattggactccaaaagttggtttataggaattcaaagaaacggaaaaccgaagccaggcaaaaagactggagaaacacaaaaggccacacgatttttacctcgaagatgattatcaaacgacttttatataaacaaactacagcagctagatcattcgaatgattcacatatttattttttcttccacatgtcgtcggtctgatgtgaaaggtgaataagtccaaaatacctgatattgcaggagatacaaaatactaactgtgcataactccacttgtacacaactaatataatgtgaaaattgcacaagcccattttactaataaatttgtttaattatcaaacaatatgtgtcattttaacctgtaccctatagtagtgatgttgattatagatactttcgagtattcgttaccaatcgttacttttgtataaataatcagagtaatcgaagtagatataatagtcgttactctactttttacgatttttacgaagtaatcagagtaatcaagcaaataaaagtagatgcgatagtcgttactctttctgatacgattggcattttgtaccaagtaagcagagtaatcaaagtagatacaatagtcgttactcgctctaatacgattggtatgaagtaacgaagtaattagagtaatcaaagtagatacaacagtcgttactcgctctgatacgattggtacgaagtaatcagagtaatcaaagtaacgatttgcctctctctatagtaatcgttactttcggtatttgtaggtaacgagtactttgtaatgaatagttactttttcaacatccctagaacacacaattaaattgatattgtataaggtttgttcctacaaagaatcacaaactagctcatgacagtttctgactgctgcacaatacgcatatgcgaattcaaccagccgcgaactagtttgtaatttttgttggaacaaatattctaccgagctggcaagttgcctagtgcacagagaaaagaaaagaaagaagaagaaagcattctggaaaacgagggaaaccaaaactttaaccttactactttacaccacaacacgagcaacgagcacatcattaacaaatactatggacagtccatagtatttgctatcactcattgtttcataaattataacaaaagtataaaacactaaaatacaatattatgtacttaaatcaacaaaataaccaaaacaaaggtaaaggtacctatttgatataaatataaatagttatttagtgtgagcatgtgagtgaatcaaaattatactaattgcgcatgtccgtgattaacagtttgcaaaaagttcggaaacttttcaaactgtcagaaattaatctcaaactgattaaatatttcatggaacagtgtac

SEQ ID NO: 2470 - DNA, 2110 bp, Diabrotica virgifera
  misc_feature (151)..(151): n is a, c, g, or t
  misc_feature (342)..(342): n is a, c, g, or t
  misc_feature (365)..(366): n is a, c, g, or t
  misc_feature (380)..(381): n is a, c, g, or t
  misc_feature (397)..(398): n is a, c, g, or t
  misc_feature (433)..(433): n is a, c, g, or t
gttattattatttttttttagtttgttttttatatgtagttttttgttgtggggggggggggggggggggttgttttttttttttttttttatttttttttttattaaataaaaatttttttttttttttttttttttcttttttttcccnccccaccccccaaaaaaaaaagcgttttttttttttatattttataattttaaaaaaataccccctttttcttttttgggggcctgcgtaaaggagtgggaggcttattattccccccagttttaatttggttttaggccaaaatagatttttttaaatatccttcccccagtttttctttgaatattttnttagtttcctttcatattccgannctatacattttttnnatccctactatattannccacatagggtacataaacgctctaaatacccatntcatttttaatctcatttttactattctttcttagatttgtttagttcttaatgctaacatcagttttagcctatgtgaccctgaccagctacctaattacatatttggtaacgaaatgggatctattaatattaatttaccatgtctttctattaatttttcattaaaaaatactatttctacatattatgacttaaatattacctgtaatgtatcaaccagttattcttaattttaagtcttaaataactatatatattatttttctacttatttaaaatatatataatacaaaaaggtgtgaaaattaaaaaatatagaactgtgttagcattgaaactttaaaaggattttagactaggtgtagagagttatcctgatcgtatccttgtatcgtttttcattttgaggaactatgggaattttctggctcaagctacaatcttagctggtatcaaagcacaaattacgtctttgtcattttcgtcaattaaatgtagctcaatatctactgttaccctgggataatttttttttacaggcatgctgacgcggtcggtgtaggtattccgatataacaatgatcttcaccaatctgtttaagagataaaaatgatttgattacttttgtatttgagtaccggtaatcatatcgagaatcttatttctcagtaggtaggtattttgtataggtattccgatagaataacgaccttcacgaagtacgaagtaatcagagtaatcgaagtagatacaatagtcgttactcgctctgatacgattggtacgaagtaactaagtaagcagagtaatcaaagtagatacaacagtcgttactcgctctgatacgattggtacgaagtaatcagagtaatcaaagtagatacaatagtcgttactcgctcgaatacgattggtatgaagtaatcagagtagtcaaagtagatacaatagtcgttactcgctctaatacgattggtacgaagtaatcagagtaatcaaagtagatacaatagtcgttactcgctctgatacgattggtacggagtaatcaaagtaacgatttgcctctctgtattatagtaatcgttactttttcaacatcacttaggagatcgctcctctgccattatttgttttataataataataaaatggtgactggacattgtcgtttaagaaaacacctatccaatctaggtaaggtgaatgaaccatggtgcagataatgcgaaatggaataagagactgccacaaacatcctacctatgccactgcaatgtactaagagatatgaggcgggaatacactggccaactgaggattgaaccagaagatatactacaacttgcaataaggaaactgttgactctagttaaggtgatagaacttattagagtatgagtctcgccaaaactaataagaagtactaagctcgtagctagtacttcttctagaattagtagcctattcgtagaataggctactaagctaaactaaaaggtaaataaatttattgtttcagtaatgcaatacatttccgtattaaccagtaagtgaattagtcaaataaaaccgtaggaatagttatcaggatacatgcatgctttgcctgatgatacacatcctgatccccgtgcgtctttttcgaattaggtattaatgattactgacac

SEQ ID NO: 2471 - DNA, 1233 bp, Diabrotica virgifera
ccacgcgtccggattcaccaaaatgaaagcggcttttattattacactattactacctgttgtattaagttacacagctaacttaaatcctctttcaaatgagtttataaactatatcaatagcaaacaaagctcatgggtggctggaagaaactttgatgaaaacctttcaacccaagagctcaaaaagttattaggcacaaagaaaaggaatttaggggacgtaaaaggatttatccatagtgaaaatattcaaattccagattctttcgatgcaagggaaaactggaaagagtgttcagatgttatcaacactattgtcgatcaatctgcttgtgcggctggttgggccctagctgcagcttctgcaatgagtgatagacgatgcatagcctcccaaggaaagcttaaagtgcctgtttctgctgaaaatgtagtggcttgtagccgtaatagtcttggatgcaaaataggatatatggaagatggatggtggtattggctaaaaaatggaattcctacaggaggtctttatggcagcaaacagggttgtcaaccatattcgcttcaatcttgtgaacatcatacaaatggtactaaagtggattgcagtactttgaaattggatacacctacttgcagaactcaatgtaacgatcccgcacttaattataagtccgagttaacttatgctgcaggtccaccagattggtacactagagttgccgatatgcaaagggaaataatgacaaatggtccagtagaaacaactttccgcttgtacactgatttctggaattataaaagtggtgtttatcataatgtcggtggagattatgctggagaccattgcgtcagagttttaggctggggtgtagagaatggagtcccatattggttggctgctaattcatgggaatgaagaggggagaagaggaattcttataataaatccttgaaaaaataaaatgaaattaaatttcaaatgccagcgtgtttgccgacgtctaattgtagccaaatttggaaaaaaaaaaaactgggagcttccccttttcaaaaaagtttttttttttttaaaaccaaaattataatttttgggaaaaaaaaaaaaaaggctaaaaaaacaaattggggggggcacaaaagggagataaacaataaaaaaagaaaaaataaaaaaaacagaaaaaaaaaaaaggtggaaaaaatataaaaagggggggggggggg

SEQ ID NO: 2472 - DNA, 1976 bp, Diabrotica virgifera
cctataaaacgtttatttaattttaatttataattatacattctactattagactacgttaagagttgtaggctattaatacacagtttaattagtttaaggcaaatacattttttaatatactaccacagcttctctgatatatttttagtttccctcatattccgaactatacatttttttattcctactatattaaccacgtatgggtacataaacgctctaaataacatttcattttaatctcatttttactatcatttcttagatttgtttagttcttaatgctaacatcagttttagcctatgtgaccctgaccagctacctaattacatatttggtaacgaaatgggatctattaatattaatttaccatgtctttctattaatttttcattaaaaaatactatttctacatattatgacttaaatattacctgtaatgtatcaaccagttattcttaattttaagtcttaaataactatatatattatttttctacttatttaaaatatatataatacaaaaaggtgtgaaaattaaaaaatatagaactgtgttagcattgaaactttaaaaggattttagactaggtgtagagagttatcctgatcgtatccttgtatcgtttttcattttgaggaactatgggaattttctggctcaagctacaatcttagctggtatcaaagcacaaattacgtctttgtcattttcgtcaattaaatgtagctcaatatctactgttaccctgggataatttttttttacaggcatgctgacggtataggtgtaggtatctccggagcttattggacacgtcactcccatttcacaagcatttggatttggcaaattaaatttttgtttaagtagaccaagtttaccaatgacgagggtctttaaggttttagagttggtattcgatttaaacgtcgccaccattgatgcgtttgtgcctcgttttaatgggcatcgatcttcgccttcacaacctgccagctctactttgactatttggccagtcacggatccacaatcctcaatatcgtcagtatctgctaaacaggatgatatacctaaaactaaaattaaacacatcgcacttatcaccacttttttcgatcccattttgaagagcaaagacacaagaccgtccaactaattaacgatagtaatcgttactttcaatattcgtaagtaacgagtactttgtaacgaatagatactttttcaacatctctagtgtacacaacctaaaaattaatttttttgaagttatacttctttagaccatagagttatatattaacatagagagagtgtccttcagagcgaagtgacgacaccatcttttttatttggattagtgctgtttcactcttacgcacagtaaagctgctatagttgtcctcctcttccgtacctatgttcacactgaatgtcatcatagattttcgatacaatgtgttagaaagagatgcagcaaaccagtccatgagatcttgtcgtcaggaagcgcggaaggtaggctccctctatgtcaatatatacctctatgctttagacacgagggtgaatttttacattccctggcgcatgcgcacaccgacgctatcttattagtcgctcaaacgttataagggatctgattgggtgttaaaatcatctgtcaataattgttggatattatggataaacaaatgtgtatattagtttttattattgtgatggcagagaaaaaaataagtttataatcgtagtgactttttaaatagtttttaaaagcgacagatacgtaataattgtaaatgtttcagtatcctaataaaaaattacataggtacctacctatttgtaaaatttaaaataaacataccaaaatagtatgtaatgatttacataatttgattaccatcataatttctgtcaatattcacctgaatatattgttttattactctatgttttgtt

SEQ ID NO: 2473 - DNA, 1684 bp, Diabrotica virgifera
gactcgcgggccgacacaagcctacgcgtgggcaatacggattcacgaaaatgaaggctgcttttattattacactactactacctattgtattaagttacaaaggtaacccaaatcctctttcaaatgactttataaactacatcaatagcaaacaaagtacatgggttgctggaaaaaactttgatgagaacctttcaatccaagagatcaaaaatttgttaggagcaaagaaaggtaaattaggcgtggctaaagaatttacacacagtgaagatattcaagttcccaattctttcgatgcaagagaaaactggaaagaatgttcagatgttatcagcaccgttgtagatcaatccgattgtggatcttgctgggccgtcgctgcagcttctgcaatgagtgacagacgatgcatagcatcccagggaaagcttaaagtacctgtttcggctgaaaatctaatgtcctgctgaaaatgtggatatggatgaaagttttttaaacattcgtgtttcagtgcggggaaccccaattcattaaagacgttgaaaaaaaaaaaaaaccaggggcccttaacgtttaaaaaaaaattttaaaatgggggggggtttttcaaaaattcctttggacaatttttttttttttaatttttcccaaaaattgtttttggggaaatggcccaaaatttttttttgtttttaatttaaatttttttagtagcagcaccagctgggatagtgagcatatataacagctgtatctttggcgtccatttcatttggactgaaacccagcgagggcaaatatagaaattttacaatagactgctccaactcccacaccacatatggcgtcattaagcaaaactaaaaatgctgtagaaggaaaaaattcattttttccaataaatgtctgctggtttccaaaaggtaagttgccataagctaaagctctaaccaacggactgaccaaatgttgcatgaaggctaccggagctaagctaatgtgtgccttgacttttcggttatattctggtttttcagaggtcataacgtaaaatgaagttgtcccttgtgaatgcccaacatgaaatacctgcgattttcctgtggttttcaaaatataatctatcatggtcggtatgtcgtaaatcccaatttcattccagctgaagtcccagaatgcatcagcatctttgtccggattgagtgtcgtgtgatttctagaataagtattacctctaacatttcctagccaaacgtcataaccctcatcagccagtaggaacgagagactcttgtttggaccgagaattacccaatcagccgatgagcataaaagtccatgttgaaggtaaacaggtatattttttttagtcttgttagtgttaccatgtggaatcctatgcatatttaaaatgtatccatctggtgtagttacataatgactttctgactcatatccagcttctttgataaattctggaataggggttctctttggcggcgaatcaaagctaaaaacattgttcatagagtccttgacgaaatcggatccaccatgtataagatttttggcggagtccaatatgttaataccagaagttgaataaacacaccaaacgcacaataaaaatattactttatacttcatattgactactacccggggggacggaatt

SEQ ID NO: 2474 - DNA, 1765 bp, Diabrotica virgifera
tttctcgcgtccggattcaccaaaatgaaagcggcttttattattacactattactacctgttgtattaagttacacagctaacttaaatcctctttcaaatgagtttataaactatatcaatagcaaacaaagctcatgggtggctggaagaaactttgatgaaaacctttcaacccaagagctcaaaaagttattaggcacaaagaaaaggaatttaggggacgtaaaaggatttatccatagtgaaaatattcaaattccagattctttcgatgcaagggaaaactggaaagagtgttcagatgttatcaacactattgtcgatcaatctgcttgtgcggctggttgggccctagctgcagcttctgcaatgagtgatagacgatgcatagcctcccaaggaaagcttaaagtgcctgtttctgctgaaaatgtagtggcttgtagccgtaatagtcttggatgcaaaataggatatatggaagatggatggtggtattggctaaaaaatggaattcctacaggaggtctttatggcagcaaacagggttgtcaaccatattcgcttcaatcttgtgaacatcatacaaatggtactaaagtggattgcaggactttgaaattggatacacctacttgcagaactcaatatgacgattccgcacttattagctaagaatttatgaatatagattcacgaaaatgaaggcggcttttattattacactattactacctgttgtattaagttacacagctaacttaaatcctctttcaaatgagtttataaactacatcaatagcaaacaaagctcatgggttgctggaagaaactttgatgaaaacctttcaatccaagagatgaaaaaattattaggaacaaagaaaaggaatttaggggatgtaaaaggatttatccatagtgagaatattcaagttccagattctttcgacgccagggaaaactggaaagtgtgttcagatgtaatcaacactattgcagatcaatctgcttgtttagctggttgggccgtagctgcagcttctgcaatgagtgacagacgatgcatagcctcccaaggaaagcttaaagtacctgtttctgctgaaaatctaatggcttgtatcgctttcggatgcgacggaggatatctggaagatggatggtggttatgggaggcgaatggaattcctacaggaggcctttatggcagcaaccagggttgccaaccttattctcttccaccatgtgaacataatacaactggtactaaagtgcaatgcagtactttgaagttagatacacctacttgcagaactcaatgtaacgatcccgcacttaattataagtccgagttaacttttgcttcaggtccatcgtattcgttcactacagtagccaatatgcaaaaggaaatattgacaaatggtccggtagaaacgactttccacttgtacagtgatttctggagttataaaagtggtgtttatcaacatgtcgctggagatgatttaggataccattccgtcaaagttttaggttggggtgtagagaatggagtcccatattggttggctgctaattcatggaatgaagattggggagacaagggattatttaaaatacttcgcggaaaaaatgaagtagagttcgagtaccaaatgatggcggcacgtccaaaagtctaattttaaacaaaatattggtgttacgcttatgtaggtacgttttattttaaataaaaaacttgatttctccggtt

SEQ ID NO: 2475 - DNA, 1698 bp, Diabrotica virgifera
cgcccacgtgatacagattcacgaaaatgaaggctgcttttattattacactactactacctattgtattaagttacaaaggtaacccaaatcctctttcaaatgactttataaactacatcaatagcaaacaaagtacatgggttgctggaaaaaactttgatgagaacctttcaatccaagagatcaaaaatttgttaggagcaaagaaaggtaaattaggcgtggctaaagaatttacacacagtgaagatattcaagttcccaattctttcgatgcaagagaaaactggaaagaatgttcagatgttatcagcaccgttgtagatcaatccgattgtggatcttgctgggccgtcgctgcagcttctgcaatgagtgacagacgatgcatagcatcccagggaaagcttaaagtacctgtttcggctgaaaatctattgtcttgctgcgattcctgtggatatggatgcgaaggaggatatccaaccatggcatggagttattggatagatacaggaattactacaggaggcctttatggcagcaaacagggttgtcaaccttattcgcttcaaccatgtgaacatcatacagagggtaataaagtacaatgcagcactttggactatgacacaccttcttgtaaacataaatgtgacgattccgcactcaattataagtccgagttaacttttggttcaggttctgtgcgtaacttctattcagttgcaaatattcaaaaggaaatattgacgaatggtccggtagaagcagcttttgatgtgtacagcgacttcgtgaattataaaagtggtgtctatcaacatgttgctggagaatatttaggaggacatgccgtcagaattttaggttggggagaagagagtggagtcccttattggttggttgctaattcatggaatgaagattggggagacaagggattgtttaaaatacgtcgcggaaataatgaatcaggcttcgaggactctattgttgctgcacctgctcaagtctaattttaaacgaaatattagtgttacgtttaatatgttttattttaaataaaaaaattatttgtccaacatgaaatacctgcgattttcctgtggttttcaaaatataatctatcatggtcggtatgtcgtaaatcccaatttcattccagctgaagtcccagaatgcatcagcatctttgtccggattgagtgtcgtgtgatttctagaataagtattacctctaacatttcctagccaaacgtcataaccctcatcagccagtaggaacgagagactcttgtttggaccgagaattacccaatcagccgatgagcataaaagtccatgttgaaggtaaacaggtatattttttttagtcttgttagtgttaccatgtggaatcctatgcatatttaaaatgtatccatctggtgtagttacataatgactttctgactcatatccagcttctttgataaattctggaataggggttctctttggcggcgaatcaaagctaaaaacattgttcatagagtccttgacgaaatcggatccaccatgtataagatttttggcggagtccaatatgttaataccagaagttgaataaacacaccaaacgcacaataaaaatattactttatacttcatattgactactcggacgcgtgccgcccgcgatctagaactagt

SEQ ID NO: 2476 - DNA, 1753 bp, Diabrotica virgifera
ttcttgttcttcggacgcgtgcgtgtgaatagagattgaccaaaatgaaagcggcttgtattattacactattactacctgttgtattaagttacaaagctaacttaaatcctctttcaaatgagtttataaactatatcaatagcaagcaaaacacatgggttgctggaaagaactttgatgagaaactttcaatccaagaaataaaaaatttattaggagcgagaaaaaggagtttaggagatgtaaaaggatttatgcacagtgaagatattcaagttccagattctttcgatgcaagggaaaactggaaagactgttcagatgttatcagcactattgtagaccaatctgcttgtggatcttgctgggcaatgtctgcagcatctgcaatgagtgacagacgatgcatagtcacccagggaaagcttaaagtgcctgtttctgctgaaaatttattgtcttgttgcgatgactgtggatttggatgcgccggaggatatatagatgatgcatggtcgttttggcaagagaatggaattactacaggaggtctttacggcagcaaccagggttgtcaatcatattcgcttcaaccttgtgaacatcatacaaatggtactaaagtgcaatgcagtactttgaactacggcacaccttcttgcagaagcgatcaatgtgacgataccgcactaaattataagtccgagttaacttatgcctcaggtccagtgaattactatactacagttcccaatatgcaaaaggaaatattgacaaatggtccgatacaaactcgttttgatgtgtacagcgatttcttcagttacaaaagtggtgtttatcaacatgtcgctggagattatgtaggaggacatgccgtcagagttttaggttggggagtagagaatggagtcgcttattggttggctgctaattcatggaatgaagattggggagacaagggattgtttaaaataattcgcggaacaaatgaatgcagtttcgaaaaatggtgttgttgccgcacctgcatatgttaatcctacataaacaaaatattgctataacgtttagttatgatttattttataataataaaaacttgatttcctaaattaaaaaaaaaaaaaaaaaaaaaaaaagggggaaaaaaaaaaaaaaaaaaaaaaaaaaaaaaaaaaaaaaaaaggcctttgggggggggggggggcccccccccccccccccggggggggggggaaaaatacccccgggggtactaaagtgccaatgcagtgctttgaaagttagatacacctacttgcagaactcaatgtaacgatcccgcacttaattataagtccgagttaacttttgcttcaggtccatcgtattcgttcactacagtagccaatatgcaaaaggaaatattgacaaatggtccggtagaaacgactttccacttgtacagtgatttctggagttataaaagtggtgtttatcaacatgtcgctggagatgatttaggataccattccgtcaaagttttaggttggggtgtagagaatggagtcccatattggttggctgctaattcatggaatgaagattggggagacaagggattatttaaaatacttcgcggaaaaaatgaagtagagttcgagtaccaaatgatggcggcacgtccaaaagtctaattttaaacaaaatattggtgttacgcttatgtaggtacgttttattttaaataaaaaacttgatttctaaa

SEQ ID NO: 2477 - DNA, 2706 bp, Diabrotica virgifera
aattgagtgccaaaaacaagccctcgaaactctagatgacgtaccttagcagtaaccctgggcacccaggtgcttcggaggtcggttctgattgcatattcgtgttcagtgaccccaaatacctcgaaataagaaaatctggcctttaatatactgattttaacatgtttatgcatttttcgatgcgttttatacactttaaaatgtaataatgcatttccacccatttttctattgtagacttgtttccaggcgtcatcctaatcctaaatataatgcaaaaagttgcaagtctctaggtacagttacggtcactgaatagtttacactttaatttttatattgtaatactgtaaaattgcagtgtcgtacggatttgataaatgtcaaagtaaaaaaatctcaaaaaggcaatgcttgtcaaaaatttcgtgagttgaaaaataaaataagaaactaaaccatattaagaccataatccattttattcaaaaaaacttctttctatattttccattttgataaattttgtaaaatttatttttattattttgattttttaaatttaatctggcaacttgcaacgtcactttgacgcaagtggtgcgtttaaccgaggtaaaaattttaaaaatcggctcctagataagccagcctgtaaactattcactgtccgtaactgtacctactatatttaaaaatatatttattcctgtgtttttagtgttaaatgccctggtctcataaaaacaatgccatacctacatgtaaaattaaagttgatgatcacagtctagaaatattatcatttctacattttttccggtcaatctaagctaggtatttttttttctaggcctgataagaatagtgtgtatttattattaaaatctaatgtgttgcatttttattttcaaacgaacaaacatctgtgaattatctacctcgacaaatcatattttatcgtatagacatctgtttctgggtgcatgctttgttaaatgatttacctccctctgtttcagctacttctcagcgccctgtaatcctgtaaaactcttcatagccttagcccttcatagataatattttagttaactgtactgataccgaacactcgtggaataccggtccgattccgacatcagccgattgtagatacaatactcaaatatgtactcgctctgatacgattggtacgaaataatcagagtaatcaaagtaatcaaagtaacgatttacctctctgtatagtgatcgttactttcggcattcgtaagtaacgagtactttgtaacgaatagttactttttaaacatcactaccattttgaccttcttcttcttcttcttcttcttgtaataggactatgtcctgtttcttctgttacagtctttactgcgatccggagctccaactctcataccatcgttttttgggttttcctatgggtcgtttggtgttgggcttctgtgttttcgcccaatgcgccatacgttcagggtccatccgatctacgtggtctctccacatgcgtcgtcgcgctcttgtccatctcactacgtcttgaacgcctagctctctcaatgtgtctttgtttcgtattctatctctgagtgtgatacctcttatggatcttagggttttcatctctgttggtctcattatttgtttggtctttgttgtctcggcccttgtctcagctgcgtatgtcagtacgggtctaacacatgtcttataaatgcggactttgctttcggtgctcatatatttattccgccagattatatccctcaggaaaccagatattctcgctgctttggcagataaccaaattgtgttgagatgttgcttaaactatacatccaatttccggaaaaaaattcttctatctagaggatacttcacttgtctagtaatattgaacagaaaatggctttcatcactgaatattaatttttaatcctcgttcaggtctgcagtttacattttttagctcttgttggtcgtttttcttcattgcaacagtcttaagttgtttatgtgtagtgatgttgattatagttactgtcgagtattcgttacaaatcgttacttttgtataatcatttaaagtattcgttactttgattcgttactttgatccctcggaggaattcctcattgacacaggacttagacaaggagatcctctcgcccccctgctgtttaacttcgcactggaacatgcagtaaggaaagctcagccacaactgacaaatggatttgccgtccaaggatcaaaaatactattagcctttgcggatgacgtggacacaattgcacaatccaccagagatgcaaaagaagttttcaccctattcgagaacggagccaaggaagttggtcttaaggtcaacgaggacaagaccaagtacatggtggttacgaagaacccaagaccaagggttagacaaaacgtaacaattaatgaatacaattatgaagtcgtcaaagaatttaagtacttgggagcgatcataacatctgaaaataactatgaacaggacgtggcagccaggattattgcaggaaaaagggcatattactcgttaaggaccctacttaaatcaaaaatactctcaagaccagcaaaaataagagtatataagacaataattcgtccccacataaaggtacgaagcgaaacctggactctgaatcagc

SEQ ID NO: 2478 - DNA, 836 bp, Diabrotica virgifera
agaactagtctcgagtttttttttttttttttaaagggcctaaaacccaaatttcagtggctaaaattttatattttttaattaaaacaatttctgctacccacttgaaaaaaaaaaaaaacaaaaaaaaaaaaaaaaaacaaaaaaaaaaaaaaaaagaaaaaggtagtacatttcgaaacatgaaactgatagtagtgattttagccgcagtttgtctctacgacgtatctgctaaacaagatgactacgtgcaatgggtgagttatgatggtacaatacccgccaatgttgtggaaggaactacatccattgatggtagacaattatatattgcccgtgcctttgttagtttagatgagtctgatctttataatgacaatcaaggttacatagtaggcccagtggaagcaggagttttacaactcaatgctagttttcctgatttaacttaccatattaccgacaacattgagatcctaactgttgtggatggagccaaagtcgaatgggttagcacaaatcaaacatttttaccaaaatggttcgatagtgatgactaccatccagtgcactccaactggcatcaaattgttaatataaattcaaccatttatataggaagaatccacgactcggatataggtggtacatttggacatataccggtctccactgagttatacgaggacgaggatgtggcatactatgcttttggcgatgatgtccgcgaatctaatgtatacgatattttactgtattatttcaaataataggtaacgtaaaatatacttgttaacaatatataaaaaagaaaaaaaacgtacagggtcaga

SEQ ID NO: 2479 - DNA, 911 bp, Diabrotica virgifera
  misc_feature (891)..(891): n is a, c, g, or t
taatttgtatcgtattgttcttagattttaaatttaaaattaattacgcctatgggcacataaacaggataagaaaagcttaacaaaggttgtgaagaattttaactgattaatttttatattattacctactgtacagattacgagagtggaatacacagtgtacaatgactgtaacaaaggagacatttgttcaactagaagaaaaatatgctaaagtaattaaattgctggaagaagatagtaaatttgatcctgaaactgaaccatatttatcaaaatattcagctagacaaattttgatcggtatgaaagcacaaattgaaaatttgttaaggggccagggactggaagaatcttgtcagaaaaagttaaatgccatgctaggtaccgtttacttgtatttgggtatgatatcagttgaaactggagaagtttctaatggtaaaagccatcttgaaaaatgcaaagaaataatagaaaaattccaaatggaaccagattttatattaatagcactcaatatgtataaccagttcggaataatgctatcagtaactgaaccagaaagttcgaaattatatttggatatagccgaaaatttatatgcagactttaaaagcaaagatgtgaatccaattgatattagtgatttatttcaattaaataataaatcacacgatgttgaaattgggttaaaaaatttggaaaaaatacacacactcacattatattacttagctcagatatttggcgcaatgcaagatgccttaaaaagttcagtgtattgtcatttaactttaaaaaaacaattagaaatgagtgactatgatcctattgaatgggcgttgaatgcagcacattatcccaattttttattggaaaaaattnggtttaaacagctcgacatc

SEQ ID NO: 2480 - DNA, 419 bp, Diabrotica virgifera
cgatttgggatattattaatataattattcaaatgaaccttgttcccgttgtttattgttaaaaacaatgagaagcacaatttatattagggctaaaacattaaataaattagtaataaaccgttttaatgtgacaagcaaagtaaatattttgggaaactgcaattgctacaatgaacccttttatcaaacttactcgtgtttaacacctagatctgtgatatttaacagtccagcgctatatcaatcttgtagatttcaaggcaccgatattaaggaggcagctaaagatgactctaaaaggtctgaaaaagagatacctgaaaaaattgtcctcaaagaaactctttcaagaaaggaaaagttaaagaaggctgtaaaagaatatggttcaactgttattgtatttcacattggaa

SEQ ID NO: 2481 - DNA, 879 bp, Diabrotica virgifera
  misc_feature (825)..(825): n is a, c, g, or t
tctttcgcgtccggcggcaggttaagaaaatcgcgcacaaagtgttggttcctctaacattgtttacgttgttaatttgtagtgttataatcggatcggtttcttcggccgaacaaccgaatgtgattgttattgttgctgatgacctcggttggaacgatgtggggtttcatggaagcaatcaaataccgacgccgaatatagatgccttagcatataatggcataatactaaacagtcattatgttcattcaactagtagtcctacaagaactgcacttctaactggaaaatatcctatgaaactgggtttacaaggaacttcatttttacccgctgacaaacgatctttacctgagggaaagctgttaccagaatattttaaggaacttggatatgctacttatttagtgggaaaatggcatttagggtattcaaaatggaacgatactccccagtttaagggattcgaccatcattttggcttttataatagcttcactagttattatgattatttaaccacatacaagttcgacaacaaggagtacacaggctttgatttaagaaaagatgggaaatcagcacacgaagaaagtggaaaatatgccactgatctttttacagattacacagttaaaactattatggaacaagacagctccaagcccttctttattatgttgacgcatttggcagtgcacgctgggaatgatggaaagctcctcgaagcacctcaagagactatcaacaaatttagtcacattgtagattcgaatagaaggacttatgcagctatggtctcaaaattagacgacagcgtgngagctatagtagaagctttagataataagaatataatgacaaacacaatagtag

SEQ ID NO: 2482 - DNA, 3442 bp, Diabrotica virgifera
  misc_feature (3299)..(3299): n is a, c, g, or t
  misc_feature (3306)..(3306): n is a, c, g, or t
  misc_feature (3342)..(3342): n is a, c, g, or t
  misc_feature (3414)..(3414): n is a, c, g, or t
  misc_feature (3430)..(3430): n is a, c, g, or t
cccacgcgtccgcccacgcgtccgcccacgcgtccgcccacgcgtccggaacttttaccgtatgtatttctcgtattcctgatgttcctgatgcaatattaaatatattgtgaattatttttatacaggacactaatttaaagatgactgaaaagaaacttcaacaaataccgagagttccagaatcggtaaattttcccgatgaagaagtaaaaatccttgcctactggaaacaaattgatgcctttaaatcatgcctgaagcaatcaaaaggaaaaccaaaatacacattttatgatggccctccctttgctactggtttaccacattatggccatatactagctggcactattaaagatgtagtcaccaggtatgctcatcaacaaggctttcatgtagaacgacggtttggatgggatacacatggtttaccagtggaatatgaaattgacaaaaaacttgggataaaaggacctgatgatgtaatgaaaatgggtattgcaaaatacaatgaagaatgtagaaagattgtaatgaggtacagtggtgattgggaaaaaattgttagtaggattggacgttggattgattttaaaaatgattacaagacattatatccgtggtttatggaaactgtttgccgggtatttaagcaactgtatgtcaaaggtttagtttacaaaggcaacaaagtaatgccatactctacaacatgtaatacacctttatcaaattttgagactggacaaaactacaaggatgttgttgatcctgctgtgacagtgagcctgccaattttagatgataaagaaggtgctgccttattagtatggaccactaccccttggactttaccaagtaatatggcagcttgtgtccatccagacttaatttatgcaagatttcagcaagttagcactcaaaagatttacgtaatgatggaatgccgcatagaatctatatttgctgctgatgatgttaaggttattaaaacctttcctggtaaagaattggaaggcctccgctatgaacctatattcaactacttcactcacttgaaagataaagcatttagagtgtttgtagacgattatgtgacgtcagagtcaggtactggcattgtacatcaggctccatattttggagaagatgataatagagtttgtttggcaaatggtgccataactagagatcaagaaccgatttgccctattgatgctaatggctgttttgttgaacctgtaaaagaatttttgggacaatatgtaaaagatgctgataaaaatatcattgctaagctcaaagaaactggaagactgattcatcaatctcagattaaacacagttatccattttgttggaggtctgatactcctcttatatatcgcgcaatcccatcttggtttataagagttgagcatatgagagatcaacttcaggaagttatatccgatacctattgggtaccagaatttgttagggacaagagattcgccaattggttaaaagaagctagagattgggctgtcagtagaaacagatattggggtacacccattcccatctggatgtctgctgatggcagtgaagttgtttgcattggcagtatagctgaattggaagaacttagtggaaagaaagttgccgatttgcacagggaaactgtggacaccattgaaattccaagtcgtataccaggaaaccctccattaaaaagaatatccgaagtttttgattgttggtttgaatctggctccatgccttacgcccaagttcattatccgtttgaaaatgtaaaagaatttgaagacaatttcccagctaactttatagcagaaggtatcgatcaaacgagaggatggttctacactcttaccgtaatatccacagctctctttggcaaggctccgttcaaaaatttagtttgcaatggattagttttggctgcagatgggtttaaaatgtccaaaagcaagaagaactatccagatccgatggatatagttaataaattcggcgctgatgctttaagattgtatttaatcaattctccagtagttagagctgaaaatttacggtttaaagaagaaggtgtgagagatgttataaaagacgtatttttgccgtggtacaatgcttttaggtttctgcttcaaaacattgagatatacgttcaaaattacaataaagatttcatatacgacgaaaataatgttaaaagcgacaatataatggacaaatgggtattatcatttacccaatctctgcttctttacatcagaaaggaaatggagttgtatcatttgtacaatgttattccacgattaacaaaattctttgactatcttaccaactggtacgttagaatgaacaggaaacgtctaaaaggagaaaacggcgaggaagactgctacgcagctctaacgactttgtttaatatccttcttaatataatcaagatgatggcacctttctcaccgttcctcaccgaaactatgtatcagtatttgaagcaactactagataccaaagcggacagcatccactatttaatgttaccacaaccgaatcaaactttaatacatgtagatatagaacgagctgttgctcgtatgcagagtgtgatagaactgggaagagtaatcagggacagaaaaacaataccaataaagtatcccttaccagaaataatcgtagtacatcgagatcaacagtatttagatgacattatacaattgcaaggctatattttatcagaattaaatgtaaggaaaataagcacaactactgataaaagtaaatttggcatcactctgagagctgaacctgatcataaagtgctgggtgctagactgaagcaagagtttaaggctgtgacacaaggacttaagtcgttaactgatgctgaaattaacgaaatggtggaaaaaggacatcgggatatagctggtcaacgcattgacatttctgaagttagattaatatttaaatccgagagtttaaatagcgaccagtatgaagtaaatagcgataacgatgttctggtgttaatggacgttaccccggattcgtctatgcaagacgaaggcatcgcaagagaaattattaatagagtacagaaactaagaaagaaggcacatttggttcccactgacgaaattgcggtattctataaaacatctggtgacttaagtcgagttgctacagaatatactgagtttatagaaaatacactcaaaacaccatttaaatgtctccaaagcaaaaaagcttcagatgaaactatcatagaaganaaacaanagttaaaagactttgacattcaaatacttttgactnaaaacagtaatattcagctgcctggttgtaaatgggtaaacctttcattagtaggactaaaatcgaagtacntgtaagatgctacaanagggattagttt

SEQ ID NO: 2483 - DNA, 1003 bp, Diabrotica virgifera
  misc_feature (745)..(745): n is a, c, g, or t
gttcttcgtattcttcagttgtgattctatgtctaggagggctataaattgcagcaatttcgaagttccaaggcgtggcatttatattaagtattgttgcttgtagcttatctgttttatgttccggcatttgatgatgttgtatattgttccttataattattgcagatcctccatgggctgttccatctgggtgactagtgtggtagactgagtattgaggtattttaattacgcttctttctgtgaaatgcgtttcggatacaaagaggatgtctattatgttgtcctctaggaattggattacttctgctttatggtttgctaaaccatttgcgttccattcggctattcgaacagatctaatgaattttattaattaatgttgttagcgtggtaaggatcatgctgttttgattcattagttgggtgaacattgctttaaattcgtttaagaataagttcatctgagaccctatgtcagctacttgatttcctgctcttactgcttaggcataggattgggttccattctgttgttggtactgtgattgttgactctgatactgtgaagttggtgctgggttaacattttgatgtgggttatgattattatgggttgactgatttccacgttgtctattatttcttacattttgcaagtccttgtaaattacgcagcctttatagtttgcagtgtgttctccgttacacagggcacattttgctggtgtatttctgggtnttgtacattctggcgttggatgacttcctccacatttcacgcatgcgtaaggtcttgtacaatacgcttttgtgtgtccataacgttgacagcgctgacactgtggtatatttttctttctgggaggagggtaaaagctgaattttctatttgcgatagaaatccaggggataaaagggggttggtggttttttttcgggtcctaagggcaacaaaaaaaaattgacaacggggggaatttattggaccctggggtaa

SEQ ID NO: 2484 - DNA, 905 bp, Diabrotica virgifera
ctggggacgcagttccccgaccggcccggaactcccggccctttttacgcgtccgtttttttaatcatatatttttaattccatatgaaattctatagaatatgagcagcaatataatttgttttaaaatataacaaaacaaaagtaaatactatataaaatattgatacaaaacgaatagacagagtaaaatattaaatatttaagattatcgttgaaatttaataataaaacatagtggaacaaatatttaattaaaagtttatcttaggacatacatcaaagttggcaataaacttccaactggctgactaaaaccactaaagacatgtaaaacatattttaaatcctaatacatatatctaattatacgatttgaatgggtaatacagaaatcactcaaccaaccaactatttaaaaatcacatcttcgtaagaagatcctgcccaagtgtaaaattatagtgaaacatcgcaccccgcctggtatattgacgcacatcgccgattgccgatgaagaaacattgaatacatttaaataacagtgtacatcacagagcatcgcacttacggccgatttctcataactaagttaatctatagttcaactgactgaggttcaatacagttatatacacgttctacgcctgaacgtttgttggtaatgcgaatatccctagattatagtagctttcgagaaattccaataggtggcaaaaggtaaaaatatcgccattgtgtatgaactttttatgctatctctgaataacgttatatttaagtatttatagtaaaagtcattttaaaaattattaataaatctaacaaaaatacaaataatgttttcgtaatgctcagatatctatttaaacgctttgatacaaactgaatttgacatttttat

SEQ ID NO: 2485 - DNA, 1432 bp, Diabrotica virgifera
ccttaggatgaatgttaaagtatcatttgcgtgacgtgtgagacgataagtggttaattattttaaataaatatctgcttaaaaaagagctcatttttgtgtttattgtgtatttggtggttggacaagcagtaaaggatgagatcgcttctatttcttctgcttttctatacctggcaaatctctttcgcccaaaagtgttcgagtccggaagtatcaagaaagttatcatttatttatagaacagtaccatcatctcaaattgaagtggtagaatgtttctatactgacggcaactcgaaaaatgattattacgatattaccaaaaactgcgttactgctgccaggaccagaatattcattgataaatatggcgacgatcaccgtgttaatgagggaggatccaaagtttctcttaaaacgtactataccaatgctgatctatcacagaacgtagtttttctcaaatccggaaagaaatgcaggtatgacgctggtttttgctatgacccttcccaaggaaataactacgccgtggtctgggcagtcaatccagtaccaaaagtcgtgtgtcctaatcaactagaacaaattttctacggttacgttgattattggacctttactgccgaaaacagaaaataccttatttactcggttcctctaaaggatgagtcattttcgttaagtctatcaaatacaacagtttgccatggaaaacaagcttggtatgtcgacgaacaaggtttcttagtatcctttactagtttgctacctcgtgttacagcaactcccgttttgaaccgaaatctctttccgacattcaagtctaaaggagatattagtgacagtattattagggactgcactctgaaatcctacaacttaaattttgatacgaagatcgatactgattatttatcagattcagaaaatctaaaaatcattctcagattttatcaacaaaatattgataacaacaaaaatgccataaataaactagcaaaagatatacaagatgacaacagggacaagaaaccatctgaaaatgtactttcagaaattaaccaaataaaatcatcactaagtacaaacttcaataatattaacaaactattcaaagatatcaaccagctgaaaactgtagatacagatatttattcgataataacgaatttagctaatagtattaaacaattaaagatagatattaaaaacattactaaaaatgatgaatacttagaaaaatatttaaaagaatttaaaaacgatgtttacaagaaattgaacaactacaatacagatatcaaaatacaattagataaagttaaacagtcgtcaggatcaaatgttataaacacgcctaatccaacgatacaaagtcttaaccacagcagtacaacctgcataaataaagtaaatagtctcaaaa

SEQ ID NO: 2486 - DNA, 927 bp, Diabrotica virgifera
  misc_feature (864)..(865): n is a, c, g, or t
ggtacgcgtaccactggtggtacgcggaaaggtttcaggtggtacgcgtcacgtgggtgaaccaagcgattacaatgggcctttgactgcggaagtgtcacttttcacccgtttctttaaactgaggtcagaagttttaatgcttttagctgaaaaaaataatgacagactcaacacgcttaacatgggtcttcagagagcaaacacccttcacagccaatgaggaaataaacttcttcaaaaaaaagttagttcctttattttttcaaatacaggggaagaatgtctgtgcgtttgcgactctgtcatcattttttgacgaaaacgaaatatctcgaataagagatgtggttgctgatataatttatcacttggataggaatttcttcaagaaagttttgataaatatttctctgaagattattccaaacttgactgaatcagaaattgttttgcaggaagcccaccaaataagttagaattacaggatttacagaaaacattcatcgatttcacagaagacacttttaaaaagaaatccttaattgacttctggatgaaataaaacaagccaatggacatatttttgatagcaaatatgtttctaaaaaaattgggaggcttccttttattccatgtcccccccccccccaacaacctgtatttggtggtacaccaaaatcttcaaaaatatatcaggtggtacgcagttgctcgaatattgggaacccctaacacttcagtgtttgcggtttcaaaataggataatttgatgtaagttatgaatcataaaaagcagccatatgtatttgtacaaatatttattccaaacaaaaataaagcttaggtttgttttataattgnntgtaaatgatctgataaatcactgctcccaaaacgtgttactaatatctttatctgacatta

SEQ ID NO: 2487 - DNA, 1058 bp, Diabrotica virgifera
gaaaaacactgaaatgcataccgtcacatctaaaaacaaaagcggtgttcgtcgctctaataactcgaaatcgaattttaaaaaaataattaatccaagcctatcagagtggtgggggaaatacgtaacagaatcagaactataatatataacgtagagatactctcgagtggttggttgtacgataaacgcagcatttaggttaactcgagagacaaaaagttatacaacgagttcgcaatctgaaatttcgtaagtggtactttcttcagcagtagttgatccggtcagtggttgttggtgtattttttttgaaaaaaaaaacgacagctacactgctacaggtggtttcgtcgaatctcatcgaggggataaaatttatcgtagtccgatcatacaaatgaatcacagatcatcgcagagtgtaagatacactcaagttggttgggtgtgcttagcaattggattgttccttcaaatcgtatccggcaacctggtgaataggtcgccgaatcttcttaatcatcatcgtgttaccaaaagatccttctatgagttacagtgcaaaggagtctactctccaagtatatatgcaagattagataaaatttgcgaagagtgtctcagtctctttaaggagccttcaatatatactctttgcagcgcaaactgtttttcaacaaaatactttgggagggtgttgcgagacccttctttgcgacgatatagaaacaatccaggatatgataaaacaattaaatgggggagacccaatttagttataactgtttctccggaaaatacttcaaagggtgtgcagaaagcttattaatggccgacgattggccagaactggaaaaaatggtagaatacatcggaaaataagcttcttgcccttaaacgcccagtgtcctgttaatctagtcgatgaatatatcaccaataggcgattaataatttaatttaatttgacagaatttggtgattatctctttttgctgtactggtcttacattttatttatttatttattttaaatatttttaggtatgcccgat

SEQ ID NO: 2488 - DNA, 1139 bp, Diabrotica virgifera
tgtgtggtgatttgcgttgacgttgaaggtattcgtgttaggacaacttgcccattactcgataaaagggacgaccaagatgcttctaacatcgtcatggataacggatattacaatattaattgccttgataggtttgttgatttacaagtatctcacaagacattttgattattgggaaaaaagaaatgttccgtatctaaaacctacactcctatttggcaacttcaaagatgtgttcacttgtaaattaactattcaggagcacttgaaaaatctttacgacaaaatagatgcgccatattttggagtctttcttatggatgaacctttgttaattttaaaagatcccaagctttttaaagatgttctaataaaagatgctgatgtattcgccaacagaagacctcctacacctacacatcgtcttatggaaaattcagtaattttcatgaaatatccacattggaaaagtgtaagaaccagactaactccagtttttactcctgtgatgttaaaaaacatgcatgtcgaaatatctgaaataactaaatcaatggtacaatatttgttcaaaaataagaaaacaatagatggcagaggacttggaaaacttttttcagatgagttgatatttaagtgcttctttggagttaatcttgatggctttaatgaaaaaccaactccaataggatcgctggtgaaaaatatgaatgaatttagtctcaggaatgcacttgttcaaaacctctcctttatcaaaccgtcatgggcaactctgttaaagctagatttctttagtgatagttcattgaggtttttcgaagatattttccaaaaaggaatggaagctagaaatcactatgatggaaaaccactgaattatgttgattttgcccataaagggggtcagaaaaattaagaaaaagggattgaatggcgagcaaaggaatggaccatggcagaagcttgggggacatattaatttctaataagttgggtaaaaaaacccttaaaaaatatactttttttttcttcctatttaaaattaatttttgccacaaaactgggaaagaacttaatattaaggccaggaaaatttccaaaaaaaaaaataaaaaaaaaaaatcgggggggcc

SEQ ID NO: 2489 - DNA, 1121 bp, Diabrotica virgifera
tatgcgtccggcatcgtggggaaatgggggctagcggaccaaaccgtacatacctatatttggtggcaattgccgctaatatttcagtctttgtctgcggtactgcattcggatggtcatccccagtaatcccccgtttaaagaatttggacgctagcccgttagatcatgttatatcaacatccgaagagggattgatcgcttctttcctaccgctagcagccgtcttgggacccgtcctaggtggaatactggcgagtaaaattggaaagaagctgacactaataattgcagtcacacctttcatcattgcattcatcatatttacaattgcgacaaaaatagaactattctactttggaagatttttatgtggattagcatgcggtatgacttatgtcaacatacccacttatattgcagaaatcgccgacaacgaagtaagaggttcattgggatcttacctgcaacttttttgtaccataggtatactgtttccatattctctaggaccatatgtaactttaaaattatttaacattattttactctttcctccaactatatgcatagtattgtttattgtattcttgcctgagagtccttattatttattgcaacgtggaaaaattgaacaggcactacaggttttaagtaaattatcagggaagccgacttctattgctgaaaaagatttagcagatatgcaggtacagatacgacaagaaagcgagcaaaaaggaggttttggcttaataatgaaaactccaggacttagaagagctttgatattatcgttgtgtttagtaatatttcaacaatttactggaattaatgttgttttcttctttacacaaactttgtttgaggatgctggagttgctttggcgccagagatttgcaccatcattgtaggtattatccaaattctggccagtactttaagtcctttatttgttgaaaaatcaggaaagagacgtttgcttatgatttctggtattggttcagcagtcagtgtagcagttttggcaatctatttctatattaaagacgttctaaaatctgacacatcaagcataagctggcttcccattgctagtcttctcgcatttatcattgct

SEQ ID NO: 2490 - DNA, 1580 bp, Diabrotica virgifera
cacaaaacacaggtcagtttttggcgaagtcgacaaagcttttaaaaaatttgtgtgtaacgacgtgtttacaaacgagtaaaaacgacgatatcggcgattaccaccggactcgggtctataatggcagccagcgattctgcaggcgatgattctttgtatcccattgctgttttaatcgacgaactcaaaaatgaggatgtgcagcttcggctaaactcaataaaaaaactttcaacaatagctttggctcttggagtagaacgcacaagaacagaactaataccttttttgacagaaactatatacgacgaagatgaggttcttttggcacttgcagaacaattgggaactttcataaatttagtaggaggttctgagtatgcctattgtcttctaccacctttggaaagtttagctacagttgaagaaactgtagttagagataaagcagtagaatcattaagagctgtagcccagcagcacagtcctgctgatctagagacacattttgtacctctagtacagaggttggctgctggggattggtttacaaccagaacctcagcttgtgggttattttcagtatgttatccaagagtctcagcactagttaagggtgaactaagagctcattttagggctctatgccaagatgatacacctatggtgcgaagagctgctgcaaccaaacttggtgaattggctcaagttgttgaattggaatatctgaaatctgacctaatacctatgtttgttaatttagcccaagatgaacaggattcagttcgacttcttgcagttgaagcctgtgttagtattgcaacacttttacaacaagaagatgttgaacaactagtaatgcccactcttagacaatgcacaggtgatacatcctggagagtccgatatatggtagcagaaagatttacagaattgcagaaagctgtgggacctgaaattacaaggactgacttggttaatgctttccaaagccttttgaaagatactgaagctgaagttagagctgcagcagcaaataaagtaaaagatttttgtcaaaacttggacaaggctcatcaagaaaacattataatgacaaatattctaccatgtgttaaagaactagtagcagatccaaatcagcatgtcaaatcagccttggcctcagttattatgggcttgagcccaattcttggtagacataatacaatagagcatttattgccattgtttctaacccaactcaaagatgaatgtcctgaagtcaggctcaatattatttctaatttggactgtgtaaatgaagtaataggcattcaacaactatctcagtctctcctcccagccattgtagaactggcagaagattcaaaatggagggtacgatcggctattatagaatacatgcctttgttagctggccaactgggtagagaattttttgatgaaaaattaaatgctttgtgcatgacatggttgatggaccatgtgtttgctattagagaaagctgcacatttaaattagaaaattgggtgatcagtttggagcagaatgggcagagagtacaatcatacct

SEQ ID NO: 2491 - DNA, 1750 bp, Diabrotica virgifera
gttgaacgagcagttgatactcgattagaattacgaaggtgccggtgaataggtgacattggatttatttaagtgcagatataagacaaactaactaaaaatgacaccagatgttccagatagaattgctgaagtttttaagggtagtaccatattcctaactggtgctacaggattagtgggtaaagcgctcatagaaaagattctgaagttatgtgatgttaacaaaatatatcttttaatacgagacaagaaaggaaagacaccaaatgaaaggataaaagacatatttagtaatccactctatcaaactgtcctggcacgaaaaccagattgtcaaaaaaaatgtataccaattcctggagatgtttcactagtcaatttgggaatatcagacgaaaacagaaaaatgttaatggacgaagtagatttcataattcacagcgctgcaaccgtaagatttgatgattctttgaagtacgcagtgacagtcaacacgagaggaacaaaatttatgcttgaccttgcagaaggatgttcaaaattgaagttatttattcacgtatcaacagcctatgcttttccaaataacaaagacggcattacatttgagaaggagtatcctcctccagcgaatccgcatgaagttctaagcagtataaactggctcaaagaagatgatttgactgatgctttaacaaaaaagttattaggcgatattcccaacacctacacattttcaaaagctctatcggaatctttggtatacgaaaaggctaaaaagttgcctattattatttgcagacctgctatagtaattccggcatttaaagatccaatacctggatggacaaacaaccttcaaggacctgctggtatattcgtcggagcaggaaaaggtgtaatcagaactgtatatatgaattgtgacagttatgcaaattttgctcccatcgattgtacggttagtgctattatgatgtacgcatggcactatcttaccactaaggatcctcagtacatttacaacctatgcatgcctcaaagtgatttacaagtcacttgggtagaagttcttgacacagctagagatgtaatctataacgaagtaccatttaatttaatgctgtggtatcccgatggttcgatcacccaaagtagattgtataacaaaatcaacacagttttatttcaactattaccggctctgattatcgacttgatcctcttaatagcaggacaaaaaccacaatttttagcgattcaaaatagaattttaaaaggaatagaaatgtatgaattttacataacaaaaaaatggaattttgaaactacgagtttagaacaaataagaactggattaaatgcaactgaaagaaaactatcaagttcagtctgacgaaaaagacgtgagaaaatttttaagggactgtatgttttatctaagaaggcacttcttcaaagagacggacgatatgttaccggcggctagaagaaatatgaagatattgtactgtcttgatcgctttgtcaaggctttagtaattggatttatagtatattacttgtataaaaccttcttccttagaagtttacatgcatgattaaaaataaaaagaacatgtaaaatattatgtttaaaaaaaattatatttatgtttattgtatactggatggttaccaaaaactcattgacagattaatatcaaatccgatatttgtatattgttctaaaatgtctgtaccaatt

SEQ ID NO: 2492 - DNA, 1408 bp, Diabrotica virgifera
aaaacatcacaaccgacgacagcgggaagtacgatgtatcgcgttaggaactcgcatcggagaagattcgaactcacgcctctcgtggctcgtcgaaggacctccagacccacctagcggcaccccatcgcataaccacgtccttggatagcgttacgttgacctggagcagctcgccctatcgacgggggcaaaatcgtcaacgggtatcgccgtggattactctatggtgggcagcgacatttggacgacagccgtcgaagaatgccactccctcagttacgtagttagggggttgcaacctggaggccgatatgtcttcagggtgcgggcgcttaacgtccacggatatagtaaaccaagtctcgaatctgatatcgttcagttagaagaacataatgaaagtagctatttcgaaccgagagtggtatcagtggaaccaggtcccgaattcaagacgcgctacgacgtcctcgaagagttgggcaagggccggtacggcgtcgttcataaagttatagataaagtatcgaatcagaaactcgcagctaagtttattaaatgtagaacttccaaagatagagataaggtacaagacgaaatcgacataatgaatctcctcaggcaccaaaaactgttacaactggccgccgcctttgaaaaccccagggatatgattatgattatggaatatatttctggtggggagctttttgaacgggtggtcgccgacgactttacgcttactgaaaaagactgcattttatttatgagacaaatctgcgaaggcgtagcctacatgcactcgcaaagcatcgtccatttggatctgaaaccggaaaacatcatgtgccatacgaggacctcgcacgagattaagatcatcgattttgggttagctcagaaactcgatcccaaagaacctattcgagtactgtttggaacgccggagttcataccgccagagatcatcagctacgagcctattggagtggagtcggacatgtggtcgattggagtaatttgttatgtgttactgtccggtctttcaccatttatgggcgacaatgactcagaaacctttacaaatataaccagagcagattatgattttgacgatgaagcgttcaacactgtgtctcagaatgccagagatttcattggagctcttctaattaaaagaaaggaggaacgtctctctgccgagcaatgtctaaaacatgtttggttggatccagagactcaccaacaaactgtcgtcttgtcgacagataaactcaagaagtttatcattcgccgcaagtgtcaaaaaacaggcaacgccatacgagctctaggcagaatgccgactctctccggctccagaagaaactctgccaattctgtacctagtacacctcgacctttc

SEQ ID NO: 2493 - DNA, 789 bp, Diabrotica virgifera
cgtaatatctttctgacataatattaacattggatctgatcagttaattacagacattagaccagccttcaactaataatttgaagaacatactaagtagataaactagtaaataataagcatatacagttaataaactaagtatataaacacaaaacattaaatacttaaaagtttctagacgaaatgcaagaaattaattggttcgcagtggctttcatagttctgccacacactggaggacttgcagggggcattataacgaagaagaatatattttggtacaatggcctaaaaaagccctttggcacaccaccaagctggtcatttagtccaatttggacgattttatatagtagtatgggatatgcgtcatatatggtttacagagatgggcatggttttgatggtcctgctgggttaccacttattatatacggaattaaccttttggccaattggacctggacacctatgtttttcgcaaggaagaatatgaaattagccctctacaacatgcaacttatcaacgctacagctctttgtatggcttaccttttctacaaaataaatactacagctggtcttcttattataccatatctcacatggttggtcatatcaacgtatctcaattactccttcatgataaagaacccacccaaaacagcgaccaattaaaaaatattaaatagaatatgtattatagtgatatatttattagactaatgtttagttaaggcgacaataatttttagatataaaataaaataaaaatctggacatacc

SEQ ID NO: 2494 - DNA, 1425 bp, Diabrotica virgifera
gggcaacttgaaaatatgtaaagaaaacatcgatataacatcaagatctaaatttttggatggtgacaataaaaggtctaaaagttcttgggcagagaccggaaagggcaggatttatcaacttaaaagtgagacgaataaactacgaccgtttagaaaattttttcggaaatttaagaagcaggaaactctgtaaaccttaccgcaattcaatgtgatggagcattcagcaaattactttgtcttaattatttacgcctggaacatatgaattgtgcagatgacttagggattatattaaccggcttaaataatatcaaacataatactttcctacctataaatgttacaaaaaatataaatatcgctatatccagatgccaactacaggtacagaaagtgcctttatttatttataggaatattttatcaaaaaagctttacaaatgcatgagatgcaagcggctgaaattaagaatgacagtaatttatttactagactgaaagcatacagtaccaaaaaaaagttgttttgccaaattcgttggcctagcagcaagaatgagtaaatgaggtattcctaaaaattgttttaaaaattttaatcttaaagcaatattaatacgtgcataataaagaatttgtaaatgagttattcctaaaaattgtttcaaaaaattaaatcttgatataattaattctcttccctcttaatttaattactattttatttgtgtatattgagtatattatatgttactgaatataataaataatattaaaaaaccaactatagatagacatactagatttattgtagtattgaacaaagcttgatataaaaactacaataatattaaatatttaaacatgtgataatatttttaattttctatctccccccttttttttacttttttactttttaaatcagcgttaaaatattttaaagaataaaataatcttacacgaataaataattttaatatataagtatatggaaatgaatcacacggatgtttaaaaggaacttctttcattaccctaaagtatgagtgtgatattccacctttagttaatatatcttcatatgaagcactaaaaattatttctaacttataaatgtattggataaagtccttacttggagttctcagtcccccataatcacatttatcagtactgtatgctttaaaatgtgtcaataataaactactatctagttcgtcaatttcccttgaatatttattacatatatgacaaacatgaatattgagagcctttttaattaaataaccacatacatactgaaaagcattttgggttgttagattttctgttttataatcacaatctggaagtgaaatagccttcattggcgaatattgttgactattagaaactttttttacatttaaatccatt

SEQ ID NO: 2495 - DNA, 975 bp, Diabrotica virgifera
  misc_feature (943)..(943): n is a, c, g, or t
  misc_feature (948)..(950): n is a, c, g, or t
caacatcaaccaaaaaccaaaaccaaacatcaaaaaatcaaaatcaacatcatggtaaacaaatagacttgtgagagatgcaataagtttttaaagtattatttttaataagcatttgagttttgaaccgaatttataagtttttatgaacaataaataaaattttacatcaaatatggtagataatcctgaagcttccagtacaccaaaaaaagtaatgggaagaaaatctattcgaaattatcaagttgtgagtcctattgaaaatcaaaaaaatatatcacaaacagatcattacaatgataaagttcaaagagaagatgcaagggaatgctttagttctggaacggagtcatattcagatggtgaaggacaagtagattccgctgaggaaaatagcctaaatcctgaaccgaatgtgagcaaaactcaatttagtgtcaatggaaatatgatttacattttgtttattataccagttttagtaggcctatatatgtacaatccccaggccgaacctatagaaagcatacatagtgattttgccgatttaataagtgatcatccacaaacggacgatttctggattaatgtcagggttgccctacatgacattaagaggttaaaacaacccaaatccataatatttttgtatgaggatgacacaactatggctaaggttcttaacagcatatcaaggtattcttcatatgatatatgcaaaagtaaacaggtaattcaattacctggtagatatttaaaaaactcaaatttcttagaagattatggtaccttcatatcagaaatcagagacgacttggctgaaaagtgtgtcgtaataataacaaatctagatgaggctccaggaacatctgctcaagcatttcatagtttgtgtgatgaatataatccagtcaaagagcaagttttatttttattcacnatgannnagtaaagtctcgctaacactagcga

SEQ ID NO: 2496 - DNA, 928 bp, Diabrotica virgifera
accaaccgttaagcgtaaacttaaccacattatttactttgtgattgtgaatgccgatttattataagaaaaacttaatttaagttagtaaccccgtttaaaataatatataaatatgtattcggttttacacaaaaatgaaaatgctcatgaagaatgtatttggagttgtttttggggccgatatgcccccgaaaagaagaaaaaatccgaggacgacaatcaaggagacgatgagaaatccagagattcaattctatcagatgagcctccgattgactatattgttactggtggagtagatgatttagttaaagtttgggaattgcaggatgatcgtctagttcttaagcataacctagaaggccattctcttggagttgtgtcagtagctgtcagtcataatggcaaattatgtgcatcaagctccctagattcaagtatgaggatttgggatttggagaagggtgaaaagattgcaaatgttgatgtgggccctgtagatctttggactgttgcttttagtccagatgataaatacattatttctggatctggaaaaattacagcctatagtgttgaaacagccaaagctgaacaaacttttgaaactcgaggaaaatttactttaagcatagcttatagcccagatggaaaatacatagcaagtggagctattgaaggcattattaatatatttgatgtagcagccaacaaactgttgcacacattagaaggtcacgctatgcccatccgttctctttgcttttctcctgactcccaactactgctaacaggatctgatgatgggtatatgaaactttatgatgtgcgagatcaaaaaacccgtctgataggaacattatcaggccatgcttctttgggttcttagtgtagcattttctcctgatggcaagaactttgtttc

SEQ ID NO: 2497 - DNA, 889 bp, Diabrotica virgifera
  misc_feature (710)..(710): n is a, c, g, or t
  misc_feature (854)..(855): n is a, c, g, or t
  misc_feature (859)..(859): n is a, c, g, or t
ttttgtccgcactgtttctcacgatactacagatacttttgtttttttttcttttaagaccgaagcaggtcctttaaattgcgtttcttatataaaatataaacatttctaatatcttcaaaatgatctgttgttcaaaagttcacaaaatatttatttatatacccctgtttaaatttaatcaaaactttcacaagtcgtagtcaggtagtcactagtgagtgagagtagtgagttagtgactgaactcggtcctaattattctgatattgtatcacttggttttatttattttttttttgaaacagtagttgatacttttgttgatttttcttttaagaccgaagcaggtgctttaaattgcgtttcttataataaaatataaacatttttaatatcttcaaaatgatctgttgttcaaaagttcacaaaatatttatttatatacccctgttttaatttaatcaaaacttttacaagtcgtagtcaggtagtcactagtgagtgagagtagtgagttagtgactgaactcggtcctaattattctgatattgtatcacttggttttatttattttttttttgaaacagtagttgatactaatgtaatcgaggagcagtaaataaataacaagatggctctaggttgtcgttaaacactttattacatttatgtaaaaacaaacgttgactaccatctaatatctaanctaaggttaagtctatcttctataaaacatagccgcacccatttgtgcgggaaccagtgtgtccaacggctgtcacatgcgttaagccaagtctacatgtgttaagccgtgtctacactgtttctcacgatactacagatactnnttgntgatttttcttttaagaccgaaagcagtcc

SEQ ID NO: 2498 - DNA, 771 bp, Diabrotica virgifera
cactgtcattcgtcattctcatactttttttttgggtactttgggttgtacttgggataaaagacctttttgtatttccaaatacattgtcatataaattaaaaaagaaatggctgccatcagatctatgtctcgccttcttattaatagatcacttcaaaccactgcaaagaggacctatgccgaccaaatgaacttcacatttgcagctggaaatcaggtttactatactgcaacttcagttaaacaagtagatgtgccatctttctctggtagctttggtatcctccccgcccatgtacccacactggctgtgctaaaacctggagtagtcactgtttacgaagatggtggtaatgttaagaaaatctttgtttccagtggtactgtcaccatcaatgatgattcatcagttcagattcttgctgaagaagcccacccagtagaaaacattgatgtcaatgcagcaagagacatccttaccaaagcccagagccagttatcatctgcaagtacagatgaggcgaaagctgaagcctccattgccgttgaagtgggagaagcgttagtcaaagcggctgaataataatttaatttttgtaattttatgtaaatttaataaattagtgtctcaatggtactgttcattttaaaacaacaacatattagatctatacctctatgagttgacaatttttacaaaaacgagaatcaatccaaatacataatttttgtttaccgtttaaacaaacaaaataattttaccttata

SEQ ID NO: 2499 - DNA, 938 bp, Diabrotica virgifera
gatggctgcttcctgtatctgctgtagtataatgataagttggtacataagctggataagaataatgatgattattattgttgataatcgttacatgacctccactgggatttgcactgtaagcaggtggtgcatgatatccacctgagctataacctggatggcctgctggactataggcaggtggcgggaaattaaaaccgcctccagcttgtggtgagttgtgtactggtgcggatccatatccagctggattatacgctggtggatgtccgtacccagcagggttgtagttggggttatatgctggtggtttttctccatagtgagctccagaatttcccactcctgcaatagtttttggtggtccaataggctgtgacccggtattgtgtccagtagatcctccagttgcgaatcctatcggtcttgtaatttctggaccatggttcgtattggagctgccaacaccagaaacatgcttaggtggtccaatcggaccagacgaagcatggctgtcgggatgggatcctccaacgttccatcctatcggcctgtaaactggagctgctggaagtggatgatatgctggaattggcgcagatggatgacttactgcagagggatgggaatacgatggcgagggatgagagtaagatggagaaggatgggaataggatggagatggatgagaataggatggagaaggatgagagtaggaaggggaagggtgataggaaggatgggagtatgatggggatgagtagtgatatgatggatgcgaatagctatggctactggaatgactataggaatggctggaagaatggctacttgatcggccaccaccccttccctggatggtgattgtttgtgatattaatatcaatacaccaccccctccttggatggtgattgtttgtgatattaatatcaat

SEQ ID NO: 2500 - DNA, 1110 bp, Diabrotica virgifera
gctgttgtgatagtagtgatggacttcgtagtggtcgtatcttggtgtattatcatataaaacggagctgtgatagtggtagcttggagaggttagtcttcataatgaatatcccaaaaagaaaccaagatggctgcttcctgtatctgctgtagtataatgataagttggtacataagctggataagaataatgatgattattattgttgataatcgttacatgacctccactgggatttgcactgtaagcaggtggtgcatgatatccacctgagctataacctggatggcctgctggactataggcaggtggcgggaaattaaaaccgcctccagcttgtggtgagttgtgtactggtgcggatccatatccagctggattatacgctggtggatgtccgtacccagcagggttgtagttggggttatatgctggtggtttttctccatagtgagctccagaatttcccactcctgcaatagtttttggtggtccaataggctgtgacccggtattgtgtccagtagatcctccagttgcgaatcctatcggtcttgtaatttctggaccatggttcgtattggagctgccaacaccagaaacatgcttaggtggtccaatcggaccagacgaagcatggctgtcgggatgggatcctccaacgttccatcctatcggcctgtaaactggagctgctggaagtggatgatatgctggaattggcgcagatggatgacttactgcagagggatgggaatacgatggcgagggatgagagtaagatggagaaggatgggaataggatggagatggatgagaataggatggagaaggatgagaataggatggagaagggtgagaataggatggagaagggtgagaataggatggggaagggtgagagtaggaaggggaagggtgataggaaggatgggagtatgatggggatgagtagtgatatgatggatgcgaatagctatggctactggaatgactataggaatggctggaagaatggctacttgatcggccaccaccccttccctggatggtgattgtttgtgatattaatatcaatacacatattcctaatattcgcgacatttt

SEQ ID NO: 2501 - DNA, 2582 bp, Diabrotica virgifera
  misc_feature (2001)..(2029): n is a, c, g, or t
cccccctccgcggccgctactcgttcagtgttcgtcacttaattttcagtactggggcgactggcaaaaaaatgtctttgctttccgcacgattagctgcctcattggcaagaaatgcccctaaaaatgtaacacagattgcgggagctgtcttccctgctgcatccgtcgcagcccggaacttccatgctactccacaaaacaaaggtgctgaaatttcatccatccttgaagagcgcatccttggtgctgcaccaaaagccaacctcgatgaaacaggacgagtcttaagtattggtgacggtatcgcccgtgtatatgggttgaacaacatccaagccgatgagatggtggaattctcctccggtctcaaaggtatggcccttaacttggaacctgacaacgttggtgttgtagtatttggtaacgacaaactcattaaggaaggtgacattgtcaagagaactggtgccattgtagatgtgcctgtaggtgaccaaattttgggacgtgtagttgatgccttaggtaacccaattgatggcaaaggaccattgaacaccaaacaacgtttccgtgtaggtatcaaagcccctggtatcattccacgtatctctgtaagagaacctatgcagtctggaattaaggctgtagattctcttgtaccaattggtcgtggtcagcgtgagttgatcattggtgatcgtcaaactggtaaaactgctttggctattgatacaatcatcaaccaaaaacgattcaacgatgctgaagacgaaaagaagaaattgtactgcatttacgtcgccatcggtcaaaagagatctactgtggctcaaatcttgaagcgtctcacagacactggtgccatcaactacacaatcattgtatcagctactgcatctgatgctgcacctttgcaatacctcgccccatactccggatgtgctatgggtgaatttttcagagataatggcaaacatgccctcatcatctatgatgatttgtccaaacaagccgtagcctaccgtcagatgtctctgttgcttcgtcgtcctccagggcgtgaagcctaccctggtgatgtattctaccttcactcccgtcttttggaacgtgccgccaagatgtctgaagcccacggtggtggttcattgactgccttgcccgtaattgaaacccaagctggtgatgtatcagcctacattccaaccaatgtcatttccatcactgatggacaaatcttcttggaaactgaattgttctacaaaggtatcagacctgccattaacgtaggtttgtctgtatccagagtaggatcagctgctcaaaccaaggccatgaaacaggttgctggttccatgaaactggaattggcccaataccgtgaagtagctgcttttgcccaattcggttccgatcttgatgctgctactcagcaattgttgaacagaggtgtacgtcttactgaattgttgaaacaaggtcaatacgtacccatggctattgaagaacaagtagccatcatctactgtggtgtcagaggacatttggacaaagttgatccatcaaagattacagtatttgaaaaacaattctcagaacacattaagactagccacaaaaacatcttgcagagcattgccaaggaaggaaaaatcacagacgatactgatgcccaactcaagaaagtcgttcaagatttcttggccagcttctctggttaaatataaataatacaattattattaatacctaaatcgtcacttttgttgatgtgatctgtaaacgtttaagaacttcatgagctgtaatcctttcaaattagaataattaggcaggactcctatgttatccaataaggcacgtgaaagaattttcttttctccattttacaatatttatcgatcattgttttttaaggatatcttatttgtaaaaataaaaaataaactttaaaaatttttttttttattttattttttttaaaataaaaacaannnnnnnnnnnnnnnnnnnnnnnnnnnnngatataactggctggcttcctataatacctcaagatcaatattacaaccagcataatcagaaggccctcaaactgcgacatagaaactactcttgtcataactgtacgccaaaatagcattttgctgttggtagcttctccctactatccaagtgcgccagccccagaagagcacctgataagacatgacgatcgaataaagaatatcgcatattaacttaaaaacttgaaacgaattggagaaagagcaaaatcccattagctctccaatcttgagaggtatttggaacaatacctgcttttatagggattgttcgttctattttaatccaaacttatgtcgatacaacccacaccttaatatataaaatgttataccaaggtcagatgctccctgttcattcgccatgcccaccacatcctccaaaataagcacttccaggccctaatctagatctcatcgatcctacccgcacaatcccatatgactaagccccggaatccgctgccacatggtacctagattgtttacaattccacagattctggtcta

SEQ ID NO: 2502 - DNA, 895 bp, Diabrotica virgifera
  misc_feature (862)..(862): n is a, c, g, or t
cagaatgtgtaagtatgacagcaaatgccaaatttaattaatccaagcgattagataatacattttgtgcattaccacattgaggataacggataacttattagataatatattaaaatgtctaattaacttactgaatgatgggactaaatagaaattcttcatatcttcgtttaatttaggatctcaaatatttctgcagataaatttgatgcacaactgtgaatgtgagtgcaagataagacaaccaatataacgcattaaaattaagatcttgcaattacttttgacactgtttacattaggtccagctcccacgacgtaactgttttaaaatacggttgaaaaccagtttcaggcggattgccttgtaggcggatcaccgtggttttcgctgtagaaatgacaaaaaaaaaattgcgagtgcaatgggtttcagtgggtgctgaaccaaagtctaaggtgtcaaaattttcaaaatcacagatttcatgattccaaaattgtttatttaaaaggcatttaagtggaaatgcatttcgtaataattggaaataaacagatcatcatacttgtcatttgtcactaagttatagcgctatatagaaaatattcaaattatttgggaaaattagtttaattacataggaaacataagtgatgataagagtgtagaatgccttattaatattattagacaagacctattaacattttggtgtactgaataatttgaatgtttttaagtcaatagcaagtgcacctttcgaaaaattgctagtcaatcacagaaatttttttaattgtcctatcctttagcaagtttatgatctttaccatacttcgtaataaattgcttggnatttttttatatatttcgactaacgacaacaaa

SEQ ID NO: 2503 - DNA, 450 bp, Diabrotica virgifera
ctcgcgggtcgatacaagactctaaatgatttcaacgaaatcaatatacctatcaactttaaacagtttttgaagatattcttctttagcggcgattcgattgagggtaaaattgtacatatatctgcgcgcctgcgcacacagacagcatgtagttcattgctaatctttcaagataggtatgtatgtatctgtaaccgtgcaaacaagtcattaaaagaatgtattagtgtttttggtaaatgtattatttgttataattcttgtgtttttggatttgtgtttctctgtagtaaaataatgaaatattatgtaggcataacatttttacactatttgtcgccgtgttgtgtaattatatccgaaacttacacgtcaattacaaggacctcgctggagtagttggtaagtcgttagctccaagattggaaggacgcgggttcgaatcct

SEQ ID NO: 2504 - DNA, 723 bp, Diabrotica virgifera
  misc_feature (681)..(681): n is a, c, g, or t
gtgtggaagtgaggatttgttttcatcattacaagtgcagttcacttcaaaaaagtattgtaccaaccagaaacatttcttttatatttagtacatagctgttatttttagacacaacacacaaaaatgcctgcttctccgagttctacgaatgtgggttcaggtggaagatccccccctaaggctgtcgctcccaggtcttctatgggaagcagtgtaaggcagaggaagacgactaccacaactactactgccaggagaaatacaggtgcaggaactggaggaatgtggcgtttttacactgacgattctcctggcatcaaagtaggtccagtaccagtcttagtaatgtctcttctattcatcgcatccgtattcatgttgcacatctggggaaaatacacgagaagcagctcatagatgaaattccagcgtttcatcattccatcttccacctatttaatgcatttttgaactgtatattttatattgttataagtataaaatgaagtgtttttgatttatatatatcataaaatttaatggaaaaatacactccttttcatataattctcattttgattgatagttgttgttatatgtttataattaaagtcaaaaagacaattattttgtgtaaatacttttcccgatagactttaaaacatttgttggttgtgnggatgggtttttaatagtttataataaaaattacttttttac

SEQ ID NO: 2505 - DNA, 859 bp, Diabrotica virgifera
  misc_feature (763)..(763): n is a, c, g, or t
gtaatgtaaaagatttgtagatattttgtcctgtaaaatcatttcctgttaaaagttttttttgtttgtttaaaaaaaaaccaccgtaaagttttaaataaatgtttgtgaaagtgtatctatcatctcatttctgtagcctttggaaaaattttaacagaaaactaatgcaactgtatgaaagttttagttcagaagaaaagaaagaatatggcatagaagccaataataaggaaagatgttgtcccaatgtaaccccaaagaggaatcaatgatgattgtccccccgattggtacccgtaagtaagaaagtatccagtaagtacccataggtgaaatagaggatttatttcaaacggcgtccctttttgttaaatagtagaaagatcctctagtcagattttagttcagaagaaaagaaagaatatggcatagaagccaataataaggaaagatgttgtcccaatgtaaccccaaagaggaatcaatgatgattgtccccccgattggtacccgtaagtaagaaagtatccagtaagtacccataggtgaaatagaggatttatttcaaacggcgtccctttttgttaaatagtagaaagatcctctagtcagagtaagtacccttatgtatttagttatggtagtgtagtcatcttaacaccccttcaccctccctaacgaatctacgacctagctcccgcacaacaaatgagctgccgtcccgcaacgaggctttatgtgtctgcttcttcttctttangcccattcttaccccccagtatctctatagatagtcttttcttttgtccatatgagcagaccagttaaatgcagcaaaatttaattttcatcaatc

SEQ ID NO: 2506 - DNA, 958 bp, Diabrotica virgifera
acagttttttgttttcgtcatgtcaattttcggggagtagttaagggggttttatgggccagtgacacagttccaaatctgcgagtaaatttcgcaagaaaattcagcacttcgagatgtagatatcaaactgcagaatatgacctcatcgttatcggaggtggttccggtggtttggccgccaaggaagccagcaacttaggagctaaggtagcagtactcgattacgtcactcctagtccgaagggtacgaaatggggtttggggggtacgtgcgtcaacgtaggatgcatccccaagaagctgatgcaccaggccgccttattaggagaagctgtccatgatgcccaaacatatggatggcaattacctcaaccagaaaacatttcgcacaattgggaagcactcaaggatgcagtacagggccacatcaagtcagttaattgggtaaccagggtagaacttagggataaatctgttgaatacatcaacggtctaggtacattcgtagacccacacaccatccacgcccaaacgaaaaagggcgacaagacactcacaggcaagaacatcatcatagcggtcggcggcagacccagatacccagacataccaggtgcagtagaatacggaatcagcagcgacgatatcttcagtttagaaaaacctccaggaaagactctagtcgtaggtgccggatacatcggttgaatacatcaacggtctaggtacattcgtagacccacacaccatccacgcccaaacgaaaaagggcgacaagacactcacaggcaagaacatcatcatagcggtcggcggcagacccagatacccagacataccaggtgcagtagaatacggaatcagcagcgacgatatcttcagtttagaaaaacctccaggaaagactctagtcgtaggtgccggatacatcgggttgaagtgcgccgggtttttg

SEQ ID NO: 2507 - DNA, 1114 bp, Diabrotica virgifera
  misc_feature (1041)..(1041): n is a, c, g, or t
  misc_feature (1069)..(1069): n is a, c, g, or t
gtgtttgctttcatccctgttttgaaaaagtagtctaaccccagtttggaagagtgaagtctactcatgttttggaaaaataaagtctacccattgttttggaaaagtaagatctactcatgttttggaaaagtaagatcatatccccggttttgaaaaataaagaatatcccagtttgtgatttgaaaatgagaaagttgtcttgtgaactttcatgaaaggcttttatgtcctaggtaggactgttgattgaaaacgtaatgatgtagtatttcctatgtcatgtgttacgttcatttttttttggtcttgattaaatagtttgatatcccgtttgaatccagtatactagtttttttggtcttttgtatgttgtcacacgcgttccccccccttgttggtcttgtttgaatgagttgttgagatgtcatttttgacattttatctcaacgaggtatttagactgcattgtctaaatcctccttttgcagaaccgttgccgaatgtcccgtgaaactcgctaggtgtttagagtttaagcagatgcctatctgctgagccaagagctcagaaagattttttagtttttgaaaaccaatcctggttaggcaacgaggtgatgaggctgtgtctgccctgctatatggtatatattatatggtatatatagtatatatgtcacttgtgttactgcagtggatgtcagcgaggtccacacagggcacaagattatttctttcccaaggcacagaaactcttgtcacctacagttctttgtagagtcaagaaacatttaagtctactcgactttaaagagtctggcgattgatggcacgctagcccactccctaacaatgatgttttgtttttgtttaatccccattagccattatttaaatattttggtattgttgtcctgtcacacccaagaagtcaatgttggatttttgtagttatcgaaaactgaattggtaatccagtttcctctcttccgaggaggctattgtagcagatggatttctactacaatattttataanaaatatccattaattttaatcctatccncagaaaaatattaatttttctaatatattttgcgagtttatatat

SEQ ID NO: 2508 - DNA, 1366 bp, Diabrotica virgifera
gaaaatattttcactattgtaaaaatctgtaaacatcggcgtagaatcgccattaatatataagtattttatatagaattaattcaaaatgccacccaagttcgatcccaccgaaattaaatatgtttacatgagatgtgtcggaggagaagttggagctacctcttctttggctcctaaaattggtcctctaggtttgtctcccaaaaaagttggtgacgatattgccaaaggcactgctgactggaaaggtcttaaaatcacagttcagttgaaaatccaaaatcgtcaagctaccatttctgtagtcccatctgcctcctccctgatcattagggctcttaaagaaccaccacgcgataggaagaagcaaaagaacattaaacacactggtaacattactttcgatgaaatcatcgctattgccagacagatgaggcccaggtcgatggccaaacagttatccggaactgtaaaagaggttttaggaacagcccaatcagttggatgtacaattgatggtaaagcagcacatgatgttattgacgaggttaatgaaggaaccatagaagtaccagatgaataaactattattagaatattttttctaagctttgattgacttctgtgttgtcatctccatcttgagagggtcacgtttgttgtattcgtatttcgtgttttaacgttccaaagaaaaacaatccaaaatggttcatcacattaaagataaggatgacttggaagctaaattcaaagaagctggaaccaacttggtagttctcgacttctcagctgcctggtgcggaccttgtaaaatgattagccccaaattggacgaatgctgccgaataccccaacgtcgttattgtaaaaatcgacgttgatgaatgcgaagatctcgctatggaatacaacatcaagtccatgcccacattcattttcctgaagaacggtcaagaaatcgcgaatttcagcggagctaactacgaaagactaaaacaaaccattgaagataacaagtaatgcaaaacccagaatattctgcctaaatatttttttaataaattattcaaaataaatatgtattaatgatattgtagctccgttaaaactatattcgtactgcatagtaattttattttgtacttgttcttgttaatgtcaaatgttttgaaatatttttgaaaagtagtgcctgacgctgttatacacttcatttatctataaatatatatttaagatttacacagttgtcttttaagtatgttaatatattatgtgacatgttgcacatgaaggtaataaaagctgttgctacataaaaaaaaaaagaggggggggggggcccctttttttttttttt

SEQ ID NO: 2509 - DNA, 1148 bp, Diabrotica virgifera
agtttgcgctggcgcggttacgttagccttgtacataggtgtgtttgtggctacattatttaataaatcgagaataacgtgtcagaactttgttttctctcaccaggtgttagtgtaaattgacaaaatggcaccgatagatcaaactgcagaatatgacctcatcgttatcggaggtggttccggtggtttggccgccgccaaggaagccagcaacttaggagctaaggtagcagtactcgattacgtcactcctagtccgaagggtacgaaatggggtttggggggtacgtgcgtcaacgtaggatgcatccccaagaagctgatgcaccaggccgccttattaggagaagctgtccatgatgcccaaacatatggatggcaattacctcaaccagaaaacatttcgcacaattgggaagcactcaaggatgcagtacagggccacatcaagtcagttaattgggtaaccagggtagaacttagggataaatctgttgaatacatcaacggtctaggtacattcgtagacccacacaccatccacgcccaaacgaaaaagggcgacaagacactcacaggcaagaacatcatcatagcggtcggcggcagacccagatacccagacataccaggtgcagtagaatacggaatcagcagcgacgatatcttcagtttagaaaaacctccaggaaagactctagtcgtaggtgccggatacatcggtttggagtgcgccgggtttttgaacggtctaggttatgacgctaccatcatggtgagatcgattatcctcagaggcttcgaccaacagatggccaatgtgatacaagccgagatgaaagagaaaggagtcaaattcttacccagaaccgtccccactgaaataaaaaaaggcgatgacggcagattacacgttgcgtataagaacgataaaggagaaaccgcatcagacattttcgacacggttctttttgccatcggcagaagggctctgacgaaagagctacatttagaaaacgccggcgtcaaagttgctggagatggagaaaagattgatgtcgtcaacgaacagaccaacgtacccaatatttatgccgttaaggagatgttttatataaaaagccagaatcttaccccggtggcat

SEQ ID NO: 2510 - DNA, 1028 bp, Diabrotica virgifera
gccttgtacataggtgtgtttgtggctacattatttaataaatcgagaataacgtgtcagaactttgttttctctcaccaggtgttagtgtaaattgacaaaatggcaccgatagatcaaactgcagaatatgacctcatcgttatcggaggtggttccggtggtttggccgccgccaaggaagccagcaacttaggagctaaggtagcagtactcgattacgtcactcctagtccgaagggtacgaaatggggtttggggggtacgtgcgtcaacgtaggatgcatccccaagaagctgatgcaccaggccgccttattaggagaagctgtccatgatgcccaaacatatggatggcaactacctcaaccagaaaacatttcgcacaattgggaagcactcaaggatgcagtacagggccacatcaagtcagttaattgggtaaccagggtagaacttagggataaatctgttgaatacatcaacggtctaggtacattcgttgacccacacaccatccacgcccaaacgaaaaagggcgacaagacactcacaggcaagaacatcatcatagctgtaggcggcagaccgcgatacccagacataccaggtgcagtagaatacggaatcagcagtgacgacatcttcagtttagaaaaacctccaggaaaaactctagtcgtaggtgccggatacatcggtttggagtgcgccgggtttttgaacggtctaggttatgacgctaccatcatggtgagatcgattattctcagaggcttcgaccaacagatggccaatgtgatacaagccgagatgaaagagaaaggagtcaaattcttacccagaaccgtccccactgaaataaaaaaaggcgatgacggcagattacacgttgcgtataagaacgataaaggagaaaccgcctcagacattttcgacacggttctttttgccatcggcagaagggctctgacgaaagagctacatttagaaaaacgccggcgtcaaagttgctggagatggagaaa

SEQ ID NO: 2511 - DNA, 1686 bp, Diabrotica virgifera
gtagcggtattttatctaaatggcgacagttttttgttttcgtcatgtcaattttcggggagtagttaagggggttttatgggctagtgacacagttccaaatctacgagtaaatttcgcaagaaaattcagcacttcgagatgtagatatcaaactgcagaatatgacctcatcgttatcggaggtggttccggtggtttggccgccgccaaggaagccagcaacttaggagctaaggtagcagtactcgattacgtcactcctagtccgaagggtacgaaatggggtttggggggtacgtgcgtcaacgtaggatgcatccccaagaagctgatgcaccaggccgccttattaggagaagctgtccatgatgcccaaacatatggatggcaactacctcaaccagaaaacatttcgcacaattgggaagcactcaaggatgcagtacagggccacatcaagtcagttaattgggtaaccagggtagaacttagggataaatctgttgaatacatcaacggtctaggtacattcgtagacccacacaccatccacgcccaaacgaaaaagggcgacaagacactcacaggcaagaacatcatcatagcggtcggcggcagacccagatacccagacataccaggtgcagtagaatacggaatcagcagcgacgacatcttcagtttagaaaaacctccaggaaagactctagtcgtaggtgccggatacatcggtttggagtgcgccgggtttttgaacggtctaggttatgacgctaccatcatggtgagatcgattatcctcagaggcttcgaccaacagatggccaatgtgatacaagccgagatgaaagagaaaggagtcaaattcttacccagaaccgtccccactaaaaaaaaaaaaaaagggccccaacccccctgtcttgaaaaatgaagtctatcccctgtttcgaaaagtgaagtgtagccctgttttgaaaatgaagtctttccccagcttgtgatttgaaaatgagagagttgtctagtgaacgttcatgaaaggttcttatgtcctggattggactgttgattgaaaacgtaatgatgtagtgttctctatatcatatgttgcgttcatttcccttagtcttgtttaaaaagtttgatatcctgtttgaacccagtatactagtctttttggtcttttgttgttgtcacacataccccctcccccttgttagtcttgttttgattttagcccttgttgttgtcatatacccctttgtctagccctgtcttgtttgaatgagttgttgaagtaagttgttggtgagattttgtctcactgaggtgtttagactggattgtctaaatcctcgttttgcagaaccgttgccgaaatgtcccgtgaaactcgctaggtgttagcagagtttgggcagatgtttatctgtcaaacatcaactttttagtttttgtgaaccgctcgcggttaggcaacgaggtgacaaggctgtgtctgccctggtatgtcacttgtgttactgctgtggatgtcagcgaggtccacacagggcacaaagttagtttctttcccaagcacagaaactcttgtcacctacagttctttgtagagtcaagaaacatttaagtctactcgactttaaagagtctggcgattgatggcacgctagccccatc

SEQ ID NO: 2512 - DNA, 1246 bp, Diabrotica virgifera
tcgcgggtcgatttaccattgtgaaaatattttcactattgtaaaaatctgtaaacatcggcgtagaatcgccattaatatataagtattttatatagaattaattcaaaatgccacccaagttcgatcccaccgaaattaaatatgtttacatgagatgtgtcggaggagaagttggagctacctcttctttggctcctaaaattggtcctctaggtttgtctcccaaaaaagttggtgacgatattgccaaaggtactgctgattggaaaggtcttaaaatcacagttcaattgaaaatccaaaatcgtcaagctaccatttctgtagtcccatctgcttcctccctgatcattagggctcttaaagaaccaccacgcgataggaagaagcaaaagaacattaaacacactggtaacattactttcgatgaaatcatcgctattgccagacagatgaggcccaggtcgatggccaaacagttatccggaactgtaaaagaggttttaggaacagcccaatcagttggatgtacaattgatggtaaagcagcacatgatgttattgacgaggttaatgaaggaaccatagaagtaccagatgaataaactattattagaatattttttctaagttaaaaaaaaaaaaaaagggcggccgctcgcgatctagaactaggaggccgcggtggattagttttcatcattacaatacaagtgcagttcacttcaaaaaagtattgtaccagaaacacttcttttatatttagtacatagctgttatttttagacacaacacacaaaaatgcctgcttctccgagttctacgaatgtgggttcaggtggaagatccccctcaaaggctgtcgctcccaggtcttctatgggaagcagtgtaaggcagaggaagacgactaccacaactactactgccaggagaaatacaggtgcaggaactggaggaatgtggcgtttttacactgacgattctcctggcatcaaagtaggtccagtaccagtcttagtaatgtctcttctattcatcgcatccgtattcatgttgcacatctggggaaaatacacgagaagcagctcatagatgaaattccagcgtttcatcattccatcttccacctatttaatgcatttttgaactgtatattttatattgttataagtataaaatgaagtgtttttgatttatatatatcataaaatttaatggaaaaatacactccttttcatat

SEQ ID NO: 2513 - DNA, 1845 bp, Diabrotica virgifera
cataaatatcacggtctctttgattgacttctgtgttgtcatctccatcttgagagggtcacgtttgttgtattcgtatttcgtgttttaacgttccaaagaaaaacaatccaaaatggttcatcacattaaagataaggatgacttggaagctaaattcaaagaagctggaaccaacttggtagttctcgacttctcagctgcctggtgcggaccttgtaaaatgattagccccaaattggacgaattggctgccgaataccccaacgtcgttattgtaaaaatcgacgttgatgaatgcgaagatctcgctatggaatacaacatcaagtccatgcccacattcattttcctgaagaacggtcaagaaatcgcgaatttcagcggagctaactacgaaagactaaaacaaaccattgaagataacaagtaatgcaaaacccagaatattctgcctaaatatttttttaataaattattcaaaataaatatgtattaatgatattgtagctccgttaaaactatattcgtactgcatagtaattttattttgtacttgttcttgttaaggccggccgttgtatgaaagagaggtccccaaatgccggcgcaacagagagaaaagattctttcccgagagatgctgcctctatcggagaaataacgcaatagatatctaagcgaggccgcaaacggcagaatttttagtgagtcgatagtttagttaagtacagagagtatgcaggtgcggcctcgctaagatgactcgaaatcgttttatatatcaggtgcgaacttttaattttttagtaggcggtttaaggacggggtctcgctgaaaattttacttggataaatactgtgctcgtatctcgtggtaaaatctaaaccaaaagtattggagaaatctattttagtccatgtggtgagaccgctcccgtctgggaaaatttctgattcggtttctttgtggattcctattcaaacatgtcccctctaaacaaatctgaagggtgccgggcggaatttttgggcagaaactgtttaaacaatttttataaacaaatagaaaagatcacgtttttttgccccggaacatatatttttaagtttagtgggtcattctaaacaagaaaggtatcttgtaatttttttcaaaaattgatagttttcgagttatagtcgatttaaaatctgaaaagtgcgaaaatgctcatttacgaggcctaaaaactcatatttaaattagaacttttgaggttgccagattcttaaattgaagtttaaacattcagcttgaagattctaaagagtgattgtgtctaaccctaatttaaaccgtcgtgttttaattgttaaatatacatgtccatccgatttttttgtcggtgcggcgcgctctatttcaaaaatctccagttttcctccaaaaaatattttttctagattttttgggacattttaaataaaataagtttcttgacatttttctcaaaagttaacagttttaaagttaacagtttttaaaagaaactttttatttattctaagggactgtcggccctcggcaataacgttttctttcattctgcgtttaatttttttaaaaatacttattagttttctcagtattcgaaaaaaaatgaacacatttaaaacacaggaaaattttgagaggcgacattttgcgtctttccccttaaatttttttgcacatgaatgaagcaccctgtgtattaaattaaaaatatacattcaagtaaataacaataatatttttgtatatcaaagttttcaaacaaattttatatagggggtctgcataactagcaaccatatggtttc

SEQ ID NO: 2514 - DNA, 1911 bp, Diabrotica virgifera
agaatcgcgttcgcgtatgacttgtaaaattgagaatctaatcaatgtattatctctggtagggatatctataaaaatcatagaggattggacaaatagaagatcatttaaattaacgcaacaaaacagaagttccaagtttgcgctggcgcggttacgttagccttgtacataggtgtgtttgtggctacattatttaataaatcgagaataacgtgtcagaactttgttttctctcaccaggtgttagtgtaaattgacaaaatggcaccgatagatcaaactgcagaatatgacctcatcgttatcggaggtggttccggtggtttggccgccgccaaggaagccagcaacttaggagctaaggtagcagtactcgattacgtcactcctagtccgaagggtacgaaatggggtttggggggtacgtgcgtcaacgtaggatgcatccccaagaagctgatgcaccaggccgccttattaggagaagctgtccatgatgcccaaacatatggatggcaattacctcaaccagaaaacatttcgcacaattgggaagcactcaaggatgcagtacagggccacatcaagtcagttaattgggtaaccagggtagaacttagggataaatctgttgaatacatcaacggtctaggtacattcgtagacccacacaccatccacgcccaaacgaaaaagggcgacaagacactcacaggcaagaacatcatcatagcggtcggcggcagacccagatacccagacataccaggtgcagtagaatacggaatcagcagcgacgatatcttcagtttagaaaaacctccaggaaagactctagtcgtaggtgccggatacatcggtttggagtgcggacgcgttttcagaggttagttaaaaagagcccgtgaagtagtagttgaagtctcccccccagtgaagtagttgaagtccccccgtgaatgaagtatgtctttttgtatctgacatgtcacaagtgtaatactcgtgatgaaggaagtgttgttcagctatctgtgaacactttcattagtagtcggagcaagaaatgtcttatcccgtgtgagctcatataggaaccaaatttcaatattgtttgtgtttgtaagcccctgagtatatctagaagtcaaaaagtatgttgttgtctgtttgtttgtctatccctgttttgtctggaagttttagagcccattgtctgttgtcccgtgttgtctattagcccgtgttgtctattagcccgtgttgtctattagcccgtgttgtctattagcccgtgttgtctgttagcccgtgtccgtgctggagtttgattttttttggcgaatagttagttgacctctcttctctttgttgattgaaagtaggccaagagcagaagctgtgacaaggctggtgaggttaggatctggccgcgttgagtacaggtgaagcttgctttcggtcgataaatggaagcggttgttcgtcagaactgtcatactttccaatgtccctttggtcttccccttgcgtgttgctttcaccccctgttttgaaaaagtagccccccgttttgaaaaataaagtccacccccagtcttgagaaatgaaatgcccccagttttgaaaagtaagtctatccccagttttgaaaagtaaagcccaacccccctgtcttgaaaaatgaagtctatcccctgtttcgaaaagtgaagtgtagccctgttttgaaaatgaagtctttccccagcttgtgatttgaaaatgagagagttgtctagtgaacgttcatgaaaggttcttatgtcctggattggactgttgattgaaaacgtaatgatgtagtggtctctatatcatatgttgcgttcatttcccttagtcttgtttaaaaagtttgatatcctg

SEQ ID NO: 2515 - DNA, 2912 bp, Diabrotica virgifera
  misc_feature (702)..(702): n is a, c, g, or t
gtctgttagtccccatgaaagagcccatttttgtagtttttgttgcagaatgttaataattttttccgaagaggtataagtacgtacacatagtattgtggtgttgatttggtcgtactgttgtttgtataagtatgtaccatttcatacatcatagtgtatttacattgtaaccccatattatgtaaaccgtagtatactggtattgtattttatgtatcgtacaagagaatagtatgtttaatatagtagcgtacttactatattgtattgatattgtacccatgatgaaagcattggttaaattttttggaaaatattgatgaattatatagacatagacaaacagatgagtaaaaaataaagtataaaattttttttagaaaattttggtaaaaaaagtaacgttaaaaattttttttaaaattttgctaaaagttacaattaaaatgtttagaatattgaatccacttatagagtataacaatatgttgtatttttttgcatgtattcttatagatcaacagttttttttacagaataaacgttttttgtgattattgatttggtcgtttgagtagatgtgtgataatagttggtatggtccgtgtatgagctaattcggtatggtctgtgtgtgtatgtcccgtgattttccagcgaagcctatctatatttgggtatattattgccacaggttangttggagaagtcatccttgaagaagtaaccccatgaagaagtgaagagggaaaccgtggcgaggcccctccacttattgattaaaaatgatgtatgttttcttgtatctggcatatcacaagtgtaatactcgtgatgaggaagtgttttacagttgtctgggaatactcccattaatagtcggagcaagaacggttttatttgtgtaagctcatataagaaccaaatttcaatatttatttgtgtttgtaagcccatgtatatggagtatatataagaaccaagtttcaatatttgtttgtgtttgtaagcccatgtatatggagtatgactaagaaccaagtttcgatattatttgtgtttgtaagcccatgtgtatggagaatgtataaatgccctatgagtcttttgttccctgtttgtttgtctatcccttttttgtctggaaattctagagtctgttatcccgtaatgtctgttagcccatgtccctgatggagtttgattttttttggcgaatagttcgttgacctctcttgtgtttgttcattgaaagtaggccaagagcagaagctgtgacaaggctggtgagcttaggatctggccgcgttgagtacaggtgaagcttgctttcggtggataaatggaagtggtcgttcgtcggaattgtcattctttccaatgtccctttggtctttcccttgtgtgtttgctttcatccctgttttgaaaaagtagtctaaccccagtttggaagagtgaagtctactcatgttttggaaaaataaagtctacccattgttttggaaaagtaagatctactcatgttttggaaaagtaagatcatatccccggttttgaaaaataaagaatatcccagtttgtgatttgaaaatgtgaaagttgtcttgtgaactttcatgaaattgttttatgtcctaggtaggactgttgattgaaaacgtaatgatgtagtatttcctatgtcatgtgttacgtttattttttttttttttttggtcttgattaaatagtttgatatcccgtttgaatccagtatactagtttttttggtcttttgtatgttgtcacacgcgtttccccccccttgttggtcttgtttgaatgagttgttgagatgtcatttttgacattttatctcaacgaggtatttagactggattgtctaaatcctccttttgcagaaccgttgccgaatgtcccgtgaaactcgctaggtgtttagagtttaagcagatgcctatctgctgagccaagagctcagaaagattttttaatttgtgaaaaccaatcctagttaggcaacgaggtgatgaggctgtgtctgccctgctatatggtatatattatatggtatatatagtatatatatcacttgtgttactacagtggatgtcagcgaggtccacatagggcacaagattatttctttcccaagacacagaaactcttgtcacctacagttctcagtagagtctataaacatttaagtctactcgactttaaagagtctggcgattgatggcacgctagcccactccctaatgatgtttttgtttttgtttaatccccactagccattatttaaatattttagtattgtttatcctgtcatacccaagaagtcaatgtttttttttgttgttatcgaaaactgaattggtaatccagtttcctctcttccgaggaggctattgtagcagatggatttctactacaatattttataaaaaatatccattaattttaatcctatcccaagaaaaatattaatttttttaatatattttgcgagtttatatatctttaaaatttcctaagccgctcctgttcgcattgtaaaggttaggaaatttcctatttatttgtgtagcaataaccaactacgtagattgttattgaaaacatccattattcgagaatgaatcctctaaaaggttcagtgtttttcctttaagttttgagcgctaaaaatcccatgttattattggtctgcattttgaaagatccttgagttgtagttgacgattggtcaatagttttggccgaacgatcgagaagaaatgcatcgtttggacgcgagagagacgtgacgatgtaaagccagttctaaaagtacatcacttcagtaaacatctttttgttagaactcaaccaacagactcgtagaaagtcgcactttgccggca

SEQ ID NO: 2516 - DNA, 2326 bp, Diabrotica virgifera
  misc_feature (2226)..(2226): n is a, c, g, or t
caatccgtatgtatataaaagaccacgtagactgggacaagaatttagcaaagatcagacaagctattaataccgcaaagcacgaagtaactggatacaccccagctttccttaattatggccgtcatgttcccctgagtggaaactactatggtgttgatcaaaacgatcaacggaagcaagatctagaaattattcctggtaaccgtgatatgtatgcttcagaagtaaaaggattaagtcaagtcttcgaaaaggtcagggctaatcttcgaaaaggatatgaacgtaacgctagaagttacaacttacgaagaagagaagtccaattccaagtaggagatagagtatggaaaaggaataaagtcctgtctaatgctgctaacaagtttatgtctaaactagcaccgaggtacattgaagctacagtccgtgaaaagttgtcaccagtggtgtatcgtctctctgatttaaatggttctgatcttggtaaatggcatgttaaagacttaaaaccttttgtatctgatggagataatatgtcatccccttagtcctgatcccctattccatgttccccctgtattgttcttcagttcccttagtcttgataagaagttgatattctctttgattttggtatgtcgtcttttggtccctgttgttgtcgtatacccccttgtatgaatttgttgtgatttggcccttgttgttgttgtatccccctttgttagtcttcttttattttagtctagttgttgaagtgagtatattccctgtgagacgtttaacataaagttaccgatctcgacttgagacaaatgttaagattacgttgtctcattgaggtatttagaatggagattctaaatcctcatttttgctgaaccgttgccaacaaaattccctgaaactcgctaggcgtttagtggagtttaggcagatgcctatctgctgagcctagagctcaaatgatttgtttagtttttgagaaccgctcgcggttaggcaacgaggtgacaaggctgtgtctgccctggtatgtcacttgtgttactgctgtggatgtcagcgaggtccacacagggcacaagtttagtttctttcccaaggcacagaaactcttgtcacctacagttcattttagagtcattacacatttaagtctactcgactttaaagagtctggcgatcgatggtacgctagcccaatccctaacgtttgtttgtttaatttaatccccactagccatcatctaaaaaaatttttgatgtgattgtttagcctcactcaaggagtcatggttgatttttgtttggtttatcgaaaactggatagctatccgagctttctcttttcggaggaggctgtgtagcgtttaaaaaaccagtgaaaatatgatctttagatttgtatagattttacaatccctctctaacaagtccgtgtttttttattcagttttttacttaaattcagattgcaaggaattttctaaaaccgcacctgtatacatctacgaagtattccgcaacatttcaatgtgttacaagattcctgtttatttgagacgcaaaaacagaatttgtaagaagttttgacaaaagtacagttctaatgcgttgatgaactttctagaataaatgttgaaaatcaatttgattggtttgtttgaatttggtacaaagatcgaagctcgtaattggctctgaagaacggaagccggaaattgcgtagtgacaggatcaaggaattttggcaggagacggagaagaaagcaggcattcttacaatggtagtgaatcagtaaacatcgatagtgagttaccggcttttttgtgacgcaaaaagaatttccaagtaaatgggatctatcaaagttcttctgtgttgttgttaagtaggtgtaccatcagtttgatggtgtagcagttccttttttgatggtaaaagtgtaatatacgctttgtaaaaatactgcgtatgtatttatgaaagccggcatagtactaatatcgtagtgatgaattaaacccaagcctcccgtctcctggattagaaaacctatttcccgaggtaaataagcaaatttcttttgttttatggtattttcatggtataatggtatatggtgcaatcagtaattttccattgacattttccccttcgagtgacgtatgaactacgtacgtgctgtcaagtgtcatgtcaagtttcacaatggntgaagttttgaatttttaggtatagtgacttttataattataaaattctcaaactaataacgttaatttctttcacataaaaaaaataaatctttttgga

SEQ ID NO: 2517 - DNA, 1946 bp, Diabrotica virgifera
aagcagcacatgatgttattgacgaggttaatgaaggaaccatagaagtaccagatgaataaactattattagaatattttttctaagcaaaaaaaaacccacgcgtccgtgtggctacattatttaataaatcgagaataacgtgtcagaactttgttttctctcaccaggtgttagtgtaaattgacaaaatggcaccgatagatcaaactgcagaatatgacctcatcgttatcggaggtggttccggtggtttggccgccgccaaggaagccagcaacttaggagctaaggtagcagtactcgattacgtcactcctagtccgaagggtacgaaatggggtttggggggtacgtgcgtcaacgtaggatgcatccccaagaagctgatgcaccaggccgccttattaggagaagctgtccatgatgctcaaacatatggatggcaactacctcaaccagaaaacatttcgcacaattgggaagcactcaaggatgcagtacagggccacatcaagtcagttaattgggtaaccagggtagaacttagggataaatctgttgaatacatcaacggtctaggtacattcgtcgacccacacaccatccacgcccaaacgaaaaagggcgacaagacactcacaggcaagaacatcatcatagcggtcggcggcagacccagatacccagacataccaggtgcagtagaatacggaatcagcagtgacgacatcttcagtttagaaaaacctccaggaaaaactctagtcgtgggtgccggatacatcggtttggagtgcgctgggtttttgaacggtctaggttatgacgctaccatcatggtgagatcgattatcctcagaggcttcgaccaacagatggccaatgtgatacaagccgagatgaaagagaaaggagtcaaattcttacccagaaccgtccccactgaaataaaaaaaggcgatgacggcagattacacgttgcgtataagaacgataaaggagaaaccgcctcagacattttcgacacggttctttttgccatcggcagaagggctctgacgaaagagctacatttagaaaacgccggcgtcaaagttgctggagatggagaaaagattgatgtggtcaacgaacagaccaacgtacccaatatttatgccgtaggagatgttttatataaaaagccagaacttaccccggtggccatcctcgccggacgtttcttagctcgccgtcttttcggtggcgccagtcaagttatggattacgaaaacgtggccactacagtattcagccccctagagtatggttgtgtcggcttgagcgaagaaacagccatcgaacgattcggtgaagacaacatcgaagtctaccacggatattacaagcccactgagttctttattccacagaaaagtattgccaattgttacttaaaggtagtcgcccatagagagggtaatcaaaaagttgtaggattgcacttcattggaccaaacgctggggagatcattcaaggatttgccacagcaatcaaattaaatttaacagtaaaggatttaatggaaaccgtcggcatccatccaaccatagcagaggaattcacgagaattaacgtcacaaaacgatcgggaaaagacccccaccctgcgtcatgctgcagttagagaaaaaaaatactcatttccaaatatttttatttttgtttattttaagcctatttaaggtcatccatcacttttttaattataaaaaaaaaacccttgggcccacccccaaaacgttggaaattaaattttttgtttaaaaccctaaaaactctcggtaaaaaagtattttttttctggtggggctggggaggggaaaaaatataattttttttttttttttttttttaaaaaaataaaaaaaaaaaacacacaaaacccaaaacaattataaa

SEQ ID NO: 2518 - DNA, 2025 bp, Diabrotica virgifera
caatactctatagaaagtcgtattagtgtaagtatgtacacattttgttgtgatgttgatttggtcgtgctgttgattgtatgggcatgtaccatttcatacatcgtagtgtatttaacttgtaaccccatatgtatactggtattgtattgtattgtatgtatcgtagaacagaattgtatgttattttagcgtactaactgtattgtattgatattgtacccatgatgaaagcattgatttgaatttttttgaaaatattgatgaaatatatagacaaacagttgaataaaaaagtaacgtaaaatttttttgaaaattttgattaaaagtaacgttaaatattttgaatattgaatccaattatgaagtataacagtatgttgtattttttgcatgtattcctatagatcaacagtttttttacagaataatcgttttttgtgatttattgatttggtcatttgattagatgtgtgatgttgttggtatggtccgtgtatgagcttagccccgtatagtctgtgtgagagtagtcccttgtttttccagcgaagcctatctctgttggtgtatgtcatgccacaggttagttggagaagtcatcccattgagaagtcatccccttgagaagtggccccgtgaagaagtgaagagggaaaccgtggagaggccccccacttctgtgtttttttcaagcagccaggagaaaagctgtcacttttagatttgaagatagcgttctctgtcgacactgtttgagaataactgtcttgaagtgtagaagttagcccctgaaaaagccccccccttgtctgtgttgccccttgtttttttttttttttgactaatctatctttgtaggtgtcaaaaggatgccagaggttagttaaaaagagcccgtgaagtagtagttgaagtctcccccccagtgaagtagttgaagtccccccgtgaatgaagtatgtctttttgtatctgacatgtcacaagtgtaatactcgtgatgaaggaagtgttgttcagctatctgtgaacactttcattagtagtcggagcaagaaatgtcttatcccgtgtaagctcatataggaaccaaatttcaatattgtttgtgtttgtaagcccctgagtatatcatcacggtctctttgattgacttctgtgttgtcatctccatcttgagagggtcacgtttgttgtattcgtatttcgtgttttaacgttccaaagaaaaacaatccaaaatggttcatcacattaaagataaggatgacttggaagctaaattcaaagaagctggaaccaacttggtagttctcgacttctcagctgcctggtgcggaccttgtaaaatgattagccccaaattggacgaattggctgccgaataccccaacgtcgttattgtaaaaatcgacgttgatgaatgcgaagatctcgctatggaatacaacatcaagtccatgcccacattcattttcctgaagaacggtcaagaaatcgcgaatttcagcggagctaactacgaaagactaaaacaaaccattgaagataacaagtaatgcaaaacccagaatattctgcctaaatatttttttaataaattattcaaaataaatatgtattaatgatattgtagctccgttaaaactatattcgtactgcatagtaattttattttgtacttgttcttgttaatgtcaaatgttttgaaatatttttgaaaagtagtgcctgacgctgttatacacttcatttatctataaatatatatttaagatttacacagttgtcttttaagtatgttaatatattatgtgacatgttgcacatgaaggtaataaaagctgttgctacatactctaaaaaaaaaaaaaaaaaaaaaaaaaaaaaaaaaaaaaaaaaaaaaaaaaaaaaattaaaaaaaaagaaaaagggcggcccgtcaatctaaaaataaatccgaacggggggggggggacacacatcgtttcccttggagggggggggggagtaacttgg

SEQ ID NO: 2519 - DNA, 3024 bp, Diabrotica virgifera
gaagtagtagaagtccccccgtgaatgaagtatgtctttttgtatctgacatgtcacaagtgtaatactcgtgatgaaggaagtgttgttcagctatctgtgaacactttcattagtagtcggagcaagaaatgtcttatcccgtgtgagctcatataggaaccaaatttcaatattgtttgtgtttgtaagcccctgagtatatctagaagtcaaaaagtatgttgttgtctgtttgtttgtctatccctgtttagtctggaaattttagagtctgttatcccgtattgttctgttagcccctgtccatgatagagtttgatttttttggcgaatagttcgttgacctctcttgtgtttgtttattgaaagtaggctaagagcagaagctgtgacaaggctggtgagcttaggatctggccgcgttgagtacaggtgaagcttgctttcggtggataaatggaagtggtcgttcgtcggaattgtcatttctttcccatgtccctttggtctttcccctgtaaacatcggcgtagaatcgccattaatatataagtattttatatagaattaattcaaaatgccacccaagttcgatcccaccgaaattaaatatgtttacatgagatgtgtcggaggagaagttggagctacctcttctttggctcctaaaattggtcctctaggtttgtctcccaaaaaagttggtgacgatattgccaaaggtactgctgactggaaaggtcttaaaatcacagttcagttgaaaatccaaaatcgtcaagctaccatttctgtagtcccatctgcctcctccctgatcattagggctcttaaagaaccaccacgcgataggaagaagcaaaagaacattaaacacactggtaacattactttcgatgaaatcatcgctattggcagacagatgaaggcccagtcgatgggccaacagtttatccggaactgtaaaaagaaggttttaggacagccccaatcagttgggatgtacaatgaaggaagtgttgttcagctatctgtgaacactttcattagtagtcggagcaagaaatgtcttatcccgtgtgagctcatataggaaccaaatttcaatattgtttgtgtttgtaagcccctgagtatatctagaagtcaaaaagtatgttgttgtctgtttgtttgtctatccctgttttgtctggaagttttagagcccattgtctgttgtcccgtgttgtctattagcccgtgttgtctattagcccgtgttgtctattagcccgtgttgtctattagcccgtgttgtctattagcccgtgttgtctgttagcccgtgtccgtgctggagtttgattttttttggcgaatagttagttgacctctcttctctttgttgattgaaagtaggccaagagcagaagctgtgacaaggctggtgaggttaggatctggccgcgttgagtacaggtgaagcttgctttcggtcgataaatggaagcggttgttcgtcagaactgtcatactttccaatgtccctttggtcttccccttgcgtgttgctttcatcccctgttttgaaaaagtagccccccgttttgaaaaataaagtccacccccagtcttgagaaatgaaatgcccccagttttgaaaagtaagtctatccccagttttgaaaagtaaagcccaacccccctgtcttgaaaaatgaagtctatcccctgtttcgaaaagtgaagtgtagccctgttttgaaaatgaagtctttccccagcttgtgatttgaaaatgagagagttgtctagtgaacgttcatgaaaggttcttatgtcctggattggactgttgattgaaaacgtaatgatgtagtgttctctatatcatatgttgcgttcatttcccttagtcttgtttaaaaagtttgatatcctgtttgaacccagtatactagtctttttggtcttttgttgttgtcacacataccccctcccccttgttagtcttgttttgactttagcccttgttgttgtcatatacccctttgtctagccctgtcttgtttgaatgagttgttgaggtaagttgttggtgagattttgtctcactgaggtatttagactggattgtctaaatcctccttttgcagaaccgttgccgaaatgtcccgtgaaactcgctaggtgttagcagagtttgggcagatgtttatctgccaaacatcaacttttttagttttgagaaccgctcgcggttaggcaacgaggtgacaaggctgtgtctgtcctagtatgtcacttgtgttactgctgtggatgtcagcgaggtccacatagggcacaagtttagtttctttcccaaggcacagaaactcttgtcacctacagttctttgtagagtcataaaacattttagtctactcgactttaaagagtctggcgattgatggcacgctagcccaatccctaacgactttttttgttttgtttaatccccactagccattatctaaatatttcgatattgttgtcctgtcacaccctagatgtcaatgttagattttctttgcagttatcgaaaactgaatagataatccagtttcctctcttccgaggaggctattatagcagttggattttccgctataatgtattattaatatcattcattaatttaatatcctaatcccaaaaaaatacctatttttctaatttgtttcatgaagttgaatatcattgaaatatccaaagccgtccctgtttgaaaattgcagaagcttacgaagtattgtgcaatattggaaatgtacagtacccccccttttagaaaaatgtttggactcgtccagagtaccgaatttttgcaagttgcagcattaagggcgaaaattgcttttaactgcgcaacagggctcttcggtggtaccccaccgccgagaagaatttcagtccagttttaggatatgaaggagtagcatctactccgctcgctggtactcgcttgaatagggcgtagccccgttgcccctcgct

SEQ ID NO: 2520 - DNA, 2997 bp, Diabrotica virgifera
gaatctaatcaatgtattatctctggtagggatatctataaaaatcatagaggattggacaaatagaatagaagatcatttaaattaacgcaacaaaacagaagttccaagtttgcgctggcgcggttacgttagccttgtacataggtgtgtttgtggctacattatttaataaatcgagaataacgtgtcagaactttgttttctctcaccaggtgttagtgtaaattgacaaaatggcaccgatagatcaaactgcagaatatgacctcatcgttatcggaggtggttccggtggtttggccgccgccaaggaagccagcaacttaggagctaaggtagcagtactcgattacgtcactcctagtccgaagggtacgaaatggggtttggggggtacgtgcgtcaacgtaggatgcatccccaagaagctgatgcaccaggccgccttattaggagaagctgtccatgatgctcaaacatatggatggcaactacctcaaccagaaaacatttcgcacaattgggaagcactcaaggatgcagtacagggccacatcaagtcagttaattgggtaaccagggtagaacttagggataaatctgttgaatacatcaacggtctaggtacattcgtcgacccacacaccatccacgcccaaacgaaaaagggcgacaagacactcacaggcaagaacatcatcatagcggtcggcggcagacccagatacccagacataccaggtgcagtagaatacggaatcagcagtgacgacatcttcagtttagaaaaacctccaggaaaaactctagtcgtgggtgccggatacatcggtttggagtgcgctgggtttttgaacggtctaggttatgacgctaccatcatggtgagatcgattatcctcagaggcttcgaccaacagatggccaatgtgatacaagccgagatgaaagagaaaggagtcaaattcttacccagaaccgtccccactgaaataaaaaaaggcgatgacggcagattacacgttgcgtataagaacgataaaggagaaaccgcctcagacattttcgacacggttctttttgccatcggcagaagggctctgacgaaagagctacatttaaaaaaccccccataaatatcacggtctctttgattgacttctgtgttgtcatctccatcttgagagggtcacgtttgttgtattcgtatttcgtgttttaacgttccaaagaaaaacaatccaaaatggttcatcacattaaagataaggatgacttggaagctaaattcaaagaagctggaaccaacttggtagttctcgacttctcagctgcctggtgcggaccttgtaaaatgattagccccaaattggacgaattggctgccgaataccccaacgtcgttattgtaaaaatcgacgttgatgaatgcgaagatctcgctatggaatacaacatcaagtccatgcccacattcattttcctgaagaacggtcaagaaatcgcgaatttcagcggagctaactacgaagactaaaacaaaccattgaagataacgttttctttcattctgcgtttaatttttttaaaaatacttattagttttctcagtattcgaaaaaaatgaacacatttaaaacacaggaaaattttgagaggcgacattttgcgtctttccccttaaatttttttgcaacatgaatgaagcaccctgtgtattaaattaaaaatatacattcaagtaaataaacaataatattttgttatatcaaagttttcaaacaaattttatatagggtgtctgcataactagcaaccatatggtttcatattaattttattaattattaattttaattattattaatacattattaattttacgggaaaaggtaatacccaagttaaatacataatcataattcatagagtatgtgtttacttaagggtaattatcattagagtaaaagattcactttataggagtaaaactgctaagttgcgttatgggtactaatttatgtttctagtcgtcaaggagtgtgatttgatgtttgattttcatatggcaagcgtaattcaatctatctacatacttcaaagaaaaaaaattaggaagggacaataaaatgtaatatattttagacggagtacgttcaacatttcaggacgggaataataaatcattttttcagtaataacacaatatttgatttttgagatttctctagctgttcatgaaataaataaaattgtatataaaaaatgattatctcatttaaaataaatatttcttatttaccaatccttcggtttggcgccccattggggttacgcacgcgtgcaccgcacgcgttgcacgcccggttacggggccctgatattattccaagtacgcaataatgaaccacccgcatccctcaaaacggtattactctctatacagtaccgaaatttccaaaggaaagtttcaaacgggccataccgctcctgaattttgcacatgtataaatatttttcgtagcgccatcttatacataatggctacattaacagagcttagattcttacagattcctatactgtattcgtattatatgtcgaatatttacgtttcacatgccaatttttattaatttcagaaatttattttaaaagtacaccacgcaaaaagtactttattaattcacatttttttaacgttatatccttccattacttctactgtagtgctaaacggaattttatcatgaaattcatttaaatacttaagtaatttagatataaacgctcttatatttattgagaaaaaggcaaaactttcacatttttttataaacaatacacaacaggtaggataacaaaaatatggctggaactagcgacatatattgttagtaggttaagcatttttcggtatacatatatgctctagattatgagtggtgtactttataaaggtgatgggatcggctatacttataacattaccaa

SEQ ID NO: 2521 - DNA, 2804 bp, Diabrotica virgifera
ccaaatttcaatattgtttgtgtttgtaagcccctgagtatatctagaagtcaaaaagtatgttgttgtctgtttgtttgtctatccctgttttgtctggaagttttagagcccattgtctgttgtcccgtgttgtctattagcccgtgttgtctattagcccgtgttgtctattagcctgtgttgtctgttagcccgtgtccgtgctggagtttgattttttttggcgaatagttagttgacctctcttctctttgttgattgaaagtaggccaagagcagaagctgtgacaaggctggtgaggttaggatctggccgcgttgagtacaggtgaagcttgctttcggtcgataaatggaagcggttgttcgtcagaactgtcatactttccaatgtccctttggtcttccccttgcgtgttgctttcaccccctgttttgaaaaagtagccccccgttttgaaaaataaagtccacccccagtcttgagaaatgaaatgcccccagttttgaaaagtaagtctatccccagttttgaaaagtaaagcccaacccccctgtcttgaaaaatgaagtctatcccctgtttcgaaaagtgaagtgtagccctgttttgaaaatgaagtctttccccagcttgtgatttgaaaatgagagagttgtctagtgaacgttcatgaaaggttcttatgtcctggattggactgttgattgaaaacgtaatgatgtagtgttctctatatcatatgttgcgttcatttcccttagtcttgtttaaaaagtttgatatcctgtttgaacccagtatactagtctttttggtcttttgttgttgtcacacataccccctcccccttgttagtcttgttttgattttagcccttgttgttgtcatatacccctttgtctagccctgtcttgtttgaatgagttgttgaagtaagttgttggtgagattttgtctcactgaggtgtttagactggattgtctaaatcctcgttttgcagaaccgttgccgaaatgtcccgtgaaactcgctaggtgttagcagagtttgggcagatgtttatctgtcaaacatcaactttttagtttttgtgaaccgctcgcggttaggcaacgaggtgacaaggctgtgtctgccctggtatgtcacttgtgttactgctgtggatgtcagcgaggtccacacagggcacaagtttagtttctttcccaaggcacagaaactcttgtcacctacagttctttgtagagtcaagaaacatttaagtctactcgactttaaagagtctggcgattgatggcacgctagcccaatccctaacgacttttttgttttgtttaatccccactagccattatctaaatattttgatattgttgtcctgtcacacctaagatgtccatgttggatttttttctgtttgttatcgaaaactggataatcttatccaggtttctcttttgcgcggaggctttgtaacgtttgaaaaaactccaacattaatttaatatcccaattcccaaaaagaatgtctatttttttaatttattttgtgaagttcaatatcattataagatcccaagccgaccctgtatacagccatgaagtattgcagcaacatttcaatgtgttacaagattcctgtttatttgagacgcaaaaacagaatttgtaagaagtgttgacaaaagtacagttctaatgcgtagatgaactttctagaacaaatcttgaactgaaagttgagttcttgtcaactaagcatccctaaggatcaaaatcgctcggtacttccgtcgtattttccccgatctgtggcttcagaccgaagcgcagatcagtccggtttgatttcttcaagcgtgaagatcgcttgccgactcaccccaaaagggcgtggtgccttttgttacccgccggtaaagggtatagtatgtcgttctggaagatctagtgtgagggcacgatgtttttttttaccccgtagtgaagttgggtgctcttacactgtgtttgagttgtgacgcagtactatacgccggcgtggtatgaagtccctgtatcttgtccaagttcctgtttaaatgaagtcttccgagtcccgattgatgtcctgatgtagacattttgagttccagtcccgtgatgtttatccagttgattgccccgaaataaaaaggaagccatgaagcccacctcaggtcgatgaccctgcttgtttgtagatgaaccccctttccgtgtagtttgtgacgtgtgataaaggattttgtttaaatatggtatgatatatttttttaaattttgcaaggatcccaaatggataaatatttttgttggtaaagagttttgaaaaataatagttgtttgtgctttcatgatgcaacttgtaaattaaaatgacagtgactttgacctttgacagctgcgtcaaaattttgttttgacatacactgtccaacaagttcttttgtcattcttttgttatgttaaattgaagattttttttgtaatgtaaaagatttgtagatattttgtcctgtaaaatcatttcctgttaaaagtttttttgtttgtttaaaaaaaaaaccaccgtaaagttttaaataaatgtttgtgaaagtgtaaaaaacaaaaaagggctgccgctctcggaaaaattttaacagaaaactaatgcaactgtatgaaagttttagtactcttgggagaaagaatatggcatagaagccaataaataggaaagatgttgtccccatgtaaccccaaagaggaatcaatgatgattgtcccccc

SEQ ID NO: 2522 - DNA, 4132 bp, Diabrotica virgifera
  misc_feature (3992)..(3992): n is a, c, g, or t
gaatttgaggatttttcaaacggcgtcccactttgtttaaatagtaggaaagtcctcaagtctgtgtaagtatcctttgcttatttggttatgtagtttagtcttctttaaaccctcctacccctcccaacgaatctacgacctgccaccgcacaaaaaatgagctgccgttcgcatgaaggtttgcgtgtctgttccttctgctagccccatttcgactccccagtatctctatagatagtctttccttgatcccattacagcagacaggtaaaacgcttcaactggcacccaacgtgtgaggccgattcatttttctgcctccttcagtatccagtagtcgtcttgtccagttgaacgcttcaactgtcgccctagaacgtggggcatgtcttttttgcctccctcagaccccatttgcatgttcccactaccatgtccttttagcctcctttcggtctcatttgtactacaactccttgtcagtgcccgtcttgtcaagccgatctcagttattggtgcaagtgtttccgataacatggaagctcgactcgtgtcatgttttgtatgcccattgttacaagtctagcttgtagacatgttcaactagtagttagcctatctactagtccccaatgtctttagccacccccccacttagtgttacatttgtaacgtacaccctgaagtttgacctgagtagatatcgccccagtcttcccatgtagtttagcccagattcctcttgtcttgcccccccgaaactgtttcatgtcttttagtgcccccgaaactgtttcagtctgttagtccccatgaaagagcccatttttgtagtttttgttgcagaatgttaataatttttccaaagaggtgtaagtatgtacacattttgttgtgatgttgatttggtcatgctgttgattatataggcatgtaccatttcatacatcatagtgtatttaacttgtaaccccatatgtatactggtattgtattgtattgtatgtatcgtagaacagaattgtatgttattgtagcgtactaactgtattgtattgatattgtacccatgattgaaagcattgaattgatttttttgaaagtattgatgaaatatatagacaaacagttgaataaaaaagtaacgtaaaatttttttgaaaattttgattaaaagtaacgttaaatattttgaatattgaatccaattatgaagtataacagtatgttgtattttttgcatgtattcctatagatcaacagttttttacagaataaccgttttttgtgattattgatttggtcatttgagtagatgtgtaatgttgttggtatggtccgtgtatgagtttagtcccgtatagtctgtgtgagagaagttaccccttgtagaagtcaccccatgaagaagtgaagagggaaaccgtggagaggccccccacttctgtgtttttttcaagcagccaggagaaaagctgtcacttttagatttgaagatagcgttctctgtcgacactgtttgagaataactgtcttgaagtgtagaagttagcccctgaaaaagcccaacccccctgtcttgaaaaatgaagtctatcccctgtttcgaaaagtgaagtgtagccctgttttgaaaatgaagtctttccccagcttgtgatttgaaaatgagagagttgtctagtgaacgttcatgaaaggttcttatgtcctggattggactgttgattgaaaacgtaatgatgtagtgttctctatatcatatgttgcgttcatttcccttagtcttgtttaaaaagttgatatcctgtttgaacccagtatactagtcttttttggtctttttgtgttgtcacacataccccctcccacgcgtccgtattgtcttgattttagtccttgttgttgtcatatacccttttgtctagccctgttttgtttgaatgagttgttgaagtaagttgttggtgagattttgtctcactgaggtgtttagactggattgtctaaatcctcgttttgcagaaccgttgccgaaatgtcccgtgaaactcgctaggtgttagcagagtttgggcagatgtttatctgtcaaacatcaactttttagtttttgtgaaccgctcgcggttaggcaacgaggtgacaaggctgtgtctgccctggtgtgtcacttgtgttactgctgtggatgtcagcgaggtccacacagggcacaagtttagtttctttcccaaggcacagaaactcttgtcacctacagttctttgtagagtcaagaaacatttaagtctactcgactttaaagagtctggcgattgatggcacgctagcccactccctaacaatgatgttttgtttttgtttaatccccactagccattatttaaatatttttgtattgttgtcctgtcacacccaagaagtcaatgtttatttttgtagttatcgaaaactgaattggtaatccagtttcctctcttccgaggaggctattgtagcagatggatttctactacaatattttataaaaaatatccattaattttaatcctatcccaagaaaaatatcaatttttctaatttattttgtcagtttaaatatctttaaaatttcctaagccgctcctgttcgaaatatttcagaatattttcgcaacaaagtaaaatcataggaaacgtccgcgtccgctcgggccaagcgtccgcccacgcgtccggttattgtgaaatcattcattattcgagaatgaatcctctaaaaggtttggtgtttttcctttaagttttgagcgataaaaatcccatgttattattggtctgcattttgaaagatccttgagttgtagttgacgattggtcaatagttttggccgaacgatcgagaagaaatgcatcgtttggacgcgagagagacgtgacgatgtaaagttagttctaaaagtacatcagctctgtaagcatctttttgttagaactcaaaaagtcgcactttgccggccaaaatggttttcttcttatagtaaaagaactaatggatttctaacatgtcaaggaatataatgacaatagtttcacggcattttaatggatatattattgtgaaacagttctattgttatgcagtttgatttgccggtaaaagaagtgcgtggtttcctggttcctgtcctttatgtagctgttgctatttttatgatgttttgatttgttcatgttccagtaagaaatgcccagatgatattatttggtatcgattttatccagttttgtaatgatttgaatatcttcccctcccagccccgtctgaatggaaaattttgaagttccaagtgttgtgacatggatttttgttttaacaaggtatgataatgtttattttaaataattcacaagtggatattattggtaaaggttttacataattaaaaatgtttgttttcaacatggaaaatatattatgtaaagtaaatattagatggcagtgacatttgacagccatgtcaaatttttgttttggtacactgctaaaaataaggttaaaaattgtaaaatcatgtattttgttattattattcatttctggtttgagaatgtgtctattctcaataaaaataaaaaggtattaaggtttaaataaacattataaaatgtacacatctttatttctgtaacctctttatttaagaaaattattaacagatatctaatacaagtgaataagttttagaacagaagaaaatataatggcatagaagccaaatgatgataatttgtagcccactataaccccaatgaggaatctacgatgaatgtcccccagttgctttccagtaagtactcgatatgagaatttgaggatttttcaaacggcgtcccaatttgtttaaatagtaggaaagtcctcaagtctgtggtgttactttggctgatgtagatccatctgctggtgcaaaagctttggaagagcttgaaaaggaatttggtcncaataaggcaatatttgtacagacagatgtacgggatcggcaacagtttgaagatgcttttaagaagactgtcgaaacgtttaaatatatcgatattttatttaacaatgctggtattttaaatgattctacatgggatg

SEQ ID NO: 2523 - DNA, 983 bp, Diabrotica virgifera
aatttcttttctgatcataacatataatctgcacgaagtatcacttgtggtaatatactactattgtaaccaatgatggcaatgaagtaaaatcagcagcagattataatttttctgcttgtaatataacatacgttcatccttatctaaccgtggacgaatggtgcttgatatcagaaagaattagcaattttggagaaatatcgtgtaaacaattattatacaaattattcattcaaaaagtgcgtgctttgtacatttttgaacaaaaagtaaatgaagaaattttgcaagatctatcgaggtacataacaagggatttagaagaaaattggaaatacatattacaaaacaaattcttaaccaacaacttagtaccactaatggattcttcctcaatcaacttactagctgacaaattggtagccaatataacggatttggatgacacacaactaaaccagtacatttttaataattcttgtgttttaaatgccgttgcttattctataatagttaaatctgataaaattatttcgaaaagaaaaaggaaacatgatgaagatttggttgatgcaaagaaattaagcacgaaagtaagtaacatggtcacagtagatacattttgtaatgatggccacaacgaagatttaataaagaaactcaagaaagtatatgagtcctacaaggtggatcataatgtagaagtaaagtttaatgaagcaaaattattagagctactcgaggtactaaaaaagtttcctgtcgtattttgtaaagaatccgtccagaaatgttttctcgtctacctattttctctacacaaggagttgcgtcaagatttttccaaaggacgttatgtagatgtacaaagcagtttagagaatattatattaggtatgctgcaacagcataaatataggttagatgacatttttaatatggaaaccatatgtccagaagtactgacaaagtttaatgaa

SEQ ID NO: 2524 - DNA, 3252 bp, Diabrotica virgifera
  misc_feature (1449)..(1449): n is a, c, g, or t
aatatccacgatgacgacccagcaaccgactccagctcctccgaaacgtggaattataaaacagattctttctggggattctgttataattcgagcaccatctggagcacctccacctgaaaaacagattaacttttcaagcattactgcaccaaaattagctagacgagctgcagaatctggagaaacaacaaaggatgaaccatgggcctgggaagcaagggaatttttgagaaagaaactcatcggggaagaggtattctttactagtgaaaaaccaccaaatgctgttcgtgaatatggagttgtttatttgggaaaagactttaatactgcagaaaacattacggaatccttggtatcagagggactagtcactgttagagaagcagtaagacctactccagaaataacccgcctgcttgaacttcaagatgctgccaaatcagcaggaaaaggcatatggagtggcgctccgtcatctgagcacgtccgtgatatcaaatggactattgaaaaatccaaagaattggtagatcaactccaattcaagccagtaaaagcagttattgaacacgtacgagatggatccacagtaagagctttcttgttaccagacttttactacgtgactcttatgctctctggaattaggtgtcctggtttcaaattagacgccaatggcaaaagagaccctaacgccaaagttgagttcgccgaagaagctcgttactttgtcgaagtccgtcttcttcaaagagatgtagagatcgtccttgaagcagtcaataacaataatttcattggaaccgtaattcatccaaaaggaaatattgccgaactcttactcaaggaaggtttaggcaaatgtgttgattggtctatcatgctcatgaagagcaacccagacaaattgagagcagctgagaagcaagctaaagaaggtcgaaggaggttgtggaaagatttcgtaccgacggcacctaaaattaccggaaaagaaaaggaattctccgctacggttagcgaggtcaacaacggagatgcccttgtacttaagatggccaacggtgacagcaaaaagatctttttggccagtattcgcgcccccaaagagcctggccgtgccaacgacgacgagggaaaacccattccaagacctaagggtttccgtcccctctacgatatcccctacatgtttgaagccagagaatatttgagaaagaaactcattggcaaaaaggtgcatgtcgtcgttgattatatccaagaagctagagatggcttcccagaaaaagtttgtgctaccgttaccgtcggaggaaaaaatgtcgcagaagctctagtttccaaaggtcttgcaactgttgttaagtatcgccaggacgatgaccaacgtagttgtcgctatgatgaactcctaactgcagagactaaggctaacaaatnctcaagtcggtgttcactccaagaaagatgctcctccactaagagttaccgaaattgatgctgctagagcaaaattggaacttcctgccttacagagagctcaaaggatagatggaatcgtcgaatttgttgccagcggatctagattgagattatacattccaaaatcaaacagcttatgcactttcttgttgggtggtatcaactgcccgagagcaacccgccaagccaccgacacccccggagaaccctacggagacgaagcgctcctcttcactaaagaaagatgcatgcaacgggaagtatccatccaagtcgacactcatgacaaagcaggcaattttattggttggttgtgggtagataatgtgaatatgtctgtggcactcgttaaagaaggttttgcttcggttcatttcacaggagaaaaatcccaatacgcgtctctattgaaaagtgcagaagacagtgcaaaatctgaaaaattaagaatatggaaaaattatgtcgaagaagaaaaggaagaaaaacacgaagaggaaaaagtacctgtcgaacgtcaagtgaactttgaggaagtcgtagtgacagaggtgacgcccgaaggtagtttctacattcaaaagatttcagaaggaccaaaagctgaagctctgttcgccaaactgcgacaagaattccaagccaacccgcctcttcccggtgcttttacaccgaaacgtggtgatatctgtgctgccaaattcacagtcgacgatgagtggtacagggtgaaggttgaaaaagtacaaggaggaaaagcttctgttcattacatcgactacggtaacaaagaaactcttccaaccacccgcctagccagtttacccgccgcctacgtaagtgagagacccttcgcaacagaatacgtccttcccttcatcgtcctgcccaaagacgaagaattctcttcgttggctatcaaataccttaaagaagataccgccgttagcaagctatacatgaatgtagaatacagacaacccggatcccctgcagcagcttctttacattctgacaagacgtctgatgccgacattgtaaaaaatctcgtcaaagagggattacttatcgtcgacaacatcaaaggaaggcgtaacaataaattgttggaaagttaccgagaagctcaggaaacggccaagaaacaacacgctaatatttgggaatatggtgacatcacagaagtcgatgctaaggaatttggacttggcgtttaaactagggaatagggaccagtctaccagagcaaaccatctacattgtaggttcatagacttccaaatcatattgattaaaatgaaacaacttccacatttatagtaatagacataatatttataattgatttccgatatttatacatgagaaatatgtttttagggggttatttgttgttttatatttttattatgtgcgaattttaattattatatttatatactgggtctctttattctaagtcatttttttgtaattttttccgacacgattgtttttatgatatatttattttgaattcaatttatctatttacatatttctgttgaatattaatttttgtgatgaattctaaaggtggtcacacacttccactctggaaaagacatgaaaatatattaaactagactgatacgcccgtaaaggaaatatttagtcctctggattggtatatatttatgtacggactgccattattcatattttgggaaagcggaaatggtaggggatgggctctgtttacaataaattactttgatcgtt

SEQ ID NO: 2525 - DNA, 827 bp, Diabrotica virgifera
  misc_feature (810)..(822): n is a, c, g, or t
caagaagtgtgtaagttccagatcgactgtctcctttcaccgccaatatgcctattgattgctactacgttcctggtggagccccatcaagaaacgtccttctagctgccaaagcatgcggagttgaacttaatctcaaatacatggacttgatgagcggagagcaaatgtcccctgagttccttaaactgaaccctctgcatactgtccccacaatcaacgacaatggttttgttttgttcgagagccgagcaatcatgacctaccttgcagatcaatatggtaaagatgacaacctttatccaaaagatcctaagaagagggctattgttgaccagagactgtactttgatatgagcactatgtatggaagacttgctgattattattatcccgtgatcttcggtggagccagttacgatcccgacaagttggaaaagatcaaagaagccttcagcttcctcgaccagctcattgacaacaacgactttgctgctggcagcaacctcactttggccgacttggcccttgcctcatcagtttccacttacgagctgctaggattcgatttcagctcctacaaaaacgttgtcagatggttcgagaaagcaaaagccacgattcctggatacgaagaggccaacgctgagccgctccagcagttcaaagctttgatggagaagttggcaaagaagtagataggattggatacagtattattgttaaggaagtcttgatgcttcaagattattgatttatgccacttgaagttgtattttatctttttttaataaaacctgttattttctnnnnnnnnnnnnnaacgg

SEQ ID NO: 2526 - DNA, 886 bp, Diabrotica virgifera
gcttatttctgggaaaaagcaattgatttgctctcttcttcatttgaaataagcaattgatttgctctcttcttcatttgaatagacacgtttaaagtcatccataacaaaggttcctttaggtagttcagaaaaagggtccttactcttgggttcttcagcaagagcggcttctgcagcatctaattcttctggctgttccttttccttcttttctttaggtgtttgtggcttcttctcttgtttcttttcttccttcttcttacctttacctggtgttgcagctgcagcagttaaagttccaggttgagcaactgcactgcaaagtttaacttctccaagtacagctatgaattgtggctggttaataagtgtattgaaccatctattgacgttaccaaaagattttctaaagttgggatcaagtacatatttgtaggcattcaataggttgcaggcaactacaatgtcagctagagtgattctctctcctaccaagtaagtgtgggcaagtaagtggctgttgagaatagacaaagaggatttaaggtcttcctttgctctttggaaagtctcatcattaccactgttatttttaacaattcccaagatagggaatacccaggcacatgctgctggaacaatttcaccttcagcaaagccaatccattgcaaaatttgtgctctatcatattcgttttttcctcttagttgttcattggaaacatagtaagcgatggcgttgctgtcttgaaggtacttgccatcgtttgattcaaaagcaggaactctttacacttatcccgaaaatttccggagccgcaaaaactctgattgcctcacaatatgctacggataacgtcaaagcagcacccaactttgtttt

SEQ ID NO: 2527 - DNA, 497 bp, Diabrotica virgifera
attctgcaacggtcactccgtaactgttggaactacatcgagcgataagcatgaataccatcttcaaaaccaccacattgttggggacaaattgacggtctcaaattttcattctgcaacggtcactccgtaactgttggaactacatcgagcgataagcatgaataccatcttcaaaaccaccacattgttggcttcttccttgctaatgattttgacccacttgaaggacaagctgcgaatatcttcgtcagcttccaactgtgccaagtagatggatcgagtaacgacaaatgcgttataagccgttaatgtattggctttataatgtgtcactataatatgtattaaaataaagatttactattatgtttttttttttttttttttttttttttttttttttttttttttgtggttgaccgtttatttcacatctagaagcttaaaataatcaatgctctttgttaaaatcatttggatgcgtgtgtcgaccg

SEQ ID NO: 2528 - DNA, 1189 bp, Diabrotica virgifera
agtaatatttaagtataagcgttgggtagtgggaaagctagtcgtagtttcggattagctgaggtgcattatagaatttctagggtgaatctgcttggctgatgaaagatgccaaatgtgtatatcgatgttcaagagggtggggttcttcttgttgaaaatcctccaggagtagtgagtgaacgatgagtttcggggaaaagctagactctgagaatcctgaatcgattgttgtccttgtggagtttggagatatccagttgatgtttcttatcaacgaaaatgaatcagagtttgaaccaaacggatggttcagacccagaattagcaaaagaattgcaagattctgtggcgtaattgttggaaaagtctatattcgagttatttatcgaagatttagcgttggataacctcctcacaagaggggtagccaaaatctgtgtgaaactcataattattctgcaatgaaacctcactgcttttacactaagtgtaattatatttactatcaaaacaatcaaagcaaataattattaatcaatatattaatctgaaaaaagttaaatttattttttaatcaccccaattaaataaatttattatataaataaatttaatactaaaaaaacttattaataattttataaaactctatagggtcttctcgtcttttaaaaaaatttaagctttttaacttaaaaataaaattctttataaattaaataaagacagtttttttttttcatccaatttttttgattataagaataaattacgctgttatccctaagcggacccgttaaggttttaacgaagatctgcacattttcgatagtatctgagggctcgacctcaagagtgatggtcgtacccgttaaggttttaacgaagatctgcattttggggtccagccctcagatactatcgaaaatgtgaaagctaatatccacgataaacagggaattcccccagaccagcaacgtcacatcttcgctggaaaacaactcgaagatggtcgtaccgtgtctgactataatattcacaacgaatcaacccttcacttggtgttgagattgagaggaggtgctaagaaacgtatgaagaagaattactccacccccaagaaaatcaagcacaagaagaacaacgttaagttagccgtattgaacttttaaaaggttgaacaaaa

SEQ ID NO: 2529 - DNA, 1231 bp, Diabrotica virgifera
agcaagagcggcttctgcagcatctattcttctggctgttccttttccttcttttctttaggtgtttgtggcttcttctcttgtttcttttcttccttcttcttacctttactttttttcttattagttttttccacaatttcagcatctccatttggtttagctttgttgtgagcagctggtgttgcagctgcagcagttaaagttccaggttgagcaactgcactgcaaagtttaacttctccaagtacagctatgaattgtggctggttaataagtgtattgaaccatctattgacgttaccaaaagattttctaaagttgggatcaagtacatatttgtaggcattcaataggttgcaggcaactacaatgtcagctagagtgattctctctcctaccaagtaagtgtgggcaagtaagtggctgttgagaatagacaaagaggatttaaggtcttcctttgctctttggaaagtctcatcattaccactgttatttttaacaattcccaagatagggaatacccaggcacatgctgctggaacaatttcaccttcagcaaagccaatccattgcaaaatttgtgctctatcatattcgttttttcctcttagttgttcattggaaacatagtaagcgatggcgttgctgtcttgaaggtacttgccatcgtttgattcaaaagcaggaacctttccacttggaaatttcttggtgaactctttagttttattagtttctccaaaaacaaaattgggtgctactttgacgtttgccttggcatattgtgcggcaatcagagtttttgcggcccggaaattttcgggataagtggaaagagttccggcagccattctcacatcattaccactgttatttttaacaattcccaagatagggaatacccaggcacatgctgctggaacaatttcaccttcagcaaagccaatccattgcaaaatttgtgctctatcatattcgttttttcctcttagttgttcattggaaacatagtaagcgatggcgttgctgtcttgaaggtacttgccatcgtttgattcaaaagcaggaacctttccacttggaaatttcttggtgaactctttagttttattagtttctccaaaaacaaaattgggtgctactttgacgtttgccttggcatattgtgcggcaatcagagtttttgcggcccggaaattttcgggataagtgtaaagagttccgg

SEQ ID NO: 2530 - DNA, 1002 bp, Diabrotica virgifera
ttgattcaaaaagcaaggaaccttttcactgggaaattttcttggtgaactctttagttttattagtttctccaaaaacaaaattgggtgctactttgacgtttgccttggcatattgtgcggcaatcagagtttttgcggcccggaaattttcgggataagtgtaaagagttccggcagccattctcactacactcaaaactagctaaagaagttctagatcgcggcgtccggtcaagtagttctttttacagcgtgttatggtggagtagtcgttgactccccaaaatgcagatcttcgttaaaaccttaacgggtaagaccatcactcttgaggtcgagccctcagatactatcgaaaatgtgaaagctaaaatccaggataaagaaggaattcccccagaccagcaacgtctcatcttcgctggaaaacaactcgaagatggtcgtaccttgtctgactataatattcaaaaagaatcaacccttcacttggtgttgagattgagaggaggtgctaagaaacgtaagaagaagaattactccacccccaagaaaatcaagcacaagaagaagaaggttaagttagctgtattgaaattttataaggttgacgaaaatggtaaaatccaccgattgagacgtgaatgccccgctgaacaatgtggagctggtgtcttcatggcagccatggaagacaggcattactgtggcaagtgcggttacactcttgtcttctccaaaccaggagatgagaaatagatatatgtccttgtatattgtttaagaaaaaaatagaaaaacctttgtttatttgaataaaatattcgaggaagaaaaaaaaaaaaaaaaaaaaaaaaaaaaaaaaaaaaaaaaaaaaaaaaaaaaaaaaaaagtataaatcaaaatgcaaaaaaaagaaagcattgaaaaaaaaaaaacgatcgtatcgaaaaatgggggggggtttttttaaaaagcttttttgggggggggcctcgt

SEQ ID NO: 2531 - DNA, 2009 bp, Diabrotica virgifera
  misc_feature (10)..(11): n is a, c, g, or t
  misc_feature (43)..(43): n is a, c, g, or t
  misc_feature (1318)..(1318): n is a, c, g, or t
agatctgctnnttcttcgtcggatgcaccttcttttaactgtntaatagctacttttgtatatccaggatgtgtttaagttcgaaagcttctccataatacaaaaatcaaaaaaaagcccccttttttttaaaccctgtttttttgggtttgaattttgattttttttttttttttttaaaatttattaacaattttgggattccaaatcgaattaagtccaaaactttttttattatatggaggggaactaaattttttttttaactttaaaatttctttttttaagttaaaccttatatccaggacacaatgataatctgttacttacgtaaagaaagaaaaaaaatgttgttagttatcatttcataattaatttatggatatattgtagctacttagagttagagagcctttttatatctagactaatttgggaactgttataaatagcagtcagttgcaaaccagatacatttttgaagtactgaaaatgaggaatacctcacgtcattaatattttcaataattataaaataacatttataattaacaagaatattgctaacacaaggtgttccagacatctccagattattgttcatatgtatttaatatcttggtttcacaactaaaactgtatttagcatgctggtcaaaacagttttttactctaaccatatatgcataaaaactgtaatgacaatgaaccacaaacatagtagtcaagatacacatttaattgtttacttagtaaagtttatgaatgtaaaacattgttaatgccaataaatattatttgcacatagtattcgcaaatatattaggccacatctattgtttaaaacaatatacatgctttgtctgaaaacatgacacttgcggtattatgtgctaattttgttagaacggcctcaatgtagctcataatctgtacttagcaaacactaacaatttaggtgcctatataagtgctactaccagagctctgcatagcttttaatgatgagaggcatttgtccttggacaaaattatttgtaaccaccggtctccgttggccgacatttcccacgttctgggtttgtggggtattatatccagtacttcttcgcgtactataagacatatttatagtaaattagtattaataatgtaattattaacaatgtatgaacgaaaaaacactaccgcttagaattaatactacgcagtaatatgccagcagtacgcaagtgacgccaagcctcctctagcaattaccttatttcttggaaattcgaatttgtcgtatttatgtacattcattacaaattccaantggtgtatactgactatttgttacttcttctttgagaatagtgtgagataacggactggtggcttgaagatctccaatttcttcatcccaacatgaaatatactttttgtaactcgccaatttggccttaagcctattggagctcataacaagagtgtaaaggaacattaagacgaatattactgctaatactaatacaaaaattacagtgagaggattcctttcttctggaactgtaaatgtaataaaagacggataattacatccatcatagtaaaatcttgcagttattctgtagcttacactttctttcagatctggcagagtaatttccgctccatcatcactaacattacattgttttacttgacttggagcagtactattatcatcgcgtatatagtatacatccaaaagtgtcaactcttcattggatagtttatcccattttaaaaagtatacatcgtcatgcactggaatgatactacttaattgatatggggacgattttgcgcatttacatttatcttgaacacaatctggtatttgatatattaatgtttgttctaaattctctaaaagatcatgagtttcaataattatttcatattcgcagccatttactaaattatcagcagggttggccaaatttaaggatggaatgatgagagtttcactctgtttcacagag

SEQ ID NO: 2532 - DNA, 1851 bp, Diabrotica virgifera
gggggggaagaatgttaaaaattaatgagattttttttctcttaaaacccagaccttttttggctttgccccttttttgttcttttacgtttttaaaaattaatacgggtcaatatgtccttcacaaattttttttccttttcaacgttactactttccactcccttctttcccctttaaaatattgcagaaaatattaagaaaaatcccaatactttcttttttagggtcgtccatttttcaaccgttatatacaagtttttgatgtttttttaagtatccagtggctccaaataggttggtaagctgattccaaattgcatggtaagaatcgtctaaggaaattctttccagtggatggcatgctgctatccagccggtgtgggtgagtcagtattgctgtcaatagtgtactcataaaaaatttagtttctttggtttcaagtttctccaacacctgacaaaaattttcaaatctttcttctctaacgttactcctgaatatattgcttggaaacgtaagtttattgagactgtttctcaagcttatagcgaagtttaagtgaaatttactctgaggttcattccctggtttgctccaaaaatttagttcgtgcgataaccatttagcgctgagaagagatatttcaagcatggttgataagaataatcgtggagagttgagagctatttcgacgtattgacgaacacgccataggatggattcaatcaatggtatatgttgtaggtatatgttttcttcgttatattcaactataggcttgggtactattaaagctagtcctagtttcgaatagctcacgttcattctaaaatttctagctgaatctgcttcgctgaggaaagatccaaatgtatctaacgatgtacaagaggttgagcttcttcttgttgaaaagcctccagagtactgagtgaacgatgagtttcgggaaaagctagactctgagaatcctgaatcgattgttgtacttgtggaatttggagatatccagttgacgtttcttatcaacgaaaatgaatcagagtttgaaccaaacgatggttcagacccagaattagcaaaagaattgcaagattctgtaaacgaattgttggaaaagtctatatttgagttatttaacgaagatttactgttggataacttcttcacaagaggggtagagaatacttgtgtaaaaatcaaacgatctggaaaagaaacatcatggattttaaaataagtgtcgtgatatttcatcgctgtagaaccaaagatcatttctgtcagatgggaaaattcttcaggtttgttcttttcctctttcgtcggaccattttggtcttttgtttcacgatatgagtcaaaaatcaattctcggtctcttaaacgacattctttaaataaaagaatgcggattctgtttgaagagtataagtttaaattttcccagtattgctcgtttccgtaaaaacaatcatttttctttttactttttagaaaattgttcttgttagccattaactcattcggccgcccgggatctagaactagcaagtaaagataacacaatatcagaagaattagaagaaagtttaaatatcggagagaatgacactgatgacgataaagaaatgaaagctattaattctagcctaaaaaacaatgcaaaggaagtgaaaacattacaaataaaagccaaaaagacaaaaaatattgataaaaacaaagaattcatggatttactagaaagcgatgaataatttataaagccattccttgaactcatgaaacagatagaatatgtacgcacatgacccaaaaacattaggttaaccggacgcgtaaag

SEQ ID NO: 2533 - DNA, 2820 bp, Diabrotica virgifera
  misc_feature (883)..(883): n is a, c, g, or t
aaaaccccccacaaaaaaaaaaaaatttgtttttttttttttttagttttaaaagaaaaaaaaaaaaaaaaattttttttttttttttttttttttttttttttatcaaaaaaagaagggggggcgcccccccacaacaaaaaaatattattttgggggggggggcccccttcttttttttttttttttttggggggggggggggggggggggggttttttttttttttttttttttttttttttttttctctcccccccccccccccgggggggggggcgcccccccccccaaataataatttttttgggggggggcccccccccccccccaaaaaaaattttttttttcctcaccaaaaaaaaaaaaaaagggggggggggggggaaaaaaaaaaaatttaccccccccctcttttggccccccaaaaaaatttttttaaaagggggggggaacaaacctttttttggggccccttaaaagggggcgggggccccaccaaaaaggcaggggggggggttttttttccccccccaaaaaataggggggggaaaataaaagtgtctttaaaaaaaaaaaaaaaagggtttttatgtttttccttttttttttggggaaaatttctccccctttccccccgtgtttttttttacaatttccccaaaataggggaaaccccgggcccctttttgggggacacattttccctttcgagcaaaccaatccattgcaaaaatggggccttaaccaatttccgttttttccttttagtgttcaatgggaaacattattaagggaaggcggttgctttcttgaaaggttcttgccatcgttttgattcaaaagcagggaccttttccacttggggatttttctggtgganctctttagttttattagtttctccaaaaacaaaaattcaatcaaatgggtatgtgtatatatgttttcttcgttatattcactattagggcttggtattaaagctagtcctagtttcgaatagctcacgttcattctaaaatttctagctatctgcttcgctgaggaaagatccaaattctagatgtacaagaggttgagcttcttcttgttgaaaagcctccagagtactgagtgaacgatgagtttcgggaaaagctagactctgagaatcctgaatcgattgttgtgcttgtggtattttgagatatgtgtattttttttttttactagttctagatcgcgagcggccgccctttttttttttttttaaattgttattaaatttatttaagtgtcttataaactcagggagtaaagcccaaagaataagcttcgatcaaaacaattacatattaataaaaaaatattattaacaaaacattgggatttatttctcttgcttcacatgatcagtacagcattttgtaagatttattaaatagatgtagatcatttaaagatttttccttgattgaattttctaccttgtttgtcagtacctgtccatgagaagtattgctctactaatttctttgtttcttctgatttggcatctaacttcttccattcataggattcataatctatttgccagtcgggacttaaggtaaaagctaattcttgtcctctccatacccagataccggagattgtgctgttgttgtcttctccaaaaaggcatacagatgcaaaggcctgctttctcatcttatctagtctctgttgcatgccagtaattaggttacagctcatgaacactttggagagctcttcagggtatttgtattcaccataccagattgaatagttttcagggtcgaatttttcccagaaataagcaattgatttgctctcttcttcatttgaatagacacgtttaaagtcatccataacaaaggttcctttaggtagttcagaaaaagggtccttactcttgggttcttcagcaagagcggcttctgcagcatctaattcttctggctgttccttttccttcttttctttaggtgtttgtggcttcttctcttgtttcttttcttccttcttcttacctttacctggtgttgcagctgcagcagttaaagttccaggttgagcaactgcactgcaaagtttaacttctccaagtacagctatgaattgtggctggttaataagtgtattgaaccatctattgacgttaccaaaagattttctaaagttgggatcaagtacatatttgtaggcattcaataggttgcaggcaactacaatgtcagctagagtgattctctctcctaccaagtaagtgtgggcaagtaagtggctgttgagaatagacaaagaggatttaaggtcttcctttgctctttggaaagtctcatcattaccactgttatttttaacaattcccaagatagggaatacccaggcacatgctgctggaacaatttcaccttcagcaaagccaatccattgcaaaatttgtgctctatcatattcgttttttcctcttagttgttcattggaaacatagtaagcgatggcgttgctgtcttgaaggtacttgccatcgtttgattcaaaagcaggaacctttccacttggaaatttcttggtgaactctttagttttattagtttctccaaaaacaaaattgggtgctactttgacgtttgccttggcatattgtgcggcaatcagagtttttgcggcccggaaattttcgggataagtgtaaagagttccggcagccattctcactacactcaaaactcgcgaaagaaagaaaaggacagcattattccggatttttttttcaaaattgggagctactttgacgtttgccttggcata

SEQ ID NO: 2534 - DNA, 4802 bp, Diabrotica virgifera
ggtcaccttcgaaccagtcttattggcccaaaatggcttcttctttacttcagttgagtctgaaccattagttgcatccatagattgatccgcatcatgctttatttgttgtgcttgcgtactgctggcatattactgcgtgggattaattctaagcgtaagagattttacaacactttatatgtaataagtgctcgatgttacatttgaacattttgatttagcatgtgtctattcatctgcaccaactcgtaatacgattgtttagcttcaatactgtcgttgactccccaaaatgcagatcttcgttaaaaccttaacgggtaagaccatcactcttgaggtcgagccctcagatactatcgaaaatgtgaaagctaaaatccaggataaagaaggaattcccccagaccagcaacgtctcatcttcgctggaaaacaactcgaagatggtcgtaccttgtctgactataatattcaaaaagaatcaacccttcacttggtgttgagattgagaggaggtgctaagaaacgtaagaagaagaattactccacccccaagaaaatcaagcacaagaagaagaaggttaagttagctgtattgaaattttataaggttgacgaaaatggtaaaatccaccgattgagacgtgaatgccccgctgaacaatgtggagctggtgtcttcatggcagccatggaagacaggcattactgtggcaagtgcggttacactcttgtcttctccaaaccaggagatgagaaatagatatatgtccttgtatatctattaataaaaatttttgatttggaagattacaagtgttaaaatgcagaaatacaactgcaacatctttactttaaatcccaaggctacaagacttgtgtcccaacaagacacaggattaatcctaccaatgtgccataccaactactacgtttacaatgttggtaagactagtgtaaaggttactgtcaaagcaggaacaagaattatgtggatcagaaatgtgaaaaccctaacattggaacctggccaagatgcttaccttgatatgtccaaaaccaagtgccttgtttcaggtgtggacttaaccaatactgaagacatcagaggctacgtccattgctgccaagttaccggctaccccttctacgacaatagcgactcttcgattccaattgacattaatatggtttccaaaatacttacttcagttggaccagcagcaataccaaaagctgcagatgatctatcaaaaattatacatattttctggccagaaaaccaagagtcactgtgggagaaaatcaattctgtcatacttcatctgttagacacctctaggcaagagcttgttcaatccgtaatcagtaaacttgcccaaatagcagaaagacttagaacggtaatgcatgaattagaagaaggaaaaccaacagttcagcagaaatttttgagcattctagaagatctggtggatttccaaaacaagtttagacttgaacgaagagaaactcaagaaaatcttagaccaagctacaaactgcttccttattattctgctgttgtgaacttgaggcttaagatcaatcagttcgctataattaaccgagataagcttagtttggatgaagctgccgtcaagcacattcaggtgtggtctgataacctgataaacgatccagaatcgggagcaataggatatattacctccctttccaaggatcggcttgagatggaatacaaaacatgttatgcagaactattgtatgacggtcttgtaactgttcgaggttactgtatccttagcggattgcagttcttcccgctctggaaatcaattgtagattatccaaatagcacagaggagccctacaatgatgtcatcatttactcgacgtactggggtagagcaacacctagacttcacaggcaaatggtcacagaagaccatgttccaccagtgaaaccagctttggtgaacggtaaacgtaaccaaccaacatctattgttgtttacactttgaaagataaagtgtctggtgatccagtcatttctggtcttactgttcagtatgaaaacggcgaaaaaagtgttactggcaaagtgtctcccgactttcaaataattgagtttgatggaaatcatgtaacttctgttagtgcttatggttggggacaaattgacggtctcaaattttcattctgcaacggtcactccgtaactgttggaactacatcgagcgataagcatgaataccatcttcaaaaccaccacattgttggcttcttccttgctaatgattttgacccacttgaaggacaagctgcgaatatcttcgtcagcttccaactgtgccaagtagatggatcgagtaacgacaaatgcgttataagccgttaatgtattggctttataatgtgtcactataatatgtattaaaataaagatttactattatgtaaaaaaaaaaaaaaagggcggccgctcgccggacgtttttgtgtggttgaccgtttatttcacatctagaagcttaaaataatcaatgctctttgttaaaatcaaaaggatattcgaaaatacgtatctgttagtagtttggcaaaactgaataaatgtagatataaaaaaaattttcgggccaattcacaaccaaaataaatttgtaatttatttttacagttaactaaatttggctttactacacaacatgaaacacatttttctaaaatgcaaatgtaaaactttgccagaactacgtataaaaaaacagtaattgttttaaattacagatttacgtttttgtaccttctgcgccacataaaaacatggaagacaaaaagttttcagttttttattgcaatgattttatgatgttattaagttttgtttgccttcagttagtctcatatgccaaattaattattaaaaattaacattttgtactcctaatttcgacatcacttttatgtgcctatatcatatactcttaattcagattttttaaacagaggtttaaatttgtatagctgctacggaagttcttcttaggaacttgctattgtttgttcacaaatctggcagttatagcatggttttcagaatatatgcaatttctatccaattaaatttttttgttaaataaaccaaagatacattaaaaccacttgacttttgtaaaatattgaattgttgttcaacatttttgtactaatagaaaatgaaacaatctactttttaacttccacaaatattacaagccgaagttacaaaaaatgagaacaaacatgacttaacatctacctatcttatctatgacttaacagcattaactagtataatcataaaaaaatgtgtgtatgaataaaaacttaaaataaattcttaaaatactaggtctgaatgatactgcacattatacattaatacaataaatagttatgtaaaatccgaatacataatgtatatgtcattaatataaatgaattacttagttgatacataaacatctggtgggtattgtatacccaatactttgctgcaagctccgaatgcagccattttctttgcagctttcttgttggaacctgttccaataaatgattctccatcaacaatacatttgaatgaaaaaagaacatttggaggatttccagtttttccaatttcctcaaattgtgcttgtggtagcatctgattcacaagcattaatggattaatagtatctggattttcaggcattttcttagcaggcttgttttcatgcagtttttctccactaggtattgactgattttgattgacattgagatcttctccccatgaggaaaacagtttgtacagagcaaatgaagcaacatgttgccatggtaaaggtgcttgagttgcgtcatcttcagatacatccattttttcatttccttcatcatctttcttcacctcagtcaatttattagtctttacataatgttttaatgcagcttcggcagctgtgttctttgcatttattttactacgaccataaccaacatgttctattccttcatataacactgtagctttaaattggttgccatcatatttctgggataattcatcaactgtataactagtgtttctcactagttcgtttaatatcataacagcattcttgggttgtaatattttgcttaatctaacattgcgcctacgtactctttctcttttggtcaccttcgaaccagtcttattagcccaaaatggcttcttctttacttcagttgagtctgaaccattagttgcatccatagattgatccgcatcatgctttatttgttgtgcttgtgcctgctgttgtagtcttgcagcatttgctgctgcttgtgtggtcgcagcttgttgatttgcttgtggtgtctgttgctgagccctgaactgaattcctgcctgtggagttgtagcctgtggtcttgcagtagctggtgttgttggtttattttgttgtacctgctgctgctgctgctgctgtggtggtttttgttgtccttggacaaaattatttgtaaccaccggtctccgttggccgacatttcccacgttctgggtttgtggggtattatatccagtacttcttcgcgtactataagacatatttatagtaaattagtattaataatgtaattattaacaatgtatgaacgaaaaaacactaccgcttagaattaatactacgcagtaatatgccagcagtacgcaagtgacgccaagccaaatcaaaaaaaaaaaacccaccactcgcgatctagaactagtcgg

SEQ ID NO: 2535 - DNA, 919 bp, Diabrotica virgifera
gtggacgcacgcgtgttgacaagtttaaagttcaatgtccaactccaacttggttttttggtagtaatataaaataattagttttattccacttgctgatcgagacagagatttcattttatttttaaaatgtcagacttaagattcgacggacgtgtggtcgttgtcacaggagctggagctggattaggaagagcctatgctctactttttgcttccagaggagctaaagttgttgttaatgacttaggaggcggaagacatggagatggcagctcttccaaagccgctgatactgtggtagaagaaattaaaagaaatggtggcactgctgttgcagactataactctgtagttgaaggtgaaaagatagtgaagactgcaatcgataacttcggtcgtatcgacgttttgatcaacaacgccggaattttgagagataaaagttttgctaagatctctgatcaagattgggatttggttcataatgtacatctgaaaggtagttttaaagcaacccaagctgcttttccgtattttaaaaaacaaaactatggccgaattattatgacatcttccaattctggaatttatggaaactttgggcaagcaaattattctgccgccaaattaggtttggttggtttggcaaacacaatagccatcgaaggagctaagaataacgtttattgtaacgtgatcgtaccaacagcagctagcagacttactgaagacattttaccaccagatgtctttgctcaattaaaacctgaacttattgctccagtagtggcttatctctgtcatgatagttgccaggataacggttcaattatagaatcagctgctggttgcgctggtcgatgtactatagttagatcagatggtgccttattacgtaaaaatctcgccgacggcg

SEQ ID NO: 2536 - DNA, 1258 bp, Diabrotica virgifera
  misc_feature (1193)..(1193): n is a, c, g, or t
cgggcgcctttatttgtccgataaaataatcacttttattccacggacgcgtgggcgtgggtgttgatcgagacagagatttcattttatttttaaaatgtcagacttaagattcgacggacgtgtggtagttgtcacaggagctggagctggattaggaagagcctatgctctactttttgcttctagaggagctaaagttgttgttaatgacttaggaggaggaagacatggagatggcagctcttccaaagccgctgatactgtggtagaagaaattaaaagaaatggtggcactgctgttgcagactataactctgtagttgaaggtgaaaagatagtgaagactgcaatcgataacttcggtcgtatcgacgttttgatcaacaacgccggaattttgagagataaaagttttgctaagatatctgatcaagattgggatttggttcataatgtacatctgaaaggtagttttaaagcaacccaagctgcttttccgtattttaaaaaacaaaactatggccgaattattatgacatcttccaattctggaatttatggaaactttgggcaagcaaattattctgccgccaaattaggtttggttggtttggcaaacacaatagccatcgaaggagctaagaataacgtttattgtaacgtgatcgtaccaacagcagctagcagacttactgaagacattttaccaccagatgtctttgctcaattaaaacctgaacttattgctccagtagtggcttatctctgtcatgaaagttgccaggaaaacggttcaattatagaatcagctgctggttgggctggtcgatgtactatagttagatcagatggtgccttattacgtaaaaatctcgccgacggcgtttctttagaaaacgttagggataattgggaagctgttagagacatttccaatgctaagaggttagaaaatatgcaggaagtaaccatggctttagtgacgtcctttacaaatgaagagtccggaggaaatgctgaagtttccgacgtgtttaattattgttctaaggacactattttatatgcattaggagtcggtgcttcagttgcaactaaggacgaactcaggtacctgtacgaaaccatgaggacttttcagttttaccaacctttttcatcatgcctgctatgcaagttttatttactantccattcggtgatattattcctggtaagcaagttagtcttgaaaatatctcccacgcgacagtac

SEQ ID NO: 2537 - DNA, 1732 bp, Diabrotica virgifera
  misc_feature (1638)..(1638): n is a, c, g, or t
  misc_feature (1655)..(1655): n is a, c, g, or t
  misc_feature (1694)..(1694): n is a, c, g, or t
  misc_feature (1699)..(1700): n is a, c, g, or t
aggatattataagacagatgacggccggacactcttgaaacttcgggtgattctcggaatcctaatattcctgttttcatttatccccaaagtggcttttccccaaaatgctaagatttattaaaaggattcctaataaaaaaaattggaagaactgtaccccagcattgacagtatatcgctctataaattataattataataataatgcaaactataccacatcaggaagatcctacagccaaggctcaaaacattccgagcaaggtgggggaggtggtggtaaaggatttttcttaacagttggggcattgattactgctggaggagccaccttggcatatgctaaatatgatccagatttcaggaaaaccctggtaggctttgtacctttcacggatgatgtaattaaaacaatatggcaggaagataatctatattcaagtaatagcaatatcctatcttcgtattatgaaagttcaaagaaggccatctttgatctattcacaggcaaacctactacagaaagtaaatacattagttctaaagaaatttctgagttgccatcatcagaggtatataaagctcctccgccaattctaccagtaatagaaaaagaaatgaaaaagccgcctccgcctagctatgctgaaattagactagagaaaatagaaagtgggaaactagagcctgttgtggaactagctggagaaccaaagcccaaacctatcacagtagccactgatagccctaccaccgaaaacttagcaaaaccacagtagctactgatagccctaccaccgaaaacttagcaaaacttgaggaaaacatccgtgtatccgcagaagaagccgtgaacgctttcaacaaggcagtttttattataaaatcgtacaactcagacatagagtacatcatagaggaagcagggaacgaagttaaaccagagacgtgggatacacttaagagcaagacgagatctaagcacgagtgtgtaagacgagcgacagaaaaagctgaaatcgctgttagagacataaacaaattaaaagaaattgtttccaaaccatcattcgatgctgatcccattaccaaacagacgatccaaagtaatatcagcagagttcaagaagacatagaacacgccaggagggaatttgaacacgaacaaaagatgggcagcgtagccgaaaaatactgggacaaagtagaaaaagctagacaaaacttttccgaagaattggagagtctttttcctacgatagatctttcgaaaaaacacctctgcataaatgaagaggacttagatctttttgttcttcacacatatgcccatgtactttattatcaaaaagagttggctaagatggaaaccatcgttcaagaacgattgagaaatgccacggaagtcgccagactagggggcggtgaagttttgaacaacgctcaaatttgtgaggcagtagaacaagagaagaggaggcttacattatgtttccaacagcaggtattgaagttaagaaaacaacatgagatagaacttcgagaagcacttaagaggcaatctcagacgttcactgaccatttagaggaagcagttagaagacgcgctgaagaaatcgaaagggaactgactanaaaatacgacgaattgntagaagaagaaagggtgcaggctaaatttcattggcagncattnngtgggcgtctaaagggactagatgaagctata

SEQ ID NO: 2538 - DNA, 1571 bp, Diabrotica virgifera
cgtaacagaaaataaaaatttaacctaaaaagctataaaattacatttttaaataatttaaatttaaatgaattaaataagccttgtctatttattaaactttctatttttctggttacaatttaatttctcacgtgatcattgcctttcagatctgttactcatttgaagtttatcagttctgagctaaggatattataagacagatgacggccggacactcttgaaacttcgggtgattctcggaatcctaatattcctgttttcatttatccccaaagtggcttttccccaaaatgctaagatttattaaaaggattcctaataaaaaaaattggaagactgtaccccagcattgacagtatatcgctctataaattataattataataacaatgcaaactataccacatcaggaagatcctacagccaaggctcaaaacattccgagcaaggtgggggaggtggtggtaaaggatttttcttaacagttggggcattgattactgctggaggagccaccttggcatatgctaaatatgatccagatttcaggaaaaccctggtaggctttgtacctttcacggatgatgtaattaaaacaatatggcaggaagataatctatattcaagtaatagcaatatcctatcttcgtattatgaaagttcaaagaaggccatctttgatctattcacaggcaaacctactacagaaagtaaatacattagttctaaagaaatttctgagttgccatcatcagaggtatataaagctcctccgccaattctaccagtaatagaaaaagaaatgaaaaagccacctccgcctagctatgctgaaattagactagagaaaatagaaagtgggaaactagagcctgttgtggaactagctggagaaccaaagcccaaacctatcacagtagctactgatagccctaccaccgaaaacttagcaaaacttgaggaaaacatccgtgtatccgcagaagaagccgtgaacgctttcaacaaggcagtttttattataaaatcgtacaactcagacatagagtacatcatagaggaagcagtgaacgaagttaaaccagagacgtgggatacacttaagagcaagacgagatctaagcacgagtgtgtaagacgagcgacagaaaaagctgaaatcgctgttagagacataaacaaattaaaagaaattgtttccaaaccatcattcgatgctgatcccattaccaaacagacgatccaaagtaatatcagcagagttcaagaagacatagaacacgccaggagggaatttaaacacgaacaaaagatgggcagcgtagccgaaaaaaactgggagaaaggaaaaaaagctaaaaaaaacttttccgaaaaattggaaaaactttttctcaaaaaaaaaaattcgtttaaaaaaaaaaaccttaatggaaagaatttttaattttaactttaaaatttttttttttttttttaataaaaaaaaaccccaccctcccctcaaacaaaaaaaaaaaaaaaaaaaaaaaaaataaaaaaaaaattatttctttctttttttt

SEQ ID NO: 2539 - DNA, 699 bp, Diabrotica virgifera
ctgtggcttaggcttaattcatttttggtttttattttattaaattgtcattcattgtgttatgtgtttcttttctgtgcaaaagggttctaactttctaacaaagatattaaaaacaaattttgtatttaaataaaaatatttactgtaagggacctacaaaatgtttcaatttggattcaacatgtttcctgaggtccccaggccttttaatatgacttataagtgctactcagtggctatgtttcctggcaatgaacgagaagacgttgaaaggggtggaaaaattattatgcccccatcagctttggaacaattgactaggttaaatataaactatcccatgttgtttaaacttgtgaataaaaagacacatcgcacaactcattgtggagttttagaatttgttgctgatgaaggaaaagtttatttgccactttggatgatgaacaacttagtactgactgaaggagatttggttcaaatggaaagtgtttcccttccagttggcacattttcaaaattccaacctctcaatccagacttcttggacattactaatcctaaagcagtcttagaaaatggatttgagatcttttgccttcctcaccacaagagatgtcattgcagtaaagtacaatcaaaaagcttatgagttgtgtgtgccagaaaccaaacccggagatgccattagtatca

SEQ ID NO: 2540 - DNA, 792 bp, Diabrotica virgifera
ctacttcttctcttctacttttacttttattgtgttgttctcgtggtttctcgtgtagcgtataaataatgctggtattatataaatctctctatacacattaggtagttttaatttaaaatcaaagccaattgtttgtataaaatgaataaaatataaactataacaatgcacaccatgacaaataacatgttttagaaatgttttgccgtgaagcaattaatgtaaacttacaacaaaaggaaacaatacttagctacattttaaacggggcttacttaagctagtcataaaaaaaaagcaaactggacagttccaacattagttttgcttgcattccttaaattgaatattgttaaaattcattgtagattttttgttatttgttatatgtttgatcttgtaattatttaataaagtttttgaactatcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggggccccccggatttaaaccccccccccctttttttggttttttttggaaaagaattttgggggggggttttaaaaaaatttttttttttaaattttttaaaaaaaaaaaaaaaaaccccccccccggggggaaaaaaaaagtgcccttttttatttaaaaaaagggtaccggtttggggaaaaggggtttttggggggaaaggaccccccggggggttt

SEQ ID NO: 2541 - DNA, 983 bp, Diabrotica virgifera
gagaatatgtaaaaagtatgttatataaagttaatggtaaataatgtataagaaatacaggaaccagggcacatcatagatctgggaaacaagctccgagaggaacagaagaaaagggcagaactggtccaagagatccacaacttaaaagtccagttgatgcagtgcaagagcaacgaaatgacgacttcggtagatgaaatcgccgaccaactcaaaagggaattggacaactctatcaaaatcgattccaacatcatgagcgccgtcagtgaccagagtttgagttcgatttcggaagtgcaagacgtcgaggcttacaaaaagtctttagccaaggaaaaagcctgtaagaaacagctccttgaactagtaaacacgttgcaagacagaataacgacattgcaaaatgatttggagaaggaacgtgccactctggtgtgtaatagtacagaagacgcccaatgtattgaacagctaaggatccagctagatgccgccttggaggcgaacgaagccctcaaaagggctatatcagaaagagaatcggagaatgaacaattggaaaaggatttagaatctctgaagagaaagaatataagttcagcttccagatcagaatctacgaaatacaaagagcttcctagcaaggaatccatagctttgaataagctgcagaaagaccacgacgtcttactgggcgaacaaagcaaactcattggtgaattagccggtttaagacagacccatctggatatgacgacagattataaatgcacaaaggatcttttagctctggaaatgcaaaggaagaaaaatttaggaggggaaggtctacagtttgcagatgcgagaaagggaactgacagagaagcttacgcagataacactggaaaaaggaaagagttgtagacgaaatatcgccaggaaagggcgacctcatcaaacaaaacttgaactgcttcaaagactgaaatcccagc

SEQ ID NO: 2542 - DNA, 1050 bp, Diabrotica virgifera
cccacgcgtccgaattatttaccttggatatcatctaaattgtaacgcagagagtcacggtaaaattagatccagaatagagcaggccaaagccgcttttacaaagatgtacaagatgttatgtaacagagatctaaaattggcattcaggacccgcctacttcgctgctccgtgttcttggccttagtttaggatatcgagtcttttatttatttatttattttgctcaacaggccatgtaggctctgggcgtgaaaaacaattacattttttcctactatacatatatccaatatacaatattaatttgtctattaaaaaatacatcatataaatatatacatatatatatctatatagctctcattttacaatgcatggcacattcttctgttacaatttctcttgcgctcttcttaccactcccctccattcttttcggtctaataccttgtgtctccagttatctatttttatttctcctaaatctgcttggacgctgttaaaccatcttttacggggtcttcctttccttttttccctactggtttcctgttcaatatcatcctggtcattctatggttttccaatctttgcacatgtcccagaattcttattctatgcgcctttattattgcggtgatttttggttccgtatacagctcttccaactctttatttgtccttcttctctatcccatttgtgtatttatgcctccgtaaattgatcgaagaattttcctctcccatctttctaatctttcttcatctgcctttcttaaaacccataattctgctccatatacaaccgtagctctaatcactgtcttataaattctttcttttgtttttcttgaaacaaacttagacttcattaaggatctcagcattccgtatttctgagtaccttttgtaattgtgaattatatttctttatcatcatgaccattttcctttactttgacaccaagggaatttaactcttccactctaggtaggctgtgtatgtaatatgtttactcttgtatttttaaaaactataaattgtg

SEQ ID NO: 2543 - DNA, 1404 bp, Diabrotica virgifera
tccaactagtcagaatccagtgcagcaaccgataccaccagaaccgatcccacaaaatttaacaaataactctccagtctcaccccatattcagcaaaatgaattcaccaacacaaacaataccacagtggtagcatcaaataataacgggacagtttccagtacacagtctaccaatacaattggacaaaacttcactggtgcaagtggcacttggaatggttctaacactctaacatacacacagtctatgcaaccaccagacaacagaagtcatactgcttactggataagttcacccaaccagattaactcggaagtaagcattggcggtttattatctactcaacctgctccagaatactggtgttccgttgcttactttgagttggatactcaagtaggagagacttttaaagtgccatcaaattgcccaaacgttaccgtcgatggatacgtagatccttccggtggcaataggttttgtcttggggccttgagtaatgttcataggactgaacacagcgagagggctaggcttcatatcggcaaaggtgtgcagttagatctcagaggtgaaggtgatgtgtggttgcgatgtttaagcgaccattcagtttttgtacaaagttattatttggatagagaggctggaagacaaccgggggatgctgtgcataaaatttaccctggagcttatataaaagtattcgatttaagacagtgccatcaccaaatgacaacacaagctgctaccgctcaagctgctgccgcagcacaagccgctgctgtagctggacatattccaggaccccattcggttggtggaatcgctccagctatcagattatccgccgcgaccgggataggcgtggacgatttgcgtcgattgtgcattttaagattaagtttcgtaaaaggctgggggccagattatccccgccaatccataaaggagacaccttgttggattgaagtgcatcttcacagagctttacaacttcttgacgaagttcttcacacaatgccgatcgatggaccgagacaataggatgacaagtgtgtatgtcattaaggcagaaattgtttaacttcctagttttgaaactgatgaaattcttgcagatactcacttaaaaaaagaatttttgctgaaaagataaaagacaagatatttttataaaaaggtactgaaagattcataaagaattgtgacaaatattgacatcttcaactagacgtaatcgaagccaaaaatcaagaaggaaatatacaaaagtataatcttggtacagtcttcttgtaaacaatcttgtattggtatattaatatgttatctatatcagatgagttcttttcttctgacttgaaagaatcgagtacagatttagaaaatactataaa

SEQ ID NO: 2544 - DNA, 1136 bp, Diabrotica virgifera
gattgtcatgcattggaacctactgaagttccaaacttaatggacatcttactaaccttaccaaaagatatagatactgaggtgttgcttcggagaattgaaaaacagaatgaaaatgtcgatacatcaaagtggaacttaacaagcaagaaaactgaggaaggtgctgaactaaaaattgtagactctgtaccgaacacatctaaagatatctccaaagtgattgttcctaagaattatccattagaatttttcaatactgaacagctagataaattacaatcagacatcttgaaagaaattgataacataccagatggaagttttatgccgcaattcttaagctgtcttaaggaaaggggagcattgaaattcaattgcaataacttggcaagtgctgaatggctaagaactacagttcccactttggagaattggaaagatgaagatgtttcaatactagatcctgaaacagtaccagtaagaagcacattgcagctgtggataccaggagcagttgaagaaccagagcaagtcttagaacgtctggaacggcaaaataagggattagataccttaaattggcaagttttaaacaagaaagttgaagaaggcggccaaaaactatttgtaacagtgcaagatcacgtactagacgctctgaagaaaatagattacaatcctttcctaaacttcactagggttaaagttaagcgcccacgcaggcgcccacgcggtgagaagaaagatgagaagaacgaagatccagacactgcttatatagaaacaaaagaagatccaatggctggagatattggtgagttcacagctattgatgaaattaaagaggaagaagaagataaggcggtgccagctgcaaatgcttaagtgatccattcaattttaagcagttcaataaacaaaaattaatagttagaaaacaggacattacaatttttcgagtttaaccatttcaattttaattcatattatgagtcagccatcattcatcgtcatattttttactataatttaattctacatttcaaggtcattcatacctatggttgaggagtaaacctcgaaataaaaaaaatccccattactacggtgtaggtaatcgtgctaaaagtatg

SEQ ID NO: 2545 - DNA, 1420 bp, Diabrotica virgifera
aattcttgtgtcagaaggtgcagttttttgtcctatgaataataaaaacgtggtactataaaaagttttttttataattatttcaacatagtcttctttgagttccataaacttagtccaacgattctcctctccaacgttttatcccttccgaagaatatgattggtcgaggtcatcaaaataggcatttgtttgtgagatgatttcctcattggagttaaacatctttccaccgaaccatttcttcaagtttggggctcaatctcacatagtcactcggggactcacatagtcactcggggccaaatctggggaattgggaggatgagggagcaattcgtagtctaattcatagattgttttgtaacaattataaatttctgttaataggtagcaccagatctccaatacctacagcaaccacaggcgaccaattctttaatgcacatgataaatcaaatgcaacaaggcaataaaattccaggacaaggattggtcgaaaaacaaccaaatttacctggtaccttagatcctcatatacaaatgcaaatgaataatcttctttctatgcaaaaccgtcttccgacgaccagtcacccaaccaatattcccgctggtctcagtaatactctacctgtaaatctgccacaaccagaaggattatcgtcaagtatgcccagtttacagacacccactcttaacacggccgcaatgcctataccaggtatgcagagcaatataccagtcagtattggaggaagtattaatctaccaagacctacttctcgaagttctgttgaacaaatctcttcgactcaagctagcgatcccataacgagcctacttaagcagcttcaacaacagcaacaacaacagcagcagcagcaacagcaacaacaaaagcaatcgactcctccacaggtggattcactgtggcaacaaaatacatttaccgccaacaacggtacttcgcaatggcaaccccaaaacgaagtccccatgtcgatgtgggatctacaaaataatcctgtacctgctgttccctcgcctcccttgactcaatcggaaaaactgcaacaagcgttacagccgaagacttcgaaagccgacaaagagaaggagcagaaacaaaaggaagaagcagcggcaaaagaattgaagaaaaagaaagaattggaagagaaactggcgaaaaaagaggctgaagaaaagaagaaactggaactccagcgacaagaagcggaaaagaaagctctcgaggagaaaaggaggaaggaggacgagaggattaaaagggaattgtaaaaggcaaaaaaaagaagcagaggaaaaaaggctgagggagttagaggaaaaaaaagacttaggaaactgaggaaagcccgaaaaaaagggaaaaaaaaaagtgaacaccaaaaa

SEQ ID NO: 2546 - DNA, 1736 bp, Diabrotica virgifera
gcacctgacagcaccttgcaatcttttaaattttgtaaatatttgaaaaaattataataaatatagttgaagataaaatcgtccaaacaataattaataataatgacgtccacagtgaaactaaaagaagcctttgaagttgaatcaaaacatggtgcattttacacaggaggtaacttagaatggatagaagacactatatattgccaaaccaatgcaaatatcaacgtgctaaacgtagaaacaggactaatcgataaagtaataggggaacaaggtgccgaagaagaagataccatacaaacattcaccacagacggcaatagaactgttacttcacacaaaagtggcttgttgaagtcttggaatcaaaacggtgagctggaaaaaatgtggaaatatatacataaaggacctatagctagactaaccttaaaagctgagaaactggccagtggtggttgtgatggggttgttcggatatgggatcttcaaaaccaagtatgttctttgagccttaaagggtgccaaggggttgtaaacgtagtagaattccatccaggtgaagacgttttatttgcttctggtgacgatgggaaaattaattcctacgaattaaccaaaggagaagtaaaaacaatatatgcaggacattatagtaaggttacaggttttgtgtttgctagagagaactattttgtgtcatgcggtagagataaagtaataattttgtgggaagtaggtaaaagtgagggtatcaaagtaatcccacaattcgaagcaatagaaacgataacagggttgcctttgaagtttaaggttcctggttttaaatcagaagctgatggtatttacgttgcagcagctggtgaaaagggtgtagtttgtgtgtgggatgttaaaaaggctaaacaagtctatgtccaagataattctctagtaagtaaagcttctgaagaaggtggtttatcagtagtattgcttagatgcaatcttaaagacaaagccttagctgttgtaacaactgatcataatattatcattcatcatttgaagtcatttgtatgtcttaagcaatttgtaggcttttctgatgacattttggatattacgtttgtaggcgaggaagattcacacttagctattgccaccaactcgtcagatataaaactttattgtaacgctaccatgaattgtcaaatactaaagggtcacacagatatagtcatgtcattagctacttgcccagcagatccaacaaatatgctttcgtcaggtaaagataatacagtgaggctgtggaaacttgatggaaatatcatgaactgtatagctacaggttttagacatacaggttctgtaagttccgtagctttcagtcaaaccaattgcaactttggagtctcagttagtcaagatatgtgtttaaaactgtgggaaataccaacgaaatcaaaaatcgcaagcttaaactgtatgcatactgtcttagctcaccaaaaggacattaattctgttgcagtagccccaaatgacaaaataatagccactgcttcacaagataaaactgccaaactgtggaccccaactttagaattattaggtactttacgagggcataaaaagagccctttggtgtgtcaagttttctcctgtagacccatgtcgttgttacagcatcttctgattctactatcaaactgtggtcatagctgacttaagttgtttaagacact

SEQ ID NO: 2547 - DNA, 985 bp, Diabrotica virgifera
  misc_feature (895)..(896): n is a, c, g, or t
  misc_feature (926)..(926): n is a, c, g, or t
  misc_feature (950)..(950): n is a, c, g, or t
  misc_feature (967)..(967): n is a, c, g, or t
aattataattattctaaatgattttgtaagtatatagtgaaccatgtcgtctgtgttaatcaagcctattctgtattcctattggagaagttcctgtgcgtggagagttcgaatagcactgaacttaaaagaaatcccctatgatatcaaaccagtttcattgataaaagctggaggggaacaacattcaaacgactatcgagatgtcaatcccatggaacaggttccagctttgcacatagacggaaccacccttatagaatctttaaatattatgcattatctggaagaaaccagacctcataggccgttaatgcccaatgactgtattaaaagagcaaaagtaagagaaatatgcgaagtaatagcatctggtatccagccattacaaaatcttacagttctaatccacgtcggcgaagaaaagaaagatgaatgggcgaaacattggattaaacgcggtttcaaagccgtcgaaaaactcttagctgctagtgctgggaaatattgtgtcggggatgaaataactctagctgattgttgtcttattcctcaagtttttaatggcaaggaggttccacgtagacttaagaccttatccaactattttaagaattgatagagagctagaagctcacccagctatccgagcagcacatccaagcaatcaacctgattgtccaccagaggctatcaaataataaattcgccaaatgtttatatattaaaaatctttcgattattgaattgttttcaaaatatgttaagtattaatttaaaaaattatattacatataacagtcagccacaactggaacaagttcacatttttgtttcttcatctacgagtattacatgctttatacactttttccaatcctccctgattacattnngtggcagcgattccagcgaactcacctggnatgtagtagtctaagtagaggttncatggggattgatatgncgagctttcgattcttac

SEQ ID NO: 2548 - DNA, 1411 bp, Diabrotica virgifera
aataatgaacaatcaagatttttaattgaaatgctaatcttaatgttaaggtaccgatagtttttaagtaacgtgttctgtgttttgagataaagttacaagagagataaaaccaaaagcgaagattccaaaaaatatatttttgagagaatttagttttttgtaatagaataacaatgtctaactctgtatcaaatcttgtgtgtgtcaacgattacgaagaatatgccaaggagaaattaaaaaatgggagctttgatttttataatggtggagctggacaacaaagaacgttggaatggaataaaactgattttagcaaatatcgcattagaccaaaatatatgcgcaatgtaagcaacagaaacttatcaacaaatattttgggtaaacctgtggcagttcccataggaatatctccctctgcttttcagaaaatagcacacccggatggagaatgtgctactgcaaaagctgcccaagaatcagacaccatcttgatattaagttcacactctaattgtacctttgaagaggtcgcgaaagcggcaccacatggaagaaaatggctacaattgtatatttttcgaagcagggaaattacgaaagattttgtaaaagaagcagaaaaaaatggctttgaagcattagtagttaccgtggattttgctctatatggtatacatttaggagatttaagaagccaatttaagacaccacctcatcttgagtcgatcaattttaaaaagtatagagatggcgataatacaataaacttcgttgattttactgacccagaagtagaatggagctacattacttggttaaaaactatcactaatttacccatcgtagtcaaaggtgtattgaccggtgaagacgctattgcagcagcagatgccggagcttccgctattctcgtatcgaaccatggtggtagacaactagatagtcttccctctgcgatagaagcattaccagaggtgtcaaaggcagtaggacatagaattgaagtatacatggatggaggaatcagagatgggactgatgtatataaagccctaggactgggagctagaatggtgtttattggtagacctgcattatggggtttaactcacgatggagaaaaaggtgttaagaaaattttagaaatcctaaaaaaggaactagataatgcaatgggaattacaggatgttcaaaactaaccgatataaatcaagatcgagtggttcatgaaagttactacgcaaggcaatggtgatatttcagtataaacattttttataccagtattgacacaacaatcaccaacatcgagaccacaaaatttacaactatgtattgaaaaaaacattaatcttaagtcttaaattcattttgtaaataaaaaatacatatttttgcttt

SEQ ID NO: 2549 - DNA, 1604 bp, Diabrotica virgifera
  misc_feature (1556)..(1556): n is a, c, g, or t
  misc_feature (1602)..(1602): n is a, c, g, or t
acaatattaggcggacctaataatattattattataggtaggtatattatacctacctctttttaaagtaggtgtttttcactccctctcacgtaaggtcaaaggtcaataccaaccatgaaaatttaagtacccttgcctgcccagtcagcagtcccagtaggtatcatagatgtcggtatataagaagtgttcggtacaagtttctcagtttttcctacacaattcaaaaatatagaataacaatgtctaactctgcatcaaatctagtgtgtgtcaacgattatgaagaatatgccaaggaggaattaaaaaatgggagctttgagttttataatggtggagctggacagcaaagaacgttggaatggaataaaactgattttaacaagtatcgcattagaccaaaatatatgcgcaatgtaagcaacagaaacttatcaacaaatatcttgggtaaacctgtggcagttcccataggaatatctccctctgcttatcagaaaatagcacacccggatggagaatgtgctactgcaaaagctgcccaagaatcagacaccatcttgatattaagttcacactctaattgtacctttgaagaggtcgcgaaagcggcaccacatggaagaaaatggctacaattgtatatttttcaaaacagggaaattacgaaagattttgtaaaaagagcagaaaaaaatggctttgaagcattagtagttaccgtggattttgctctatatggtatacatttaggagatttaagaagccaatttaagacaccacctcatcttcagtcgatcaattttaaccagtatacagagggcgagaatgcaataaacttctatgagtttactgacccagaagtagaatggagctacattacttggttaaaaactatcactaatctacccatcgtagtcaaaggggtattgaccggtgaagacgctattgcagcagcagatgctggagcttctgctattctcgtatcgaaccatggtggtagacaactagatagtcttccctcagcgatagaagcattaccagaggtatcaaaggcagtaggacatagaattgaactatacatggacggaggaatcagagatgggactgatgtatataaagctctaggactgggagctagaatggtgtttattggtagacctgcattatggggtttaactcacgatggagaaaaaggtgttaagaacattttagacatcctaaagaaggaactagataatgcaatgggaattacaggatgttcaaaaataaccgatataaataaagatcgagtggttcatgaaagctactacgcaaggcaatggtgatatttcagtataaacattttttataccagtattgacacaacaatcatcaacatcgagaccacaaaatttacagctatgtatttaaaaaaacattaattcattttgtaaataaaaaaatacatatttttgctttaaaaaaaaaaaaaaagggcggcccccacgcgtccgcgttaaacttagtcaagggagatatacataataaataaaatgggataatacccngaggggtggctgtataccaccctagttaataaaatttaacgtgaangc

SEQ ID NO: 2550 - DNA, 952 bp, Diabrotica virgifera
gcaaaagttaaacttttgaactattttgatctatcgtcaatgtttgcagaaaatatttgattaaatacaattgaaaaaacaatggaacatcatagaaacttgatgaagacttacaagaacaacaagtactcggtcaaataaacattttggaaagtttacctttttaaaatagttggactttttttctgaactcctgccaggctctcgataatcttagaataatgggttgttttatgtatacttgtttattggctgaggtatttaatatctagattaagattccaatcaaagtttttggcctaggtgaactgtagttttatagaaaaatctcaaacgcatttagttgcgtttataaatgtctactacctaattgtatagaacgcacaggttatattttacagatttctcgactttttgacttctatccgtgatgatttgacgtgagaggcgtccaaagtctcttttgaaaatttgtaaatgtgttaaggtgctttgagttcgaaagttagctgtcttttcgaagcattaatttgtcaaaaacatagttatagtataaaccaataagcgcttacctcaggaatatttgtcttgtagaggtaaaatgaagagttatatttttattgttcgtcagagataaaagattttgttttgtgagaatatcgctaaatattatatttttgatacattaataaatatacagattgggcaagctagtttttgaataacatattgacatttatttatcggattcactgtgttcagaagagcctttggaaatttagattagggtgcaagtatattaaagatgataagagattgatacatatcatactatacatatcatattaactatatcgatgttattctatattataaaattaatatttaataaatgtctaccagcaaaaaaaaaaaaagaaaaaaaaaaaaaaagggcggccgctcgcgatct

SEQ ID NO: 2551 - DNA, 1958 bp, Diabrotica virgifera
gattagtttctactaacacgcgccagggagaaaaggtatcaaaaaattgaatatcgctttattcaacaaaataataaaattatagaacgtgaaaagtcacaaatcgaacactttttttacttctccgtttgtgaacgaacgtaaaattcacgtcaaattctccagacactaagggacccaaaatgactgaccgcaaagcagttattaaaaatgccgatatgagcgaagacatgcagcaagatgctgtagactgcgctacccaggcgatagaaaaatacaatatagaaaaggatattgccgcctacattaaaaaagaattcgacaaaaaatacaatccaacatggcattgtatcgtcggtagaaatttcggatcatacgtgacccacgagacccgccacttcatctacttttacctaggacaagtggcgatactattgttcaagagtggttaatctccaaaaagccccaatttcacctgacttctaaccccccaaacaaactatccatcattccctaaccccatttccagtattccactattagatgatcaccttttcaaacatcctaagtatatgtttcgatctggggcgtatttttgaagatcttatgacatggatgtgaagatgcgccctaaaaatttatgagttttttctcagacgataattttataaccttttggaataaaattattttgttgatgcagtttagatttttcacttaaaatgagggattttgggcaaaagtaaggtgacgcacaaatttttatttttctttctcgattgatgcaagaaatttggataaatgggaaactcttcttacaattttgaccattaaccgagtttttgattcgattcggattaataatgtatttaaaagctagcaaaaaaacaacagctgaatcttaattgttgcatatttataattaataattaacttaaccgttttaagttttcaagtgcaattaccttgtttttccaattttcttgcaaactttttcggtttggtgcacatggaaaatctaaaatttgtgttttcgagctcgaattatttttgaattgaattcgaatctggctgtgagatttggtgtttgtaaaccaagatgataaaccgatcttatggggcattttcaaaaagactgataaaatattttgggaacgccctgtgtatttcagtgtacattcctttcgagatgtgagcatataggagtattttgttttacagtttgtaacaatctggtggaataactattgattggaaaacgttacagagatagccgttgtcaacatattttgttatatgttcttgatttatgagttttatatgtaatttgtggagagggggaggtagaagaagaaagagactgccttatcagaagtattaaaagcagcaatattgaaataaaggttgggatatttagaaagatgaaagaataacaaatataataaaattggagagaaaaactaaagctgttattaaccccagatgatatgacatattccttgtttgtctgtaattatgtcaatgtttcagattgcatagtagagataacagtttataaatttggaaagcttttaaagctatgagttattaatattcctgaagctattttttgggggggaaaaaacctaaaatttttcttaaaaatttcctttggggattttatggaatttaccctttttaattggaaaaaaagccccaattttaatttgaaaaaggtttttttggcgtttcccacttccaaaaaacccaaagaaatttttttggacacgggggaaaggaccttttgtttttacgtaaaaattgttacgttttataaaacatttttaaaaacagatattctcccaaaagtctaagggggggttaaaaaggagagaaatttgcctcctttttctctctttttttctctcccacacaaaaagtgttgataaaaaaaatttttgggcgggggcgttgtttat

SEQ ID NO: 2552 - DNA, 1414 bp, Diabrotica virgifera
gcaactaccaaaaagtttgaattggaatcaattaaggcttctgtcaatgtcaccctctctaatggtacctcaagcattttaaatgtaactcatgaaaagccagagttctctacttcgttggatcattcttacaagtgtgctaaggtccaaactttgaatttgactgtcgcaggtggtaatgatactattgctttattgcatattagtcatgtgcagttccaagccttttctaatgtgacagcacataagttttatgatgctatcgattgtgaagcttccgctataacttcagatgtcgtcccaatcgtagttggatgcgtattagcccttctagtagtcgtggtactggttgcctacctcgtaggaagacgctattgccaagccagaggatatacttcaatgtgagttgcaaaaacactccaaagctcgcagatagggagcgttttacataacatctcgagcttaactatctaaattaataacgagaacatactttatttgatgtgtattttattatcaagttaacattgccgttatctgtcaaatgtcactgtgatcggtttttcctatagcacagtttaatgttaaagaatcagttaattcactctcgaattttgacggttccaatttttgcaatccactcccgaaacaaaattttgtatgcgcgacgatatagaacaatcaaggcaaacgtcagctgtcatttgactgcgcgagggactaaaatgtttgatgcgcactaccaaaatggaacatagagaacaaaggcttttcggggagggactactgattcttcagtattatactgtggcaatagtatgaactctttagtctcgattattttctatatgtttgttaaaagcgaagatctgaaacaaaaattaatgttgaataatatctaaaaattaaatggtaatgaggtacaataagtataatactaagcaatatagaaatatgaccctcacaaatgtctcatgctatataggcatatatttccttctagcagatacgtaaatacagtgacatgtatctaaagaatcccgtccaacgatgtggtacttaatattttatgagaatatacacgatatacatgtctataaaatggccctaaacacaacagcctacctaccacataaaaaatcatccataattctagatatgcatgttgcagtttatgttagatcttatcatgaccttgatctctttaattacatttcccttttggacttaactctgtgcttacaattagaaaaatgacaagaagatacaattacttgcagatgtattatgagacatgttatatgctataaactctaactggacgataatccaatagatgttttttattattgagtgtgttttttaaagagttttaccctcgggtgtgtatttttagacacataggatatgaatg

SEQ ID NO: 2553 - DNA, 1980 bp, Diabrotica virgifera
cgataaggtagagtcgtattggggatggcgatggggaaagctcgccgctcgcgtgccccagtgccccagtgacaactgacattttggtgaaatgtgaaatcggtggtaccttttaggaaagcttgtctaagggtggtacggtggtcggtcggtgacatttggtgacgaccacgtgacgacgacattcacatttttcacgtaaataaattcataatgaatactccaatttcagcgttttcagtttatagaaaaaagccaaatccaaaaatagttaaaagacagatcgttgtaaaaaaacaggttaaaaagaaaatgactatttctttaaaaaaatgcgtgaataaaatcaagcagaaaaataccaatcctaatccacaaaaattgaaggacactgtaaaaccaagagctgtgataacacataatctaaatcaaaactttaagaaggtagataataaaataaagaaaaccacatctccactaagcacaaaacttaaaaaaggtacggtatttcacaataaagatccagtttcggaaagtttaaaattatttaaatggttaattgcacctctaagtccaaccaagttttttgaacagtactgggaagttaaagccctacacatacaacataattcacctcactactttagtgatatcttgactacagcaagattggatagtatttttagggaatttccgttatactacaccaaaaacattgatgtcgtctcatatgaaaatggtgtaaaagaagttcacaatgaacaaggaaaggtggttgcttctgctttatatgattattattcaaatggttgtagtataagacttctaaatcctcagacgtatgatcaaaaagttcatttattggtatcaacattacaggagtattttggcactttagtgggagcgaatacttatttgacgccaccaaacagccaaggctttgctccacattatgatgatatcgaagcttttgttatacagttagaaggaagaaaacattggaaattgtataaacccaggggtagcgatgttttagctcgtgagtccagtcctaatttaaaacatcatgatattggagaaccttttatgtccgttaccttgaatgctggagatatactttattttcctagaggtacgattcacgagggtaggactgatcctgattgccattcattccatataacagtgtcagtctatcagcataattctttcgccgatttgttagaacatgctttacctgaggccctaaaaaaagcatcacttgacaacatacgttttcggaaaggattaccacttaattatttgaaacacacaggttatgtaaatcgaaatataatatcagaggaaagattaaatataaaggcagaaattgaaaaattatttgactctctgagggattatattgacatcgataaagcagctgatcaattaggtagaaggtttatgtatgattcaatgcccccgacattgtcaaaacaagaagtatgtcatacatctaaatatgatggtgatattatgaaggatggcaaaatttttaacagggccgaaattgatatggatacggaagtacgactacttcgatatttttgtttacgccttgtaacagatgaaaaatgttcaaaattgtactataatacagaaaacgcaaaaatatatcatggcgaagaagaacaggttttagaaatagattccgacttaatcccaacgatagaaatgttgcaaagtacatatccaaaatttacaaacgttcaaagattagtcgagaataataattccaatatggcaacaatacaattggtctctgacttatgggaacatggattactaataactaataattcactcactactgggactgacgactaattatataaaaatgacgaatttatatgtctataatgtatatggtatattaaaacgttaagtttaaaattgaataaaggaatatattttccccgaaaacccatacaccgggtgtat

SEQ ID NO: 2554 - DNA, 437 bp, Diabrotica virgifera
tgccgtcgcgtccgaataatactaagaagttgcagaataagtctcgtaagaataaacagagtgtgttacctgacaatataaaacaacgtactgactcgtttacttgaaaatctctttagcataatttttatatattttattgttgcagggcgttagcaagtataatttatagtaatcgtcatatcttgacaacccctgcattgtttttatcgacaagatgtgatagaataaacattagtaacgtaattaataattactcagctcaataacgaactattagtgaatttatttagattgtttaagacttttatatagtaaaaatatacattcctcatcacatccagcgaagggcagtgcctgtgagtgtataccaaaatatattattttaattattgttaatgtaatttgttgcggatactgcccttaatgatatattt

SEQ ID NO: 2555 - DNA, 476 bp, Diabrotica virgifera
  misc_feature (439)..(439): n is a, c, g, or t
ccggtacgaccacgcgtctatacagagtcgtattaatgggtaaatttaatatttgtgttttgggccatgaaccatttccagtccaaatataaagtgctagaaaaaataggcgagggatcattttcggacgttctaaaatgtgaaaatagagaaacaaaagtatgttacgcagcaaagaggcttaaaacacatatcgatctgaggcaagtatacaggcatgcgcggagatagttgctgcgcagaagataccgaatcatcctaatgttgtcaacatgttggagtaccactatgacatatacacagggaaactgacctttatctttgaacttatggatatgagtatgcatgattacctcaaaacaaagcgtaggggtttgtcagaacatagagttaagttctatttgtttcaaatactgaaaggattggtacacctccacanacacggattatttcatagagacataaaacctgaaaat

SEQ ID NO: 2556 - DNA, 1821 bp, Diabrotica virgifera
  misc_feature (1682)..(1682): n is a, c, g, or t
  misc_feature (1764)..(1764): n is a, c, g, or t
gtagagttgaggaagatgtgcaaagtgttgaaaagtttatgtacatgaattgtagaaactaattgtttattgtgtatcattcgaattcagtttcaaaattaaaagtgtgctagtggagaaaactaaacgataacttctgtttatactgttgtttttatcgtttaacaatggctctctttcttctaggtttgttgttctgcctatctagtcggatctctgccagtggtttctacgaaatcagtaacattgacttctataattctgtttttacagattctcttgattggagattgttacaggagctatcaaaccagtataaaaacgtagtgatatctcccatcagcctaaaaatcatattatccctattatatcaaggatctaccggacagacagaaagggaattccaaacacttttaaattatcaaaataaagaatatgtcaggaacaattacagccaaattgtcgctgccctttataatgcagacagaactgaatatatgctcaacattgggacatcgatgtttgtagatgaaggtctatacgttttatctaaattcgaagaccttgcaagaaaaagcttcaaaacagacatcataaagactaactttgacaaacaggaaaaggctagtaaagatattaattcgtgggtggaacagcttactcatggtaaagtgaagaaaatagtcaatgctgatgatctgtcgcaagcactaatgataattaccaatgccatttacttcaaaggaacatggactcgtaaatttgataaaaatagatcaacgcttggaaacttctatacatctcctgataatataagatctagcagaaacttaaaattagttcaatacatgactaccactgacgaatttctttattacgaggacagatctttggatgcgaaaattgtcaggttggaatacaagggaagtgactatgccatgtatatagtcctaccgaacactttgggaggattaagcagccttatcaaaaatgtggacataaacaaaataggaactataaagttccaaatgacacaacaagttgttgaggttactattccaaagtttaagttcaattttgacatcaagttgggaaagattcttcaaaagtttggactacgcgaagcattccaaaacacggccagttttacaggcatcgtgcaaaccaacaggaccttaagaaggagtctatacgtatctgacattgttcagaaatcgggaatagaagttgatgaagaaggaagtgaaatcttctcagcatcagctgtcaacgtgggtaataaattcgccgaaaatacgatgatattcaatgcatcacatccgttcatgttctttgttgatggtcccaacggtaccatattgtttgttggacaatatgaaaatccagatgcggtggacccgtcagaggtaccgaatcgttggagtcaagaagtagaagaaaaaaatcctactgaagctgtgcaattccaaaatactcgcccaagtagaccaaataatgaaattgatcaatccaataatgtacagttccaacagcctcgtccaaatagaccaagtgttgaaagtcaacgacccgacaatgtacaattccaacagaatcgcccaaatagaccaaatactgaaaatgaacagcccagcaatgtacaaggtcttaaattgaatccaatctggaccccgactactatncacctccagatgtagaaatggatgagattgcatatagattcaatctgtttgatattgactttatatattccttttctgattnatccacgaacgtattaatatctccccgctagcatcaaaacgacattagcaatgattt

SEQ ID NO: 2557 - DNA, 1692 bp, Diabrotica virgifera
taaaggccgcgcgaaaggtaaaagagctaataaacactatcctaaacttcttaacgcgggtgacactggtagtgcttcgcaagagtaaagcagatgtgcaaaaagaaaaatcgttgtttatattttaaacatagtggattaaaatgttgttagttctgtttttgtgtatagcaggattagcagctactgaagctgtgcaattccaaaatactcgcccaagtagaccaaataatgaaattgatcaatccaataatgtacagttccaacagcctcgtccaaatagaccaagtgttgaaagtcaacgacccgacaatgtacaattccaacagaatcgcccaaatagaccaaatactgaaaatgaacagcccagcaatgtacaaggtcttaatttgaatccaaatctggaccccgactactatcaacctccagatgtagaaatggatgagattgcatatagattcaatctgtttgatattgacttattatattccttttctgatttatccacgaacgtattaatatctcccgctagcatcaaaacgacattagcaatgattttagaaggagcagaaggaacttgtgcagaagaaataagtgaagcactgaggatacctgatattaatcaaaaaggtgtcagaagtgttcttgtagaacttctaaataatcttaatgaaagatctacgccaaatagtgtcctagaaagccataatgccatatttgtctctgaaaaacatcgactggttgataattataagaatgtcgttataaagtattacaacgcttacctgaaaagcttagatttttcaaattcagattatgctgctagggtcattaatggatggatatctgactccactcatggcgaaataaccgatgtcatctcaccacaggggatagttcctgattgttacgtggtgctgtcaaacgccctgttctttaaagcacagtggaaatatgcttttgataaaagaagtgtacgaaaatgtttccacactcctaggggatgtgtttatgttgacatgatgcacatttcacataatttcaattacaattacatcacccgtttgcgagccaatgttgtggatattccttatcaggataaattctccatgctactgatcttaccatcttcagattcaaatgtaaggagtgtgattcgggatttacctcactttagactgtcgagcattttggagagtctaaatcaatccgagattgttctagaactaccaacatttagcttcgagtattcagcagatttggttgaatttttaaaacctcttaaaatccgagaaatatttggttcccgcgctaacttaaccaaaatgatagaaggccaccatggtatgataaacaacctgttacacaagaccaaaatcacagtagacgaaaaaggaacaactgccgcagcatcctccagtgccatgataattcccctgatgcagccagtgacagttgcggctgacagaccgtttgtttttatgatctatcacagagacactaaaaatataatctttgaaggaattgtacaaaatcctttagaaaaatagtatctaacattactgataattttttatttaatgtgccgaaaactcatctaggttagatctcttcaaactgtagttacgtgtaaaaattggtctgtatttgcttttttcataaaaaccttttttaaataaattgtttaatacc

SEQ ID NO: 2558 - DNA, 944 bp, Diabrotica virgifera
  misc_feature (835)..(835): n is a, c, g, or t
  misc_feature (863)..(863): n is a, c, g, or t
  misc_feature (881)..(881): n is a, c, g, or t
  misc_feature (895)..(895): n is a, c, g, or t
  misc_feature (912)..(912): n is a, c, g, or t
  misc_feature (933)..(933): n is a, c, g, or t
aagcaagcgagttcctgacgtttgagcagaggacgcagagttcttagtgaaaatgtctttgaataaactatgtgttaagtgcttaggacctctgaaaacggaaattagagttttaaatgggttagtgaataaaagaaatcatttcgtttacacgccagatacaaatagtccagtcaaaggtgaaacaacgaaaatgaacatgttccaagccatcaacaatgcactagataccgcactaaagactgacgactctgcccttatatttggagaagatatcggattcgggggtgtgtttaggtgtacaatgggacttagggataaatacggaaaggatagagtttttaatacgccgctttgcgagcaaggaatagccgggttcgcgataggcgctgctgtaatgggatcgactacaatagccgagatacagttcgccgattatatatttccggcctttgatcagctagtaaatgaagcagcaaaataccgatacagatcaggaggaaccttcgactgtggtaaacttacagttagagcaccatgtggagctgttggtcacggagctctgtaccattcccaaagcccagaagcctattttgcccacacaccaggtttgaaggttgtcatacctagaggaccaataaaagccaaaggactcctgcttagttgtattagagatccagatccatgtttagtatttgaaccaaagattttatacagacaagctgtagaagaagtacctgtcgatgattatcaattacctataggaaaagctgatattttagtagaaggtaatgacgttaccttaataggatggggaacgcaggtccatgtactncaagaggtagctcagttgggcaaagaanaattgaaagttcctgtgnaagtatagatttgntttctatcctaccgtgngatacggagacagtatttaangtcgtgaaaaa

SEQ ID NO: 2559 - DNA, 846 bp, Diabrotica virgifera
aaatgctcatatgacacgatgcattgtcctgacgaaaatgattcttctgaaaactgtgtcttttttcacgaattttttccttcagctgttctaaagtttacaataatatttagaatttattgttttaccagtttgcaagtaatttacaaacaaaattctttttacgtctttgccgttgctctcttctgtgtgtatattcattagtatctcgaggtgttctttattttctgctatgatcgtcgtatcatctgcataccttgtgttgtcattgagtagcttcatcagtaaataaaatttgttttataaaattgttattttatttctgtaattgtgtaactgaaattgtaatcgatcaagaatacctcttggtgttatattttaatattcacattattttttttatttattcaaaatgcaatatttatgtcattcctcttgatcaactagaatatttttggacgtcctacattagacctggttttaaattttcctaattacataattaagtttatgaatatctctctaattggaaagaaatcgcatggggccaaatatggtgaatactgtggatggggcagcagttcgtagccaaattcgaccagtttggttatgaccactgcggaggtgtgagccagtgcgttgtcatgatggaagagcacttttttcttcaacacgtggggtcgtcttctccaggtagtcgatgtaagatagtccagatattgtaactttcttatttttattgggtttattatttcgtattctttgcacatttcttaaaatacttccgtgtctgtttttcctctgtaacatcacatatcaaatgactagcttatctatgtgttcttg

SEQ ID NO: 2560 - DNA, 831 bp, Diabrotica virgifera
gtaactttcgacatcgacgctttacggtattgtacatgtatcagccagagacaagggaactgaaaagaaacaacaaatttgtaaccaatcttctggtggcgtgagtaaagatgaaatcgaaaatatggttaaaaatgctgaacaatacgcacaacaggataaggtcaagagagatagagttgaagcagtaaatcaagctgaaggtattttacatgaaactgagacaaagatggaagaatacaaagatcagttaccaaaggaagaatgtgacaagttaaaagaagaaattaccaaagtcagagatttattaactaaaaaagatgagacagatcctgaagaaatccgcaaagctacaaccaccttacaacaatcgtcacttaaattgttcgaaatggcttacaaaaagatggctgccgaaagagaatcatcatcaagcagtagtagcaatcaacaacaggatcaacagcaacagtcagagcaacaaaagaaagaaaaagaaaattaaattagtgattttccataagttttatatacattctagtgtaaatatgtgatgttatttcgtctggaggtacagatttcctgttgagtagccttgatgacggaagtttatttcttttccaatttaaaacaatgcaatttggcatctatgtagcaattttatgttggaaaattatttcgagttcttgtatacaacttcctcattggactgatgctgtgaaaggcttggtgaatgatgtatgaatcgatcggttagtgtgtgttgttcatagttcgctatttttaccgaatgtgttatgaatttctgttaatataaaataaatttttcgt

SEQ ID NO: 2561 - DNA, 2541 bp, Diabrotica virgifera
ctctcctgggcgtccggaagatcaaagtgttggttttagattttaaagaaaaaaaagaaaaatgttgtctgccgctcgcgcccttagcaggaaagccctcgattgctcgaaaatcactttcgaaaaagctggaaacagaaattttaaccatttgtcaaataatagatcttccctgtacgctctaaacccaaaatatgacattcaattacgacacaaatcagaaggaatcaagggggctgttattggtattgatttgggtactacaaactcatgtgttgctgttatggaaggtaaacaagccaaagttatcgaaaatgcagaaggttccagaacaacaccttcagtagttgcctttagtaaagataatgaacgtctagttggtatgcccgctaagagacaggctgtaacaaattctgcaaatacattttatgccactaaacgtttgattggtagaagatttgaagatgaggaagttaaaaaagatatgaaaactgtatcatataaaatagttaaagcatcaaatggtgatgcttgggttcagggaagcgatggaaaaatgtattcccctagtcagataggagcatttgttttggttaagatgaaggaaactgcagaagcctacttaaacaccaaagtaaagaatgctgtaatcacagtacctgcctatttcaatgactcacaacgtcaggctaccaaagatgctggacaaatttctgggcttaatgttttgagagtcataaatgaacccacagctgcagctttagcttatggcatggacaaaacagaggataaagttattgctgtttatgatttgggaggtggtaccttcgatatatctatcttggaaatccaaaagggagtttttgaagtaaaatcaaccaatggagacactttccttggaggtgaagattttgacaatgtcctggtcaaccatcttgtttctgagttcaagaaagaacaaggaatcgatataactaaagatccaatggcaatgcaacgtcttaaagaagctgcagaaaaagcaaaaattgaattatcttctgctcttcaaacagatattaatcttccctatttgaccatggatgcatctggtccaaaacatatgaatctcaaattgtctcgttctaaatttgaaagtctagttggagatctaattaagagaaccatccagccatgccaaaaggccctgaaggatgctgaggtttctaaaacagatattggtgaagttctattagttggtggtatgactaggatgccaaaagtacagagtacagttcaagatatctttggaaaacaacccagcagagctgtcaatccagatgaagctgtagctgtaggtgctgctgtccaaggtggtgttttggctggtgatgtaacagatgtccttctgttagatgtaactcctttatctttgggtattgaaactcttggaggtgtatttaccagactcattaatagaaatactacaatcccgaccaagaaaagtcaagtattctcaacagcagctgatggtcaaactcaagtagaaattaaagtccaccaaggcgaacgtgaaatggcatcagacaacaagattcttggtcaattctccctcatcggtattcccccagcacctcgtggtgtaccacaaattgaagtaactttcgacatcgacgctaacggtattgtacatgtatcagccagagacaagggaactggaaaagaacaacaaattgtaatccaatcttctggtggtttgagtaaagatgaaatcgaaaatatggttaaaaatgctgaacaatacgcacaacaggataaggtcaagagagatagagttgaagcagtaaatcaagctgaaggtattttacatgaaactgagacaaagatggaagaatacaaagatcagttaccaaaggaagaatgtgacaagttaaaagaagaaattaccaaagtcagagatttattaactaaaaaagatgagacagatcccgaagaaatccgcaaagctacaaccaccttacaacaatcgtcacttaaattgttcgaaatggcttacaaaaagatggctgccgaaagagaatcatcatcaagcagtagtagcaatcaacaacaggatcaacagcaacagtcagagcaacaaaagaaagaaaaagaaaattaaattagtgaatttccctaagttttatatacattctagtgtaaatatggtgatggtaatttccctggaggtacagattccctgatgagtacctgtaatgaaggagattttatttcttttcccattttaaaacatgcaatttgggcattaatgaaaaaaatttattgtttgaaaaattttttttaagttttttgataacaactttcctccttgggatgaatggctggggaaaaaggtttgggggaaaagaagggtattaaaaaacaaaccgcgcggagaggggggtggggggggtttctcaaatatttctccttttttttttttctcccccaaaggggggggggttagaaaaatttttttttttttaaaaaaataaataaaaaaaaaaaaatttttttttcttc

SEQ ID NO: 2562 - DNA, 1013 bp, Diabrotica virgifera
  misc_feature (917)..(917): n is a, c, g, or t
gattaattagaggtctattcaccaaatataaaagcaggccacaattttcttttcttaaaccaagttcaattttcattccagtcggtttttattttaacataaaaattcacaatgaagtatttcgtactgtgtgccttagtactttactgcccttcggaagttttaggaaatccaaaatgtgatggtgtaaagtgcgaacctgtacaatgtggatttggtgctaatgcaaaagtgaaggagggtgattgttgtcccacttgcgtaggattcggtaacccattgttacccaaagataacccatgtgaaggtaaacaatgcacagttgcagtggctacagactgccctcctggatctatattgaagatgaaagatggtaattgttgtcccacatgccaaccattcggaaatccagcttgtgctggtgcaaattgcgctactccacaatgtggacttggttctcgtctacaactgaaggagggtgattgctgtgccagttgtgtaggattcggaaatccaaaatgtgatggagtaaagtgcgaacctgtaaaatgtggatttggagcaaaccttaaattgaaggaaggtgattgttgccccagttgcgaaggattcggaaatccaaaatgtgatggagtaaagtgcgaacctgtacaatgtggacttggagctaatcttaaactgaaggacggtgattgttgccccagttgcgaaggattcggcaacccattgttacccaaagataacccatgcaaaggtaaacaatgcactgttgcagtggctacagactgcccccctggatctatattgaagatgaaagatggtaattgttgtcccacatgcgaaccattcggtaatcactgtcaaagccttaaaactgaagaatggatatttgtgtgccacctgccaagttattttangataactaataataaatcaaggacatatttcaactatcagaaaaaatgacccgcgttagatgaaaaattaccattaatttaatgagtacttatgac

SEQ ID NO: 2563 - DNA, 1131 bp, Diabrotica virgifera
aaatcattatgatttcgttttttagttaatacaaacatcactctacaataatttaagtatttacatcactttaaagcattcactctaaatatattagtgctatttatttatacgatgtccctttaataattatattaggttctattataatttgttttaaaaatgtgtgatagttcaactagtgctaatccaatttcttccgaatatacttcaacacctagtagaagagatcgagaaaataaatttagcgaaaagactgaagatgcggctacaacagattctgaagaatatttatctgaacctctgaggtataggaacttccaatactcggcacagtccagtatctctaatataactttatcagttcaaaattcaagaattgaagaagaaaatggcaactgtttcccacagattcccaatggacctatatcatttaataatatacagattcccattgtaggatacgagattatggaagaacgtgctagatttacagtatataaactaaaagtagaaaacaaagaaactggtgacttttggtacgtcttccggcgttacactgacttcgttcgtctgtgtactagattaagaaccaatcatcctaacatagtacaacatttaccaaggaagagatggttaaagaacaacttcgatcctatttttttagaggagagagtcaacggtctccagactctcgtcaatgctatcttaagtgtacctgaactcatcgcgtctcaagaaatacaggacttcttttgtctaaacgaacctcctgtgtattcggaaactagcgaagaaaccaaagcaatattcgaggctttagaagaaaccattagttatctgaaacaacaagtccgcgaaaaagatgcttccctggattccttagaagaaaattacattccttatcaacagaaaatgaaaatttaagaaacttattagcaattcatgatgagctgtcagaaatgtcagaaggagtgcgagaatatccaaaaactgtcaaagtgataccaatacttttctcctattgttaaaaatgaattttatgtgaacaaagttgactaaatttgaaattttttatgagatattttaataatttatatactaaaaaatattataaggatctacttctac

SEQ ID NO: 2564 - DNA, 1637 bp, Diabrotica virgifera
ggccgccaagactccacgtggtctgttgaccatgttataaatcgtcgcgaaaaaacataatcgaacgtattcgcattcgcgaaaacgtatcgagagtaaattaataaacaaactgcagtggagtatcagtggctactactctaccataaataacatcagatcatgaaagtaatacctgaaaatttagttacgtagtcccgagtccagagacattagtagctggaatatcgttatatctgttttcatatacgtcttttgacaatttctagtcgatatgaagtgctacattgtgtacgcttcggcagtattattcagctatatcagcgctgagaccgtacaatcatgtgatagtttaatttattgtcaaggggagctgttggacacagtgcaatccgcaaggatcttcagtgactcaaagacgttcgtggatttgagccaacgacaatccccggatgaaactttaggaaatttcaaaaagtttatggcaaaatataacgataatccgactaaagatgaagttattaagtttgtggaagataattttaaggataacaaagaattagtagaatggacacctccagattttaacgataaccccagtttcctcgatggaataaaagatcccatagttttagaatttgcaaaaatacttgtaaacatatggccaaatctagctagaaaagtagatgagtccgtgagcaaacaccaagatcagcattccttaatttatcttccacacggatttattattcctggaggaaggtttaaagaaatttattattgggacacgtactggattattaaaggtttattgcttagtgaaatgacagaaactgttaaaggtatcttggaaaactttctctccctagttgacagatatgggtttataccgaatggcagccgggtatattacttaaaccgatctcaaccacccttattgtctctgatggtgggtctttacatagatgctactaacaacaaagaatggttagcaacaaatgtgaatattctcgaaaaggaattgacgtggtttttaacaaatcgtatggtatctgttcatgggcacaagatggcgaggtatgcgggtcctagcggcacaccgagacctgaatcttactatgaagatactatcacttgccagtcctttaaagacaaagataaggaacagtgttataagaacctaaaaggtggagccgaaagtggttgggacttttcctcacgttggatcttaaaagaagacggaacttccggatcggacttgccagatattgacactttcagagtaatacctgttgatttgaacgcctttctatgtaaagcctttaaagaactatctagattttattcaatactaggcaatgttgacaaaactcaagaatggaacggcagagctgacaagctagagagggctatacaaaaatttctttattccgaggaagacggtgtttggtatgatttcgatataaaatctggacaatctaggaaaagcttttatcctagtaacttaactcctttatggacaggagtcttcgataaaatcctaaaactggagaaaaggtcgtacagtacttaaagaataataacattgacgatttcaaaggtggtattccgtcatcactgcttgacagcggtgagca

SEQ ID NO: 2565 - DNA, 914 bp, Diabrotica virgifera
  misc_feature (735)..(735): n is a, c, g, or t
atgtaaaattgattattgacttttatcaaaataataaacaaatgtggctctaatttgtaaattaaattttgtaaatcgattgttatacctaataatattatgtgacgtgtcctttgaataattctgaaaaatgttttttaacacatttaatcttttattgataggattatgtgcaacatgctgttcctccttcattctggaattaggtaacaacttttctgaattacggaacaatggtggagattggttgatcaaattttatgctccttggtgtggacattgccaaagattggagcctgtatgggctgaagtgagtgaagcacttgatgactcaaatattcgagttggccgagtagattgcagtcattatccagccattgctaccgaatttggtatccgtggatatccaacaatcaagtttatttctccaaagagtgatgtaacatttagtggagatagaaacaaagatgatattgttcagtttgctcttaggatggcaggaccacctgttcatattataagttcctcgaatgatctgtctaaggttaagagttccggtgatgtatttttcatgtataatggagccctgaaaggggagttgtggaatatattttatgatgtatctaaacgattcagagcccattcgcaattttttgccttcaatgaaaatgctggagatgccactaatacaccctcaatttatgtatataaagacagtaaagcacatttctttanagttgacaacctcagcaacgaattaaatgactcattaagtcagtgggttaacgaagaacgatttggaacttttcaaaaagtaactcatggaaatttcaatgatcttatacaattaaatcggttcgtagtattagttgtcgtaatgagaaaaaattgagggaaatcctgacatgctggac

SEQ ID NO: 2566 - DNA, 1039 bp, Diabrotica virgifera
gtaatttctcgtcccaaacaaccaaatgcaaatatagcttcgacttcctttgatagtccagccacaacagatgcagcacttgctgccatagctgcagaagctggtctgatagatcctgcacctgagggaggcgtaggaaaattagatggatctgagggaaatgctacacaaacagtagttctttcgcagggaagcagtacatccaatgttgctgctcctgtgcaagtcttaggatctggttctattatgcagcaacttgggttgaaagggggtgctagattccaaagaccacctaaaagctttaggtatcgtttaggattgtatggaggtggtggcgtggatgatgtagatgaagaaatgaaaccttcaactacaacagctgaagctgattctacgcaagctaccgtcaatgaaattgcgccctcttcttctaatgctgaaattataaaaatggactgggagtcagattcaacacctaaacaatctgaagaaagcttaagcgttgaggcaaaatctgactcagaaacaaaatcggaagccgaagcaaaaccggaagaaactacacaaattgaggctgaatcagaggctgatataggaacagacgttgacatgagattagaaactgaagaacaatcaggcagcaaagacaacttggaacccgagacaagtaaaaacacattggaacctgagacaagtaaaaacacattggaacctgagacaagtaaaaacacattggaacctgagacaagtaaaaacgcattggaacctgagacaagtaaaaacgcattggaacctgagacaagtaaaaacacattggaacctgagacaagtaaaaacacattggaacttgaagaaaagtcggagagtgaaaacaatttagaagctgataaaaaaccagaaactgatgacaaatcggaagctgaagaaaaatctgaacagtctagtcagatagaatcagatattacaaaatctccagaggagaatcaagccaagtctgagtctggacctgaagaaacgaagtcggaaatggagactgata

SEQ ID NO: 2567 - DNA, 1085 bp, Diabrotica virgifera
  misc_feature (803)..(803): n is a, c, g, or t
gttgtataagatagaagatagtaatctattatagataaaatatggaatcattgttgtgaagaatattaattcaatacaagtgacatgttttgagtgaattctgccgaaaagttatttggaatatttttagttttagagctgtccactgacgccataatgcttctgacggtagtattggtggtagcaggtctcgctgttgcactatgcttcttcgtgagaaaacggtggcattattggaaagatttaaatgtagagcaggcggatatcaattatatatttaaaaacatttacattctgttctccaagaagacaagttttgctgaaatgactgtgataggatataacaaatttcctaaatctaggtatattgggacatatcaacttttgaagccgatgatgttaatcaaagaccccgaactattgaaagatattaccgtcaaaagttttgaccactttatggatcataccaatcaagtatcggaaaactccgatccactatggacaaaaaatttagtggcgcttagaggacaacaatggcgcgacatgagatccgtcctcagtccttcctttacgagtagtaagatgaaagttatgtttacgctgatgacagaatgtgcccaaaatttttcaaagcactttcagaagaaaaaggaagatgttgttgaactggaattaaaagaaactttcacgcggtttacaaacgatgtaatagctacaactgcatttggtataaaggttgattctctggaggatcgcgataacgaattttatttgatgggaagggatgtcaccaacttcactgngactttaaagatgctgaagtttatgattgctgcagcttttcctagattggcaaatcttttgaaaataacattcttcgataataaaaccagaaatttctttaccaaatttattgataagacggtacaagtaagagaagataaaggaattgttcgtcccgatatgatacacttactaatggaagctagaaaaggagtccagatttaaagaaaaactttactgtggatgaaggatttgctacggcaaaaagaagtcgaaaatttaacaagaaaaagtcgttttca

SEQ ID NO: 2568 - DNA, 895 bp, Diabrotica virgifera
  misc_feature (766)..(766): n is a, c, g, or t
ctcaggcggacgacagtttggaatggttactaggggaacttttaagtctagcccaacaatcccaccctaattccaaacaggcatcagctatttggttactggctgtgatcaaatgttgcggagaaagggaacctatcacgaagaggctaaagcagttgcagaacatctttatgggctttttgagtgaaaataatgatataatccaagatgtcgcttcaaaaggattgtgtgtagtttacgacacttacaaatcggaggaactgctacaagctttggtgaagcagttgacatctggcagtcgacaggttgcagctgtgacttcagatacaaaattatttgaagaaggccaattgggtcagtcacctacgggaggcaacttaaccacctacaaagaactttgctcgttagcatccgacttaaacaaacccgatttgatttaccagttcatgcatttagcaaaccacaacgccatctggaattccaagaaaggagctgccttcggtttctcaaccattgctgaaaaatgcggcgaagatctgaaagctttcttgccgactataatcccaaaattgtacaggtatcagtacgatcctacgcccaatatccaagcatctatgcacaacatttggagagttttggtgccagaaccaggaaaaataatagatgaatactaccatgaaatattggtggatctgctagcaaatatcaactctcatcaatacagagtgcgacaatcttgttgtttggcactacaggatttcttganaggatcatccaatcgatccatacatgatgctgtagatcacatggacgatttatggtctaaattgttcagagtcatggatgaccatcacgaacaaacgagaataactgcccataggactgctagaatttt

SEQ ID NO: 2569 - DNA, 1304 bp, Diabrotica virgifera
ataggtccgatatttctatcaattacaaaatgttcctccttaatcaccgattgatgatgccgttactatcatgctgaacgaattggtgtaccaatctgctcatatcgtagatatccccggcatcccgcataaaagaagcttcgcacgtgagatccaataactgcgaccgatacctatgctacttgaaaagtttctcgcgctcaccctcaccactaaatttatcacctagctcatcccaacttagtctctattccattcgaaacaagaaccctctcatttacgaatgactagataaactcacatatccatctatataccgctcactattatactctggtgtaagtaacaaataacatgacgatcaacaataccgaccaccgccagctgtgatcatgtctaagaccgcagtccgtaccgtcctcgagccgaactcgttcaatatgcttctttgatgaaggagttgcagaagaagatcgttaagaaagaatctccgaacgttacatcacctcaaagcaacacaagtgaaagtgccaccacttctgagaaaactcaaaactcgaaaagtagtagtcgatcagaaggaaaaagcagcgacgcagatttctccaaagaactagaagcagctcttcaattaattcaggatttagaaagtcccaatactattgaaactccctccgatgccaagtccttagacggacatgccagacccttagccgtatggaggaatagcgatgctagcgaaagcagtgaaaaaactcttagcgcagtaggatccctagccgagattacctctcctctaactgagtgccaacccgaattgtataccttcaagccgtcaacgaacggtaagggtgcaaaagttatcgttcactaccccgattcccaaagcacctccggttacagttcaccaacccacggacctaattggtccacagcttccagtatatctggaggtagtccagatactaaacctacattatactccattcataacactaaatctactaccgtcatatcattatattcttctcccaataacaccaaaggcaaatccgttacactagtcaaaataaccggcgatgagccagttaatactaccaaaattaaagttagcccttatactgataccatagataattcttcattcttatcagattataatagtacaaacaatacacattcccccgttgataaccgactacgagaccaacaaaaccagcgagaaactttctgatgtggaaccaaggaaaagctgtctactttaaatctacccctccccagctgggtgacactaaattcactgc

SEQ ID NO: 2570 - DNA, 1808 bp, Diabrotica virgifera
cggcgcgcggaattcccgctggacacccaccgcgctgctgcttgctgccattttcattttgccggcaggacgaaggaaggaattataattatagaaaagttacaggtaaaattgtgaaaattatctgattcaacaaacgatatcgcaaggatgtacgaaggagatgaatacgggagtgactatgaggaaggcgatagtgaaatctttagctcctctttcaaaccgtcctatgtcgtagtggccattgatacgcacccatgcatgttcaaaaaaaagagcgaaaaggaacaaatgccatttcgtatatgccttgaagccttggcagaagttatggaaaccttgattttcaaaaaagacaccagaatgtggagtccatttgctgttgttctagccggtgcagctactcccttaatcagttttaaccaaagcgtattggatactgttaagtttctacaagtaaaatgtagacaaacagatgctgaattgacctctcagcaccaaagaaaaacagctttaaatgtgtcttcattttttcttacctgcaagaaactattccatgaaatcaagtctgtttttcataaaagaacccttctttatttgagcaacgatgataaacctgtaactgacaaaaatgctcgttttacagcctttaacgagatcaagacatttgcagccagtcaaatagagtttcagattattcctacaatacaagattttcagtacaagttgttttacaatgaattgttcagcattatcggtaatccaaaacgagaagaaatctgcactgataaagaaggattagcagaaaaattgtcttctttattaatggtgtctataatggaaactagaatacttttctatccgtttccagatgatacggagcgctatttgaaatgtaaaagattcgcttatactacaaacattcagctgtataatcagtacatgacaaaagatggaaagaaagtcatcaatacagatgctcctccggatgaccaagaatactttagactcaagtctgaggatccaaaccaagaacacatgagattcgatgcgctagagaaggagcgtttgatggacagtgtaactcccaagggtcttactctagcctttgttggagatagacaaatcggttatggccatacgttctttaatacacaaatactgaaagttgatccaacagagaccttgccgtacttcaataagttttgggatcattgtgtaaattcgaagaaagttttggtttgtctttcaaaacttagacagcctgatagaccgagatatgtggagctcattccagtcttgtgtaatgggcagcagatgtttttggaaaaacggctaccattcggaaatgaaatagtaatgccatttaaatatcctttccccttgcccgaagaagaagttgatgacaagagaaaacttgtcatagaacaattggtcgagaaacttacattcgactttaatctcaaaatgttaccagatgtcaatctgcaaaagaaaaaggcctacatcaaagcaaaactactggacatttttccagagccagttaataatgttgaaatagatagcaccgcattagatggagttcttgaggaagtagtagcagaaatacaggcaaagttccagttgactgatacattcaaaaggaaagcccctcaacattacaacagaagaaacaagagaggaaaataatcaacaaaaatgtgttttttaaatatttttataccattttgtgtttagtttctccattgatatgaaaaaaaaaaattgaattaaatataattttgagatgctttcattttttccttttt

SEQ ID NO: 2571 - DNA, 1830 bp, Diabrotica virgifera
  misc_feature (734)..(734): n is a, c, g, or t
  misc_feature (1741)..(1741): n is a, c, g, or t
  misc_feature (1743)..(1744): n is a, c, g, or t
  misc_feature (1803)..(1803): n is a, c, g, or t
cagcttcagaacaacttaatgaaaataaatttcaaagtttgtctggccaaattagtttcttctaggtttgaagaaaactctttagttagtggctggataaagtcatttatttgggctttgactaagaccttaacacttagactgtcacaatagtaaaaaaagtagttccttccagccataaatatttttatcctatatatatatatatcgtcgacctaagctgtaaactgcttcaagtctatttatctaaattttataggggacacaaaaaactatatttctacagactaaggcgaatactatgtatctcccattgtaaaaggtaggatggtaaaacggaaatattttatagatacacatattatcaccaattacttaccatcaatttttcttgaaaatatcactttctgaacagtgagttcagtcttgtggtatgacaaactagggagttacgtatttttcatactaaatttggtgacaagggagatacagtgtatacgaagaggttgctttttactcatctggtaaaaatatgcatctgcgatcttttttaaacgataagtagggactttttgaaacagatgacagtaataactgattttcaaaaaattatggagttactcagtttacagattaggagggcgatatacacatacaagtgagaatcaattgttgattcttgcagctatagaatcaaattaactgcatcatggcatgcttctgatggcaatcancctattacgtcagacctgaggattgactagtcaaactcatgagcaccggacgcgtgggttttgttagacaacaagaaaaaggaaaaccaagaagacacgtagattttgttgctaatcgaagtcttgttttgtaaatttcagtatttaaataagtgcgatgaagtttcaatataaagaagagcacccttttgaaaagaggaagtccgagggagagaaaattaggagaaaatatccagacagagtccccgtaattgttgaaaaggcccccaaagcaagaattggtgatgttgacaaaaagaagtatttagtaccttctgatctgacagtaggtcaattttattttcttattaggaaaaggatacacttgagacccgaagatgcgcttttcttctttgtgaataatgtcattccaccaacatctgctactatgggatccctttaccaggaacatcacgaggaagatttctttttatatatcgcttactccgatgagaatgtatatggaggtgacctgtagaaacatacccctgaacgattaatctatattttacggttcagcaatctgatttttaatgtataactgaaatttattaaatagttaacaacaactttgtgattattaaaaaaaatttcaagtttttcttttgggttactgacatttattattagttatggtgattatgatttttttatttaaggaataagtacgtatgtgcacatatttaatcttaagagagctacagctagatattagatcttatccacctgatttgatggatttaatgtatttagatattgtgattaaaattagttaagttccaaaaaaagtaataaaatgtttatttaagattcaaaaaaaaaaaaaaacaagtgttacctaatctaaaaaatattaaaaaatgtttgccgcatcagctaccagaattgcctcaaggctacaactccagcaagttagaaacatgtcagccatctctggccaacaaaaataaaaatctcctctggccgananngttgtcatggtattgccttggcagtaggaattgtagctgtcccagcctgggtactagtncacatcaaacactacagggggaggact

SEQ ID NO: 2572 - DNA, 683 bp, Diabrotica virgifera
acgcgaccgccaacgcgtccggtttagtgaagtaaaggacattggatattttttcgtaataataataattattaattaaaatacgtaaaattaagcctaaacttatttagtaaaatgcacggaagattaaaagttcgtacctctgaagagcaaaaagctattaaacataaagaacaacagaagaaactagctgcatatcattggggaatgaaaagaattttatctactagaaacaaagacagttatgagcctgaaagttttcagattagttcacaaattttaatagcgaatccagatgtgtatactttatggaattataggaaggaaataattttaatggaaattgagaaaagtgaaaaagatgaaatagaacaggaagataacctaatgccattcttagaagatgaaattaaatttacagaacagtgtcttcctgctaatccaaaatcgtatggagtttggcatcatcgctattggatattattataccatccgaaacctaattggaaccaagaattttcattatgtaccagataccttacgatagatgatagaaattttcatgtgtgggattatcgaagactacttgtaaataaaattggtataactctagaccaccagcttaaattttctaatgaaagattaaatgtaaacttttctaattattcttcttggcattatac

SEQ ID NO: 2573 - DNA, 426 bp, Diabrotica virgifera
cggacgcgtggggaaaattcgtatttctcatcctttaataacgaaaacatgaacaaattcttagtcactaaagatacatttaagaaaattcgtaaatttggcctccagggacgaactctggaatttaaaatcagggatgtgccgcagagtgaggaacctgtgggatgggtaaaaaaggccatcgaggggattgtacttaagggaacagaaggtttggaaccaaccgatcaggtcggtttcactttttgctcgaaagactttgccagaggtcagggttggatgaggttcaaacctgcctctgaagtgaccgttgatgatatatggaataagattagttccagatatcagagtaatagcaccggcctcaataccgagacattttgtttgggtattacgacggtaaaactgcccgcgggaaaaagtggt

SEQ ID NO: 2574 - DNA, 1255 bp, Diabrotica virgifera
  misc_feature (1169)..(1169): n is a, c, g, or t
  misc_feature (1202)..(1203): n is a, c, g, or t
  misc_feature (1217)..(1218): n is a, c, g, or t
  misc_feature (1225)..(1225): n is a, c, g, or t
gcggtccgatctttcggtaggttagtggatcaacaacatcggaaatataaattaaaacggcaaaatagggccttcaatttctcaacgcagatctctccccaatctctcacgtagaatcacaaaaattaactcagatcagcggagctcgactccacttcacatcttagacgttacggacggcaactctcgttcctcaacctaactcttcggacacccagtagtaaaacgtttaaggaaaaaaataccaaacggccttctctcgaaacacataatcgatcggttgcgaacccagaaaagtggattgaacccacggcagaagccaacgttaacttatacacatttcacatagaacccgtaataaatcgacgttataaaagtgtgtaggaaagtaaaagaagcaggtatcgaaagtcggtttagcattaaaaccaggcacaggaattcgaagatgttaggcaatacatagaccatcgcagatatcattttcggtaatcgactcgtggagcctcggctttcggaggccaaaggttcatcgagtgatatcgatgcccaaggtgcaatgggttgaggcataattatccacttttagatattgaagtagatggaggagtcggactcgagtacaataactcggcttcgtgcagaggcaggtgcaaatatgatagtatcaggtacagcaataattgagtcaatcgaccaagcggcagtgatcgctagtttacgtgaaacagtggaaagctcaatccacaaatgcaacgtttaagtctgtgaaaaaaaaatggtgattcatgttaagtttaatctttaaactcgtattgttgaacaagcattccctttacaaaaaaattgaacagtttcagaaagatggtctaaaactataaaaattactttgatattccaaatttttattgtttatataatctgatgaagtatatgtactacacaaaaatttatcttacatggacatggacagaaaaaaaatctggatgacctggaaatccataatcaagtataacgacttgaaagcaatggctttaatatagcgaaaataaaattattggatggaataataagaaaataaattgatactgataaccttcttatcaatatagcaataattacatggataattatatctgaatttattaatgacatttctgatcacatgngtggtatagcttcacattcttattttactactnncctcagacgaccannaatttanaatggcatggttcatttaaaccctttgttt

SEQ ID NO: 2575 - DNA, 1307 bp, Diabrotica virgifera
agctcatcttaagctttacacaacttacccaagcaagttacaatgaattactttttgtatgtatcattcttagtggctctcgcaaccgtaaatgccggttacgcaggcagttacggaggtcatgaaggctatggtggagaccacggcggccatgatatttcccacacggtggaaattaccaaacacgtgccaattcctgtctacaaacacgaagcagtaccaattccccacaccattccagttccagtgccaaaaccagtagcagtaccagtaccacaaccttaccccgtccacatcaaagttccccaacctattgccgtacctgtcatcaaaaccatcaccattcccgtagagaaaccagtaccttacaaggttgaaaaggaaatcccataccacgttgagaaaccagtaccagttccagtagaaaaacacgtacccatcagaatccccaagccagtacccgtcaaagttccagtttacaaagttgtgtaccaccatagcaaacactaagtggaagacgcaagactgatacaatttcatctctttcatcttatctacttcatttcatcttagtcacttgttattgttgccttgttaattttttattgttaaatcttattgttgaatagatttataattttttagaaaagaaaaaaacaagcaaacctactaacaaactttcaatatcaaccgaatccgaaaaaaacaaaacatactcaagaccctttcaataaactcataattttaaaaacaaataggagaatcaaaaaaagggggggccccccaaaaagaaccaaattatcaaccggtgggggcaacctaattttttttaaggggccacaaaattttttttcgggggcgggttttaaacaccgcggggggggggaaaaacccgggggaaccacatttaacccctttgggacaccccccccttccccggggggggaaaaaaagaagggcccccccccaccccccccccccaattcgcccctctataatgggagagggggaccccccctcaaggcgccctaatatagcgcgggggggggggggggtcaccagagggggacacattaatttttgccgcccccccaacccccctcttttttttttttttttttttttttttctccccattcgcggggttttttccccccgaaattatatacaggggggggctccctctttggtggcccctctattttttgtgttctccgccccccaccccccccccccccaaaaaaatatttttaagagggggggggtgggtgtggccgccgggggggggggcgcgcccgccccccccc

SEQ ID NO: 2576 - DNA, 472 bp, Diabrotica virgifera
cgggtcgacacaagcctctacacgactctatattagcaacaacatgaacactctttttgtagccatcttcgccactttggctgttgccgccagtgctggaggtattggacctcttggacttggagttggaggactaggtcttggagttggaggactaggtcttggactaggaggtcacggaatcggcttagctggtcccgtcggtttagctggccccgtcggtctagccggtcccgttggtcttggtcttggagtaccagccctaggagtcggtgctcctctcggtttgggactgggacttggacatggagtcaaagtagccgccgtacccgtacccgccgtcagagtagttgaagcttccggagtagtcactggagctggagctgctggaccatctggagtcgttactggagctggtgctgttggaccttcaggaatcgtaactggacatggagctgtatgacccacggtc

SEQ ID NO: 2577 - DNA, 897 bp, Diabrotica virgifera
cgtttttaaaattttaaaataaccatcacataaattgaaactgaaaatagctgtgatagtgaccagtaccaaaactgcattacgatgaagtggatagtgttaaccgttgttgtacttcttggtttagccagtgcagaagaagtttatgaaaagagagcagtcctcagaagaaccaccagacaagccctaggatccatgggaggttcatttttagcacaaactgaaaggaatattataaacaactgtaagaaaaatggactatcagatcaaggcgctgacgatctacaggttacatacgctaaaatgaagtcgtgcatgtccggcacaaaaatttttgaaactcctagaaatgaatttattagcaaaatggaagattgcagtcgtgacgcaattaaagaaactaaatcttgtttggctaacaaccaaaaatatttcccagaattcgtcttggatcttgcaaaatcgatggttaaatatatgtacgatgacaaagatctatttagagattcagaaattgtcggttgcataaataacttgggaaggtacacagtacaagttgagtatattagatgtttaaccaccgtatctcaaaaaactggagacgatgaaaatattcctacatctagggcagaattttgcagaaaattcgtaccagcaaccgaatgtttcccagacactattaaacggcactgtgtaaatactgcaaaggtcaacaagttcttcagcgactacagtaatgctatcgagactccatgtcaagattctgttaaagaatctaactacctttaaatccagtctgaatttatgtgatggttattttaaaattttaaaaaacgtaataaaaaattataaaaacaaaaaaaaaaaaaaaaaaaaaaaataagggcggcccgcctc

SEQ ID NO: 2578 - DNA, 1150 bp, Diabrotica virgifera
caaggttaataaactaaatgaaatgattgggtaaattaaggatgatttaaagaatcttacacagtcgtattttaatcatgaagttcgtgcttatatttttaatactggttgtaaactatgttccatcatttgcactaaatatactgtatgcatatgatgtgccaagtccaagccatgaaatatggaattatgagctagcggctgcactagtggcaaagggacacaacgtaacgatgtttagtcctcttcccaaacaaggacaaggtcaaaaaaattaccatacaattcaaattgaaggtctattggatagagtaaaagaagtttttaatttaaatgatatcatcgaaaataacgattttgaaaatctgttattgtatcaccattggggaactttcacatgcgaacatacagtacaaagtaaagggttctcaaagctattgtcatatccgagagattcttttgatttaatcttagttcagtactcccttagcccttgtttactgtatttgatacaagctttcaattatccgccgacagtcgtaacaacaccatttctcttgccagcatttttagctgaaacatttggaagtgatgttcagcctgcttatatagctagttatgtattaaaccacaatggaaaatttacatttttcgaccgattgcggaattttgctttgttgaagatggacactcttctgcgacacttctatctgaatgataaaataaaagaatatgccactaaaggattcgggaaagacctagcaccacttgattcattgattaatcatgtatcactggttttatgtaacaccataccaggatttcatcatgcgcaacctttggctccaaatattgtacctgtagggggattacatattaccccggccaaaaaattacctgaagaatttatgcatataatggacaacaccaaagatggtgtaatcttaatgtcttttggaacaaatatacattccgctaaccttaagacgataaaaagaacagtattattaaggcattgggttaactgaaacaaaacagtctatggaaatttgacaaagatctggataacctttcccaaaatgtatcataaggaagtgggtgccacaaaaagaattttaggtacttaatataatttagaagtacctacatc

SEQ ID NO: 2579 - DNA, 1009 bp, Diabrotica virgifera
cctacccacgcgtccacggacgcgtgggcgttgatcgaactgttttttctttgattgttgaatgataacaagtgtttttgaagttttgcaagtgcccgtgtaggggtgtgaatgaccgatttggatttttgattttttataatgaagatcattcttcttatcctgctagcgatatgtacgatacttagcgcagcggagtaccccagatacaaaggcaggcctccacctccacgacaacgtagggtaccaaccaatcaacagttctccaagaaatggcaccaaggaggtcctttaatacaaaatttgccacaaggtattccacaaggattcccgcaaggcatgcaaggagttcctccaggacacggccagttcggcttacgtgggccacctttaagacagagacccgtcaaccacataccggtcttaatggtgccgaacaatgttcctcaaataaaacatcataagataccacaacctaatggactaggtcatcaattaccgcaaagacaagctactcttccagtaagatcattttggaaaaaccctgtagccccggttaagcttcaacaagaagtagttttcaagacacctttacctacaccaccaccagagaaaccttttagatctgcaccaagcatacctacatcacaggaattcgactaccacattcaaaccaatcaaattcctacagcacacataaatcctataaagcaaataggtgaaaaaggacccattcacacaatacctgctccaaatttaagtctcaaagataagccactgcacatagaagaagtccggaatgacatcagcttcccgcacccatctcaccataatgcccacctaagcacgcaagtcacaattcaaaagagccacgagtatccagtaacggaacctccagagcataaccagaaattattcagagcccaacagaacaccaaaagcaaatccagcggcagatccagaaacaaatccaacagatgcatcagcagactgttcaacaagagctgct

SEQ ID NO: 2580 - DNA, 1321 bp, Diabrotica virgifera
  misc_feature (1188)..(1188): n is a, c, g, or t
  misc_feature (1199)..(1199): n is a, c, g, or t
tagaaaaagtcacatgattggttaatcagatatttttctctatcaaactccttgttttaatcatccttctttcttcttaattgcctttctttcttcctattgtgtttctgaagccaaactgagtggtaccaatatcttgatcaagtttctaaaaattttttggtgtattcttttcaagaatatctttagagtgtggcttattaagctagtatgatggtcactgaaacacttaagggagtattagatccgacgatggatggaatagctgctgcttataataaatacaaacaagaaccagaaagtacaaaatgataggaaactgtgtcaatgtttcttggaacctagaaagagttttatctaccgatacttacagatacagattgttgaagagataatagtaatatgcgctacaataccatgagggtcgacattgctagaataatgtctggtgcaacattcgaatatccaggccatccagctttcagagaaaaagaagaatcacagaatgaaggcttaataaattgctggtgtgtggagataaaattctttgagtagtattccttctagagaattagatacgcagtaacgacaatcgccttataaacaatgttttttttaaagaccagatgagagaaggtctgtcggatggtctagaaaaagttgggaggattaagttataaaggatctgcaaaaaatgggaatgacacaatgggaaatagagtagtgtaacgccattgatgatgatgatagaatgaaggctcaataatatataatcacgcgagatagtgacattaaaaaagtttctggaaaatactgaacatctgtaaaaatataaaaagttattgtatgaaaactagactttacagaagaatcgcttataaaaaactagctttaagactcaaattactcaatagctatcaaaccaaactcttagttgataattttgattagattgtagacacacaatgtttttaaaggatttaaaattaaaacaaataaataatttaattacaatgcttttaatatattaagaaatgtttctaaagggctaaatattgcatttttaaaaactgataataataaacaatcatctagagtccagagttaacaatttgattgctgcgtcttcttcgtaaaatcttttagctgtgattcttactcatcctggtccttctcgatattaatggngatagaaccanaaactttgaaaactttttcacatgataacctttgttctttttttgtgtcaagtctgaaataatgaatttattgcaaaaatatttttaattgtcttttttataattttttatctattttctac

SEQ ID NO: 2581 - DNA, 1403 bp, Diabrotica virgifera
aaataagtcaaaagatctcgattgggaatataagctaatcgaggcatttccagaaatatttcaagattcggtagtcattgatctcgaacagattgataataaagcactcgtcaaaatttagtaagggggttaaaaaaactcacgagttttattcctcgaaaacaaaatatccgaaaaggaattcaagggtgctttcgataaagctctttccaaattaccttcagaacttaatcggctaatcttaaaaactacagaaatcgtctcgtctcacaattcgcttatcggcctaataagtttctttttaagtatcgacgaagatcgataacattatttcttcgcaaaattcgtagattttcaaaccataggtctcgcagcctccagtgtatcgatgtgctcatcttcttatatataaatacaagaaaaagttttagggacgaatatcttcaagatctcgttgggctcattattataagtgcttctcagattatattaaaaaaggaggttacactcggcaagtgagattattcagtgaggaggagttttatcgagacgtataagaagctcgaggtttctttcgcaaactaacatcggccatggatggataggagctcgtatcggctaataccggatgtgatatatagcaaatatttaaaaaatggacgaagattttacatacttctttttttgaaggacgcccagatagtatggttaagatattccagggtaacagctattatagagaaattctaacagaagatttaattgagatgcggtcgataatatttgacgacgaaagatagttttacttattataagaaggcagtgacgtcattagataataaaacttttaaaaaggttttgaaagggtcttcttgtggcatgactaaattaaatattagatattttaatatactcttggctaattaccaaaatacaaggaaaaattatttaccagcaattttattgctggaatcgtaccttatgattgtatatgttaacaatataggtatgcaaagtccgcagacagcgtgttactttctttataaacaaaatggcgcccgaaattcgtatttttttcaatttttgctctataactccaaagattttaactttacaccaaaaacacccaaataaaaattcaccgtaattaaattctgcatagagacgtgtctttccagatttactttgactaaaatttttcccggaaaatgcgggtttttccaacaaaatctttaattttcaactaaaattttagataagtaattgtttatcaataattaaataacttggtagtataaaagctcttttttatagattataattccagaattatttaattctttaattctttcatcttggtgtgtgttgttatagatgattgtgtagtggatttgtctgctttt

SEQ ID NO: 2582 - DNA, 905 bp, Diabrotica virgifera
  misc_feature (825)..(825): n is a, c, g, or t
  misc_feature (830)..(831): n is a, c, g, or t
  misc_feature (842)..(842): n is a, c, g, or t
  misc_feature (854)..(854): n is a, c, g, or t
  misc_feature (894)..(894): n is a, c, g, or t
atttgttttacagtacagcacgttacagtttacaaaaatatgaaatcctgaattaggatttaacaggattcctgatctcccgatgtgtgcaatggtcagcaaaaatgacatacctatagatattctcgatttatttcgagataaaaagttagtgaaaatatgtgcccccatggtacgctacagcaaattacaatttagaaaccttgtcaaactgtataactgtgatttaacatttacttctatgattttggcagattctttttgtcaaagtgcaaaagccaggagtaatgcatttaccacaaattctttagatactcctgttgttgtacaatttgcatcaaatactgtgcatgatttcgtaggtgcagcatatttagcatctccacattgtaatggagcagatttgaattgttgttgtccgcagagatgggcaagagagcaggaattgggttgcgatatgttaaagaagccagaattaatttatgatatggttcgccaatgcagaaatcacgttttgaaacctttcactgtaagtgtaaaaatgcgactgctgtgtggtgaaaaacatatggttaatatttgtaaacaattagaaatgtgtggtgttagttttttaactattcatggtcgtacttcttaccaaaatgtgggtgatattaataaggacactttaaagttaataaatgatacttgttctttacctgtgatagctaatggatgtgtgacaacattagatgattgttacaaattacaagagtatacaggatgtaagggtgtaatggttgcgaatggtatcctgaccaatcctacaatatttacctggancttanngaacactctgnattgtatacaanactggttagatatttgttataatagttctttgacaatggnatcatatctta

SEQ ID NO: 2583 - DNA, 826 bp, Diabrotica virgifera
gttcaatacctgagatagtgggttcatagctagacagaaccacagtggacttaacgaatatccttggaacaggccccggctgattgcgatattttcagtttcgatgttattttcaccaggtatttgaaggtgaattctagtcttccactctgtcattatatgctgtaaaaaggtcactatattatcatcgactttatatattctcaatatatctataagccattcatgcggcactgaatcaaaggccttcttgtaattaatgaaggcagtaaataggttcctctttttggaatatgcttgtttagaaattactgagtcgatgataagttgttctttgcaacccatggaacccttagcgcatcctttctgttgacgctctatgatattgtttagagcacagtgttggtagatacgccgggttacacaggatgtgaccaatttatacaaagttggaagacaagtaattgggcggtacttggatggatcttgggtgttattttgatccttgggtattaaataagtagttccctgagttagaaatgatggtaattcctgcggattagaaataacatgattaattaatgttgataagcactcatgaatactccaaaactttttaagccagaagttctggactccgtctggtccaggagatttccagttatgaagctctttgatgacatttgagacttcttcagtcgtgaatggttcgtagttagcagtgacgtagtggtgacagttgtgcgtcgtatcttctatccagccagcattgttgttaaaaacagctggtgtggaaagttgatttccccaaaactcatgaatttct

SEQ ID NO: 2584 - DNA, 982 bp, Diabrotica virgifera
ctaaatttttgcccacagttatgtttattccaatagcaaatgccgtttaccgtaaaaagaatccaatagtcttaaatatcattaggaataggaaaacgttagcaaagagatgattactagtcactttcaactactttctataccttcatttcattaatatgaactaaaaatgccgaatacaaatatatttaatcagtcaatgtatactgttttgtggctttgacttttaaatgttgttacaactatcatccctcttggctgttaggggtatcggcacgtcccaattaatgccaaaaaatcaacagacctcaagggggattatacggttgggtccagagttctttacccgtgcgtcatcttaaagtatacgaaataagtcagaaatttactccacgcacagcaagtcacagaaagtggctactgctccgatcacgagttatattataaaatttgacgttatcaaataaatagaatgttaaatgtaagttttgctttaaaattttggtaaaaaattacaggtacatttgaaggagcttaataaatacttttaatatcattagtggttaataaataaataaacaatttataaaaaatataatcaatatttttttgtccttttattcactttggcggaaacttaaacacaaccattccttaacggtgtaaatgagattagctttgtatgttgtaaaaatgaatggcaaaataaaatacacttaccataaaattttaaactccaatataaaattagttgtaaaaaaaaactgttattgtaatataaaaaaatttcgaacaaaatagcaaaaatttcaacagactgacagccacaagagtaaacaaaaccagaaacggcacaaatttgtacttaaaaatttggaaattatcttccaaagcggctggttttggctcctatattcttttttcgatgtactggagtcctagagccggccaataaaaaataaacatggtggtttttacctta

SEQ ID NO: 2585 - DNA, 959 bp, Diabrotica virgifera
tacacaaactcctggtagaaataggtgttttacatttaagaaagtgaatgattaaaaaaaaaaaaatttaaagggacaacagaaaagttagaatgtctgataataaagaaccggcattgtctgaaacagaccagcaaatttttaaggcaatcgagaataatgacgtagttcttttaaaaacacttcttgcagaaacaaaaaacgtgaatattctcgacgagaattctatgactccccttcaacatgctgcttataagggaaataaagatcttgttcaggttcttctggatcagggagcagatgtgaattactgcgaacaccaacacacatacacagctctgcactttgccggtctctctggaaactcagacgtttgcttggcattgttgttagccggtgcaaaatcaaacatcaccaacacagtcggccgcacaccatcacaaatggcagccttcgtaggacaccacaattgcgtctctgttatcaacagctatattccaaaatctgacatagactattacacaacaggaacagcgaataggggtccatatctcccgccgttcttgtcagaaagtttccataaattcgttatgcaagttaatatacatccaattaaagtagttttgaatgtacagaactttgtaggtttgtctgaacatttgccagaagtgaaaaaagtacttgaattgatgtgtgaacgggagataaaacgaggagccgataaaaacgaggttatgtctttcaagttccattacttagggtatattgtaggagaagtcttaaaagtaaggcagcgacaaactgcgaaaaaggatgaaggcgaggacgataaaaagttggatatgactgaactttttacgaggaaattgctaaaacctggcacagacggacagttggagtcatggatgcatttttaaaacagtgtatcagagaattccttacagggattgcacgttatt

SEQ ID NO: 2586 - DNA, 782 bp, Diabrotica virgifera
tacccacgcgtccgcccacgcgtccgcatcaagttggtagatatagccgaagacccatgtacccagctggacatcgcaaactccaacatgttgtagtgcgtagacttaaacaccatccgcccacgcgtccgggacgttttgcacgtaaaccagcagtatcccgtcctcgtaaacaatcaggtagcccagcaggtttaggacgtcgtccattccgtcgtccatcttgcaggccaatgatacgaccagcccatctttcaggtcaaggtggtcaacatccagcgcaacaagagcaccaccaagctcaacaacagcaccaccaagctcaacaacagcaccaacaaggtcctcaagctcgacaatgcagaccagcgcgcagaccaagaattgttatgcgccccgctgcccaacgtaaatccgttgctcatgatagatacacagttgctaatcatggaactcatgcttttaccgctcagatcgttcacgttaaaggaggaaagcaggagatagtacgcagtcaagttgtccaacccaacgaaaccaaagagcttcttcttaaagacgtaaatggatcgtctttgaaaatcgtcaacgaaaacgagactgattacgcaatcttctcagctgaaggaggtgaagtagttgatggattcagatatatggtaagaccactgcgtcgctgtcctggtgcaagaaaaatgttctatggattttaagtatttaaataaaatactcatgttctgaataaaaaaaaaaaaatcaaaagataagaaaccaacaacaaa

SEQ ID NO: 2587 - DNA, 618 bp, Diabrotica virgifera
  misc_feature (610)..(610): n is a, c, g, or t
aaccaactgaaactgtaaaacttgaacataagaaagacgctggagtagctctgttaaatatattgaacagacattacacagacgccgctattatcaccgccaagggtggaagagtagttagagacattgaaagaaaaatcaaacaacttatatctgatgaaaaatcaataatgatggtgaatgattaccatctagcacctgcatcatccgtagttgtcatgcatcaagttggtagatatagccgaagacccatgtacccagctggacatcgcaaactccaacatgttgtagttcgtagacttaaacaccaccctggacatacatcaggacgtcttgcaggtaaaccagcagcaccccgtccttctaaacaatcaggtagcccagcaggttcaggacgtcgtccattccgtcgtccatcttgtaggccaatgatacggccagcccatctttctagtcaaggtggtcaacatccagcacaacaaactcaagaacagcaccgtccagctcaacaacagcaacatcaaagtcctcaagttggacaatgcagaccagcgcgcagaccaagaatcgtcatgcgccctgctgctctacgtaaacccattgctcatgnataataca

SEQ ID NO: 2588 - DNA, 547 bp, Diabrotica virgifera
gggtcgatacgcgggtcgaaacacgcgtccgctaaacccaacaaacaccgccttcaacatgaaacgatcccagcaagttacggtcactgaaaccaccccaggatattcagtggaaaagatgtattataaagaatacaaatatgaaaccgctttctccatttcgcagttatcgaaactggagaatttcgttttacctcctagaactactatcttagcattatctcagaacggaggagacaaggaagaagacaaaaagtatgtcgtcaagaatcacggaaaagctgatctttttgttgaggtaatacatctcaataaccaagatgatgctccacaatggtttgtagtccagccagaccaaaccactgagatagatattgaggacaatcttgaacaaagcgtgttgaaagtaagcaacaacagttacgaacaggaagtatcattttctgctaaaggtggtcacgttattgacgacttggaaaacaacatggaagaacttcttgactcagacgaaccagaaactgaaatggtcgttctggaaaacttttct

SEQ ID NO: 2589 - DNA, 823 bp, Diabrotica virgifera
acggacgcgtgggcgtccacgaaacccagcaaacaccgtcttcaagatgaaacgatcccaacaagttaccgtcactaaaaccactacgacatatgaagaatacgaatatgaaaccactttctccgtttcgaagttatcgaaacttgagaatttcgttttacctcctagaactactatcttagcagtgtctcagagcggaggagacaaggaagaagacaaaaagtatgtcgtcacgaatcacggaaaagctgatctttttgttgaggtgatacatctcaataaccaagatgatgctccacaatggtttgtagtccaaccagaccaaaccactgagatagatattgaggacaatcttgaacaaagcgtgttgaaagtgagcaacaacagttacgaacaggaagtgtcattttctgctaaaggtggtcacgttattgacgacttggaaaacaacatggaagaacttcttgactcagatgaaacagaaactgaaatgaccgttttggaaaacttttctttaagcccaagaactgctgtcactgttttgagtcaaaatgttgaaggaagcaatgaacatcctggaaaagtacactgtaactaacgcatggcaaaaggctgcttttcgatattggagttgatggggaacctcgccccgttcaaactactagaggctccatcagcaaaacacgttcaggcctagatacatcctgaaggcttttgaaactcacaagttcaagtcccaacttgacccggttttcggaacgttctccaccaccacgccagaactggagaatgcaaggctttaagagctgaagggagggaggac

SEQ ID NO: 2590 - DNA, 946 bp, Diabrotica virgifera
ccaacgcgtccgcccacgcgtccgcccacgcgtccgattgaaagaaaaatcaaacaacttgtgtctgatgaaaaatcaataatgatggtgaatgatttccatctggcacctgcatcatctgtagttgtcatgaatcaagttggtagatataaccgaagacccgtgtacccagctggacatcgcaaactccaacatgttgtagttcgtagacttaaacaccatcctggacttacatcaggacgttttgcacgtaaaccagcagtatcccgtcctcgtaaacaatcaggtagcccagcaggtttaggacgtcgtccattccgtcgtccatcttgcaggccaatgatacgaccaggccatctttcaggtcaaggtggacatcatgctcagcaacgccatcgtccagcccaaggtggtcatcatccagctcaacaacagcaccacccagctcaacaacagcaccatccagctcaacaacagcaccatcaaggtcaacaacagcaccatcaaggtcaacaacagcaccatccagctcaacaaaatagacctcaagttggacaatgtagaccaatgcgcagaccaagggtggttatgcgtcccgctatgctacgtaaacccattgttcatgatagatacaccgttgttaatcatggaactcatgcttttaccgctcagatcgttcatattaatgggaagaaaccaagaggtggtccgcactcaagtcgtccaacccaacgaaacccaagtgcttttacttgaaggattaaatggatcatctttgaaaatcgtcaacgaaaacgagactgactacgctatcttctcagttgaaggaggtgaagtagtttatggattcagatatatgggtaagaccactacgtcgccgtcctggtgcaagaagaatgttctgggggattttaagtatttaagtaaattataaatggctctgaat

SEQ ID NO: 2591 - DNA, 1050 bp, Diabrotica virgifera
  misc_feature (55)..(55): n is a, c, g, or t
ggtcgagcccgcgtccgaccacaagtccgcccacgcgtccgtgctattatcaccngccaaggtggaagagtagttcgagacattgaaagaaaaatcaaacaacttgtgtctgatgaaaaatcaataatgatggtgaatgatttccatctggcacctgcatcatctgtagttgtcatgaatcaagttggtagatataaccgaagacccgtgtacccagctggacatcgcaaactccaacatgttgtagttcgtagacttaaacaccatcctggacttacatcaggacgttttgcacgtaaaccagcagtatcccgtcctcgtaaacaatcaggtagcctaacaggcccaggacgtcgtccattccgtcgtccagcttgtaggccaatggtacgaccagcctatcatcctggtcaaggtggacatcctgctcaaggtggccatcgtccagcccaaggtggacatcatccagctcaacaaggacaccacccagctcaacaacagcaccacccagctcaacaacagcaccatccagctcaacaacagcaccacccagctcaacaacagcaccacccagctcaacaacagcaccatccagctcaacaacagcaccatcaaggtcaacaacagcaccatccagctcaacaaaatagacctcaagttggacaatgtagaccaatgcgcagaccaagagtggttatgcgtcccgctatgctacgtaaacccattgttcatgatagatacaccgttgttaatcatggaactcatgcttttaccgctcagatcgttcatgttaatggaagaaaccaagaggtggtccgcactcaagtcgtccaacccaacgaaacccaagtgcttttacttgaaggcataaatggatcatctttgaaaatcgtcaacgaaaacgagactgactacgctatcttctcagttgaaggaggtgaagtagtttatggattcagatatatggtaagaccactacgtcgccgtcctggtgcaagaagaatgttctggggattttaagtatttaagtaaaatataaatgctctgaat

SEQ ID NO: 2592 - DNA, 896 bp, Diabrotica virgifera
gattatggtgtgtcgtcctcaaataacattctgggcgtagaccaacaatgtaaaccagccgtagcccgtccttgtaaaccagcaggtagcccaacaggcccaggacgtcgtccattccgtcgtccagcttgtaggccaatgatacgaccaggccatcttcctggtcaaggtggacatcctgctcaaggtggccatcgtccagcccaaggtggtcatcatccagctcaacaacagcaccacccagctcaacaacagcaccatccagctcaacaacagcaccatcaaggtcaacaacagcaccatcaaggtcaacaacagcaccatccagctcaacaaaatagacctcaagttggacaatgtagaccaatgcgcagaccaagagtggttatgcgtcccgctatgctacgtaaacccattgttcatgatagatacaccgttgttaatcatggaactcatgcttttaccgctcagatcgttcatattaatggaagaaaccaagaggtggtccgcactcaagtcgtccaacccaacgaaacccaagtgcttttacttgaaggcttaaatggatcatctttgaaaatcgtcaacgaaaacgagactgactacgctatcttctcagttgaaggaggtgaagtagtttatggattcagatatatggtaagaccactacgtcgccgtcctggtgcaagaagaatgttctggggattttaagtatttaagtaaattataaatgctctgaaaaaaaaaaaaaaagggcggccgctcgctttctagttttagtttacaatgctaaggtatttattatataattttaaaaatttatttatacataaaatcttttttaaaattgaacaagatatttacattgtttcgaatcagattttgtacaaaaattg

SEQ ID NO: 2593 - DNA, 1220 bp, Diabrotica virgifera
accgttttggaagttatcaacacaagccacactgaagattggaattgagctgtgagttcaaaagactcagatgtattaggctcaattccaatctaccgttttggaagttatcaacacaagccacactgaagatgcagtttttagagctgaaggaggagatgttattgaagatcttgaggatttagttagaaatattgatgagcaaaaagaaactgttgttactcatattctaacaactttggagagcttccatttagtctcacgttcgtccgtcactgctttgatgtatgatcctaatgatgttaccctttccgaacatcataacttcactgttaccaacaatggacaatctgaaatagaagttgaggtgacatacaccgacagcgatgaccgtgccaatgatcaatacagggtagttaaaccaaatgaaactgtagtaattgagcataacaaagacgctggagtagctctattaaatatattgaacagacattacacagaagtcgctattatcacagccaccggtggaagagtagttcgagacattgaaagaaaaatcaaacaactagtatctgatgaacattcagtaatgctggtgaataatttccatctagcacctgcatcatctgtagttgtcatgcatcaagttggtagatatagacgaagacccatgtaccctgctggacatcgcaaacctcaacaacagcaccatccagctcaacaacagcaccatcaaggtcaacaacagcaccatcaaggtcaacaacagcaccatccagctcaacaaaatagacctcaagttggacaatgtagaccaatgcgcagaccaagagtggttatgcgtcccgctatgctacgtaaacccattgttcatgatagatacaccgttgttaatcatggaactcatgcttttaccgctcagatcgttcatattaatggaagaaaccaagaggtggtccgcactcaagtcgtccaacccaacgaaacccaagtgcttttacttgaaggcttaaatggatcatctttgaaaatcgtcaacgaaaacgagactgactacgctatcttctcagttgaaggaggtgaagtagtttatggattcagatatatggtaagaccactacgtcgccgtcctggtgcaagaagaatgttctggggattttaagtatttaagtaaaatataaatgctctgaataaaaaaaaaaaaaaagggcgggcgctct

SEQ ID NO: 2594 - DNA, 1094 bp, Diabrotica virgifera
attccacatcacataatagcagactgcgaaggcgttgtttgtttcataatctaataatctgataaactgttatgattgtaggtaaacgtggaaccttatcgtcaatgttttggtacctataaaagaagtcccatcagcagtttgcattcgtttattctgactagattaaacccagaaaacaccgccttcaagatgctccgcgtacaatctcaggaagttagcacccaagaatattcagtggagacgacgacatatgaaacatacgaatatgaaaccactttctctgtctcggagacatcgaaactagatcatttcgttttacctcctagaactacgatcttagcattgtctcagagcggcggagataaggaagaagacaaaaagtatgtcgtcaccaatcacggaaaagctgatctttttgttgaggtagtacacctcaataaccaagatgatgctccacaatggtttgtggtccagccagaccaaaccagtgagattgctattgaggacaatcttgaacaaagtgtgttgaaagtgagcaacaacagttacgaccaggaggtatcattttctgctgaaggtggtctcgttattgacgacttggaaaacaacattgaagaacttctagactcagacgaaacagaagttgaaatagtcgttctggaaaacttttctttaagcccaagaactgctgtcactgttttgagtcaaaatgttgaaggaagcgatgaacatcctggaaagtacactgtaactaaccttggtaaagctgctttcgatattgagttgaagcgtacttcaccagttcaaactctagaactccaccgcaaaaccgttgagcctaatacatctgagtcttttgaactcacagctcaattccaatctaccgttttggaagttatcaacacaagccacactgaagatgcagtttttagagctgaaggaggagatgttattgaagatcttgaggatttagttagaaatattgatgagcaaaaagaaactgttgtactcatattctaacaactttggagagcttccatttagtctcacgttcgtccgtcactgctttgatgtatgatcctaatgaatgt

SEQ ID NO: 2595 - DNA, 1923 bp, Diabrotica virgifera
  misc_feature (1744)..(1744): n is a, c, g, or t
  misc_feature (1789)..(1789): n is a, c, g, or t
accggtaattaccatcgtcagatgtaccgtcttctattccaagaagatttcatcctttgtaccttgtgttcacgcatcatttgttactaattatatatttattattttctcagtttcgagaacttcaaaattaaaatttttattgtaacccccatattttacataatttttttggactgaaatggtattcgattttaaatatatctaattttttgacaaatacattaaatttatttattatctatatatttataattaactatttttatattattaatattacatatttgtagggatgagcttacaaataaaattttattaatatttattttttacatactagttaggattaagaattttcatattttaaaatatgtcattatttatttttatatatcattatttttattttttataaattttttattaaaatataaatttaaattatttaaatttagtactgatgataatattagtattacaaaattgtatatttatcattaatatatagagctgatacagggattcggcaacatttgtttcacctgtttattaacaacatgtctttttgtatgaaatataccgtctcgcctgtccaaacacagcaaccaccggcttcaagatggcgtaccgaccacgatccatgcaagagagcacccaagaatattcagtggagacgacgacatattatgaaacatacgaatatgaaaccactttctctgtttcggagacatcgaaactagatgcagttttgagtttaccgaggagatgttaagattttttgttttgttatacctgtaacaacagagaggaggaggcaatatgagtagagcacatgcgacaaggagctgcagatatatcattcgctagactaaataatataagatattgaatgcttcccccgtcactcatacttcactattaccaacaaaggacaaggccgaaatagaagttgagagtgacatacaccgacagcgacgaccgtgccaacgccaatacagggtagttaaaccaaacgaaaccgtagtaatcgagcataacaaagacgccggagtagctctattaaatatattaaacagacattacacagaagtcgctattatcacagccaccggtggaagagtagttcgagacattgaaagaaaaatcaaacaactagtatctgatgaacattcagtaattgtggtgaataatttccatctagcacctgcatcatctgtagttgtcatgcatcaagttggtagatatagacgaagacccatgtaccctaatggacatcgaacctcaacatgttatggttcgtagacctcaataccatcctggacgtagaccagctgtaaaccagcagtagcccgtccttgtaaaccagcaggtagcccaacagcccaggacgtcgtccattccgtcgtccagcgtaggccatgatacgaccaggccatcttcctgggtcaagtggacatcctgctcaagccatcgtccagcccaatcatcatccagctcaacaaaatagacctcaagttggacaatgtagaccaatgcgcagaccaagagtggttatgcgtcccgctatgctacgtaaacccattgttcatgatagatacaccgttgttaatcatggaactcatgcttttaccgctcagatcgttcatattaatggaagaaaccaagaggtggtccgcactcaagtcgtccaacccaacgaaacccaagtgcttttactttgaggcttaaatggatcatcttntgaaatcgtcaacgaaaacgagactgactacgctatcttctcagnttgaggaagggtggaggtagtttatgggattcagatatatggggtagacacctacgtcggcgtcctggtggaagaaagaagtgtttgggggggtttttaaatttttaaagaaaaaaataaatggtttgggtttt

SEQ ID NO: 2596 - DNA, 987 bp, Diabrotica virgifera
cccgggccgacccaccacgcgtccggaaaacaccgccttcaagatgctccgcgtacaatctcaggaagttagcacccaagaatattcagtggagacgacgacatatgaaacatacgaatatgaaaccactttctctgtctcggagacatcgaaactagatcatttcgttttacctcctagaactacgatcttagcattgtctcagagcggcggagataaggaagaagacaaaaagtatgtcgtcaccaatcacggaaaagctgatctttttgttgaggtagtacacctcaataaccaagatgatgctccacaatggtttgtggtccagccagaccaaaccactgagatagctattgaggacaatcttgaacaaagcgtgttgaaagtgagcaacaacagttacgaccaggaggtatcatcctgctcaaggtggccatcgtccagcccaaggtggtcatcatccagctcaacaacagcaccacccagctcaacaacagcaccatccagctcaacaacagcaccatcaaggtcaacaacagcaccatcaaggtcaacaacagcaccatccagctcaacaaaatagacctcaagttggacaatgtagaccaatgcgcagaccaagggtggttatgcgtcccgctatgctacgtaaacccattgttcatgatagatacaccgttgttaatcatggaactcatgcttttaccgctcagatcgttcatattaatggaagaaaccaagaggtggtccgcactcaagtcgtccaacccaacgaaacccaagtgcttttacttgaaggattaaatggatcatctttgaaaatcgtcaacgaaaacgagactgactacgctatcttctcagttgaaggaggtgaagtagtttatggattcagatatatggtaagaccactacgtcgccgtcctggtgcaagaagaatgttctggggattttaagtatttaagtaaattataaatgctctgaatattg

SEQ ID NO: 2597 - DNA, 887 bp, Diabrotica virgifera
  misc_feature (825)..(825): n is a, c, g, or t
ctaaatttctatctattttaactgtttcttgttgaagttttagtacaaacaataaagcttatgatttatttcgaaaactacataagtccacataattaaaaacttaaagccgcgttctcattggtaaatttttcgtgaggactagtgaggacgtggctaaaagccgacaaccgatggagcgtgtgcgtcgaaaattcttacgaacacatccacattagcacatttacctcgagcatccaaatatttgcgacgaacagctggttcgacgctttataccagtgaggacgcgtcataatacaaaaaactaagtaacattttttagtctttttttttttgtctttcagatacatgcatttctaacagtgcttctactaatgctacaacaaattttatctcaagtgggcagaattagagaaaatcaatgtaaatgcagtacgaaatttgtatttgcccatttcagtcaattttttgtggtacattgtgggtactgtcgcccctgaaagagttttacttttcctgaaaaatttatctattaataacatatgtattgttttcgaaatgagactattcaattataacaaacacaaaaatgagttatgtactctattctaaaggttgtatacagcatttttagcgtattgtagctaataaaatatgtacacgattcgcaaaaagtatctgaatataataggagactacttatttacatatacatacatattattttggttttctaattggtagcgtttgattttgatccagcttgcattctatatatttacaaattggtcattttaatacacattttatagtatattccatctngaaacaaaaatttcaataaatattttattttctgcacttgcagtataattttttatataaca

SEQ ID NO: 2598 - DNA, 1621 bp, Diabrotica virgifera
cccacgcgtccgccacgcgtccgcggacgcgtgggcaaccacggaaaatctgatatagaagttgaggttacatacactgacagcgatgaccgtgccaatgatcaatataagccacgcgaacgcccacgcgtccgctatttcagattgtcctttgttggtaacagtggaccaacaaaggacaatctgaaatagaagttgaggttacatacactgacagcgatgaccgtgccaatgatcaatacagggtagttaaaccaaatgaaactgtagtaattgagcataacaaagacgctggagtagctctattaaatatattgaacagaaattacacagaagtcgctattatcacagctaccggtggaagagtagttcgagatattgaaagaaaaatcaaacaactagtgtctgatgaaaattcagtaatgctggtaaataatttccatctagcacctgcatcatccgtagttgtcatgcatcaagttggtagatatacccgaagacccatgtacccagctggacatcgcaaacctcaacatgttatggttcgtagacctcaataccatcctggacgtagaccagcgtgtaaaccagcagtagcccgtccttgtaaaccagtaggtagcctaacaggcccaggacgtcgtccattccgtcgtccagcttgtaggccaatgatacgaccagcctatcatcctggtcaaggtggacatcctgctcaaggtggccatcgtccagcccaaggtggacatcatccagctcaacaaggacaccacccagctcaaccacagcaccatccagctcaacaacagcaccacccagctcaacaacagcaccatccagctcaacaacagcaccacccagctcaacaacagcaccacccagctcaacaacagcaccatccagctcaacaacagcaccatccagctcaacaaaatagacctcaagttagacaatgtagaccaatgcgcagaccaagagtggttatgcgtcccgctatgctacgtaaacccattgttcatgatagatacaccgttgttaatcatggaactcatgcttttaccgctcagatcgttcatgttaatggaagaaaccaagaggtggtccgcactcaagtcgtccaacccaactgaaccccagtgcttttacttgaaaggcttaattggatcatcttttaaaatcgtcgatcaaaaacgagactgactacgctatcttctcccttgaaggaggtgaagtagttatggattcagatatatggtaaaaccactacgccccccccccccccggggagtaaaaaaaatgttctggggtttttaagtatttaattaaaatataaatgctctgaataaaatactcaaaaagaaaaatggctcaagaagtagaagagaccatgaagaggatccaatcccacaagggaattgttggaaccattgtagtgaactcagaaggagttacaataaaaactactttggataatacaacaacggcgcaatatgctggattagtaagttctttagcagataaagctagaagtgttgttacagatttggatccatccaatgaccttacatttttatgaattagatcaaagaaacatgaaataatgggagctccggataaggag

SEQ ID NO: 2599 - DNA, 1213 bp, Diabrotica virgifera
tgtatatttaagtttctatgtattttgactgtttcttgctgaagttttagtacaaacattaaagcttatgatttatttcgaaaactacataagtccacataattaaaaacttaaagccgcgtcctcattggtaaatttttcgtgtgtattgaactaattgttcgtcgtaaatcttactagtgaggacggacaatcgatggagcgtgtgcgtcgaaaattcttacgaacacatccacattagcacatttacctcgagcatccaaatatttgcgacgaaaagctggttcgacgctttataccagtgaggacgcgtcataatacaaaaaactaagtaacattttttagtcttttaattgtctttcagaaacatgcatttctaacaatgcttctactaatgctacaacaaattttaccttaagtgggcagaattagagaaaatcaatgtaaatgcagtacgaaatttgtatttgcccatttcagtcaattttttgtggtacattgtgggtactgtcgcccctgaaagagttttacttttcctgaaaaatttatatattaataacatgtattgttttcgaaatgagactattcaattataacaaacacaaaaatgacttatgtactctattctaaaggttgtatacagcatttttagcgtattgtagctaataaaatatgtacacgattcgcaaaaagtatctgaatataataggagactgcttatttacatatacatacatattatcttggttttctaattggtagcgtttgattttgatccagcttgcattctatatatttacaaattggtcattttaatacacattttatagtatattccatctgaaaacaaaaatttcaataaatattttattttctgcacttgcagtataattttttatataacagattgtaaactacaagtcactgaattataatttcatatttctctggtactatttctactttttctctgtactatttctcgtataataagcaataactccttacacaaaacctacatcacaatttcgtaattggatcgtctttgaaaattatcaacgaaaacgagactgattacgctatcttctcagctgaaggaggtgaagtagttgatggattcagatatatggtaagaccactacgtcgccgtcccggtgcaagaaaaatgttctatggattttaagtatttaaataaaatacacatgctctgaat

SEQ ID NO: 2600 - DNA, 4040 bp, Diabrotica virgifera
gtttcttgttgaagttttagtacaaacaataaagcttatgatttatttgagtaaaacgacaccaactatgaagttaacagtgagcttatttgtgctgtttgcagtgtttagtggttgttattctcagtttccacaattgggaacaacggagacttcaataggatacggaacaggatataatggggacacaattatagagtctgtttttagtttggcggattccattttgggttttgatcaggcagtggtggaggcactaagtaataacttcaataagctcgtagtagagttcgaggcggccatagcaaataccctacccttggttaaggaatttttcccggatccctcagcttatgatgtgattgtttacaaattaagcaattataccgatcaagttactgcatattttaaccaaaatacagaaaacctgaaggcagccttggatagcattcctaagccagatctacctataacttcgcaggcttcaatcggggccctaattccaagttttgtagaagtatttaactatttaagccaggtgataattcaagttgttcaaaaagctccacctgttcctaactttttttctgttctattaagtgtgttcttcgattttgttaaatctttaacaaatttccccaaacttcttgccagtgacgtgttctccggtgctggtgcatttggcgatctcctagagattataggaaagaaaatcatcccaagtatagtacctggcttcaatatatcagccatagtttccggtattcccgatatagtacccagctggaaactttaagcttacaaagctttataggcctggatcccgcgtaaccaaaaaagttttattacaactatgaagttaacagtgagcttatttgtgctgtttgcagtgtttagtggttgttattctcagtttccacaattgggaacaacggagacttcaataggatacggaacaggatataatggggacacaattatagagtctgtttttagtttggcggattccattttgggttttgatcaggcagtggtggaggcactaagtaataacttcaataaactcgtagtagagttcgaggcggccatagcaaataccctacccttggttaaggaatttttcccggatccctcagcttatgatgtgattgtttacaaattaagcaattataccgatcaagttactgcatattttaaccaaaatacagaaaacctgaaggcagccttggatagcattcctaagccagatctacctataacttcgcaggcttcaatcggggccctaattccaagttttgcagaagtatttaactatttaagccaggtgataattcaagttgttgaaaaagctccacctgttcctaacttctttcctgttctactaagtgtattcttcgattttgtggaatctttaacaaatttccccaaacttcttgccagtgacgtgttctccggtgctggtgcatttggcgatctcctagagattataggaaagaaaatcatcccaagtatagtacctggctttaatatatcagctatagttcccggaatttcccccacgcgtccgctatcttcacgatgaaacggacccatgggtccccccgccgaaacacagcaaacaccggcttcaagatggcataccgaccacgatccatgcaagagagcacccaagaatattcagtggagacgacgacatatgaaacatacgaatatgaaaccactttctctgtttcggagacatcgaaactagatcatttcgttttacctcctagaactacgatcttagcattgtctcagagcggaggagataaggaagaagacaaaaagtatgtcgtcaccaatcacggaaaagctgatctttttgttgaggtagtacacctcaataaccaagatgatgctccacaatggtttgtggtccagccagaccaaaccactgagatagctattgaggacagtcttgaacaaagcgtgttgaaagtgagcaacaacagttacgaccaggaggtatcattttctgctgaaggtggtctcgttattgacgacttggaaaacaacattgaagaacttctagactcagacgaaacagaagttgaaatagtcgttctggaaaacttttctttaagcccaagaactgctgtcactgttttgagtcaaaatgttgaaggaagcgatgaacatcctggaaagtacactgtaactaaccttggtaaagctgctttcgatattgagttgaagcgtacttcaccagttcaaactctagaactccaccgcaaaaccgttgagcctaatacatctgagtcttttgaactcacagctcaattccaatctaccgttttggaagttatcaacacaagccacactgaagatgcagtttttagagctgaaggaggagatgttattgaagatcttgaggatttagttagaaatattgatgagcaaaaagaaactgttgttactcatattctaacaactttggagagcttccatttagtctcacgttcgtccgtcactgctttgatgtatgatcctaatgatgttaccctttccgaacatcataacttcactgttaccaacaatggacaatctgaaatagaagttgaggtgacatacactgacagcgatgaccgtgccaatgatcaatacagggtagttaaaccaaatgaaactgtagtaattgagcataacaaagacgctggagtagctctattaaatatattgaacagacattacacagaagtcgctattatcacagccaccggtggaagagtagttcgagacattgaaagaaaaatcaaacaactagtatctgatgaacattcagtaatgctggtgaataatttccatctagcacctgcatcatctgtagttgtcatgcatcaagttggtagatatagccgaagacccatgtaccctgctggacatcgcaaacctcaacatgttatggttcgtagacctcaataccatcctggacgtagaccagcatgtaaaccagcagtagcccgtccttgtaaaccagcaggtagcccaacaggcccaggacgtcgtccattccgtcgtccagcttgtaggccaatgatacgaccaggccatcttcctggtcaaggtggacatcctgctcaaggtggccatcgtccagcccaaggtggtcatcatccagctcaacaacagcaccacccagctcaacaacagcaccatccagctcaacaacagcaccatcaaggtcaacaacagcaccatcaaggtcaacaacagcaccatccagctcaacaaaatagacctcaagttggacaatgtagaccaatgcgcagaccaagagtggttatgcgtcccgctatgctacgtaaacccattgttcatgatagatacaccgttgttaatcatggaactcatgcttttaccgctcagatcgttcatattaatggaagaaaccaagaggtggtccgcactcaagtcgtccaacccaacgaaacccaagtgcttttacttgaaggcttaaatggatcatctttgaaaatcgtcaacgaaaacgagactgactacgctatcttctcagttgaaggaggtgaagtagtttatggattcagatatatggtaagaccactacgtcgccgtcctggtgcaagaagaatgttctggggattttaagtatttaagtaaaatataaatgctctgaatcgtccgcgatacagtgcctttttgatacacacaacaacaacaacaacacacacaatattatcaacccagcactacagcagcaaggtgttgccaaatgaaataataaatttttaattttttttttaaaaaaaaattttttttttttccaaaaaaaaaaaaaaaaaaaaaaaaaaaaaaaaaaaaaaaaaaaaaaaacaaaaaaaaaaaaaaaaaaactcaaaatgctctgaataaaaaaaaaaaaaaaaaaaaaaaaaaaaaaaaaaaaaaagaaaaaaaaaaaaaaggggggggggggggggcggcggggggagaaggaggaaaaaaaaaatttattttttttggcggggcgggggggggggggg

SEQ ID NO: 2601 - DNA, 923 bp, Diabrotica virgifera
  misc_feature (847)..(847): n is a, c, g, or t
  misc_feature (884)..(884): n is a, c, g, or t
ataatattgctcggaaaacaatactcgcttattcagtgttggtcaacctttacatcgatatgactttcactgattttgaatcactgaattattaagtatggcatatttgaatttggcacattttatctggattggattgttaatttattctagctcagcattaaattcatcatggagatgggaatgcgaaaacaatgtgtgtcaaagaaagaggatcacaaatgctacaatctcgacagcactaagtcttccagcttgtcgtttattctgtactgatagtgcaggaatatggccaaaatctaccggagagttctcaatgggcagtctactaacaaaaatcaatgcttacagcatagacgttgtttcaaattcttctggaactgccattgcaagtttaataaaaggcgctataaaagaatttaagtctgatattcaggcttccattacatcgcctatagagtctggaggaaaatctgtattggtatctatccgtgtaactaattcatctattaatcaactgactctacaaacggacgaaagctattctttgtatatttcggaaactaactatggattaatcgaggttttaattatatccaacaatttctttggagcgcgtcatggtctccaaactttaagtcaaataattatctttgataacttaagaaacgagttacagatgccaatggaggcaagtataacagacaagccaaattttccgcatagaggaattttattagatacttccagaaactttgttaatgtagatacaattaaaaaaaccataaaagcaatgggcgcttcaaaactgaacacatttcattggcacattactgattcccacagncttccctatgtatcacgatctcatccagaattatccnaagtaggcgcatatagtccctcaaaacatacactgctaa

SEQ ID NO: 2602 - DNA, 1515 bp, Diabrotica virgifera
tgaagtgcgaaagagtattaatgtatatattggttatttcagtttttacttatatcgagtttatagtatatcgctgcactatcgttacggaaaagtgcatctataatgtggctccgtcaacctttacatcgatatgactttcactgattttgaatcactgaattattaagtaggtattaatagttattagtagtgcaacggtaaaataattgtcagtatggcatatttgaatttggcacattttatctggattggattgttaatttattctagctcagcattaaattcatcatggagatgggaatgcgaaaacaatgtgtgtcaaagaaagaggatcacaaatgctacaatctcgacagcactaagtcttccagcttgtcgtttattctgtactgatagtgcaggaatatggccaaaatctaccggagagttctcaatgggcagtctactaacaaaaatcaatgcttacagcatagacgttgtttcaaattcttctggaactgccattgcaagtttaataaaaggcgctataaaagaatttaagtctgatattcaggcttccattacatcgcctatagagtctggaggaaaatctgtattggtatctatccgtgtaactaattcatctattaatcaactgactctacaaacggacgaaagctattctttgtatatttcggaaactaactatggattaatcgaggttttaattatatccaacaatttctttggagcgcgtcatggtctccaaactttaagtcaaataattatctttgataacttaagaaacgagttacagatgccaatggaggcaagtataacagacaagccaaattttccgcatagaggaattttattagatacttccagaaactttgttaatgtagatacaattaaaaaaaccataaaagcaatgggcgcttcaaaactgaacacatttcattggcacattactgattcccacagctttccctatgtatcacgatctcatccagaattatccaagttaggcgcatatagtccctccaaaacatacactgcttaagatattaagaaatcgtacattacggaaaaatcaggggagttaaaatcattccagattttgatgctccagctcaccttgggggagggatggcaggatagggggtttgtagtgtgccaaattgctcccccatgacaaaatatggctaaaaccacatggggaacattttatcccaaccaaaaaaaattatattgatgtttttaaaaacttttttgggacatggtggccccattttaaaccaaatattttcaataggggggagaagggggtggccctttcctgtgttgaaaaacccccccaaaaaaatcccggaggggtataaaaaaaaaaaaattgggaaaaccccacgcgagataaagggtttttttcaaattttggggggaatttttttcaaataaattggttttgggggaaacattttttaaaaaaaacgcgggaaaaaaaaatattccccccccccttcttttgggggg

SEQ ID NO: 2603 - DNA, 1209 bp, Diabrotica virgifera
gacatctcaaagtttttctaaaacggttacatataaaccaataaatacatcattttaaagtatttttcacacattttgtaacacattttgtcaaaaatgaaaatttatgttttattaaatagtgtgtacctcaaaattggtggaaccactcaacaacagaagatttcctgcccattttatgattggagcagcaacagcatcatatcaggtggaaggtgcatggaataaggacggaaaaggagaaaacatctgggatcgactaacacattcccccaactctccagtgctaggaaaccaaaacggaaacatagcttgcgactcttaccacaaatataaagaagatgtagcgatgttgaaacatctaggagtcaaccactacagattctccatatcatggtccaggatcttacccacaggattcacgaatcgaataaaccaagcaggaataacgtactacaagaatctgataaaagaattgaaggataatggaattgaaccgttcgtgaccatcttccattgggatacaccacaacctttggaggatataggtggttggaccaacgaactaatcgtcgacaaattcagagactacgctaaagtactcttcgacaacttcggaaacgacgtcaagtactgggtgactttcaacgagcctaaacaaacctgccaagaaggatacggttctggacagaaagctcctgccataaagtcgcacggaattggagaatacctttgtgctcacaacgttattaagtctcatgctaaagtatggcatctctatgataggtactaccgaaaggaacaacgaggaatggtgggaatagtacttgatactatgtggatggaacctgatactgaaagtgaactggacaaagttgccgctgaaagaaaattgcaatttatattcggatggtatgctaatcccatcatcaacggcgactatccagcacaaatgaagcaattcatcgcgaaaagaagtatcgcgcaaggtttcaaacagtctcgtctaccgcaattcacaccagaagaagttaagtacatcaaaggatctatcgacttcttgggagtgaaccaatacacatcgatgttagtacgaaacatggatgataagtataaaaccgaagtagcgtgggaagctgactcagaaacgtatctttaccaaccagacaactgggaatcgactgcaactgattggttgaaagtcactcc

SEQ ID NO: 2604 - DNA, 1462 bp, Diabrotica virgifera
acaaaagtacatagggccataattttgattcatatgtggtataactaaatggccatatctcagcaaacctttatctgcatatttgtacactcttctagtttgcagcaaagcaggagatagatcctttacaactatttccatattagtttcttcccatatctgttttaaggccatatgtacaactccatcattttggatagggctcaaagaacatgtggagtacacaacaacacctcctattttaactaacttcaaagcttggaacaaaagctgtctttgtagttccggtaactgaagtcgttcctttactcttgatggtttaaagatattattgtcattttcatgaagggaatgtcgatcagttgtacaaggaacatctactaatattctatcaaaatcatattcttccatatatctaccatcaacattactcaatcgaatttttcctgttttgagccatttctcttcaaaatcaaacagaaattggttgtatacgctgtcaattctattaactctagagttagaaacatcgtttgaaacgatacatgaggggtacagagtttgtaaagctaataaacttttgccgccgggagcagaacacatatctaacactttgtgtcctggttttatgtccaaagctaaaactggaagaactgaaccaccatccattaaatagtaattatatacatcagttattgatctttttggtgattcaaaatcacttttattcccttcttcataacaatagacctctagatgatctggaaaatgaaaatcaaactccttctctatctgtactccaaattgggtattttgatcgtacaaattataatgactagattccagtataaaatcttcctttcctttaatttttgttgcgggaatatattcatgtagaacctccattgatagagcattttctgtgtctaccattcttctcatatcaatttcagctttttcaaggctactttttaacgagaaatctttagcttcaaactttttaggtgtaggatcttcttgtacggcttcatcagttttttcggttaactgttcatccattttaaacacttcgtctaaaagtcggtttttcttttttttgttcaatttcttctttcagataacctttttctaagttaaacaacgttcgcatattcaatgccccttttaattccaagtcgtactttgtttcttgaatatcaccaaaacaattgagaacagctacatacttatgttttcctaataatgcttttcgaatcgataaccattttgtatcaaaaacttgttggtaaaaatcatcaaaatggtttagggctttgtctacagggtttactttctttctaacaacagaccaatgatgtgcaggatgtttatatctaacaaattttttttgtttcttgagttatttgcttaaaaatactgtaagaaaacatttgatttaaacttttattacacctaaaattat

SEQ ID NO: 2605 - DNA, 933 bp, Diabrotica virgifera
aagcctctaaaacggacgcgtgagttttgaacgatttgtgtgaaaggtttattattatttattatttacatatattgcaaacatgaatacaatttttaacggtaacatcctgatgaatggaaatggagctctcaatggaaaaactaatggcacaaacgtagaaaatggagataacggagtatacacttacgaaactttaaacgaaactgcagaatttttgaagaatttggttcccatcaagcccaagattggtatcatctgtggctcaggcttgggtaccttggcagatgctttggatcagaaaatagcagtcccatacgaaaagattcccaattttcctgaaagcacagtaaaaggccacacaggagccctcgttttcggttatattggaggagttgctgtagtctgtatgaagggtcgtttccattattatgaaggatatcctctttggaaatgtgcgatgcccgtacgagtaatgaaactattaggaatcactcatctcatagctactaatgctgctggtggattaaatccaagatacaaagtaggagatattatgcttatcaaagatcacatcaacctcatgggttttgctggaaataatccacttcaaggacctaacgatgaaagattcggaccgagattccctcccatgaacaactcatacgacagacaactgataagagaagctaaaaggatagctaagggtctcggtttagaaaaggatatccatgaaggagtttacacctgcttaggaggacctaacttcgaaacggtagctgagctcagaatgttaaaaatgtggggagctgataccgtaggcatgtccacagtccacgaagtaatcacagcccgtcattgcgacttgacgtcctagctttcagtctcgtaaccaatgaatgtcttgtcgaatatgacaacacagaattccta

SEQ ID NO: 2606 - DNA, 1129 bp, Diabrotica virgifera
cctccaaaatttttaaacgatttgtgtgaaaggtttattattatttattatttacatatattgcaaacatgaatacaatttttaacggtaacatcctgatgaatggaaatggagccctcaatggaaaaactaatggcacaaacgtagaaaatggagataacggagtatacacttacgaaactttaaacgaaactgcagaatttttgaagaatttggttcccatcaagcccaagattggtatcatctgtggctcaggcttgggtgcgtattggaatgaaggtaccttggcagatgctttggatcagaaaatagcagtcccatacgaaaagattcccaattttcctgaaagcacagtaaaaggccacacaggagccctcgttttcggttatattggaggagttgctgtagtctgtatgaagggtcgtttccattattatgaaggatatcctctttggaaatgtgcgatgcccgtacgagtaatgaaactattaggaatcactcatctcatagctactaatgctgctggtggattaaatccaagatacaaagtaggagatattatgcttatcaaagatcacatcaacctcatgggttttgctggaaataatccacttcaaggacctaacgatgaaagattcggaccgagattccctcccatgaacaactcatacgacagacaactgataagagaagctaaaaggatagctaagggtctcggtttagaaaaggatatccatgaaggagtttacacctgcttaggaggacctaacttcgaaacggtagctgagctcagaatgttaaaaatgtggggagctgataccgtaggcatgtccacagtccacgaagtaatcacagcccgtcattgcgacttgacggtcctagctttcagtctcgtaaccaatgaatgtcttgtcgaatatgacaacacagaatttcctaatcacgaagaagtattggacgttggaaaagtaaggcaagaagtactccagaaatttgtgaaacaaatcattgaatttatcgcaaccacgaaggaattcaaacaataattcgttttaggattaactgtaaatatggaatttttaaattattttttcgtaataaatatatttaatttaataccccccccccc

SEQ ID NO: 2607 - DNA, 490 bp, Diabrotica virgifera
cattgccgagttctgaatttgattcagccacatctcgcattaaaaaagaaacgtagttaagaaaaaaatgttcgttacaagaatacttagaccagctgttgtgcagaatgtccgcttcatgtcacaattaggagacctaggaagcggtgccggcaaaggaggcggtggaggtggttccattagggaagccggtggtgccttcggcaaacaagaagccgcaagagaggaggaatacttctacaaaaagcaaagggaacagttgcaaaagctgaaaactgatcttaaagatgaaatcagcttccatgaagaacaaattaagagacaccaagaagctatttctcgccataagaaccgagtcactgaattagacaagaaggaatagtgagttcctatgaatcctcaaatttagttactctttattttcattcatgtatgttctaagatagtgtattgcttaaaattttgatttcttaataaacaataacttgtt

SEQ ID NO: 2608 - DNA, 869 bp, Diabrotica virgifera
gtatttgttatactgtttaatttaaaaaattggatatgtctgttagcaaaggattagcggaaccggacgtttatgtctgcactttgtcaccagagacccaaagaatcgctaaggaggagctgcgcgaagacgagcatactcgtcaaaccgcgctggcctccatgcgagaatggatcatgcaaaatccaaaaattaaactatgccggctagatggaaaattcttgctgcgttttttacgttttaagaaatttcacgtaactctcgcacaagaatgtcttgaacgttacatccttttgcgtcagacattcggagtcgcctttaactgcttggacatcacaataccaatgatgaacgatctaacggatttgggatacatgtttgcttgtccaaaaagagaccgattgggcagaagggttatattttacaggccaggagtgttcgatctatactcattctcaaatgccgatatgtgtcgcatccatggtgttgtgtatgagactcttttagaagatgaagaaaatcaagtacgaggatttgttcacgtcgcagatggacaaggagtaggattcccatacttgactttgttcagcatcagggaggctgtgcgtatagttaaaaatggagagaagaccctcccaatgagacacaaagaggttcacggtatgcacgttcttccaacaatgaagtttgctgtcgatttcggtatgtctctaatttctgagaagatacgtaatcgggttagagtatacagcaatgttcaggatatgatatcgagcggccacattgaagttgacattctacccaaagaatatggaggaaccatgccgatgggccgaatgatagcattatgggcatgaagaattgtacgc

SEQ ID NO: 2609 - DNA, 1785 bp, Diabrotica virgifera
  misc_feature (1741)..(1741): n is a, c, g, or t
ctcgctaaccaggcgttgcatagcccttattttgacagacggtaccgatcgtggtcgtagtggttttcagcgtcggtttaattcagcagtgaaaagtgatttttcaggctgaacagcgagtttttcttcatcacccgttaaaatctcttacaaagttcctgcaactaaaaatggcggctgtagcagcagcacagaaaaatcgcgaaatgttcgctattaaaaaatcttacagtatcgagaacggatatccagcacgaagacgttctttggtcgacgatgccaggtttgaaactttagttgtgaaacaaacaaaacaaactgttttggatgaagcaagacaacgtgctaatgacacattagaacctgaagtagatgaaacacctatacaaaaacaacctgcaccaaatacagaagatgataccggattaaccgaagaagaaattgtgctcgcaaatgccatcactgaaggacttgaggccgaaaaagctatccagaaagccgccttaatcctccgtctacgtgaaggaatgaactcactatcacgtgtacttaaagctatcgaaaaatatcagggtgtagttcttcatttagaaactcgccctaaccaacgcgacaatggacaactggatgctcttatcaaaatcgagatgacccgtgttaatttacttcagcttcttaagggtcttagacaatcaggaactttggaacatactactcttatcggagaagacaatatttctgcaaaaaacccatggtttccaagacatgcgagtgaattggacagctgcaatcatttaatgaccaagtacgaacctgatcttgatatgaatcaccctgggttctccgacaaagaatacagggccagacgaaaagaaattgccgaaattgctttttcctataaatatggggaacctgtaccatttattgaatatactgaaactgaaaataaaacttggaatgcagtgttcaccacagtttgcgaattaatgcacaaacatgcatgtgcagagtacagaacagttttcagaatacttcaagacgaagggatattcaatccacacaaagtaccacaattggaagaaatgtcttgttttatgaagaaacgtacaggatttactttaagacctgccgctggattacttacagcaagagatttcttggcttcacttgctttcagaattttccaaagtacacaatacgtccgtcacacaaaaacaccattccatacaccagaacctgactgcattcatgaaatcttaggacacatgcctctacttgccgatccaagtttcgctcaattttcacaagaaattggtcttgcatcacttggggcatcagatgaggagattgaaaaattatctaccatttattggttcacagttgaattcggactctgcaaggaaaatggagaaactagagcgtacggtgccggtcttctcagtgcgtatggagagcttctccatgctctttctgacaaacctgagcacagacctttcgacccagctaagaccgctcttcaaccatatcaagatcaagaataccaaccagtttactacgtagcagaaagtattgaagatatgaaggataaattcagaagatgggtatctcaaatgtccagaccccttcgaagtcagattcaacccacacaccggagagggtggaagtcctagattcagtagaaaaactggaatcacttgcacaccagttaaatacagaaattatgcacctttacgatgccatncataaaatgagggctcctgtcatttaaattattgatagggaaac

SEQ ID NO: 2610 - DNA, 928 bp, Diabrotica virgifera
catacctctccgtccggttagtttcgtattatctttttttacaattatcaaaaataagtaatacaacaggttttaagacatcaatatgacactaaaagtggttttatattttgggatgtatctaattgcagagatatctggacatgggatgatgttaaatcccccaggaagaagttctttctggaggtttaacgacactgcacctcgaaattttgacgataatcaagtgttctgtggtggagcttatgtccaaaatgaactgaatgatggcaagtgtggtgtatgtggagatccttatacagatcctcatccccaaagaaacgaaaataccggattttatggtataggaattgtcgtcaagacctatgaaccaggctcagttattgatgttaaaatcatgctaactgctaatcatctaggaaatttcacatacagtctatgtgaactcgaagattttgacgctccagaacctgaaaattgttttgaagatttgttactggaggatggttcagctaactataatgtagagtgggaagatgaagtagtcttcaataaggttcgactgccaaatttccaatgcgagagatgtgttcttagatggacttataaagcaggaaacaactgggggctatgtgaggatggaaaatggagaagaggatgtggacctcaagaacatttcatatcatgcgcagatattgcactattataattataaagacatttaacactattcagtaattttatagatcttatcctggataagcgcacccgcgtaccaaagaaagttgattgatggcaagctgaggatttgttaatagcttgacggtgtctagtcggacaaactttgatgtatgggaacactctaacaaggggaagtttttattggtggaaccgggattttaatttgagaacgtgtcatcctgacaag

SEQ ID NO: 2611 - DNA, 1014 bp, Diabrotica virgifera
accgtaaatggtgagcaagcactttgattttggtaacaaccaactttcaatagtttcgtgtataaactgatcgaagaaaatggccctggttttaaagagagcaatattaggatatcgatggctttttgacgaattaggggattcgaggcctctagagcagaatttgtttctgatgtcatcgccatttcaagccctggcagtgatcgtggcatacttttattttatttatcgtttaggtcctcgacttatgcaaaatcgggaaccttttgacctcaaacgcatattacttgcgtacaacttggcgcaaatagcagtaaacgcgtttatagtatacgtggcttttgacgaagtatggtttaacataaattggcattgcgaaaagataagctatggacgtgatcctcattcgatatacatcttaaaaatgtatcatctgttctttctaactaaactagctgatttgttggaaacgatattctttgtactgcgtaaacgacagagacaaattacatttttacacgtctaccatcatttcggcatgttcctcataatctggataactgtcagattcgttgctggtggatataacacttgggtaggattggttaattcagcagtacatactgtaatgtatacgtactacttcttatcctctttggacgaaaaatggaagcaaaatctagcatttaaaaaatttataacccaaatacagttggtacaatttacattttttgtaatcctctttggaaggcagctgtttgtggaatgtggatatccaaaacttttatgcatgttctttgtgcctcaaaactttttcatgatgatattattttccgacttctacagaagagcctatttaaaaaagcctaagcatgtagcctaagaaaaatacgattagatgacgccgtcagaagaggctttgttttagaagttcttaaattttccttaagttggaaatttaaatgtacatataattattgttacgatattatgaaatatatacttttagttatg

SEQ ID NO: 2612 - DNA, 727 bp, Diabrotica virgifera
ggccgccctttttttttttttttatttgccgtgccgaaagttgagccgtaaaaagtaaaattggttttactcgaattaatttaatttggtttggtttgatacaaatttccaatttgtttgcttatttactaaaccataatgccagccaaagcagtttgtgtactaaagggagaagtcaccggaactgtcttttttgaccaagcaagtggttccagtcctgtccaagtaagtggcgaaatctccggtttaacccaaggccaacacggcttccacattcacgaattcggcgacaacaccaacggttgcatctcagccggagctcacttcaatcctcacggtaaagaccatggtggtcccgacgcttccgttcgtcatgtcggagatcttggcaacgttgtagctgatgctagcggtgttgccaaaattaacatctcagacaaatatatttccttggagggagaacacaacatcgtcggtcgtaccgtagtagtccatgcagatcctgatgatttgggagttggtggtcacgaattgagcaaaacaacaggaaatgctggtggaagattggcctgcggagtcattggcttggccaagatttaaaatatttttgtaggggaccagtaaaagagtaattatataagtttatttttaatttaaaaagtgtcattcagtttttatcaataaaaagttggtttagagtgaaacaaaaaaaaaaaaaaaactccac

SEQ ID NO: 2613 - DNA, 863 bp, Diabrotica virgifera
aacacacgtccgcccacgcgtccgcccacgcgtccggtagaaactacaaagactttagaaagttgttggttgttgtcttcatgcgaacatttaacaaatgtaacacatattgaaccaagaacgaccaaaaaaattagttatcaaaaatgaaaatatcggttttacgatgaggactgtgatagtgcttgtgtctttgtgcatatttgggtttcaagtatactgtcaagaagaagatggcccttaccgcggaaaatatctgggaaagctaaactcctaccaccatcaagtatctggagacatatatgcagtagatgattggactctgttgttgacgtcatttagttatgatggaaacggagcagatacgttcttctgggcaggagccgccaatagaccaggacctcaaggttttattgttcctgacatgtatggaaaaacaaacgttttagaacgattctttaacaaagacttcaccttagtcttaccagataagaaaaaaatcaccgatattaaatagcgcgccatttacgacatctggagcgagaataccttcggggatatttatattcacgagtatattccacctccaacagtccaacgagtatcggagaattttagaaactagattgggatgactacggagtctgaagagatgctaactcccgaacggataacagaacaccaatgtgcatatgacggtaaagcaaagaaagcctatttctgggtaggggtaggagctcaacctgtctctaaaggatttaaagtccctgatgaatatggatatttagatcctttgagagcatataaaaatttaacaattacgttggagataccaagcgatagcacagtatttgacatcgact

SEQ ID NO: 2614 - DNA, 897 bp, Diabrotica virgifera
cggtgttacttggagaaactaacatcgttgacaaccatggcggataaagaaaagaaggtcaagaagaagaagaaggaagaaggcgaagcacctgctgccgctcctgcccccgccgaaaccaggtcctcctcaaagagttcctccaagaaagccaaaaggtctggttccaatgtcttctccatgttttcgcaatctcaagtagctgaattcaaagaagctttccaacttatggaccacgacaaagatggcatcatctctaagagcgatttgagggccaccttcgatgctgttggtaaactcgccagtgagaaagagctcgacgagatgatcaacgaagcacccggaccaatcaacttcactcaattgttgggattgttcggtacccgtatggctgattccggtggtactgacgatgatgaagttgtcgtcaaggctttcagatcctttgacgaaaacggcaccatcgacggagacagattccgtcatgccctcatgacctggggagaaaaattcaccggcaaagaatgcgacgacgccttcgatgccatggacatcgatgacaacaacaggatcgacacccaggcacttatcaccctcttaacagcagccgagaaggaagaaggtgaagaaggtgaagcagcataaacaccatcataacttacaacagaaagtcgatgtaaatctccacggctaccgtgtggttccactaagacgaaaacatcaattcggatacatctaagtgtgggtgtgtttcttatataatgccaatgaacacatatgaaaagggggacttatatgtgtattgtattatggatttggttttttggtttaattttattccggtgctttacccccccgccgactcaaaaaaaaaaatatattatttttttgtttctt

SEQ ID NO: 2615 - DNA, 1232 bp, Diabrotica virgifera
ctccctgcgtccgattttttattaaaatataaatttaaattatttttatttagtaatgatgataatattagtattaaaaaatttataggagtaccgtactagttctagatcgcgggcggccgctcgcgatctagggtgttacttggagaaactaacatcgttgacaaccatggcggataaagaaaagaaggtcaagaagaagaagaaggaagaaggcgaagcacctgctgccgctcctgcccccgccgaaaccaggtcctcctcaaagagttcctccaagaaagccaaaaggtctggttccaatgtcttctccatgttttcgcaatctcaagtagctgaattcaaagaagctttccaacttatggaccacgacaaagatggcatcatctctaagagcgatttgagggccaccttcgatgctgttggtaaactcgccagtgagaaagagctcgacgagatgatcaacgaagcacccggaccaatcaacttcactcaattgttgggattgttcggtacccgtatggctgattccggcggtactgacgatgatgaagttgtcgtcaaggctttcagatcctttgacgaaaacggcaccattgacggagacagattccgtcatgccctcatgacctggggagaaaaattcaccggcaaagaatgcgacgatgctttcgatgcgatggacatcgacgacaacaacaggatcgacacccaggcacttatcaccctcttaacagcagccgaaaaggaagaaggtgaagaaggtgaagcagcataaacaccatcataacttacaacagaaagtcaatgtaaatctccacggctaccgtgtggttccactccaacgaagatacatcaattcggatacatctaagtgtggtgtgtttcttatataattccaatgaacacataagaaaaggtgtacttatatgtgtattttattatgtatttgtttttaagtttatttttattcagttgctttaccatcacgcgactcataagaaatatattattttttgtttcataaaaaaaaaaaaaaaagagaaaaagctttcacaggacccccgtttacgatgggcggccttgggacggcctttgcaacttctagaccacgacccaagatggcatcatctctggccggcgatttaaaaaccaccttcgatgctgttggtaaactcggcagtgagaaagagctcgacgagatgatcaaacaagcacccggaccaatcaac

SEQ ID NO: 2616 - DNA, 2575 bp, Diabrotica virgifera
ccttttgcgtccgcacttagctgataaagactgtaaacaataaattaagcagtttaaataattttaatttaagatggctcttcctcgcgtattttctagtgttttacaagtagttaaaaatcataattttagtcagcacttaaaaataacaagtgccagaggtttccatacatcaaggtgcacatgggcagaaagactgttcactaataaacacgaatgggttgaagtaactgaaaaaattggaattgtaggaatatcacagtatgcccaggaagccttaggagatgtagtatatgctcaattaccagatgtaaatacagtggttaaacaaaaagatgaatgtggagcattagaaagtgtcaaagcagctagtgagatttatagtccaatttcaggaacagtagtagaaaaaaatgtagaagttgaaaataatccatcactgattaatacttcgtgttacgacaaaggttggttatacaaagtagagttatcaaatccagacgagatcaaggagttaatgtcagaagaaaagtacagtgagtttgtaaaaaccgaggaatctcactaaacaccaaagattttaatgtttgttgtatatattttgttgtgttatagacgttttggtaagattttataaaaagtaataaaaccttagttttaaaactaagataggtatggaaaaaaaaaaacttggagaaactaacatcgttgacaaccatggcggataaagaaaagaaggtcaagaagaagaagaaggaagaaggcgaagcacctgctgccgctcctgcccccgccgaaaccaggtcctcctcaaagagttcctccaagaaagccaaaaggtctggttccaatgtcttctccatgttttcgcaatctcaagtagctgaattcaaagaagctttccaacttatggaccacgacaaagatggcatcatctctaagagcgatttgagggccaccttcgatgctgttggtaaactcgccagtgagaaagagctcgacgagatgatcaacgaagcacccggaccaatcaacttcactcaattgttgggattgttcggtacccgtatggctgattccggtggtactgacgatgatgaagttgtcgtcaaggctttcagatcctttgacgaaaacggcaccatcgacggagacagattccgtcatgccctcatgacctggggagaaaaattcaccggcaaagaatgcgacgacgccttcgatgccatggacatcgatgacaacaacaggatcgacacccaggcacttatcaccctcttaacagcagccgagaaggaagaaggtgaagaaggtgaagcagcataaacaccatcataacttacaacagaaagtcaatgtaaatctccacggctaccgtgtggttccactaagacgaaaacatcaattcggatacatctaagtgttggtgtgtttcttatataattccaatgaacacataagaaaaggtgtacttatatgtgtattttattatgtatttgtttttaagtttatttttattcagttgctttaccaccacgcgactcaaaagaaataatatattattttttgtttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggccccttaaaaaaaacaaaattttaaaccgggggggggggaaaaaaaatttttttttaaggggccccaaaaattatttttgggggccgttttttaaaacgggggggggggaaaaacccgggggtaccccaatttttacccttttgaaaaccccccccttttcccctggggggaaaaaaaaaaaaagcccccccccctccccctcccccaaatttggcccccctaaaggggaaaggggacccccccctaagcgggcttttaaagggggggggggggggggttaaccccagggggacctttattttttgggggccccatagccccccctttttttttttttttttttttttttttttcccccagtttggggggtttttcccccaaaaatttaaaaaaggggggtcccctttagggtttctatatttggtttttcccccccccccccccccaaaaaaatttttttaggggtggggttttccggggggggccccccccccccctaaaaaaattttttttcccccttttttgggtgggggccccccttttttaaaaaggggcttttttttcaaaaaaggaaaaaaaaccccccccccccttttcccgcattttttttttttttttttaaaaagggagtttttcccccatttttccccccttttgtgaaaaaaaaaaggggggtttttttttaaaaaaaaaattttttaccccgccggatttttttataaaaaaataaaattattacttccttttttataattttttttggggtgggggccgttttcttttttgttggggggggaagaaaaaggggtggggggggcggggcgcaccaccccccacccc

SEQ ID NO: 2617 - DNA, 2781 bp, Diabrotica virgifera
acccacgcgtccgggagaaactaacatcgttgacaaccatggcggataaagaaaagaaggtcaagaagaagaagaaggaagaaggcgaagcacctgctgccgctcctgcccccgccgaaaccaggtcctcctcaaagagttcctccaagaaagccaaaaggtctggttccaatgtcttctccatgttttcgcaatctcaagtagctgaattcaaagaagctttccaacttatggaccacgacaaagatggcatcatctctaagagcgatttgagggccaccttcgatgctgttggtaaactcgccagtgagaaagagctcgacgagatgatcaacgaagcacccggaccaatcaacttcactcaattgttgggattgttcggtacccgtatggctgattccggcggtactgacgatgatgaagttgtcgtcaaggctttcagatcctttgacgaaaacggcaccattgacggagacagattccgtcatgccctcatgacctggggagaaaaattcaccggcaaagaatgcgacgatgctttcgatgcgatggacatcgacgacaacaacaggatcgacacccaggcacttatcaccctcttaacagcagcctttttttttctgaaacaaaaaataatatattatttcttttgagttgcgggtgttacttggagaaactaacatcgttgacaaccatggcggataaagaaaagaaggtcaagaagaaggtgaagaaggcgaagcagcataaacaccatcataacttacaacagaaagtcaatgtaaatcttcacggctaccgtgtggttccactaagacgaaaacatcaattcggatacatctaagtgtggtgtgtttcttatataattccaatgaacacataagaaaaggtgtacttatatgtgtattttattatgtatttgtttttaagtttatttttattcagttgctttaccatcacgcgactcaaaagaaataatatattattttttgtttcataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaaaaaaaaaaaggggggggggccctttaaaaacgcgaacaaattattcaaatcctcgtttaggcggggggggggggctgtcttttttttttttacctgccgacaaagatgaaatcatctctatttttgagtcttgcggggcgccaggaagtctacgagatgatttgaatcaacttcactcacggggcgttgaggcggaaatacgaaaaaactgggggacccacatttttttatctgcttggggaaccccccctttttctcccggtgggggaaaaaaataaattattagcagtgcccccacgcgtccgcggacgcgtgtacttggagaaactaacatcgttgacaaccatggcggataaagaaaagaaggtcaagaagaagaagaaggaagagggcgaagcaccagctgccgctcctgcccccgccgaaaccaggtcctcctcaaagagttcctccaagaaagccaaaaggtctggttccaatgtcttctccatgttttcgcaatctcaagtagctgaattcaaagaagctttccaacttatggaccacgacaaagatggcatcatctctaagagcgatttgagggccaccttcgatgctgttggtaaactcgccagtgagaaagagctcgacgagatgatcaacgaagcacccggaccaatcaacttcactcaattgttgggattgttcggtacccgtatggctgattccggcggtactgacgatgatgaagttgtcgtcaaggctttcagatcctttgacgaaaacggcaccattgacggagacagattccgccatgccctcatgacctggggagaaaaattcaccggcaaagaatgcgacgacgctttcgatgccatggacatcgacgacaacaacaggatcgacacccaggcacttatcaccctcttaacagcagccgagaaggaagaaggtgaagaaggcgaagcagcataaacaccatcataacttacaacagaaagtcaatgtaaatcttcacggctaccgtgtggttccactaagacgaaaacatcaattcggatacatctaagtgtggtgtgtttcttatataattccaatgaacacataagaaaaggtgtacttatatgtgtattttattatgtatttgtttttaagtttatttttattcagttgctttaccatcacgcgactcaaaagaaataatatattattttttgtttcataaaaaaaaaaaaaaaaaaaaaacgctcgcgatctagaacaaaaaagggaggcaaatggtaaaggaaaaaagggggggcgccgcgggggatgggcccggcctaaccttccggagaggggcccccaaaatctatttcaccggggcccccatttttaaaccccccgggggcggggataaaaccgggggggtacccccaccccggcccccttccgcaggcattcccccccttgctcgcccccgggggcccaaaaaaggaaaaaaaggcaaaccccccccactgcccccccccccctccccagctttgggccgacccccgaaggggggggggggggggggacccccgtggccggggggcatagggggggccaactttatatgagggccgggggggaggcgggggggggggggtggaggtagttcggg

SEQ ID NO: 2618 - DNA, 1235 bp, Diabrotica virgifera
tatcggtacacaagttaattgcctattatagaaaagacaaattgtttacttaaaattgtatctgaaaataatttcctgtgaaggaatataaattattaacgcccagtaacaaattcatggtcggctgctctttgtgatccgattttgataaaattttattttcactaaccggtttcataccagcagagaaatgtatgtgtggctatttatgaagatatgcgtagtttaaaaatattattgttcaaattagttcttgttgattataaatgactgaaaaatgttaccacaattatataagatggcgaattacactcaatgtgctgaaaatcctagcaattattattgttcagcacaagctagactgatcataccatctacaaatttgaataccataaatcttataaagaacttcagtttagataaaactaaatttgaccgagaatttatatacagaactcaatgtatacctaaagaatttatacaagatgactctgaactctattactatgcgtctaatctagttaatcaagaaatggagttctttcaattaagtgccaaagttgaagatgtgacctgtaacaaaataggattggaaataaatacctttgatatcatttgcttggttgtggtggttttttacaatatattgttaatgttcgccacgtataaagaaaaaaagctatgagaaggaaaaaggtttaaaatatgcaatttcaagattgtcgttgttccacacttggaaattaagatccaaaccacctaataccacagatttcaaaaacctaataaacatgaatggtactcgcgtattcggaatgttaataataattttacttcatattggagtagcgagtaacacaagctttatatctgatcctgaagtgtacgaaaaagtgtactatacgcttgtggatagtatcttaggttgtttaccagtgctgattgttttgtatttttttcttatatcctcttggctactcacgattcaagtacataacatatatgaaagaggtcaactgtcattgaagaatgttggaatactgatactaaaccgatatttcaggttaaacttggtaattattgtattaatgatcataagcagatcttcgtgggttacaatgataccaggtccagcaaatttttatacagttatggctaaccaaaagcatgcagtgaaaacgggctcccttcaatatttttatacccatatttatcggggcgtacatatatggaat

SEQ ID NO: 2619 - DNA, 1142 bp, Diabrotica virgifera
cccaaaatggattaactgactaactctaaaaatcttttgttctatataatttttaaactaagtcaatacttttcacgatttttttaccaagaaaaaaggagtcaacttgattttgagcttaactcgcttagttttgatgttagaatcttttttaaaacataaaaatagggctttactaaaggaattttaattggttttcccgaaaagtgcttcatttcttggttatttcacgttgaaatatttgatttgtaatttgacgaataaggacgtatttttcatgagctgcaactttgattttgctggttctatagactttacgagttcacattttttttcatttttttatattatgctgcatttttgctaagaatatttttttcgaccaaatacttactttttgagttatttgtgaaaatctactgaaaacgtaatttttttgtcgaaaaataaacattttcaatcgtaaataactcaaaaagtattaactaagttaaattctatagaactaaaattgctcagaattagtcaatttatccatctccggacttattttaaacgcgcggtttttcacccccaaacaggggtgactgtcacccccttgtaaaagcaaccaacggcgcacaaaccgtctaaatgttcatgcaattcggagttgatcctgaaaattacactgtatcgccgtatttcccgttcatttactggactacaaggtgtttctagaatctgtatttaatcctacataataataataaccggacgaaattacaagaaaaaatcgtagattaagtaaattatttattttttattaaaattatatttttcattcgattttgccgcttttaggagtgccttgtttttataacatagttataaaatttactgcaagtcctagtgaaattggtttttgtgggtgaaaatcgggacatttagtgtcccgatcaggtacaaatcggtacgcgtccccagatccctgaaaatcgggacgtcccgcgcaaatcgggacacctggtaacgctagttacgacacagccatccgttagtgtaataccaggtatatttgtctcataacgcagcccaagtgttaagcaaaatacatcaagaaaataagtttaatcctttaaaaaagtggtccagcattcttt

SEQ ID NO: 2620 - DNA, 1548 bp, Diabrotica virgifera
caaaaataccacggacatttgccctatcatcagcaggaatcaattatagggaaaagaataataataatcataatatcttatggcatttttgccggggagatcctttcggattgttccggcgccatttacatctttaaccctgtttgaagtaactggtatcgatgtacactagcccagggggaccgacggcttaacgtgctctccgaggcacggagggaaaggaatattaaggatcaatgttctcaccaatatattgtgcaataatgatgacttactggcaataattcctttaatagttagatcgcaaatatatagagtaaaactaaagataatattctattctacgtctttgtactggtttgatttaatggaacctcaactgaatcaatattatcatcaatatatttcacaatacatagttaatgttaattaatatatagcacaataattgatgtgcaataatactggcttgtataaatcatgttgcaatgtttcgcattatgcttattgataatttcttgtgaaatctggtaaatatttcatccagtgtggacattagcgcagttttatattttcagttgcaaagtggacattaaccgtgagataaaaagaaaacaagagagaaaacttatttcggaatgcgtttggagacatttcagttaatttattgtgaaatgaaaaaggggttggttatgtaaaaacttagggctaaccagacacaaaaattttagttgtttttatggttatgataataactaatttaacgagaataatattttttaacgttcgacatactcaaacaatcatcatttagtatctagattaatattgttgattaaactattacccgtatacgcgccaatggagcatataaaattcttaattgcctgtcaaaaaatgcacgataactatctcttaaaacctatcaaatttcatttgcacatctcgacaggttttagagcaataaataaatcgccagtttgtaagaaaaaattcaacatcccgtatctcggaaacgaagcatgtgtggacctatgtctataaagcaaacgtcaaatggtagttgtcagtctttttcacagaaaaccgttaaaatagatattaaatgacgaaaactttatttattttgggaaaatcgtaataaactgcatcatctagctaggacacttaattgtttcagatgattttaagatgattcaaatcttttttacggtagaaatgttgattaaaatacactgcgtttagttttcaattagatatacgcacttagaatggcaacactgccggcttcccacattcaataaggtatgtaatattattataatttatagacatgtctttataaacattaagagagtagacggcatcaagtcatagagtctcaatttcatcttcaaaatagaggtgactatttctttagttttttaatattcttttaaaaatccttacttgttaattgctttaaatattcatttattaaattaataggattattttgaactaactatctattcagtcattacaataatttatatacaatgcaataaa

SEQ ID NO: 2621 - DNA, 905 bp, Diabrotica virgifera
  misc_feature (874)..(874): n is a, c, g, or t
cccaagcgtccgaaaggttgctttactattcgtcttatcgcttaggccgtgtttcggttttcggacaaaatgataggactactacacagaaaccttctcgtcgaaaagatcagactttagttcgtacaaacccacgtacaacagtgccaacttgtcaaatccaaatgcaactcgtgagactctgatttctcgcggaggtcttcgccttcacgcttgtgtttgcgatgccaaacagggactaattttagatgaaaatactcaaaaatgcgtcaagaaagaagactcgccctccagcatgcaaaccaggagaagaaaaaagatgcattccatgtctatgtcacgaggccacttgtcaaaatcctaaaccattttgtcgtaaagacatgatttgctctgaggactgtcgtccgttttgtgtgtgtaaacaaggatacttaagggataattcaactggaacgtgtgtacctcaagataattgtccttcagcagcataagaaatataattgtatccaaaagaacgacaccgcacacgtcttacggaaaatgtaatatcactcaaatgcaattacatttacatgaacagatttgtctccaaattgcaatcggttcatataattgcgccgactctgaatcttgattaataatggtataaattgatataattaaatacaaaatcaaatgagtcggtacttgagttagagtgaaaaaacagattttttgaatcggcagttcataaatctttctacagatattaactcaggatagttcctctaattgccttagctcacgctggcttaagttattttcgatagcgactagactaataatatttatgattatgaccgttttatggacttcaaatgtgattacatanactttatttacatttacgccgttattatatc

SEQ ID NO: 2622 - DNA, 1021 bp, Diabrotica virgifera
ggaccggttctagtatgtgctcctagcaacaccgctgtcgaccaactcacggaaaaaatccacaaaactaaccttaaagttgtcagattgtgcgcaaagtcgagggaagcaatcgactcgcctgttagctttttagctttacataatcaaattaggaaaatggaaggcaataccgaattacagaagttgcaacaactgaaagacgagacgggtgaattgagttctgtagatgaaaaacggtaccgaatgttgaagaaaatggctgagaaggaactgttagaagctgcagatgttatctgttgcacttgtgtaggtgctggcgatcctagactggtcaggctcaaatttcattctatattgatagatgaaagcatgcaggctaccgaacctgaatgtatggtacccgttgtcctcggtgtcaagcagcttattctcgtaggtgatcactgccaattaggacccgtagtaatgtgcaagaaagctgcgagagctggtctgtcgcagagtttattcgaacgattagtagtactaggtatcagaccgttccgtctagaagtccaatacagaatgcatccagaactgtccagatttccctccaacttcttctacgaaggtagtttacagaatggagttagcgcggaggagaggaaactagcgaaaattgattttccgtggcctattcaagacaggcctatgtttttcttagttacgcaaggtcaggaggaaatcgctgggtctggaacgagttatctgaatagaactgaagcttcgaacgttgagaaaattgcgactagatttttaagatcgggtgtaaaacccgaacaaataggtgtcattaccccgtacgaaggtcaaagggcgtatttagtgcaatacatgcaataccaaggatctcttcatagcaaactttaccaagaaatcgaaattgccagtgtagacgcttttcaaggtcgagagaaggacataattattatgtcctgtgtacgttccaacgaacatcaaggaataggctttcttgacg

SEQ ID NO: 2623 - DNA, 1184 bp, Diabrotica virgifera
  misc_feature (1117)..(1117): n is a, c, g, or t
cgcaaatccgagaaattatagtttttgctgtaactttattgtcatttatctataaatatctaaatcaaacacacgcacgtggtcactattcgtatcttagacgcttatgcatctccaaacatagtaactaattatgttttgactaatagttcaattagaagccgatttaaaactggtttcaggattagtgttcaattgttatctcaaacatcgctggtatttagtatgtgtgtttccaacatgaaagatatagcgtgtgtaataatatatttatatttgcctgttctgatattatgcaggccaaataccggagaaattatagaaattgaacttcccaacagaagtggatttgatgttgatctgagtgcagtcacgcggttactaaatactgaaggtgctcaaaatgtaatcaaaggtgctcaacagttcttaacgcaggtaaatggaaaacctgtcacaatagagataatagatgctggccagatgccaaatcatcaaacctctaatagtcaaacttattggtcacagcagaatttcaaccgacagcaatggccacaacgtacacatcagagaccacaaagtatgggagaaaatgtttacattacaaaagatacaagatactccaacgatcctaatattgaagtatatgatgtatatactggtgaacagccaattcaccagaggtatccaaatcgacgataccccaatgggcagctaattccagtaggaccgatcagaacatatcctgaccctaatgtttatccacccaatcataacagatatccctatgatggtagaaacccttggaacactaatatttatgataattctagactaaatcctacacaacctacaaataaaccacgcccacatatgatgcaccaccatcatcattcttcaccacgtcctgcccccaaagatacttcaagtgatgaaagcatcatcgaagattctacaataaacattgacttaagcaaagatcaaaacacatcagagaaaccgaaaaaacccgattcgaataatgttgacggatacattgataagttccccgttattttattaaatgaaaatgaaataaggaaataaggaatatttataacgacactttttgtctgtnaatatacttaaaaataatattatttgtgtagtgagttaaattaaatataataaagatttttttattt

SEQ ID NO: 2624 - DNA, 627 bp, Diabrotica virgifera
agtgaacatggcgttattcaattcggttatattgttgtcagtgttgacccttattggtagcaccctcgtaacatcttgcaaggattatcctacgctgccgcccatccgtcccgtcccttgcagggtggataagtgggaagatgtttttcgagatcgccaatcaccggttattcctctcaaacattggggaaataaaagctactggattggcaccacctttcaggcaacttggtttgaagcaatagacttttgccatcaaatgcatatgcagctacttaccatcaactcagcagaagagaatgaagtaatttacggatatataaaacaggccaacaaaggttttgaatattggacagcaggtacgagactagtcgacgatattaagtacgtatggttcccctatggcgatttagtaaggtacacaaattggtcaaaaggtcaacctgattttctaactggagaacaatgtttacaactttggaaagctgatgaacagttacaatggaatgacagaccatgcgatgtccgcttttacttcatttgcgaaagatacgactgtcaaaatactggaagaggaccaccaagattgtaatattcttaaaaataataaacattatcattatcagt

SEQ ID NO: 2625 - DNA, 1279 bp, Diabrotica virgifera
ctggtttcgtctctttttgttttgcaatgtgttgtgttttccatcttttgcgttgttttgccggttattggtgtgatcatcactgtatacaatcgattcctaaaatatatttacacgctaatcgtggaactaaattttactgaatacataaaactcactctgtatatccacaaggtagtggaaaattacaatacacaaaacgttttcggtcaaaactgaccatcatcagtatgaacgtccagtgtacaagtatttgaaactagccacttaattaggtattgtaatggtgtaaattttttaccttttttttcgtatttatatcaaattaatcatattgtatattgattcagttactcttgtagcacataacccgacattatcattagtaataaatgaaaaacaaggaaacgtttgagaaaataataattttattggaaatttcgatgtaccattacagttacagttataaaaataataatttaattaaagagtgaagataaggcaagtatcagtcatcttaataatgtgtgttgccaccaaggttctgaatgacactcatcattcgatttggcatagaactgatcacgttttggatgtccctttggggaaaagtgatccattcctcaatgagaggcattcggacctcttcacatgttgttggagtaggcatgcgacgttttacacgccttttgagaaggctccatatatactcaatagaattaaggtctggactttgtgaaggccagtccaattttgcaatatgaacatcttcaagatactgtgttataatcattgccgtgtgtggtctcggattaacttggattagcagaaaaccattgccaatagacctagcatatggtatcacattatgatgttgtaggatgttccttatgtttctgtgtgctgttaatgtacccctctcaatcaagacgagatctgtgtgtgcctcgaaagaaagtttttcctcatgtcgcaactgacttctaacagttttataaagacactattttttttagctcttcttcatttgttattaataattatgtatgagttaaaatgccactgtttccgtctctgtttaaaccatctctctgttttgaagaagaattttgtctatggatccgagagatctgtagtcctgagaagaaatatatgtagttcttttcatcaacttttttttcaatgtgtcttcttttttttttttagcttagacatacaaatattatttatttattgacagattgtaagcatctattagcacatattagcttaacattat

SEQ ID NO: 2626 - DNA, 1243 bp, Diabrotica virgifera
  misc_feature (1199)..(1199): n is a, c, g, or t
  misc_feature (1209)..(1209): n is a, c, g, or t
  misc_feature (1217)..(1217): n is a, c, g, or t
gtttatatcaggcgattacatttaagtgtaatttaaaatacactatcaaatcaaacaacatgaaaggattaaatgtaatttgtgtaattattttatcagttttcgttatcaataccacgtgttataacaaatataccaaagaagctaatttggaaacaaacgatgtgaacaaaaataaggatgatgttgatgaaccagtggatttacgtcctataactctgaagcacctggatcggccttttcgtatggccaaattgaatcttttatggtccaaagcagttttgagactatctgatatcaaattaaaatccatctttggagacctcaaacttcatgataaagaagaaataacttggaagcatcttcgagcagaaggcaaggacaaagatggtaccatagaagcccaattaagaaaaaaattgctacagattatggagaactttgggttattggaccaagctgatgatatctcagatgttgaaaaagcaaaacgatggaaaccactcaatgaagtcagcgacaagcacattaataagagtatttttaaagataagaagctgaataaattgtgggaaaaagccgaaaaagcgggatttactacagaagagctcctagctttgagggaggagtttggacatcatcaagataaaattgatcagtattactcattattgcatgatgtgaagggccaacccgaagattatgaaggaaatgcagttgaagattctttagacaaatacaataaaatagagatccaggaagaaaaagaacctaataaagattatttagataaagttaatttactaagagaaaaacacaaggaagtcaacgacggctttgaccacctccatttactttcagccaaaggtccagcaagcaaagagtttgtagagcccaaagttcaaggtctgtggaaagttgctatagagagcaattttacaccaagcgaacttcattcattaaaaaccgaattgcttcactacgaaaataggttgttgaagctcagacatctgcaagtagaacatgctttaaacgaggaaaaattgaaggagaaacaaaaaattggaattgcaggcggtaaaacttgacacgcattctctgatggctgacaatattaagaagcatgccagaaaagtggagaagatacatctagatctctgaactagaattatgcaaaacatatcgagctataattattngtgtatgtantaggaaancagaatctacgtaatgccaaaattct

SEQ ID NO: 2627 - DNA, 895 bp, Diabrotica virgifera
  misc_feature (844)..(844): n is a, c, g, or t
aatctatgagatctactggagtagtgctcaaaatatggcgaattgcagatgtacctatgatagacatcctgaatgggtaactcaaataaatataataattctagaggaattagcaaaagtattttctttgatattgaacggtgaagtcagactaatccataattgtgcaataccgcttattacaaaataaaacaccgtagaactaacgagaatagtacacaactttgaaatgaacacccggtatataattcttgaactgattagcaaatacatgaggttagatctctgacatttcataattcttcttcctcgattagggaaattgtaacaaattaatagtttaacaatattttcaatgctcataattttaagattttttcacgatttatgtggtttaataagaaaaattggaaatagtgtgcagtgtatcttctaaaatctgtattattttgattcatatatttttatataattattaaatgaaatgcgcaaatgaaaagagatttattaactcaaaaatattttagatctgaatatcgtgcgataataagaaacacattttaacagtacgtctacaacaaaaaataccgtaaaacgagttaacttttattcaatagttgacgttgctcatctgtgttatacactaaaatcaaaatacgaaatagtcgccagaggcgtcatccctagtttatagggggtacaggttcttaagtggcagataggggtttccagtaacagtttgcagtaaagactacaatcactagtatggacagtttttataaacattaatcccatttaaatgttaccacttgacagtagaattttggttaaatttttatttttnatacagtgacgatatacacaaaagaacatttacaaatataacagctactac

SEQ ID NO: 2628 - DNA, 399 bp, Diabrotica virgifera
attttgcattttttatatattattgtaatataaaataaatgagttaatatactcgtatgatatcccaaagtaaaaaatacatgtgtattgaatattatcgactttactacagaattttttggacatctcaatgcatcctgcatcattcaaaattcactccattgcatgcgtagccgaccttctctgttctagttgaaatatcagtagtagatcattatttatataaacttctctatatgtactgttcctatttcaataagaatgtaataatatcgtttaactgacattcaagatattattttcgattattttactctcttacaacgttttactctcaaatcttcaaataaaacaacaggactaaagaaacactaacttaattttcataaaagcttcaac

SEQ ID NO: 2629 - DNA, 990 bp, Diabrotica virgifera
ataatagactgcgctcaaaagagcccatatcccctaatttataattttaccaataatgtacacctcagcatgagggttgatggccctagcatggtggcacaaactttgtacatgctttgaaggttgacaaatgtagtttgaacgaggaactattgcaacactatgtgctgtgatacctcgtaaagtgttgcgacggcccagtttgcaaattttcactagtaatcctcgatccctatcaaacacaattcctggtctaccaaaaattttgtctagtttgagcattgctactttcacgataatgcttaagtatgtcagcaactgtagacttagccagatctaatttttcagcaatttccagaattttttactctgacaatattttttaattatcaattggtgaaatttagtatgtggattggttaaaattgtgaaaggttgtaaagatgaacgttttcaataaattttggtttatccgaacatttagttgttagggcttgcacaccattgttctcgaaattgaatctctatttaaaacatacaactcataatatgtattgtacattctatttatcgtatattgtaaggtctttagctttagtacccttgtgtataatatagccgaattcagcaatgttacaaaaataatttaattgcttttaactgatctgtttattttttataaactctttatcattaaaaaaataaatatagatgattgggtttcgatttaattcgtgtctctcaccattctcctacaggtgtttcatattttacgtttcatcagggaagactttgtgaacggagagactctgtatcattttattaataatattcatctcttaaaagttggtatgtaaaaaaagccttatataaatttattgtctcatgctgtaggacaatactgcataaatcattgtttttctttatttttaagactgtataaaagctcagactttggtttaaaccttattaaatatatgatcaagttcc

SEQ ID NO: 2630 - DNA, 1169 bp, Diabrotica virgifera
cattgtagtccgccaacgacatatttcgagtaattgttcgggtgccatcttttgtaaagtgaagtgataaaacgatggacttacgtcctaccgaagtttgaaacgtttgtgttttctaaattaataatggatatgacgatgtatctgacggcccccctacagattgataaaatttgtagggcctgtttatcggaaaaaggagatatgaggcccttatttggagcatgtttagatgaaatgttaaatacttttgcatcactccaggtctcagaaaatgatggctttcctcatcttatgtgtgtgcaatgtgtcctgcaatgtagcagagcttatactttcaaacagcagtgtgagaagtcagataatattctacgacagtatctatctccagaatttcagaaacaactgtcagatacgcttgccgagaaacagagggaacaagttaaacaagaattacaagaacagctacagttttctgaacatctaggtactgtcattatcgaggaggatattccagagttcgttacatatactgatgatgatcaagtagtggtgaaagagggcttatatacaatagaaaccacaacagtaacagacgcaatcagtgaagaattaagcgagggtattgttttacagcttgaagagaaacaaccagaagataccggcaataaacaaaaatattcttgtaaaaaatgtgatctatcatttccattaaaagttgatcttaaggttcacatgatgtctcatccaaaagacctcgacttcgaatgccacgtatgcgacaaagcctttagcgaagctagaatcctgaaacgacatctaaaaattcacttagaacagaaaccccatcaatgcgatcagtgcgatatgtcattcgctgagagttcaaacctcactaagcataaaaagaagcatacaggagaattaaggaacattaaagggaaaccacatctgtgttcagtctgcggcagagcgttcaaatgggcttctagtttgtcaaaacacatgaaataccatactggacataaattgttgacgcgcgaatatctgaggaacacagtcatggtgaggtgtaaaaattaaaaaatgttcctcaaccgtgatctacgtatctcccccgcggcacgtggtggagatcttcactccagatgaacatcttggtgaatggc

SEQ ID NO: 2631 - DNA, 919 bp, Diabrotica virgifera
gaataatgaaatggcactttctgagattctataattattgtaaattgtatattaagttacgggagctctctctcctctagctaagtaccttaggataataattaatttgtgtttcgcagaaatattatttcgaaatatagatttctttgtaattgttcaatttttccctagggtttattaaaatgtacattcattcctagaaaattagagtcattttcatcatctacttggataaattcttctgttggagatacattattacccctcttcttgttcaactaagatcttactcaccatctccgatctcgggcgttctaaattagtgacgaaaaggctggctgcagcaatagttaatacttaaagttgctggtaccgcctttttccttttatatttggttatttctgatagtcttggcatttcgaaatttaccaagttaaataaacagcaataaagtaattaaaaaaaaaacaaaagtttataagttaggttaagggtaaaactttcaaattgcatgcaagccggattgcaagctgtaaaagaccatgcaatagacttgcatgaaagtcttgcatgcaaaaaattgcagcaagttttcttgcaagctgtaaagcagtcttaaccattacctgcacgcgtcctggccctagtcccgcatgcccgcatgtgaactttctagtcttccatgcctatcttgatatatacgaaaacagtttctttcaggtatatatattctctcaacaattttctttacctcaatttcccaagaaatgaaagaacggcacattcgacctaatagtcttttaagccacccgtacaagttgtttactagcataatatgtgtaatgggaagaaaattggagatctagagacctagggaaaatgcaggatttcaaaaagaaaccaacgaccatctacaaa

SEQ ID NO: 2632 - DNA, 1351 bp, Diabrotica virgifera
aaataaatttaatttatttcttaaaaaattagatatatttaaaaacgaataacatttcattacaaaaaaattatttaaaatatttattttacaataaaaattttaattttttagctcttttaaattcgaaaataataaatatataattattaattaataatccctgatacacaaggtacaaaaaataaatttttcttttataaaaataaaatattctctcacaatactaattaactatcattaaataaaatttttctttacttttactaaaaaatattttattattttaaaataaattttttttttttttgcatatccatacctcaaaagtcaaaatttgaagaagaaaacaattttacaagtcatcaaccatggaggctatggatattgttataccagaaaaagaagaaggtagtccttcggaagtaaaacaagtgctgcaggatgtggatactgaagatttgtacactaaatataaaaaacttcaacaacagttggagttcttggaggttcaagaagagtacattaaagatgagcaaaggaatctcaaaaaggagtatttacatgctcaggaagaagtgaagcgtatccagtctgtcccgcttgttattggacagtttttagaagctgtagatcaaaacactggcattgttggctcaactacaggttcaaattattatgttagaatcttatcaacaattgatagagaactcttaaaaccttctgctagtgttgctcttcataaacacagcaatgccttagtagatgtcctaccaccagaggcagattcttcaataagcatgctccaggctgatgaaaaaccagatgttcaatacagtgacattggaggtatggatatgcagaaacaagaaattagggaagctgtagagttacctttgactcacttcgaattgtataaacagattggtattgatccccccagaggtgtgttgatgtatggacctcctggatgcgggaagactatgttggccaaagctgttgctcatcatactacagctgcctttattcgtgtagtcggatcagaattcgtacagaaatatcttggtgaaggtcctcgaatggtgagagacgtgttccgtctagcaaaagaaaattctccagcaatcatctttattgatgaaattgatgcaatcgctaccaaacgttttgatgcccagacaggtgctgatcgtgaagtccagagaattttattggaactgcttaaccagatggatggttttgatcagacaacaaatggtaaggttatcatggcaactaacagagctgatacattagatcctgcacttctgagacctggtcgtctggacagaaaaatcgaatttccttttac

SEQ ID NO: 2633 - DNA, 1891 bp, Diabrotica virgifera
  misc_feature (1810)..(1810): n is a, c, g, or t
  misc_feature (1816)..(1816): n is a, c, g, or t
  misc_feature (1833)..(1833): n is a, c, g, or t
cgaaatttcagaagataatagttttatttactattctatatatttaaatgtgaagtgaatacaacaaataaacacagtaaagatggcccgatacggtcagcgtccggaaaacgctttaaagcgagcgaatgaattcatcgaagttggaaaaccagctagagcccttgatactctccaagaagtttttcgtaataaaaaatgggcgtacaattggtcagaatccgttttggaacctattatgttcaaatatctggatctatgtgtagaactgaaaaaatctcacattgccaaggaaggtcttttccaatacaggaacatgttccagtcagtgaatgtaggatcacttgaaaatgttataagagggtatttgcggatggcagaagaaagaacagagaatgctagagaacagtcagcacaagcagttattgatatcgatgatttagataatttggctacacctgaaagtatattattgagtgctgtttctggagaagatgcccaagaccgttcagatcgtacaattcttactccgtgggttaagttcctttgggaatcttactgtcaatgtttggaacttttgcgtacaaatgcacatgttgagaacttgtatcatgatatagccaggatggctttccagttttgtttgaaatataatagaaaaacagaatttagaaaattatgtgataaattgaggaaacatttagaggatatctgcaaattaccaacacaaatggcaaatgtttctatgtctaaaccagaaacccaacaacttaatcttgaaacgaggctccatcaactagattttgctattcagatggagttatggcaagaagcctacaaggccatcgaagacatccataacttgatgaatttgtccaagaagagtccagtaccaaaaaccatggcaaactattaccagaaactagccatggtgttctggaaagctggtaattatctattccatgctgctgctttgttcaagttcttccagttgtcaaaggagatgaagaagaacatcactccagaggaattacaaagaatggcctgtagggtattaatcgctacactagcaataccgttgccttccgctcaccctgagtttgatagattcattgaaaccgacaagtcacctttagagaaggctcagcgtttagctgttttattggggctgattcaaccacctactagagctagtcttttgagagatcttgtaagagttaatgttgtgaacctggcaagtccacaactacaagatttgtacaattggctggaagtggagttccatcctttactattgtgtcagagagtgcatgaggtaatcaaatctctcgaatctgaagaaaatgcagccctccaacaatatgtgccagctttacaagatgtaactctggtgcgtctagtgagacagatagcacaagtctatcagaccatagaatttgctaggttgatccagattgccaaatttactacaccttttcatctggagagacttttggttgattgtgtgagacacaatgatatgcaaattcgtattgatcatggcaaagactgtatccactttggaatggacttgagtgagagtcaaagagaggacaaaccagagggacccactttgcaagttatgcctagtgagcaagtcagaaatcaacttattaacatgtctactgttttgaatcaagccatacaagtcattaatcctaataagaagaagcttgaacgcgaaaaacttagagctgttatggttcagaattatcacgaaacaaaggtaagggaacaccagaaaattttactaagacacaagattatcgangatagnaaggatacattgagcgnttgatacagtcagggaagaagagagcagaaaagatggaagaatgcacggcagacctac

SEQ ID NO: 2634 - DNA, 1924 bp, Diabrotica virgifera
gaacaccagaaaattttacaaagacacaagattactgaggatagaaaggaatacattgagcgtttgaatacagtcagggaagaagaggagcagaaaagattggaagaaatgcaacggcagcacctactggccgaacaaaaacgattggaccaagaaagagaagaaagagagcggaaacgtgctctaaatgaaatccagcaggttaaagacagacacttaaaggaaaaactacaacaaatcagacagactggtcatggtcagaagattctgaagaaaatggatgaagacgatatcaaaaagcttgatgcagaccaaatagcggtgaaagaagcagaagagctacaaaaggaacgtcgcgaacttcaagccaagctcaaatctcaagaaaagaaggtagactatttcgagcgtgccaagcggttggaagaaatccctctacttcaagccaatatgcaagaacgtcaattacaggatcagaacttctgggagcaacaggagaaagagcgaatcgctgcagcaattgaagagcgcaagctggccgtcgcaacgagagaccgtttgctacgcatgaaagtcgacaaagatgaattcatctcgaaattaaagaaggagagaaacattgtctacgaagacaatcttaaggaattcgagaagatgttgagcgaggaaagaaagaagaggcttttggaaagaaagatccaaagaaaagaggagcgccgtgctacatatattaaagaaaaggaagaagaagccgaacgtagagccaacgaaaagagacgtcgcgaagaagaagaaagggagagattagaggaaatagcgagaaaagaacaggagcaacaagaacgcgcactaaaggaggaacaagaaaggaagaagaaggaacatcaagagagtttggatagagcttggacaatgcagaaagctaaagaggaagaaatcgaaaagaaattagcaatggagaaagaaagcagcgacaaaggaaaagattcttggaggaaagaccccaagaatagctcttcttggaggagggacgagaaacctgctgacgaacccaaaaatgaaccttggagagcatctcgtttccgatcaaatgctgaagaacccccaaaaggcgacaacaccactacttcttcttggaggaatgacgataaaagggaagatcgcagagacgatcgccaaggtgaacgtcgcggcggagacggcggaagatttggcaaccgcgacagcggaagatttggcgacagagacagagaaggtggtgtcagattcacgagagataatcgggataatcgtggggatcgcagggacgatagggagaggagagacgacagagataacagggataggagagacgacagagatcgtagagatgatagggataggagagacgacagggagcgtagagatgatagagagagaagagacgaccgtggcggaagagatgataaccgggaccgccgagacgatcgtgatcgtagagacgacagggaccgaagaggcggggacgaaggtacttggcgtagaaagactgacgatgaccgtcgttctactcctatgagaagagaagctgctccagaatcagcatggaggagtgctaaccgagagaccgatcgtagagatgattctaagagagacgatagaaggggaactccgatgaccagagaaaaaccagctcgcgagcagcaatctcagccagaaggcgaggagggctggtcccaagttggaaggagacgttaagccattatataatctagactagagaattaagttacacaattataccgatattttatttacctacaggttacgagggttttcatttatagtaatcattgttttaatgcggaactggcttgaactcgttgataaggcagtgctgtgtgctaattaacccatatagttaataaaatttcagatattatac

SEQ ID NO: 2635 - DNA, 915 bp, Diabrotica virgifera
  misc_feature (831)..(831): n is a, c, g, or t
cggacgcgtggggccaggttgtaattagtgctcatactttaatttttatttttggaatatacatcactaaaacaaatcattaataatgggtggaatgacacagcgaccttggaccccaacaaagcgtcgtggccccatcgctgctgaattcaaaggtcctggaccagcatgcgtggcgttaccgtcctatataggaagaagaactaccgaatcaagatctgaacgagctccagcgtttagtttcggatcaaggcaaaatggaaaattagaaagcatcggcccaggtccgggtcaatataacataacaggaatgagtgcaaaaggtaaagacacacccccagcattaagcttacacagcaggccaaaagaccaaaagcctgaaaattttccggctcccggagactataatccagataaggctgaaaaagtgatacacgacagtgctccaaaatatacatttgggctaaagactaacgtagataaaccactagacactccagctcccaatgtctacaaaatagccgagactctaacagccgatgctccaaaatacacgtttggaaccaaggtcaacgtagaaaaaccagatattgtctgcaccaaacgtatataatatcccatcggctgtgggtgacagaggatcaccggcttataccatatctggtcggactaaggaacttttagacgaacgtgttaaaaatcctgctccagggcagtacaataatgtagatccggagttctataaaagccattctccagcatacacgatgagcggacgaattaacgttcccaaagatgataaaattcctggacctggtgtttattctcctngaaaagttactttagatgctccgccagcacatagttttggaataagacattccccattctctgaacactattgatcaacaccgt

SEQ ID NO: 2636 - DNA, 1006 bp, Diabrotica virgifera
ctagttctagatcgcgatctagaactagctcagttgaacctcagtcttccagttgcaaaattgacgaaacaaatacagacagaggtactcgaccatgtctaccagtgccaaaaataatgttgtcaagctctttgacagaccaaaagagctggttatcatgcccaaaggaaatgaccaaactgtatttgatgttccaagcgactatatacccgatcaatataaaagtgttggaaatcagatcgtatctcgatttggagaagaagctcaaggtggtaaaattcctgtaaacactatttccatacctccattgggtgagattttggagttaagaagagacgagaatttctctcttttcttgccgaaacatagaaaaattgctggacaacttattaacatttttataggtatgcgcaacgttgatgatcttctctcagtagctgtgtatacaagggatcgtgttaatccatatctattcaactatgctctttcggttgcactattgcatagagctgatacccaggacgtagatttaccatccttcattagatcctttcccgacaaatatgtggacagtaaagtattcgccaaggctagggaagaagccaacattgttcctaccaattcaaggacaccaattgaaataccaagagattttactgcttctaacttggaaccagaacatcgtttagcttacttcagagaagatttgggaattaaccttcaccattggcattggcatttggtttatccattcgaagctgctttcgatgtggtcaataagaataggagaggagaacttttctattacatgcatcaacaaattgttgctagatataattatgaacgtctctgtcatgggctgcaacgtgtcgaaagatttattgactggagaaaggcaattcctgaagcctatttcccaaaactagacagcttggtgtctagcaaatcttggccctctcgtgtagcaaaaccaaaactatccaccttaaaaaaaaactgatcaatt

SEQ ID NO: 2637 - DNA, 1380 bp, Diabrotica virgifera
  misc_feature (1275)..(1275): n is a, c, g, or t
  misc_feature (1351)..(1351): n is a, c, g, or t
  misc_feature (1378)..(1378): n is a, c, g, or t
ctatcacgcgtccggagaaactgatcagattactcaagatattgatgatcttgaaaggtggagggacagaatctttgacgccattcattctggaaatgctagaaggcctgacggaaccaatgttgcgcttactgaaaacgaaggtattgatattttgggaaatatgattgaatccagcatcctttctcccaacagagaattctacggagacatgcacaatatggggcacgtctttatttcttatattcatgacccagatcatagacatcttgaatcatttggtgtcatgggtgactcagccacagctatgcgagatcctgtattctacagatggcattcttatattgatgacatcttccagcaattcaagtctacattgccgagatatactgaagcccagctaagtaaccctggagttactgttgagagtgtcagcatagaatcaggaggtacacgtaacgccttaaatacattctggcaacaatctgatgtagatctctccagaggtatggacttccaaccacgtggtcctgtcttcattaggtttactcaccttaaccaccaggcatacaattaccgtgtcgtggtaaataactctggagctgccaaacaagcaacttgcagaatatttatggctcccaaatttgatgaaaggggcaatccatggttattcagggatcaaaagaatatgttcattgaactcgacagattcagagttaacttgaggcaaggttcgaacacaatcactcgcgcttcaactgattcatctgttactattccgtttgacagaaccttcagagatttggacaccagcagacctgatggtggaaacaacttggctcaattcaacttctgcggttgtggatggccacagcatatgttgattcccatgggtaataccgacaatccaggattcagatgcgagctctttgttatgatttcaaatatcgatgatgacaggattgaccaagacattactggaatttgcaacgatgccgactcattctgtggtgttaaggaccgtttgtaccctgaccgtcgttccatgggttttccatttgacagacaacctaagggaaagagttgatcactttgcagcaattccttactcccaacatgagagttcaagacgttgttattaatttttcgcacaggaccttcaggccaaactaaaaaaaatactttattttgaccattattttttttttcaagctaaagggtgataatatgtcctttattaaaaaaaaaaaaaaaaaaaaaaaactaatttttaangatgttgttattcgattttccaacaggactttcaggccaagacagaacaattaaattcatattttttctaaatggntaaagattgatactgctataagactanat

SEQ ID NO: 2638 - DNA, 1002 bp, Diabrotica virgifera
gacagatgattcatatctaataataaagcaataaaaagttaattttttgtagttttagggtggttttagctaataaactcattttcaaatatgttttcaagcggtcctaattacccaaaactcaaaacaaaccttagattatcaatatcaagattaaaattgctccagaaaaagaaatcagagttaacagagaagtccagaaaagaaattgcagactacatagtagcagggaagatcgaaagggccaagatcagagtagaatacatcatcagggaagattatcttgtagaagctttagaagtagttgaaatgtactgtgatttgctgctggcaagattcggacttatttcaaacatgaaagaattggatgatggaatagctgaagctgtatcaagtcttatttgggtggctccacggcttatgtcagatgtacaggaattgaaagtcattgctgatcttttggcaacaaaatacggccctcaatatgcggaagcctgtagaatagaatccgtcgaatccataagtgctaagttgaagcacaagttgtcaattcaagctcccccaaaacttcttgttgagaaatatatgatagaaatagcaaaatcgtataatgtgccttatgaacctgatgcacagattatggctacagagaaaggacacgatgcactgttaatcgacttatccacaaacaacttgggtggtggtggtatgccccaacctccaggattttttggctacccacaaccacctccgctaccgcagtttgtaaatcccatgccgccccagccatttacttacccggatcagaaaggtaaagaactcaatatcggtccaacagcaccccctacacctccgtttccctataatattcccaccaatggagaaaaagaagtaatactgacatcgggggaggacttaccaacttgaatctatctttatccaaatttcgagaccactgcaccaaaccctaatcagatcaagctgacgacaagttatgactac

SEQ ID NO: 2639 - DNA, 2306 bp, Diabrotica virgifera
tcgcgggtcgatacaagcaactcagttaacatattcgtttattggactaaagaagtacaggcaccattgttgtttaacatgtctaccagtgctaagagaaatgttgtcaagctctttgacagaccaaaagagctggtcatcatgcccaaaggagatgacaaaactgtatttgacgttcctaaagaatatatcacagatcaatacaaaaatgttggaaatcagattgtgtctcgatttggagaagaagctgaaggaggtaagattcctgtgaacactatttccattcctccattgggtgagattttggagttaagaagagacgagaatttctctcttttcttgccgaaacacagaaaaattgctggacaacttattaacatttacataggcatgcgcaacgttgatgatcttctctcggttgctgtatataccagagaccgtgttaatccttacttgttcaactatgctctttcggttgcattgttgcatagaactgatacccaggacgtcgacttgccatccttcattaggtcgttccccgacaaatatgtcgacagtaaagtattcgccaaggctagggaagaagccaacattgtgcctaccaattcaaggacaccaattgaaataccaagagatttcactgcctccaacctggaaccagaacatcgtttagcttacttcagagaagatttgggaattaatcttcaccattggcattggcatttggtttatccattcgaagctgctttcgatgtggtcaataagaaccgtcgtggagaacttttctattacatgcatcaacaaattgttgctagatataactttgaacgtctctgccatgggttaaaacgagtcgaaagattcattgactggagaaaagcaatccctgaagcttatttcccaaaactagacagcttggtgtctagcagatcttggccctctcgtgtagctaaccagaaactctccaaccttagaagagaaactgatcagataactcaagatatcgatgatcttgaaagatggagggacagaatctttgacgccattcattctggaaatgctagaaggcctgacggaaccaatgttgcgcttactgaaaacgaaggtattgatattttgggaaatatgattgaatccagtatcctttctcccaacagagaattctacggtgacatgcacaatatgggacacgtctttatttcttatattcatgacccagatcatagacatcttgaatcatttggtgtcatgggtgactcagccacagctatgcgagatcctgtattctacagatggcattcttatattgatgacatcttccagcaattcaagtctacattgccgagatatactgaagcccagctaagtaaccctggagttactgttgagagtgtcagcatagaatcaggaggtacacgtaacaccttaaatacattctggcaacaatctgatgtagatctctcaagaggtatggacttccaaccacgtggtgctgtcttcgtcaggttcactcaccttaaccatcaggaatacaattaccgtatcgttgtaaataactccggagctgccaaacaaggaacttgcagaatattcatggttccctgacgaaaggggaaatccatggttgtttaaggatcaaagcacattttcattggactggatataaaaattagcccgaccaaaaaaagaaaaaaaaaaaggaaaaaaaaaaaattcaaaaagaaaaaaaaaacaaaaaagaagaagggaaaaaaaaaaaaaaaagaaaaaaaaacgggaaaattaaccccccaaaaaaaaggggggaaattaagatcaaaagggtcaagaccagagcacaatacctgagcagggaagattatcttgtagaagatttagaagaatgggaaatgtactgagatttgctgtgggccagattcagagttatatcaaacatgaaagaataggaggatggaataggtgaagctgtatcaagtcttatttgggctggctccgcgggttatgtgaaaagtagaggaattgaaagtcattgctgatcttttggtagcaaaatacgggcctcaatatgcggaagcctgtagaatagaatcctgcgaatccataagtgctaagttgaagctactagttgatgattcaagctaccccaaaacttttctgctgaaatatatatgatagaaatagccacaatcgtataatgagccttatgaacctgatgcacccattatggctacagagaaaggactcgatgcactgtttatcgacttatccaccaacactttggggggtcgggggatgcccccatccac

SEQ ID NO: 2640 - DNA, 2431 bp, Diabrotica virgifera
gcaactgtagtcctaggaggtaatgaaagacctgttgttcttgaccgtccaacatttgacctcccaacgtcaagagacagagatgcaaccgtagttattggaggtaatgacagacctcttcttgaccttccaacatccagagatagagatgcaactgtagtcctaggaggtaatgacagacctgttgttcttgaccgtccaacatttgacctcccaacgtcaagagacagagatgcaaccgtagttgtcggaggtaatgacagacctcttcttgaccttccaacatccagagacagagatgcaaccgtagttgtcagaggtaatgacagacctgttgttcttgaacgtccaacatttgacctcccaacgtcaagagacagagatgcaaccgtagttattggaggtaatgacagacctcttcttgaccttccaacatccagagacagagatgcaaccgtagttgttggaggtaatgacagacctgttgttcttgaacgtccaacatttaacctcccaacatccagagacagagatgcaactgtagttattggaggtaatgacagacctcttcttgaccgtccaacatccagagatagagatgcaactgtagtcctaggaggtaatgacagacctgttgttcttgaccgtccaacatttgacctcccaacgtcaagagacagagacgcaaccgttgtcattggaggtaatgatagaccccttcttgaccgtccaacatctagagatagagacgcaactgtagtccttggaggtaatgacagacctgttcttgaccgtccaacatccagagatagagatgcaactgtagtccttggaggtaatgacagacatgttgttcttgaccgtccaacatttgacctcccaacatccagagacagagatgcaaccgtagttgtcggaggcaatgacagacctcttcttgatcttccaacatccagagatagagatgcaactgtagttattggaggtaatgacagacctcttcttgaccgtccaacatccagagatagagatgcaactgtagtcctaggaggtaatgacagacctgttgttcttgaccgtccaacatttgacctcccaacgtcaagagacagagatgcaaccgtagttgtcggaggtaatgacagacctcttcttgaccttccaacatccagagatagagacgcaaccgttgtcattggaggtaatgatagaccccttcttgaccgtccaacatccagagatagagacgcaactgtagtccttggaggtaatgacagacctgttcttgaccgtccaacatccagagatagagatgcaactgtagtccttggaggtaatgacagacctgttgttcttgaccgtccaacatttgacctcccaacatccagagacagagatgcaactgttgttattggaggtaatgatagacctcttcttgatcttccaacatccagagatagagatgcaactgtagtccttggaggtaatgacacacctgttcttgaccgtccaacatccagagatagagatgcaactgtagtccttggaggtaatgacagacctgttgttcttgaccgtccaacatttgacctcccaacgtccagagacagagatgcaactgttgttatgggaggtaatgacagacctcttcttgaccttccaacatccagagatagagacgcaaccgttgtcattggaggtaatgatagaccccttcttgaccgtccaacatccagagatagagacgcaactgtagtccttggaggtaatgacagacctgttcttgaccgtccaacatccagagatagagatgcaactgtagtccttggaggtaatgacagacctgttgttcttgaccgtccaacatttgacctcccaacatccagagacagagatgcaaccgtagttgtcggaggcaatgacagacctcttcttgatcttccaacatccagagatagagacgcaactgtagtccttggaggtaatgacacacctgttcttgaccgtccaacatccagagatagagatgcaactgtagtccttggaggtaatgacagacctgttgttcttgaccgtccaacatttgacctcccaacatccagagacagagatgcaactgttgttattggaggtaatgatagacctcttcttgatcttccaacatccagagatagagatgcaactgtagtccttggaggtaatgacagacctgttgttcttgaccgtccaacatttgacctaccaacatccagagatagagacgcaactgttgtaattagtggtaatgacagacctctttttgagcgccccacatccacaactcccctttctttatgtcccccccactcccaaaaaaaaagttaagcttacattaaaaataatgatgacaataaaaaatggttatataaaaatttaaaaaaagggggcttgc

SEQ ID NO: 2641 - DNA, 2442 bp, Diabrotica virgifera
tgcaactgtagtccttggaggtaatgacagacctgttgttcttgaccgtccaacatttgacctcccaacatccagagacagagatgcaaccgtagttgtcggaggcaatgacagacctcttcttgatcttccaacatccagagatagagacgcaactgtagtccttggaggtaatgacacacctgttcttgaccgtccaacatccagagatagagatgcaactgtagtccttggaggtaatgacagacctgttgttcttgaccgtccaacatttgacctcccaacatccagagacagagatgcaaccgtagttgtcggaggcaatgacagacctcttcttgatcttccaacatccagagatagagatgcaactgtagttattggaggtaatgacagacctcttcttgaccgtccaacatccagagatagagatgcaactgtagtcctaggaggtaatgacagacctgttgttcttgaccgtccaacatttgacctcccaacgtcaagagacagagatgcaaccgtagttgtcggaggtaatggcagacctcttcttgaccttccaacatccagagatagagacgcaaccgttgtcattggaggtaatgatagaccccttcttgaccgtccaacatccagagatagagacgcaactgtagtccttggaggtaatgacagacctgttcttgaccgtccaacatccagagatagagatgcaactgtagtccttggaggtaatgacagacctgttgttcttgaccgtccaacatttgacctaccaacatccagagatagagacgcaactgttgtaattagtggtaatgacagacctctttttgagcgccccacatccagagatagagatgcttctgttgttctagatttaggtaaaaatgttttaaataacattaaaaatggtgctgacaaaaccgtccaggttgttgacaacgttttaaaccatgcaacctccagagacagagattcttctgtagtaattgaacttcctgtatcaaaggatagagattcttcagttattcttaacggtcgcacgctaccaaccaccaacattgaaatagatcctggattcgctggcccattgagaaatatattgaacatcaagaaagtacagccggtagattggcaaaaatggttgattcaacaaaaacaaaagaacaacattgatataactgttattgaaaactggatcaataaccaacatgaagtattaaaactagaccaaagtattatagaggcatggataatgcaacaacaaaactcaaatccaagctttttgtacaactggatgattaggaaacaggtacccaatatgttaaacgaaaacggaccaatggtagaatcacctttgaatggaaaaggaccaatgatggaaccaactgggaaattaaatgtagaaaaagcaactccagaagtttggcaacgatgggtaatccaacaaaaacaacagaacaacgttgatttaaatgttatcgaaaactggatcaaccagcaacaccaggtattaaaacaagatgtaggagacttggaaggatggatcatccagcaacaaaagaggaatcctagctttttgtacaattggataatcaggaaagaggttcctcaaatttcctcccaatggtttgtccaaagtaaagaagttgaagaacctgaagtttcacaactatacgtaaatggacaaatggttgaaagcgtagaaccaagtgtttggcagcaatggttaattgcacaaaaacaaaaatacaacatcgatataagcgttatagaaaactggataaatcaacaacaccaacaaatgaagttggatgttggatacttggaagggtggatcatgcaacaacaaaacgccaatgctaacttcttggtcaactggatcatcaaaagacaagttcccagtttttcataccaatggaaaatggtacgcatggtttcacaaccacaaaatagcggcactttccacgtttggatcaacaatagaagcgtagagaaagtttcccctgaggtttggaaacaatgggtcagtgaacaacaaaggaacggcatggatatgagtcttgtagagagaaacatcaaccaatggcacgaatcactgaaggtagatcttgcatatttggaagcatgggtaatgcaagaacaacaagctgactccaaatttttgtatagatggacagtcgagagaaaaatccccgctatctcttacaagtggaagatggaaagtcagagagtacaacctgtagtcacaagcagctcttcacatacctacacctggaaagtacaaaagcaaacacaacagtaggaaattaaataacatcttatatatgatttagtcatagtcactttgaaattgacaagtcgattatgttttcttcctaatgccttgttgtaaaactttaattaatttgtatactaaaataaaattataatagg

SEQ ID NO: 2642 - DNA, 2812 bp, Diabrotica virgifera
ggtgttttgagacttccaacatccacagatacagactcagttattccagttgatgagaatggtaacattgttctaggcggccgtccaagagacagttctgtagtgctcgattttggtaaaaatgtcttagatcaagtaaagaatggtgctgataaaaccgtcgaagttatcaacgatgttttaacacgcccaacatccagagatagagacgcaactgtagtccttggaggtaatgaccgacctgttcttgttgaccgtccaacatttgaccttccaacatccagagacagagatgcaactgttgttcttggaggtaatgacagacctattcttgatctcccaactttcagagacagagacgcaactgttgttattggaggtaatgacagaccacttcttgaccgtccaacatccagagatagagatgcaactgtagtcctaggaggtaatgaaagacctgttgttcttgaccgtccaacatttgacctcccaacgtcaagagacagagatgcaaccgtagttattggaggtaatgacagacctcttcttgaccgtccaacatccagagatagagatgcaactgtagtcctaggaggtaatgacagacctgttgttcttgaccgtccaacatttgacctcccaacgtcaagagacagagatgcaaccgtagttgtcggaggtaatgacagacctcttcttgaccttccaacatccagagacagagatgcaaccgtagttgtcagaggtaatgacagacctgttgttcttgaacgtccaacatttgacctcccaacgtcaagagacagagatgcaaccgtagttattggaggtaatgacagacctcttcttgacttcccaacatccagagacagagatgcaaccgtagttgtcggaggtaatgacagacctcttcttgaccttccaacatccagagacagagatgcaaccgtagttgttggaggtaatgacagacctgttgttcttgaacgtccaacatttgacctcccaacatccagagacagagatgcaactgtagttattggaggtaatgacagacctcttcttgaccgtccaacatccagagatagagatgcaactgtagtcctaggaggtaatgacagacctgttgttcttgaccgtccaacatttgacctcccaacgtcaagagacagagatgcaaccgtagttgtcggaggtaatgacagacctcttcttgaccttccaacatccagagatagagacgcaaccgttgtcattggaggtaatgatagaccccttcttgaccgtccaacatccagagatagagacgcaactgtagtccttggaggtaatgacagacctgttcttgaccgtccaacatccagagatagagatgcaactgtagtccttggaggtaatgacagacctgttgttcttgaccgtccaacatttgacctcccaacatccagagacagagatgcaaccgtagttgtcggaggcaatgacagacctcttcttgatcttccaacatccagagatagagatgcaactgtagttattggaggtaatgacagacctcttcttgaccgtccaacatccagagatagagatgcaactgtagtcctaggaggtaatgacagacctgttgttcttgaccgtccaacatttgacctcccaacgtcaagagacagagatgcaaccgtagttgtcggaggtaatgacagacctcttcttgaccttccaacatccagagatagagacgcaaccgttgtcattggaggtaatgatagaccccttcttgaccgtccaacatccagagatagagacgcaactgtagtccttggaggtaatgacagacctgttcttgaccgtccaacatccagagatagagatgcaactgtagtccttggaggtaatgacagacctgttgttcttgaccgtccaacatttgacctcccaacatccagagacagagatgcaaccgtagttgtcggaggcaatgacagacctcttcttgatcttccaacatccagagatagagacgcaactgtagtccttggaggtaatgacacacctgttcttgaccgtccaacatccagagatagagatgcaactgtagtccttggaggtaatgacagacctgttgttcttgaccgtccaacatttgacctcccaacatccagagacagagatgcaactgttgttattggaggtaatgacagacctcttcttgatcttccaacatccagagatagagatgcaacgtgtagttattggagatacagacctgttctgaccgtgcaactgtagtccttggagggtatgacagacctgttgttcttgaccgtccaacatttgacctacccacatccagagatagagacgcaactgttgtaatttagtgggtaatgacagacctcttttttgagcgcccccacatccagaagatagagatggcttcttgttggcctaagatttaggtaaaaaaatgttttaaataacattaaaaatggtggttgacaaaacttgcccaggttgttaaaaaacgtttttaacccatgccaaccctccaaaaaaacaaaaatttcttctggaataaaatgaaactttcccggaatccaaagggaaaaaaaaaattcttttagattattttcttattacggtcccccccccttcccaaaccacccaaccattttaaaaaaaaaatcctctgggaatttcctttggcccccctttttaaaaaaaaaatatttttaacaaattaaaaaaaaaaaaaacaacgccccggggaaaaaatttgggaaaaaaaaaaggtgtgtgttttttttctccc

SEQ ID NO: 2643 - DNA, 973 bp, Diabrotica virgifera
  misc_feature (815)..(815): n is a, c, g, or t
  misc_feature (845)..(845): n is a, c, g, or t
  misc_feature (862)..(862): n is a, c, g, or t
gttgatagagaataaaagccagtaacaattattttttatggcgcactttaaacacgttgatttcgttttcaatctgtgtgtcgtgtcttaagaaatactacagatcttacttgcaacacgatcacccagttaacccgaaattgtgcgacatacaaacgtgaaagatcattgagttaaattgtagttaaccaattgaatcgtaaccttgattttacgacctttaattattcaaaatcatgaagtccaaaataatagacgcggaaaatctggattcaccaccgctgttggtgataaatagagaaggggttagaaaatattggggaaagtcggagtccgatgtatgtgaaattgttaaagatcttcaagaatggattaaggaacaaaatttcccggaaatgccaacgaatcatatgatagaattttttcttaccaactgcaaatataaaattgatgctactaaagatgttctcaatacatattacacaataagaaaacaagtacctgaaatatatgaagattctaatccccgactagcagaaatgggaaactcttggaatatggggtgttattgtccattaccacaattgacagatgacttgtgcagaatatctattgtcaaacttacctcaaatacatcaaattttgtagcttcttcatattttgccaatataatgaatatttatgaactacgaatatacgaagatttatgccttaccgaaattattatttgcgactatagtgctttaagttggggacatgtttttaaaatggatatttttactgttcgaaaatggcacatataatgaattcacttnaaaatagagtaaagcagttacatatcgtgnattccccgtcttgtatnaacataattatatcatttagcaaaaaattacttaataagaagatagcagataggattgtggtacataaatcgtatgatagtctttatgagcatgttccaaaagacttactt

SEQ ID NO: 2644 - DNA, 1094 bp, Diabrotica virgifera
acaatactctacagtgagcactattagtccgtcaaccgattgaaaactagttctgtttgttttatgatttagccctgtatagggattttaacaaatataccttttataggggatttcatggttttttgtaataaatggtatacaggaaattttttcctcgtggatttgttaaccctttaacgtagagacgcatatattcacttgcatcaaaatgtacttcagagcgagaaacacattcatttctataaataattaataaaacgtttatcttgtgtgcttgtttattaaattctacactaacgaacttgtttaccacaaaagtcgggaaatgcatagatgcgcggaagtgttaaactgaagcgcacggaagagcaaggcccaaaaacaccatatatggggcacggcacgtttaaaaactgccgtcgcgaaagggtactatagggagctattttctaaaaatttcattattagatcataatcattattcaattacgactgtatcagtcatagcttatcataagtttaaccacatttgttctcattgttttaagagagcattcttgttctgttttgtcatcttgccttatacctaaaatattgttttactgcacagttatcctgctctcaaactaaaaggaagtataacatagttaataacaaaaaagccttcattaaaacaaaattaaaatcatagattgttaattattggaacatacgaaagttgcttctagaactaagttagcgccccctttttttgcaaaaaaacagacgagcaatgaatccgaagaagatagctcctgctttcgtcactagctgtcagcccagaagaacgaaataaaacaactaaagctgcagaatcttccactgtcatgctgactgattcagggttcaagtttgtttttccagaattttaataaatcattatcgaatacatattgctgggacacagagatagagagaactgattaagatcaccagatctgagaaaccaagggggaaaaccagagagagatggggaggaccaggacatgagagaaatcaaccttcccgaaaggggagaaactggaggggaactatggaccttattaaaatgg

SEQ ID NO: 2645 - DNA, 809 bp, Diabrotica virgifera
  misc_feature (473)..(473): n is a, c, g, or t
  misc_feature (492)..(492): n is a, c, g, or t
  misc_feature (504)..(504): n is a, c, g, or t
  misc_feature (661)..(661): n is a, c, g, or t
ttaaaaatcattgagttttatcaaaacagtttatttttgggtttaaatattttaaaaatgtcttctccagcaccaaaatctccagaacaatcagataaaagcaagaaatatgaccggcaattaaggttatggggagatcatggacagaaacttttagaacattccaaagtttgtctgataaatgcaactgcactcggaactgaaattctaaaaagtttaattttacctggtatcgggtcatttaccatagttgatggggaaaaggttacagaagaggatataggttcaaattttttcttagaaagtgatagcattggtacatcgagagctcaagtgtccactcaatgtctgcttgaacttaatccagatgtaagaggagattttatagatgaatctccagaacatgtaatgtctcatacacaagattttttcaacaagtttactgttgttatagccactgctctacctgaganagttcttataccactctcnaaacatttatgngaatctgacgttccattgatagtctgtaggagtataggtttcttaggatacattaggctacaagtaaaagaacatacagtcatagaatcacaccctgatagtgaaaatcatgatttgagattactttcaccatggagatctttaagggaacatcttngaagtatagacgtttccatgttggactcaaaacaagaagtcatactccggctttagttattttatactactatttaataaataccaagaattgaatggaggagcaattcccaaaactagacacgaaaaggacatccttagaaaaatga

SEQ ID NO: 2646 - DNA, 865 bp, Diabrotica virgifera
gctctgtgatatacaacatttcatctaatcatgagaatcttatcaactttatgttttgtatttgcactgtttattgttgaaggatattcagcagctttgaacagaacaaagagtgctcttagaatagttggaggacaagatgctctaattcaggattatccgtaccaagtttcaattctcttttacggaaaacatggatgcggtggttcaataatcaatcgatactatattttgacagcagcacattgtacttatgatgtcacgaaatcagtgctgaccgtacgtgtaaactcttccttcagagacgagcaaggcacagtctacgaggtagatcaaatctttgtacatgatggttttgacgacagcacatacgacaacgatataagcatccttcgtcttgcaacacctttaacctttggaaacggagtcagtccaatcgcactagcaactgctggaacgcaaataaaagacggtttagaagcatatgccaccggatggggtcgtttgggagagcatatgccagcttctcatcagctacaagtcgttatgttacctgtaatttctaccgagacatgtgctgaatattatccccctggatgggttaccaggaggatgttctgtgctggttattacgagcaaggaggaaaagatacttgtgagggtgattctggaggaccacttgtagtatctggaattcaaattggactagtatcatggggaacaatatgtgcagcacctaagagacctggagcgtttacaaaaatacctgaattcgtcgattatattaattctataatatacaactaaaatgttttacgtttcttttatgactaaaatgaataaaagatattaatcatacagaagt

SEQ ID NO: 2647 - DNA, 839 bp, Diabrotica virgifera
ctcctctcagttttgtcgacggtgttgatcgaagacgagtcatgaaatttttgattgttgccgcattggtgtttggagcctgttcggcagaaccacagaggcggcctcattcctactatgacaaccaggctgaacaagacacaaacgtcccacaaaactaccaagataactcagatcaataccaacagaattctgtccaacaaaacccaccgcaacatcaggaaaaatcgcaatatgaaccacgagtaaaagaaactatcaaattcataccaattatcagattcgataaagaacaaggagaagccggtaattacaaagctgcatatgaaaccggaaacaacattatcgctgaagaagaaggttacttgaaggaactcggtccagatccagaccagcaaggacaagttatcaaatcgcaagtacaacagggtcacttcacatatacatcccctgaaggagtagttattgaaactaaatatactgctgacgaaaacggtttccatgttgaaggagatcatttgccaaccccaccaccagttagcgccgaagtacaaaagggattggaccttatttttgctggtatcagagctcaacaggaggcgttagaacaaagattaaaagatcacccagaagaaagagacagacctgaaaattacgacgatggtcaataccgaccggcacaacaggagtaattttactctttatttatagtttagcaccatcattctgtgattttgtcgtcatttctatagaatatcttctgtacagactgaataagattgataatacactgtggaaaaaaaattgataaaaatcaataaaaatctttttacacatta

SEQ ID NO: 2648 - DNA, 1096 bp, Diabrotica virgifera
cgtttaatacatctcttcgctcttttctgcagctaaaaacaaaaaaatacattttaatatattataaagttcttaagacatttttatattaaatttagtttcccataactttatggattattattataaaatacattacatatatggattaaacgctgaccccgaattagctgtggttcgatggagttgagactgacttaaggatattaaaaataagataccgggaatcgaatataatggcaacgaatcattgctgtgtactgtaaatcaaggagccatagaaaaacacacaagaagaacaataattactttttgtagtcacataacttcactcgtacctcgtcaatattgaagttcttaacccgggaacagtcgcgctcttttctgtcacgtaatcggtaccgcgttagattatatctaacaaaacgaatttaaatacgaatttacaacacatttttattttatagtattttcaacgaaaacagtttgtttataaattcgcaaaagtgtgtgtgatcttgcgttgcagctcctgcaatactcagatcagatttatcgatggattcttatgtagttttttcttctgaatccaaatctgaaaacggcatttcgatatttctaaccgtcttcgagataatcgacctcaaagtttaaaatgtgacgtcacaattgttttatttttctgccgacacactacacgtccagctgaaatcgttgctattaagtaggctagttttttaatctcgatttgttaagcaaagcataggttatttacatttgagtttgacacttcgtgaatgtcaaactaaatttcaaattaagtattaataaaacatcaatgatatttgatagtgaatttaattattatttaaaataaattaagatgttcaaaaaatacaatttgagtatagttttaaaagcaataatttattaacagctttaaaaaggtttatacgagtatacggcctcccctttatgataaatggactgttccatttgctatgaaattaaaatatggtcggttcgctgaactcgacacaactggccaagtgattttagtaggtaatttttttgttttttgcgaattttgccaaaa

SEQ ID NO: 2649 - DNA, 669 bp, Diabrotica virgifera
caaaaaatatcttagaagaaagtttattgtgcatcaattcactctttgtagattaagctaatactgaaataccggtatttttttcaacgagaacttttcgtttataaatttgcaaaagtctgtgtgttattgcgttgccgctcctgcaatacttagagcaggtgtatcgatggattcctatgtagttttgccttctgaatccaaatctgaaaacggcatttcgatatatctaaccgtcttcgagataatcgacctcaaagtctaaaatgtgacgtcacaatccggttatctcctacagacgcactaaacgtcagctcaaatggttgattaggaagtaggctactttttttttaaatctcgatttgccaagcataggttatttacatttgagtttgacacttcgtgaatgtcaaactaaattttaaattaagtattaataaaacatcaatgacatttgatagtgaatttaattattatataaaataattaagatgttcaaaaatacaatttgagtataaatattttaaaagcaataatttattaacagttttaaaaaggtttataccagtataaataacaagaatctaccggtcgagcaagtctcgtaaatttcccgattgcgagccacgcttcacgccaccgtgtttgcgtattgggtttctagttgcg

SEQ ID NO: 2650 - DNA, 1224 bp, Diabrotica virgifera
cgaaccgacagtatatgaaataatattgtttggtataaaaaattatggtctgatatatgcaattacattcttctaatggaaaaaatatttgaagatttttctcaaattatggataccaacaacattttcatttataactcttttatttttaatgtgacgaaaaaaaagttattcttcataaaaatctcttcatgttctaagatttatgatgtaaccatatataaaattttattaattttatacgaggtatataaaaaatatgaatttcgatcaagagtaaactacctttatagttcataacatttaaattagaatgatataattgcacattaaaacataattattaattctaaaccacttttcataatagcaattttccatattatgaactaaaatgcgtatataaacaaagttttcgttatgataatgctcgcattttcagcttgtttatcctgaattagaattatcattttaaagtagtaaaactactgttaatggtagattatatttattttaagaaataattttcaaaatagtatatttctccgcgaaatatgaaaaatgttttaacctgatgctcgttcgttaaattgacaaaacgtaatttcaattttgtaactgtaataaaagttattttccacgtgaacaaaaataaacagaatttaattttgacgttacgaatatgtataatatgtagttactgtcgccgttacaaattgttctttaccatttgtacagttacgaactgccgcgttaagagatcacggtcacggtataatcactattatatgtaaaactgtcattttagggaagcatcacatgttagcatatgaatatttttaattaatataagtcatgacaatatgaacaaaaagtgattttatattgttttaacttaatttatttattaaaaatttttgaaaactaaatttacaatttatatttttaccactctgcgtaaacagccaataaacaaatttttgtttgacttttctccaaccaatttttattaaaacatagaaaactagaacattgcattttgtcattgatttttaaacctggtgtaaaactatcttagtggtagtagtattgaataaggaaacaagtctgttgttttaagtactgattcattcaaaggtatgtaatattttgtaatttttatcaatttttttatatattaattattgtcaggatttactttgttgaaatatataatttattacc

SEQ ID NO: 2651 - DNA, 3288 bp, Diabrotica virgifera
  misc_feature (3196)..(3197): n is a, c, g, or t
agctgttgttatcctgttaaagaaaattataaattagagacagtttaaacaggtcgtgtaataaattaatgtgagacatggcttctaaaaagaaaatccaagagaaattggcaatcaaaaagaaaggaggttttccatataaacttttaattctgttgacattggcagttggaggtgcaatttcttatgatatcaaacaacatggcagttggaatgattctcttacaaggaaaacgttaaaagaatataaagtatgtgaatactcacatttggcgatagacagagttaagagcggattacattggacaagtgaaaaaattgaagaacagttcccaggtttgcaacaaaatgttgccgtcttttcagaaccttacgttgagttgctcgttaatctaggaaagattggtcgtaacgtcgcatttaacgtgaaagatgttatcgttgagaagtatcctgttgttgttgaatcggttgaagcttatttaccaggattagttgagaattcacagaaggccataagtgaagtttatataacatcagttttatatttcaacagaggtgtagactatcttaaaaatgaagtatttgtgggccaactctcaccagaaaacatgcagagagtggttgtcgaagcatttaatacgacacaacaaaaggctgttgaatactaccactggatttataaaaaagttcagacgagcatcaaatgaaatacgtatgttgattaattaggtttttcaatttatttgaaccaaaaatccgttactaccacaccaacttaggttcagtttcagaaataattttgcatacccctgtatacaagatctatttcgaatgtttgatattagaacttgcagatgtttgtgactttactgttaatattttcataggaatcgtttggttgcgagatattgagtacagtacaaaaataagtttgttggtagttctgctggacagtaataaatctacaattttttatacatttcttgtctttggttatagggtgagaaactagatgaatgaaagcgtactgctaagacatactattatttaagtttattgttttaatttataagttagatgtgcatgtagagaagcggtgtgtaattaggttccatgaaatctcgtaacgtgacagttcgtaactatacaaattcgtaactccaacccttaatttttttagcaaatttagtattactgaatttaataaaaaaatcattttgcattcctttgtatactaaaagtaatggtacttttttaagacgacttttttttagatatatttcacaccaatttttgcatatgttcttgttaatatgacaactaaagaatacattttttcattttcaacgaaaacatttcgtttataaattcgcaaaagtgtgtgtgttgttgcgttgccgctcgatggattcttatgtagttttttcttctgaatccaaatctgaaaacggcatttcgatatttctaaccgtcttcgagataatcgacctcaaagtctaaaatgtgacgtcacgatcgttttattttctgccgacacactacacgtccagctgaaatcgttgctattaagtaggctagttttttaatctcgattttttaagcaaagcacaggttatttacatttgagtttgacacttcgtgaatgtcaaactaaattttaattaagtattaataaaacatcaatgacatttgatagtgaatttaattattatataaaataaataagatgtccaaaaatacaatttgagtatagtttaaaagcaataatttattaacagctttaaaaaggtttatacgagtatacggcctcccctttatgataaatggactgttccatttgctatgaaattaaaatatggtcagttgtgtctgagttaagcgaaccgacagtatatgaaataatattgtttggtataaaaaaatatggtctgatatatgcaattacattcttctaatggaaaaaatattttgagatttttctcaaattatggatacccaacaacattttcatttataactcttttatttttaatttgacgaagaaaatttattcttcataaaaaactcatgttctaagatttatgatgcaaccatcatatgtaaaattttattaattttatacgaggtatataaaaaatatgaatttcgatcaagaatgaactgcctttatagttcataacatttaaattagaatgatataattgcacattaaaacataattattaattctaaactacttttcataatagcaattttccatattatggattaaaatacgtaaataaataaagttttcgttatgataatgctcgcattttcagcttgtttaatattttatttaattatagtaatttccacacactaacatatttctcaaattgagctctgtaccgccattctttactatattacgaatatatctgccaaatatctcaacaaaatattcaaaattaaagctgtaatcttggaacgcgttttccgcacgctgatgttgcctcttaataatgtataaacatgttaacataaatttatttgaatatgcaattcaggtattgttttaagaatatttattgcaactagtacgctcaacctatgctaatgaaatgtattatcaatacctaaatcgttcaagttaatgttataaccaaaaaatataattttcatacctaaactttggagttttgcttaagagaatattgtttagacatgtttcagagaaaaccacccatggaattttaaaaaaattttgttttattttttttttcgtatgaaattaaatctattgtgtattgattctgttactcttgtagcatgtaacctgacatcatcattagtcatcatcatcatcatcatcattcaacccggatctatccactgctggatataggtctccctcagtattttccatgtattcctgttttgtgcagttttcatacaatttttgtcgatcctctacttcgatataattcttgtcttggtctccagtgtattattcgctgtgttcatctgacatccgacattctagctatgtgccccgcccagttccactttagggtcataattctttctatggcatctgtcactcctgttctccgtcttatttccttgttcataatccgatccttacgagaaatgcctaacatcgagcgttccatggctttttgtataacacaaaattttatttcttattttnnctggtactgttaaagttctgcaccatatgtaagtactggcaacacgaactgatttcagatttttcttttgagacacataggcagttctgac

SEQ ID NO: 2652 - DNA, 1682 bp, Diabrotica virgifera
aaaaaaaaaaaaaaatttttatatattaaaagaaaaaaattttttttttttttttgttttttttttttataaggggggggggaccccgggttgttttcttttataaattttttttttataattcaaaggaaattttttccccaaattaaaaatttttttttaaaatggggccccgttcccccctttttttttttttttggaaatggggggccaaatttttgaaaaatatttcaaattcacgcccaattttggacgggtttttctcccggtgatcggtactgtttcccctttgcaaaaataatttttcgggttcaaaaatgcaatttttcgatttatgttcaacgccgtttatctcgaaaactatgcatcctacgaaaaaacttgtcagaccagtttttgcttagaatgacacaaaaaatacaaaaaaaatgttttgtttgcgagaaatcgctgttatgtaatccttcaagttctttgtttataacaatcttatcggcatccggatccactgttacccaacaaattcgtgtctacgggtcaagatacataaaaaatctgggtaagaccatctgaataaaggaggccgttgtacccccttggcgacaggactatgtataatatctacctaaaaaaaattggcattcgtactgtagtcaggatttctgtacctaaacattagatttattacgaatttcattttcaggggaaataacttttcacactttttttatgtatgacaacagtagattacttctcataggtacttacattgttaaaatttgtggtggctccaatttcgatgttctcataattttggcacggcttttaatggactttttcttggaattattcgctttatttgtcgtttgattaacttttcccatttcgttaaactattgataatatgttaaaaataaaaaattctcctaaaactttatactcacattagaattcgaaatatttttacgtaaaatatacttacctacctacatagaactaaaacacacaattaacaacaatctattatttcaaagaggccaacaacttatacaacaacaacaaatataataaattaactatcaataaacactattttcctatgaaacaactataacgaattcttaaattaacacactactgcactgaacagatatcaataaagatgacagaacaaattagagaaaatctgacgcaggtttgtcaaaatgacagtgataatttctctatgttgcctaattagttatttagttataatatgttcgatttcttgttagaaataaaaaattttagtagttccaagattacacaaaatctaggcatgggataaaatagtttatttgaagaaagtttattatttttttcttcttaatggcggtacaggctccttttttcaatattttatttagttatagagtaatttccacatactaaaatatttctaaaattgggctctgtaccgccattctttattatattacgaatatgtgtgccaaatatctcgacaaaatattcaaaattagagccgcaattttggaacgcgtttgatgccacctgttgctcgctactgtagcctcttaaacataagtgctgactggaaaaattgattttagttggtttttaaatactctactggaagaagagaataaatcgatgtccaaatcattcaggtgactcaaagttct

SEQ ID NO: 2653 - DNA, 1275 bp, Diabrotica virgifera
ccggttttaataccgggatcccggtatttgaaattttaaataccaaataccggtattgagattttagctcggtattgtaagccctaaagtcagtgacgttcgatttcttgttataaaaaaatcgatttttagtagttccaatgtgacacaaaatctaggcacgggattaaaaagtttatttgaagaaagtgtatttttttgtctttcttaatggcggtacaggctccatttctcaatattttatttagttatagagtaatttaccagatactaacatatttctaaaattgggctctgtaccgccattctttattatattacgaatatgtgtgccaaatatctcgacaaaatattcaaaattagagccgcaatattggaacgcgtttgctgctacctgttgctcgctactgtagcctcttaagagtttgcctgggatatctaaagtcaacgcccataaacattatacaagctgaagccgtggaacctcctcttaaactaagaagacaactgttgagcagaaaattcatgataaaaaccatttccaaaaaaacttcttacctcaatagtatacagtcactaacagttcaagttttgacccatagatactggcacttcaagaaaacccccctcatagtagaaactttctcagaaatagctgacattacagatatagtctattccaaccaactccccccggttttaatttactcacctgaacaaattttttcacgtgaaattagaacctactattttgaaagtcaagaaggagcatgtatcaatcaaacaaagttcaacgaaacaaaaaacaaatactgccccaactatgattctatattcactgatggatcaaagtccaaagaataataccagttgtgccttttaccatttttgaggaaaatactggaaaaaaatttattttagcaaaggaagttttcattatacactgcagaaattaacagcaatagtggcaagctatgaaacacttacttcggctttaacccacgacaaattcttaatattgacgggacagcaaaaagtggaattcaaaaaactttaaaaaatggtaaaaaaaaattaaatcacgtttaatccttatttaaaccctaaaaatcccctgtatttaccctaatggaaacaaccacactcacaaaattaaaggtcgcccctcatacttaattggggtaaaggggacaccccccaggataacaacggggcaacagaaaaatgggggggtgggcccttttcacaaaaacaaccctctccaaatttcccggg

SEQ ID NO: 2654 - DNA, 766 bp, Diabrotica virgifera
cggacgcgtggggcgaaatatctcatatttcttatctgataatgtggcctaaatattccagctttcttgttttgatgttcgttatgacctcacgatcctttacatacaacaaagtcgagaagccgtagcatcttacggatcttatcctcatctccagaggaaggtttcgattaacgaacgtttttcatttttataaatgcttgttttgcaacttcaatgcgtatcttgatttctataccttggtcattgttttcattttcccaggttcccagatatttgtagttattcactatttctacttgttgctcgatatctaaccttcctaccataagttgcttagaaataatcatgaacttggttttttaacgttcattatttgtagtccttactttatactgacttgatataatatatttactagttgcagtgcttctagatctatagtgtcatctatatgttgttctatttttttgtctagtcaattttgtataaattgttctgtactgggagcattctgttgcatatactgactttgctggtgttacaaacgtggacagcaaccaatcctggggaatatcgaggaactcactaaatccctaaacatactaatgtattgcttttcatatgatacaaaatggcgcctgtctaccattttcaatgataacttcactaaaacgtcaaaaaatgaacatttaaggaaaatggagactaaaatgtggttttcaattattttataaagatatggcttctttatatttttttaaac

SEQ ID NO: 2655 - DNA, 1358 bp, Diabrotica virgifera
gtcaaaaataggtagtaaattagtaaataatagcaacattttgatttaaagacttagttaggaacaatattatggtctttaaatgccaagaagactctttccttaaagagttcacttccaaagtagttacttgcgataaagttcagatccaagaagtagtaaatggaacaactcgtacagtggatagttatgaagtaatcctagaagacaccatattatttccagaaggaggtggccagccttgtgattatggttttttgaataacttgcccgtcaaaaaaatcttgaggaaggaagacaaagctgttcactatgtatctcaagaattacaggtaggtactactgtagaacaaaagattgattgggaaagacgttttgatcacatgcaacaacattcgggccaacatttgttatcggccgtacttgaacagcactttaaagctaacacagtgtcttggtggctgggggaagaggactcttatgtagaactagacatagcttcatttttagaaaaggatatacagatagctgaagagatggtaaacgttttcattagacagggaaaaccagtaacagttactatttttcctgaaaaaacacctgaagagttacttgaaaaagtcaggagtgttaaaggtttaccagatgaccataaaggtgacattcgagttataaacattactgatattgatagtaatatgtgttgtggtacacatgtaacaaatttaagtcagttgcaagctatcaagttgttgcacactgaaaaaagtaaacgtaaagataaaattttgctgcatttcttagttggtaatagggttttaaaaaggtttgccacttgtatagaacgtgaaaaaaaattaaccgcaattttgaataacggaccccagcagcatgttgaacttgtcgaaaaattacagaagaatgttaaaatcattaacaaaaatctgcaaagtgtccttaaggatgtagctatctttaatgctggaaaactaaaagccatgcaacctccaccaaaatatttttctttgcataaaaaagaagctgaacctgattttatgaacatatttatcagagagttgggcacaacagaaatattcttatttttgtcagttggagatgagaagaaagatggcagtgtagttatacaaggaaaagaagatgatgttgcagtattgggtccaaaagtttgtgaaatattagaaggtaagggaagtggcaaaggcaatacgtacagagcaaaagtcactaatatgtccaagaaaaaagaagctgagaattgtattaaggagtattttgataagtagtgctttacttattgtggttgatatgttaattattaaaaaatatttgaaataaaa

SEQ ID NO: 2656 - DNA, 914 bp, Diabrotica virgifera
cgaaatttgatttagaaggttacacccggtttttccaaataattttcttacattattatttttgagtaaaactaatagcacaaaatggggttacttacagatcccactaccggccaaggcaaatatgtaaaatggcttttgaaatattacagcaagctatgttttttgctttatatctctggtgtcatttggttttgtaccttagcttaccctacaatgaatgccagcacatatttctctgaaaacgctctattgccaggcttagttaaatcccaatttcacgaagacagagaagcattaagatacaacgaagaattacaagacgaaatgaagaaatatgaagattccataccatatccctggattatagcaaaattcaaacagattggtttagatgcatacatacataattttactcttacttcgccttttaaccgaaatgaaaaattttcaggaaaaaacatatatgggattctaagggcacccagaggtgccagcactgaggcactagttttaagtactccttacagaccaagcactagtgtacatcctcctacaggcccatccatagctattatgttagcgtttgcaaaatatgccaacagagagaaatattgggcaaaagatataatatttttgatcactgaacatgagcagttaggaatccaggcctggttagaggcatactatggagtcagttgcggagtgaagaagttttagatcatgggtgatctcagaggcagaggtggagctattcaggctgctattaatttagaattacatagtgaaaaaattggacaaatggatataaaaatagaagggttaaatgcgcagctaccaaacttagatctcttcaatttgcctcaaaatggggccaaaaagaggtggttatcaacattcaagataaaggacag

SEQ ID NO: 2657 - DNA, 913 bp, Diabrotica virgifera
gaaataagaagcacttattcaaatgagctgccctcttgcatcacatgattactctcaagatggagatcaacttggtgacgaagctggtatgctatatggagaatacctgatgcttgacaaaatactgggagcccaaagacccttatcagaaactaacagtgatttggtgcacgatgagcacttgttcatcataacccaccaagcttatgaactctggttcaaacaagttatatgggaattggattcgattaggcatatttttagttcaatattagaagaatccaaaacgttagaaattcttcgaaggctgaatagggttgtacttatattaaaggttttagtagatcaagttatgatactagaaacgatgacacctgtagattttatggaattccgacattatctaagaccagcatccggttttcagagcttgcaatttcgcttgcttgaaaacaaattaggtgtaactcaggaaaatagggtcaaatataacaaaaattatgccaaagtattcggacacgatgaagaagccattaagaaaatcgagcaatcagaagcggaaccctccctcaaagatttagtggaaagctggttggaaagaacacctggattggagattgagggttttaatttttggggaaaataccacaaatcagttgaagctatattgaacgaggagcaggagaaagctaacaaagaaaaagtggaaagtctaagaaactataaactgagcgagttagaaaaccgaatagaagtatacgagtcgatttttcaggcccgaagttcacaaagcgctgttagctagaggggaacgaagattgtcacataaagcacttcaaggagccattatgataacattttatagagacgagccccgattcagtcagccacatcagaatcttaccctattgat

SEQ ID NO: 2658 - DNA, 1697 bp, Diabrotica virgifera
cttgtgtgtagtgttttgaacgaaaaactggtgcttttcttcgggaggtgaaagggtcaggggtgaagctagaatcgcataaataaaagaaaataatcatggctttatcgcgtttatacagtcccagccggcgattgggagcgagaattacgtttttgttcagaaattacagagaatctttcacccctcaaatagcaaatatggctgactacagagttgaaaaagacacctttggagagctgaaagtgccggtggacaagtattatggggcgcaaactgttagatctattatgaatttccccattggaggagaatttgagcgaatgccgtatccagtcattactgccatgggagtcttaaagaaagcagccgcaattgtcaacaaagactacggtttggacccaaaagtcgccgatgccatctctcaagcagcagacgaggtcatctcaggaaaactatactcagaacactttcctctcgtaatctggcaaacaggatccggtactcagacaaacatgaacaccaacgaagtcatcagtaacagagctatagaaattatgggcggcaaactaggatccaaaacccccgttcatccaaacgatcacgtaaacaagagccagagtagtaacgacacttatcccaccgctatgcacatcgcagtagcagtagaaatagaacacactctattaccaaatctcaagatgcttcacgaagctttggataaaaaggccaaagagttcaaagatatcatcaagataggaagaacccatacccaggacgccacacctttaacgttagggcaagaatttagcgggtacgcccaacaagtagcttttgcaatcgatagaatcaatgctacgttaccaagggtgaggatgttggctttaggtggtacagctgtcggtaccggtcttaatacaagaaaaggattcgccgaaaaatgtgcagccaaaatctcagaactaactggattgccattcacgtcagcaccaaataaattcgaagcactcgctgcccacgatgctatgggtgagggttctgggagcctgaatggtatagcagtatccataaatgaagatcgcccatgatatcagatttttaactttctggtccagatgcggtctaggagatataccctttccgaaaaacaaacccggtagctcaatcatgcctgggcaaggtaatcccacccaatgcgaagccatcaccatggtagcagctcaagtgatggggcaaccacgtagcagtcaccatcggtggctccaatggacatttcgaactaaacgtattcaaacccatgatcgtgtcgaacgtacttagatctatccgattgctgggcgacagctccaagtgcttcaccaagaactgcgtcgacggtatcgttgccaacaaagaaagaatccataagttattgcacgagagtttaatgttagttacagctttgaatccccatattgggtatgataatgctgctcttattgcgaaaactgctcacaaggaaaatagcactttgaaggaaactgctatcaggttaggacttcttacggaagaacagttcgcgaagtgggtcaaacctgaagatatgcttggacctaagtaaaaaatatatattcagtaatttaaatacggatttacaaggatttttttgtatatatacttttgatttttatgttttctcattacaatatttattttcg

SEQ ID NO: 2659 - DNA, 2000 bp, Diabrotica virgifera
cacgcgtccggttcgaaaatggtgatgtgtttataattcgtgtcaatttagtgaaatagcattcaattttttgtataagatctcttcaaaatgccacttcgattagatataaaaagaaagctaacagctcgctcagaccgggtaaaatgtgtggatcttcaccctacagaaccttggatgctgtgttctctttacagcggaaatataaacgtttggaacaccgaaaatcagcaactggttaagacttttgaagtatgtgatgtacctgttcggacagctaagtttttgcccaggaagaactggatagtcagtgggtctgatgatatgcagattcgagttttcaattacaataccttagatcgggtacattcttttgaggctcattcggattatgtgagatgtattgtcgtacaccctacacaaccttatatattaacaagtagtgatgatatgcttatcaagctttggaattgggaaaaagcatgggcttgtcagcaagttttcgaaggacacactcattatattatgcaaatcgccataaatccaaaagacaacaacacatttgccagtgcatccctagatagaacattgaaagtatggcaattgggagcgtccacagcgaatttcacactagaaggtcatgagaaaggcgttaactgtgtggactattatcacggtggagataaaccttatttaatctcaggcgctgatgatagattagtaaaaatctgggattatcaaaacaaaacttgtgttcaaactttggaaggacatgctcaaaatgtaaccgctgcatgtttccatccagaacttcctgtagctcttactggaagtgaagatggtactgtcagagtgtggcatgccaacacccataggttagaaagtagcttaaattatggctttgaaagagtatggactattttctgcctaaagggatccaataacgtggcattgggttatgatgaaggtagcattttggttaaagttggtagagaagaaccagctgttagtatggatgccagtggaggcaaaattatttgggccagacactctgaacttcaacaggcaaatctcaaggcgttagctgaaggtgcggaaataagagatggagaacgccttccagtttctgtaaaagatatgggtgcttgcgagatataccctcagacaattcaacacaatcccaatggccgttttgttgttgtctgtggggatggagaatacataatctacacagcaatggctttaagaaacaaagcgtttggtagcgcacaagaatttgtgtgggctcaagattccagcgaatatgccatcagagaatccggatctactatcagaatttttaagaatttcaaagagaagaagaattttaagtccgattttggagctgaaggtatatacggtggataccttttgggagtcaaatcggtttctggtttgactttctatgattgggaaactctcgatttagtcagaagaatcgagatacaaccaaaagcagtttactggtcagatagtggtaaattagtatgtttggccacagaagatagctactttattctttcttatgattctgatgaagttcaaaaagccagagataacaatcaggttgcggatgatggagtagaatcggctttcaatcttctaggtgaaataaacgaatcagtgcgaactggtctctgggtaggcgactgttttatctacacgaattctgttaatcgtatcaactacttcgttggaggtgaactggttacaattgctcatttggaccggcctttgtatgtcttgggatatgtgcctaaagacgataaataatacctcggaaaataaagagttgcgcgtagtaaagtaccaattacttctttctgttcttgaatataaaactgcccgcatgaaaagaagactttccaacaggcagaaagaagtactttccgtccctttccctaaggaaccccagaaaaggaaaagtgggaacattttttttaaaaaaaaaaaagggtttt

SEQ ID NO: 2660 - DNA, 995 bp, Diabrotica virgifera
ctttcttcaatgacatttgttccatttgttaaagagcattttgttaacaattttaaaaaataattaaattattatttattagtgttggtgaattgttgatatttcaagtttttgaagcataaattaaaatccaaaatgagtgtcatagatgatgaaacaagaatttttcaaaattctatcaggtacttgcacaacatctcaacattaccagaaacaaatgtaccaactttaagatcctttatttgtctcaaaagaagattgatggaactacgcaggagttcctttctcccaacaagtgctacaaaaccaagtatgcattgtcaaaagtgttttttgaattactttgaggggcctgcaacatataatgttatttctaagccaactagatacacctttgaggacaaagtaaaagcaaagcagaagaatggcttacctcttacaagatatcaagaaaagtatctcaaaagaatgaagaagtttactggaaatattttggtcactaaatgtaaattctgtaatcatgaaaaccaaacaaaattggataaaccaaggcgtaaaccaatacccaagatatcactaatatccagtccattaataaagaagaaaaagaagaacaaaagagataaattctgtggattgaatcaaagtattgttgcttcagtttcactaaataacagctatgttattgacaaaacaccagattggtctaaaacttttatcccattaggaaacagtattaacaataatactagcatggcaacaaagaagaaaaataagaacaaaagagacaaattgtatggattgaatcaaagtgtttttgcatcgagttcactaaataacaaccatggtaatcatgtcaaccagagcccaccagatttatccaaaacttttattccattgacaaacagtaataaaaataatactgggaaactatatggtagccagcactaaaaatcaatttgaagggatttctaggtaatatcgcccaaacaaaa

SEQ ID NO: 2661 - DNA, 1045 bp, Diabrotica virgifera
  misc_feature (1011)..(1011): n is a, c, g, or t
  misc_feature (1014)..(1014): n is a, c, g, or t
gggtttaaaagtttatccagccggtagaataggagacgaaccagctataggtttagcaaagacattagaatctttgaatttgagaatgggcaggctgaaaacagggactccacccagattgatttgcccattcaaaaagggtcgttataacaacaggaacctttttgaatgggcaaatcaatatgggtttaaaagtttatccagccggtagaataggagacgaaccagctataggtttagcaaagacattagaatctttgaatttgagaatgggcaggctgaaaacagggactccacccagattaaaagcggatacgataaactatgatgtttgtgaagtacagtatggggataatccaccacttcctttttcattcatgaataacaaagtgtggataaagcctgaagatcaattaaagtgctacctaacaaaaacgacattgggcatagaaaaaatcgttagagacaatctccacgtgaatagacacgtcatggaagagatcgcaggtccgaggtattgcccgagtatagaatccaaagttctcaagttttcaggaagagaacaccaagtttggttggagcccgagggtctcactagtgacgtcatctatccaaatggtctatcttgtacattaccggaagaattccagtgggatcttatcaggaatataagaggtctggaaaatgccgttattgtaagaccgggctatggggtggagtacgattttgtagatccaagagaattgatgcccaggtctggaagttaaacgagtagtaggcttgtttttggccggtcaaataaacggcactaccggatacgaagaagctgcagctcagggcgtcgtagctggaataaatgccggtgcaaaggcattaaagagagatcctctgatagtaagccgcacagaaggttacctaggtggtaatgattgacgaccctaacactctaggcaccacggaacccctatcgtatgttcaccagccgagccgaattccgtcttacgctgcggncgnataacgcagataacagactaaccccccaggg

SEQ ID NO: 2662 - DNA, 1268 bp, Diabrotica virgifera
cggacgcgtggggacaacgacaagtaaacaagtgatatcaaaaatcaaagtagtcaagcgaattatttgacaaagtttttgaacgttttgtgaagtaaaagtattattgtgtgaaattacatcaagaaaatggttaaagttccagcaattggtatcgatttgggcaccacgtattcctgcgtgggtgtctggcagcatggaaaagttgaaatcatcgccaacgaccaaggcaacagaacaacacccagctatgttgctttcacagatacagagcgtctcttgggagatgctgcgaagaatcaggtggcgatgaatcccagcaacacagtttttgatgccaaacgtctcattggtagaaagtttgatgatccaaaaatccagcaagacatccaacactggtcatttaaagtaattaaccactgtggcaagccaaagattcaagttgactgtaaaggtgaacaaaaagtattttctccagaagaaatcagttccatggttcttacgaaaatgaaagaaactgcagaagcgtatctgggaaccactgttaaagatgccgttatcacagttccagcctattttaacgattcacaaagacaagccactaaagatgcaggtgccattgctggtctcaacgttttgagaatcattaatgaaccaacagcagcagccttagcttatggtcttgacaaaaatctgaaaggtgaaaagaacgtactcattttcgacttgggtggaggtacctttgatgtttccattttgacgatcgatgagggctcattgtttgaagtaagatccacagcgggtgacactcatcttggtggtgaagacttcgataacaggttagtcaatcattttgctgatgaattcaagagaaaatacaagaaagatctgaaaaataatccaagagcccttcgacgattaagaacagctgcagaaagagccaagcgtactttatcatccagttccgaagccactatagaaatagatgctcttttcgagggtattgacttctataccaaaattagcagagcaagatttgaagaattatggtcagatctcttcagaggaacacttcaacctgttgaggaagctctgaatgatgccaaattagataaagggcaaatccacgacattgttttggtaggggggtctacacgtattccaaaaatcccacaactttctggcaaattacttcagtggccaaaccattaatcttttcatcaacccagacgaaggcgtagcatatggagcagccgtccaagcagcag

SEQ ID NO: 2663 - DNA, 2482 bp, Diabrotica virgifera
aattgtaaaaaagtgatggcggttcttcttgatgtcatttaaatatttttgacacgttgtaatccagataattaaaaaaaaagtaaaatgggccaaaaatttcaatacgatgaaagtggtggaacatttttctatttcttactatcatttttagcactaattttgattcccgcaacattttactattggccgaaaaagaaaaagagagatgttcaagaagaaatcaaggaatgtacatgcacaggatgcattttgaagagggaacatttaaaaaaatcagaaccatggaggggccctaaaaattttttaatcaaattaataatagttgttggatgggtgatactattcttattagcttataaagtatcccaatttgactatgagatgtcaaattttgatccctatgaaatattagggataccacttggtgctagtcaaggagaaattaaaaaggcttatagaaaactgtcactaattctccaccctgataaagacactggtaatgaaaaagagtttatgaaactaacaaaagcgtaccaggctttaactgatgatgaagccaggagaaattgggagaagtatggtaatccagatggacctggagctatgagttttggaatagctttaccatcatggattgttgaaaaagaaaatagtgtttgggtattaggtctttatgccctcgtttttatggtagctttaccaataatagttggtacttggtggtatagaagtatcaaatatactggagatcaagtactattagacacaacacagctatattactatttttttaataaaacaccaaatatggctctaaaacgggtgattatgattttagctgctagtttagaattcgataaaaaacataactctgaaattgtggaaagacagtctgataacgaagaagtcccacagttgattaaaaaacttccgaatttgagtgagaaaaataaagagcgtccattgtgttacttatatagcataaaagctagagcgatcatacatgctcatttaagtaggataccattaaataattttacgttagaacaagataggaggtacatagttggcaaatgcccatttttggttaatgagcaagtcaactgcgtgaatcaactcataattatggcttatactagacgaatccccaaattgcctcctatagaaacaatagaaaattgtatgaaattatcacctatgatagtccaaggattatgggaattcaaatctccccttttacagctaccttacataaacgatgataacttaaagtacttcatgtcaaaaaaacgccagattaagacattacagcaatatgcacagctgaaaggtgaagaaaggagaaacttgcttcgaaatctaaccgatgatgagtatgaaaacgttatgaaagtattaggagcaatgccttatgttgatttccaaattcaagttgaagttatggatgatgaaaatccaaatgaagtaactgctggtgctatagttacagttactgtgactctaatcagacaagatatgagcattttgtttggagatgagtctgccaaagatgcaacagagattaccgaaaacggtacggaagaagtaaaagaaggcacaggagacgagaacgtcgtaaaaaggccagcgtggcttaaacagaagaagagtggtaaaaaaacgaagaaatcaaaaccagtcaataagacgagcattacatcaaaaccaaagactgaagattctcccaaaccagcagccccagttaagaagaaagatacttccaaagttaagaaagaactggacgatgaagagactgatgaaacagatgaaagcgatactgagaacatcgaaaatgataaatcttccggagaagatgaagtagaaaataccaaatcaaatgatgatgatgaggaatgggagaaattccagaaaatccacgacagagaaaaatctctagaaggtaaatcaaagacttcgcatagtgtacattgcccctattatccttatgacaaacaggaatattggtggacctacatatgcgatagaaaatctagaacccttcttacagcgccttatcatataactagtcttgtagatagagaagttattcatctaaagttcactgctcccaactggccagcagtttatactttcaccgtctgtcttcgatctgactcatacataggctttgatcaacagaaagacatcaagttagatgttaaagaagctccagcagaaatcaaagagcatccgcagtgggagttcgaggactccgaagaagaggatccagcagaaacgaatgacagagaatccgagtatgccactgacgaggacttacccgatgattaagcgataatatttttttatattttatattgtttttgctttacttaaggatcaactttctgaaaaaaaaaaacagtttatgtattatttgaaaatataagaagctattacaagtgtaaaaaaaaaaaaaaagggcggccgccggacgcgtggg

SEQ ID NO: 2664 - DNA, 1354 bp, Diabrotica virgifera
  misc_feature (1213)..(1213): n is a, c, g, or t
  misc_feature (1221)..(1221): n is a, c, g, or t
  misc_feature (1290)..(1290): n is a, c, g, or t
  misc_feature (1298)..(1299): n is a, c, g, or t
  misc_feature (1302)..(1303): n is a, c, g, or t
gtagttctgaagtttttgctcctagttgctttcaagtaggaacccaaattggagactatcacgcgagagacaatcgaaacttttaggggagaaaggactgaatgcaaaatcacaaccgagaagaaagatacggaagaaaagtgccctccagacataatagaagctttgaccgataaagttttaagatcaaacaaaaaacctagcgtaaagaaaaagaattccaaaatggacttccaacaagagtgccttcaagcccacaatgaatatagacataagcacggtgtccctccattaaagctcaataaggaaatgtgtagagttagccaagactgggcgaataatttgataaaaaagagtgtcttaaaacatagcaatagtagagactacggagaaaacttattttgtatccaatcgtctaatcctaattttaccattgacggaaagaaagctgtggaaaattggtacgaagagatcaagtgtcatacgtttggggttgaaccgagcagtttagcatcaggacattttacacaggtggtatggaaagaatctagggaattgggtgtggcttttgccaaatctggtggaaagatcgttgtagtggctaactatgcaccagccggaaacgtaataggccactttgcagaaaatgtcccacctgtaggaggtttcagaagtaataacaatcacatagatctatcagaaagcgttggtaaattgtcaattgcttcatcaaggtctatcccacaaaagctaaatcagaatgccacagaaggcaacttcgaagaggacttcctcgaagcgcacaacaactacagaaaacgccacggagtgccacttcttaaactagacaaaaaactttgtaaatatagccaggaatgggcggcctatctagctcaacgaaacatactagaacacaggcctggcagtaactatggagaaaacatttactgcctttattcttccgatccaaactttactgtcaatggacatacgccagtagacacttggtacgaggaggtttcacatcatccatttggaagagaacctagtaacttgaagtcgggacatttttcccaagtgatctggaagtctagtgaatctttaggagttggtgtcgccaaaaactcacaaggtagcatctacgttgttgccaactactctccagccggaaatttcgtaggccactacgtagagaatgttcctccggtaaagnctacttgntttgcagattcgtcaccgaaagaagatcctagtccgagatcctcatctaaatctcttgcttctccttcnttctctgnnttnnatcagtcaggaaatttttccgattttgcactttgagctcttaaagttcata

SEQ ID NO: 2665 - DNA, 908 bp, Diabrotica virgifera
  misc_feature (847)..(847): n is a, c, g, or t
cggacgcgtgggaatgaaacttgtgatttttgttgttttcacaatactagattatgtttgtggtgctcgtatattatgcgttttccaaatgccagcctttagtcaccaaagagtgttccagcctatttggagagagttatctttacgaggtcacgaagtagttgtggtaacacctataccacttaaggaccctttattaacaaatttaactgagatcgatgttagtgcaccaaatagtgaacttatcaggagacacggttttcagtttttcatgaacaaggaatatgctgttcatacgaaaataccgaaaatatttgcgatgcattacgactttgccgaggtaatattaaagaatgaagagtttagcaaaatttataacaattctaatcaaaaattcgatgttgtgattgctcagacgtatatttcacccatactttatagtatagctgcaaaatttaaagcaccgttaataggaatttcttctatgggagcatacattggcactcattttgctatgggtaacccaaatccaccatccttgtactcagaaatgttcttgccgtacaatggaaagcttacactatatgaaagaataaaaagtactacttactatttatttgttcgattttatcgaacatttgtgatattacctgaggcagatgcattagctaggaaatatttgggcaatgacataccatatattgaggacattgaaagaaatatgagcttgttgttaataaccaccaatccatttatgtacacacctagaccaaccatacccactattgttagcttggaaagtattcatgttaaaccgacagaacctttaccacaggatctaaaaaanttctttggatgatccaaaagaggcgtaatatactttcagttgggctcaaacgttcaaagcg

SEQ ID NO: 2666 - DNA, 1010 bp, Diabrotica virgifera
acaaaataaactgccagttcggaagcaatcaatacaatttaaaaataattattgaaagctttcatgcatgataaataattagtttgtaaaaatttgtattggaatacattaccaaaaatgccgtgtgagatgattacactccaactgggccaatgcggcaaccaaattggttttgagttttggaaacgattatgtgcagaacacggaataaatcctgaaggaatacttgaagattttgctacagaaaatattgatagaaaagatgtatttttctaccaagctgatgatgagcactacattcccagagctgtattactggatttagaacccagagtcataaatacaatattaaactcaccttactcaaagctttataatcaggaaaatgtatttttatcaaaaaatggaggaggggctgggaataactgggcatcagggttctcacaaggagagaaactgaatgaagaaatttttgatattattgatagagaagctgaaggtagtgacagcttagaagggtttgttttgtgccactccatagctggaggtacaggctcaggaatgggttctaatattttggaaaagttatcagataggtttcccaaaaaattggtacaaacctatagtgtgttccccaatttagatgaaattagtgatgtagtagttcaaccttacaattcattacttactttaaaaaggttaactgaatcagccgattctgttgtggtattggataatacagcccttaataggatagctgctgatcgtttgaaaattcagaatcctacatttacacagatcaatagtttggttagtaccatcatgtctgtctctactactacgcttagatatccttcttatatgaacaatgatctgacagaattacttggcccgttaattccaacaccacgtcttcatttcttaatgacgggttacacgccactatctacagataatgatggagcaaatgtcaggaaaactactgtactagatgtaatgagaagattatt

SEQ ID NO: 2667 - DNA, 1194 bp, Diabrotica virgifera
cggacgcgtgggaaaataaatctgtattgtcaattaaagagatgatcttgatcataaatggaaggcatgacagtataattttttcaatttgttagttcctaattatggcaaataaaacaaaaaacgaattcattgcttatagtgaaccaaatattcgaaacaatttatctattgtggagtattgtcgtacatctgtagcagctatatccggttgtacagcaggtgtactgggactaacaggattatacggagcagtattctttgttgtagctgtaactgcattttggtttatgctattgtttaaagctggtatcgattcctggaagaaatattttatatctcgaaactccctactattgaatgggatttttggacatttcttcacatacattctgtgctggactttcatttatggaatggtgcatgtttattaaattaatttacaaaataagtgttctagagttagtactacaattatcgtggggaaggttagggtaagatggcagatgaaagaaattttcgctcggcttactacgagaaagtaggatttaggagtgtagaagaaaaaaaatcactggaaattttgttgaaggagaaacctctggatcgtggaaaactgaggcagttctgtgtaagattttctgtgccagctacttatagaaatctagtatggaaactgcttctaggtgttattccagtccatatagacagccacaacttcataatggaccaaagaaaacaagaataccatgaattacacagagctctaactgtaatgagagtaattgacacaaacactccaaaaccccaagtatttttagccatgtggctactacaaactggcaatttcaccattgatactagtctggccactgaaagaggatttactaacatagttcagtccttcatgcaatttttcgaagatgatgcagatgtcttttggttatctagaaatttttatgagaatgtcaaaaagtttgatgctgatttagggaaagtcgtggagaaaacttacgtgatactggagaaagaagatgctgcatattacaagcatttaagtaaaactggattgttggacaatttaccattagctaaatggtttgattgcggtttcgctggaatattgtataaatctgcccttgaaagattttgggataaactgcggatgtgataccatacaagattctcgcattt

SEQ ID NO: 2668 - DNA, 963 bp, Diabrotica virgifera
  misc_feature (867)..(867): n is a, c, g, or t
caatttaaaaaatgagaaaaatgtgtttagaatagaaagaattgcattaaaatatgtgtcacaggaaacatatcaaagagagtgctgaagaaagtatagtagaaatggaggacagctcagatagcagtgatgtgtccatgaccgattctgattctgagaaccaaattagcgaaactgataatggtgatggtgttgatgtttcaaatttaaacacagattctgacgttgagttacaagaagacgatgaagaagaggaggaagatgaaactataaaagcaattaaaaatgaaagtaaaaaagaaagagaccgtccacccaacatacagtgcgaagacttcataacagacatctcttttcatcctcatgaggatttattagccattgcaaatatcgtaggtgatgttctgatttacaaatattcaaatgagacaaacgagttggttaacacaatagaactccacacgaaagcttgtagagatattgagttcagttgtgatggaaaactcttattttctacatcaaaagataagtcgataatgattacagatgtgagcagtggacaactggttaagttttacgaaaattcccatgatgtacctgtatattgtttgactgtcatagatgaaaacttatttgccacaggggatgatgatggtatgataaaactttgggatatgagagagaaatctgataaacaaatatacaaaacaaagaaaaatgaggattatattagtgatatggtaacaaatgatgccaaaaattacctagtctgttccagtggagatggttccattataagtatagatttacaaaacagaaaaattcatatgcagtctgaagaatatgaggaagaattgacatgtttgngaacattcaggacagaaacaaaacttgtttcaggatcatctaaggggtaactgtttgtctacactggggagaatttggtcttcatagtgatatttt

SEQ ID NO: 2669 - DNA, 1196 bp, Diabrotica virgifera
actttttccttcctgtttttagacatatccacaagaaattagtgtttcagtgtggtttcagtgacttgtgtttttttgtccaagttggaagctatttgagggaacgaagaagaaaatcgctctaaagttgtaatttttgaaataatataaaatataattattaaacagaaaacatactgaaatatttgaaacaataattatataataaaatgacagaagcctgaactatttaaatacctttttaaacaagttgagaagcgaggaaaatgggtacacagcttttaaaatgtcctttatgttgtaatgaacatttttcttcccgtcaggatttaaagtatcatataagcgagttattaaatagtttgtcttgtccagtttgtactttagcttttaatagtgttattgaattagcagaacacctagacacggaatgtgaacttagtgaagagtgtaaccaaaatgaaactgatcctgaaatccaaatccaggagccttcagatccattgttgatcccagtggacgaatcacaagaagaacctacagatgaacatgtagaaatggtgaatgatgatactcagcagatcgaatttattgaaagtgaggatattgctgaagaagtggaggagaatggaaatgttatctatgagtgtgaagtttgtaaagttcaatttagctcaattaaagatcatttaaaagagtaccatgctggagaagatgttgtgctgcaaactgatgtatttgatgaaaatgatttaccccaagaaatgcaagtagaagaagatcaagttactgaatattctcaggaggaagaaagttttgaattaagtcaagaatctggaaatgatgaaaatgaaaggcccgtaatacaaaagaacaataaacgagtagattgggtttccagaaaagataatggtatccctttacccgaaaattatgctatagagaatggtaaagtaagaaaaataactgaggaggaagcagctgaaaaaataatagaaagtccatattccaaatcaccaatgccctaaatgtttctttacatttcttaaactaaatcatccaatcaaaaaccaaatgttctggaagcaggaaaaaaaaagaagtttaaatggggctccttggccacgagggtcctttaacctacccccccccttaataaccatttgggaattcccctcatccgccctccacccaaa

SEQ ID NO: 2670 - DNA, 408 bp, Diabrotica virgifera
ggtcgaggacgcgtccgaagacgcttggcggacgcgtgggaatcgatcgtcggaactgggtatcagattggccctagtaattttgttgacggcagctcggaaaagggatgcataggatcggttaaaacattctctcgggtttctaagccatgacgttctttttcacgcctggccctcttccttctacgttgccttgtattattaaatgaagtatattatatctcattgggtgtcgcctaacatggccaaaatattcaagtttgcgattttgaaatgttctgacaactttcgtaactttttccatccgttgtaaaacaactttgttacgaacgctattatactcgtaagattctccagtacacccagatttcaagggctttcagttttttgataagtgcttcgttaagt

SEQ ID NO: 2671 - DNA, 730 bp, Diabrotica virgifera
gaagagagcagattttgagaaaggaatacgcggatccactgctgaggtaccagaagatgccaagactcaaaaatacgaaaagaacgtagcgtccaaaactgttgttgaaggcctttcctacggtcagtctgccggtttaaaagacgatttggatgtagatgaagatgtcggagaaaagaagagaatggcattcttagacttactgattgaagcctcccagaatggtgtcgtcatcaacgacgaagaaattaaagagcaagtcgataccattatgttcgaaggacacgataccacagctgctggaagcagtttcttcctgtctttgatgggaattcatccagaaattcaagacagggtcatccaggaaatcgatgagatctttggagattctgatagacctgctaccttcgccgacactttagaaatgaagtacttagaaaggtgtatgatggaaactcttcgtatgtatccaccagtacctattattgccagacaacaacttgtagaacagaaccaaccaatttctcaagaaatatatgtccaacagtatggtttgaacaaacaagtagatcagcttatccaatcattggtatatcaccaaaatgtgatctctcaacaagttgagcaattcattcaacaaggacaacgtcttccccaagacttgctttcccaacaagtattagtctaccaacaagttcgccaattgattaaagttttgagcacccaacaa

SEQ ID NO: 2672 - DNA, 826 bp, Diabrotica virgifera
tctagatccgacggccgcctttttttttttgaaaaaaactaaacaacaatgcttgccgctaaagttgtcttacttttgggccttgcccttttcgtctcagctggtcaagatcttgacaagggcatggaaattgtgaaatgcgcccagcgagcaataagcgtaggagtacctgaattaggagttccatcacataatcccttcgtcgttattagaaacgtatcatggactggatcaatcggtgttgcaagcacccatatcgaactcaataccaataaatggtatggtcttgcggattgtaatatctcagctaataaaatcaatgacgactaagatttcgagactgtctttgactataccacatactggcccagatttataatcgtaagcaactacgaagcaaccgttgcagcgcttaaccttacagtgcgctacaaatatcctcacagatgcaccctcaacagtctgcaccctcaacaagcagcaccctcaacagcagcaccctcaacagctgcaccatacacagatgcaccctcaacagctgcaccctcaacagctgcaccctcaacagctgcaccctcaacagctgcaccttcaacagctgcaccatacacagatgcaccctcaacagctgcaccatagacagatgcaccctcaacagcggcaccatacacttatgcagcaccagcccttttttaagcaaagaattaatttaaaaaataatcaagaatatattttcctccagctttgtaacgatagaatacaataaaatcgtattcattatttactagaaaaaaaaaaaaaaagcggacgcgatggcggacgtgtg

SEQ ID NO: 2673 - DNA, 980 bp, Diabrotica virgifera
caagtaataacaacaatgctagctgctaaagttgtcttgtttttgggccttgcccttttcgtctcagccggtgaagaccttgacaagggttatgaaattgtggaatgtgccaattacgtaatgagagcaggagtacccgaattgggagtaccacaacacgacccctacgtcaaactcagggacctacaatggagtggaaacctcggtgttgccaaagcccatatcgagctccatgataatagatggtatggtcttgccgactgggaaattcaagcttaccaaatcagtgctgacactgacaacgaggctgtctttgactacaccacatcatggtcaaatggatttcaactctctatgaactacaatgcaaccattaaggaacttttcctttcacagcactactcaggaaccatcaatgcaaaatcactggtatgggattacttggagacacttatgctctcgctattcaagaaggtattgaaggtgccctcaaccatggtcttatcggaaataccgttggagacttccttaaaatgagattcaacactgtctggtatcccactggcaaagtctggcaaatgctggactattgcaactccctcgtgtccaccccagatacaccacaaccctaccccgcaatcaaataatcaggttaaaaataactaagaaagtattttcatacttaacgttaaaatacaattaaatggtagtcagtattatttacccagtgcgctgaaaaaaaaagtccatacaaaaaaaaatatgaaaaacttgaaggggcggcagtagtgctgtgaaaggaaaagttctttaatggttgccaacgcccatatcgagctccatgataatagatggtatggtcttgccgactgggaaattcaagcttaccaaatcagtgctgacactgacaacgaggctgtctttgactacaccacatcatggtcaaatggatttcaactctctatgaactacaatgcaac

SEQ ID NO: 2674 - DNA, 931 bp, Diabrotica virgifera
acaacatcctataatgagtcgtattacgctattcaagaaggtattgaaacggccctcaaccatggtcttatcggaaataccgtcggagacttccttaaaatgagattcaacactgtctggtatcccactggcaaagtctggcaaatgatggactggtgcaacggcggctccaccgacgccccaacaacagctgcagcatacacaattgcaccctcaacagctgcaccatagacagatgcaccctcaacagctgcaccatacacttatgcagcaagattccataatttatttaacaattacagatcgaaatgcttctcacataagctgattccaaaatttttattataatacataaaaagtagaaatggctttgtactttcatttggggtcaatcaacaaagtttttacgatgcaacataacctccatcaatgggtagacatgtaccagtaatcatactagctttatcactcaacaagtaagtaacagcgtcgactacttcgtggacttctccaaaacgcctcaacggtatcttctccaacatgggcttagcaacagccggatctgaccagccaagtctgcccatatctgtcataatgactgtgggattaactgcattgacacttatgctctcgctattcaagaaggtattgaaggtgccctcaaccatggtcttatcggaaataccgttggagacttccttaaaatgagattcaacactgtctggtatcccactggcaaagtctggcaaatgctggactattgcaactccctcgtgtccaccccagatgcacgacaagcctagtttgaatcaaataatcaggttaaataagaaggtattttcctttgtaacgataaaatacaattaaatggtaataattattatttaccaaaaaaaaaaaaaaagggcggccgctcgcgatctagaactag

SEQ ID NO: 2675 - DNA, 811 bp, Diabrotica virgifera
attcaagaaggtattgaaacggccctcaaccatggtcttatcggaaataccgtcggagacttccttaaaatgagattcaacactgtctggtatcccactggcaaagtctggcaaatgatggactggtgcaacggcggctccaccgacgccccaacaacagctgcaccatacacaaatgcaccctcaacagctgcaccatagacagatgcaccctcaacagctgcaccatacacttatgcagcaccagcccttttttaagcaaaaaattaatttaaaaaataaccaagaatatattttcctccagctttgtaacgatagaatacaataaaatcgtatccattatttactagaaaaaaaaaaaaaaaaaaaaaaaaaacccacgcgtccgcccacgcgtccgcggacgcgtgggcggacgcgtgggggacaaggtagtgcttaccgagtaaaccgatacgtggttagccagagacaagttaatggacaacaaagactcaccgttcctgaacaattcgttaaccaagaagtgttaaatcaagtatacagcgaacaatccttaattaaccagagagcacaacaacttgtagaacagaaccaaccaatttctcaagaaatatatgtccaacagtatggtttgaacaaacaagtagatcagcttatccaatcattggtatatcaccaaaatgtgatctctcaacaagttgagcaattcattcaacaaggacaacgtcttccccaagacttgctttcccaacaagtattagtctacaaacaagttcgccaattgattaaagtttgagcacccaacaac

SEQ ID NO: 2676 - DNA, 1253 bp, Diabrotica virgifera
  misc_feature (1233)..(1233): n is a, c, g, or t
aaaatgaagtgtctagttcttctttccctagtaacccttagtgtagctgcctactacccaagtactggtaggcaggtgacagtaggagtagctggaaatgtgaaactagtcggctctcaaggttcccagattgacattcgtagaagtccttacaacccaagaactgtcgacgtcaccctcagaagtccaaatgctccaaccagaactctgcaaattgatgaagccaggaacggccaacaacttggttattccaacctccaaggtgtcaacaaccaaggtgtacaaggtgttagtgacattgtctctctgcaaggactctctggttatggcaacttccaaggacaatcaagagtatattccccactcaaagagatcttaaagaatagagtacaaggaaggagcttcaatcaacaatggttgaacaattccccagtccaatctttgcagaccatcttgcaacagatccagcaacaacgtggacttcaacaagaattattgggacaataccaaaacttgccccaacaatatttgaacgctgaatatctccaaaaccaagacattggtaccaaccaaatcttaaacctcatctacaaacaacaacttggacaaggtagtgcttacccactaaaccaatacttggttagccaaagacaagttaatggacaacaaagactcaccgttcctgaacaattcgttaaccaagaagtgttaaatcaagtatacagcgaacaatccttaattaaccagagagcacaacaacttgtagaacagaaccaaccaatttctcaagaaatatatcgtccaacagtatggtttgaacaaacaagtagatcagcttatccaatcattggtatatcaccaaaatggtgatctctcaacaagttgagcaattcattcaacaaggacaacgtcttccccaagacttgctttcccaacaagtattagtctaccaacaagttcgccaatggattaaaggtttgagcacccaacaacttaacatggatcaacttcatccaatacctcgttgaacaaggtaatcaagttgatcaacaattgtacgctgttcaaagaaatttttaccaacaagtccaaagacttgttcaacaggtagttcttcaacaatctcaaatcaaagaacaaatccaggtacttatccaacaagaacaaactggttccacaagaactagttttatttccacaattgggctaccaacaagtttgaacattcattcnagtatttgatcagcaattca

SEQ ID NO: 2677 - DNA, 1379 bp, Diabrotica virgifera
  misc_feature (1263)..(1263): n is a, c, g, or t
  misc_feature (1294)..(1294): n is a, c, g, or t
acactgtacaagatgaagtgtctagttcttctttccctagtaacccttagtgtagctgcctactacccaagtactggtaggcaggtgacagtaggagtagctggaaatgtgaaactagtcggctctcaaggttcccagattgacattcgtagaagtccttacaacccaagaactgtcgacgtcaccctcagaagtccaaatgctccaaccagaactctgcaaattgatgaagccaggaacggccaacaacttggttattccaacctccaaggtgtcaacaaccaaggtgtcaaccaggctgatgttcttgctgatcttttcagtcaatatgagggtattgtagatgaccagaccttctacagtttgttgaacaaacttcaacatttggtacaagctggagtcatcaacagagtagtcttggatgttgtaagaaactgggatcagcaaggtgtctgccataaccagagagtccttgcagagagacaatgtcactaacaccttgtacaccttgcaaggactctctggttatggcaacttccaaggacaatcaagagtatattccccactcaaagagatcttaaagaatagagtacaaggaaggagcttcaatcaacaatggttgaacaattccccagtccaatctttgcagaccatcttgcaacagatccagcaacaacgtggacttcaacaagaattattgggacaataccaaaacttgccccaacaatatttgaacgctgaatatctccaaaaccaagacattggtaccaaccaaatcttaaacctcatctacagacaacaacaacaacttggacaaggcagaccagtaccactaaaccaataccaagacattgataccaaccaaatcttaaacctcatctacaaacaacaacttggacaaggtagtgcttacccactaaaccaatacttggttagccaaagacaagttaatggacaacaaagactcaccgttcctgaacaattcgttaaccaagaagtgttaaatcaagtatacagcgaacaatccttaattaaccagagagcacaacaacttgtagaacagaaccaaccaatttctcaagaaatatatgtccaacagtatggtttgaacaaacaagtagatcagcttatccaatcattggtatatcaccaaaatgtgatctctcaacaagttgagcaattcattcaacaaggacaacgtcttccccaagacttgctttcccaacaagtattagtctaccaacaagttcgccaattgattanagttttgagcacccaacaacttaacatgatncacttcatccattacctcgttgaaacaggtaatcaagttgatcaacaattgtacgctgttcaaagaaatttttaccaacagtcca

SEQ ID NO: 2678 - DNA, 1025 bp, Diabrotica virgifera
caagatgaagtgtctagttcttctttccctagtaacccttagtgtagctgcctactacccaagtactggtaggcaggtgacagtaggagtagctggaaatgtgaaactagtcggctctcaaggttcccagattgacattcgtagaagtccttacaacccaagaactgtcgacgtcaccctcagaagtccaaatgctccaaccagaactctgcaaattgatgaagccaggaacggccaacaacttggttattccaacctccaaggtgtcaacaaccaaggtgtcaaccaggctgatgttcttgctgatcttttcagtcaatatgagggtattgtagatgaccagaccttctacagtttgttgaacaaacttcaacatttggtacaagctggagtcatcaacagagtagtcttggatgttgtaagaaactgggatcagcaaggtgtacaaggtgttaggagcttcaatcaacaatggttgaacaattccccagtccaatctttgcagaccatcttgcaacagatccagcaacaacgtggacttcaacaagaattattgggacaataccaaaacttgccccaacaatatttgaacgctgaatatctccaaaaccaagacattggtaccaaccaaatcttaaacctcatctacagacaacaacaacaacttggacaaggcagaccagtaccactaaaccaataccaagacattgataccaaccaaatcttaaacctcatctacaaacaacaacttggacaagggagtgcttacccactaaaccaatacttggttagccaaagacaagttaatggacaacaaagactcaccgttcctgaacaattcgttttccaagaagtgttaaatcaagtatacagcgaacaatccttaattaaccagagagcacagtaacttgtaataaatagccaaccaatttctcaagaactatatctccaacagtatggtttgaacaaaacagtagatcagcttatcccatcattggtatatcaccaaaatgtgatctctcaac

SEQ ID NO: 2679 - DNA, 970 bp, Diabrotica virgifera
  misc_feature (862)..(862): n is a, c, g, or t
cactgtacaagatgaagtgtctagttcttctttccctagtaacccttagtgtagctgcctactacccaagtactggtaggcaggtgacagtaggagtagctggaaatgtgaaactagtcggctctcaaggttcccagattgacattcgtagaagtccttacaacccaagaactgtcgacgtcaccctcagaagtccaaatgctccaaccagaactctctggttatggcaacttccaaggacaatcaagagtatattccccactcaaagagatcttaaagaatagagtacaaggaaggagcttcaatcaacaatggttgaacaattccccagtccaatctttgcagaccatcttgcaacagatccagcaacaacgtggacttcaacaagaattattgggacaataccaaaacttgccccaacaatatttgaacgctgaatatctccaaaaccaagacattggtaccaaccaaatcttaaacctcatctacagacaacaacaacaacttggacaaggcagaccagtaccactaaaccaataccaagacattgataccaaccaaatcttaaacctcatctacaaacaacaacttggacaaggtagtgcttacccactaaaccaatacttggttagccaaagacaagttaatggacaacaaagactcaccgttcctgaacaattcgttaaccaagaagtgttaaatcaagtatacagcgaacaatccttaattaaccagagagcacaacaacttgtagaacagaaccaaccaatttctcaagaaatatatgtccaacagtatggtttgaacaaacaagtagatcagcttatccaatcattggtatatcaccaaaatgtgatctctncacaagttgagcaattcattcaacaaggacaacgtcttcccccagacttgcttttcccaccagtattagtctaccaacagttcgccaattatataaagtttgtgagca

SEQ ID NO: 2680 - DNA, 892 bp, Diabrotica virgifera
agattcgaaataatttattcaacacttacagatcgaaatgcttctcacataagcagattcttaaatttttattataatacataaaaagtagaaatggctttgtactttcatttggggtcaatcaacaaagtttttacgatgcaacataacctccatcaatgggtagacatgtaccagtaatcatactagctttatcactcaacaagtaagtaacagcgtcgactacttcgtggacttctccaaaacgcctcaacggtatcttctccaacatgggcttagcaacagccggatctgaccagccaagtctgcccatatctgtcataatgactgtgggattaactgcattgactctgatgttattgcgtccatattccagggcagcggctcttgtaaacccatccacggctgcttttgaggcacagtatacggtgtggttattcaagccgacaagagaagcttgagatgagatgttgacaatagatccaggtgcttttcgggttaaaagattattgaccacaattttcgatacatgaattatggctttgacattaataccaaacaatcgatcgacgtcatcttccttaacctcagttaaagggcccaaaattgctaaaccagcattgttgacaagcaaatctatcggtccaacatttgtgagagcgttttcagtggcgttccagtctgataaatcaagcggaatgattcttatagagggtatttcttttttgagtgatgctaaatgatcggcatttcttgcaacggcaatgacatttgcttggcacttaactaattgtttaacaagctctctgccgattccttggctggctcctgtgacaagagctgtttttcctttgaaagtaacctccatattgtgaaagcccggcgatgaagt

SEQ ID NO: 2681 - DNA, 954 bp, Diabrotica virgifera
  misc_feature (871)..(871): n is a, c, g, or t
acccacgcgtccgaccagtcgacaagtaataacaacaatgctagctgctaaagttgtcttgtttttgggccttgcccttttcgtctcagccggtgaagaccttgacaagggttatgaaattgtggaatgtgccaattacgtaatgagagcaggagtacccgaattgggagtaccacaacacgacccctacgtcaaactcagggacctacaatggagtggaaacctcggtgttgccaaagcccatatcgagctccatgataatagatggtatggtcttgccgactgggaaattcaagcttaccaaatcagtgctgacactgacaacgaggctgtctttgactacaccacatcatggtcaaatggatttcaactctctatgaactacaatgcaaccattaaggaacttttcctttcacagcactactcaggaaccatcaagataaccatgaaacaaccagtatggactggaagaatcagcgcacaaaaaacccccacagagttaaaacctaacaccactgtagacagttttaccgtcgactggcacgttgcagatgtaaaatgcaaaatcactggtatgggattacttggagacacttatgctctcgctattcaagaaggtattgaaggtgccctcaaccatggtcttatcggaaataccgttggagacttccttaaaatgagattcaacactgtctggtatcccactggcaaagtctggcaaatgctggactattgcaactccctcgtgtccaccccagatacaccacaagcctagttttaatcaaataatcaggttaaaaataactaagaaagtattttcctgtgtaacgttaaaatacaattaaatggtaatatttattatttaccccgnttattaacccaaatacaaaaaaaattgtcaatggaaataaagacgtacgtttaacttaaatatttaaaatgtcaataataatg

SEQ ID NO: 2682 - DNA, 1052 bp, Diabrotica virgifera
ttgcaactccctgaggtgagtcgtattagatggaagcagtttcttcctgtctttgatgggaattcatccagaaactaaagaacaatgcttgccgctaaagttgtcttacttttgggccttgcccttttcgtctcagctggtcaagatcttgacaagggcatggaaattgtgaaatgcgcccagcgagcaataagcgtaggagtacctgaattaggagttccatcacataatcccttcgtcgttattagaaacgtatcatggactggatcaatcggtgttgcaagcacccatatcgaactcaataccaataaatggtatggtcttgcggattgggatatctcagctaagcaaatcaatgacgacgaagatttcgaggctgtctttgactataccacatactggcccagttttagaatcgtaggcaactacgaagcaaccgttaaagagcttttccttacacagcactacaaaggaacctacaacataaccatgattaaaccaaaatggactggaagaatcagcgcacaaaaagtccccaccgtcttaacacctaagcccattgtagacagttttaccgtcgactggcaagttgcagatgtaaaatgcaaaatcactggtatgggaataattggagacacttatgctctcgctattcaagaaggtattgaaacggccctcaaccatggtcttatcggaaataccgtcggagacttccttaaaatgagattcaacactgtctggtatcccactggcaaagtctggcaaatgatggactggtgcaacggcggctccaccgacgccccaacaacagctgcaccatacacaaatgcaccctcaacagctgcaccatagacagatgcaccctcaacagctgcaccatacacttatgcagcaccagcccttttttaagcaaaaaattaatttaaaaaataaccaagaatatattttcctccagctttgtaacgatagaatacaataaaatcgtatccattatttactagaaaaaaaaaacccacgcgtccgcccacgcgtccgaatgcaggcaccacgac

SEQ ID NO: 2683 - DNA, 1835 bp, Diabrotica virgifera
ccctaaagggcagatgtggattattgacagtggcaggactgaaaccttgactagtcctacgtcctcatcgcgtaggtacacacacaaagttgaaaactcgcccgatcaaaatgcgccggtactactcgcactattctttgttgttgctgtcgttgtttttcgctgccgcgaattccgaaaggtttagggtcatcagagaatggaagtacataaacttcacgtggcccaatgccgatgtgtacgataatgccctttctaggggcttttacgtgcctgaaaatatcattatctcgggaataaagttcttcgaagattactattacataacgctcccaaggatgaaggatggagtacctgctactctagctagaattcccgcaggacctacagctgttactgctccagcttttgaaccttttccgtcttgggagatgaacgctgaaggggattgtaacgctttccagaacgtacaaaatatagaaatagaccctaaagggcagatgtggattattgacagtggcaggactgaaaccttgactagtccatcgtctcggtgtcctccgaagttggttatttttgatattaagaagaatatgaccacgaccgcttacacttttcctgataatgtggctagtttaaattctaacttcttgtacgatattgtggtggatgatacagactcaggattcgcttatattacggataacagtgctaaagatccaggtataatcatcttttctgtaaaagaccatcattcatggaaaatccgccattcagagagcatgcgggcagatccaacagcaaccacttttagagttaatggtgtcattattaactctccgctgaatttggcaagtatctcattaagtccacgagttcttactactagcgagggaaaacttgttgtggatgacgacagagaagtgttttacagtcccatatctagtcttaagatgtactctattaataccactgtacttaagaacgaacagaatggagctaataatggagaataccagggaaatgttaatacaattggtatcaaaggatcacaatcagcaggtatgttaatggataataaaggaatcctctattatactttgctgggaaccagtagcatagcaaaatgggacatacaaactccattcatgtcaaaacaacgcattatagcaagagacgaaaaatacttacaatggcccaactcattcaccttcgacaacagcgtttatcttaccattttggtaaatcaactcaacaaattcatctacgacagatttgatatcaaccacttctactatcgtctttagtcatcgcatcaacgaggaagaaattattaaagagcttttccctacgcttacgaacaaaggaccaagccacatacccatggttaaaccaaaatggactggaagaatcagcgcccaaaaagtccccactgtcttaaccccttagcccattgtagacagtttttccgtcgcctggcaagttgcagatgtaaaatgcaaaatccctggtatgggaataattggagacacttattctctcgcttttcaagaaggtattgaaacggccctcaaccatggtcttatcggaaattccgtcggagacttccttaaaatgagattcaaccctgtctggtattcccctggcaaagtctggcaaatgatgggctggtgcaacggcggctcccccgacgccccaacaacagctgccccatacccttatgcagccccagcccttttttaagcaaaaaattaatttaaaaaataaccaagaatatattttcctccagctttgtaacgatagaatacaataaaatcgtatcccttattttctag

SEQ ID NO: 2684 - DNA, 1899 bp, Diabrotica virgifera
cttacttttgggccttgcccttttcgtctcagctgggcaagatcttgacaagggcatggaaattgtgaaatgcgcccagcgagcaataagcgtagtagtacctgaattatgttttccttcacggaactctcgttcatcaattattatgcaatgaaatgttcaaattttcagtttttcacatggtttttgagggttgaaagtggaggatttcgaagtttttcaatttttggtcgcttatatgtcggaaactatcagctttggagaggagtcactagggaccttttctgtttggaatgatccaaaaaacggaaaaagattttgttccatgcaaaaaaaaaaatatttttgggaaaaaaacagaaaaaaaacgtttaaaaattttttgaccacctttggtcctggcaacatgcaggtttgttggaaggggtcctttttgagtgggattgtgcaaaggatccgagttagaatgtttttcctagcggatgcgcagtggctttctggactaattatacttgagaacgtctcaagtaaaatgtatgtggttgtaatcgcgcgttttcatgacaggcgcttaacgcgcttaactacatacattttacttgagaccgttcacgtgctagcgcgcgttttaagtcattaaaacgcgcgttggcatgtgaacggtttaaaataaaatgtatgtacatagttttaatctaatactaatgatgaatttgatagtaattttacaaaaaaaaattaatttttttcagctttttgtgcgatacctgcgtaggaatagtaaaagtagtccaggactacgtacgaaaagaaattccattggtaagctttttgagtaacattcaccattttctttgttgcaaattgcaactaaccatcgtccatttagtcactacctttagattaatagaaaagttaattactcggttgaaaccgatatattagaaagtttaaatgctaaggttatacaagttcatctacgacagaattgatatcaaccaaaatggactggaagaatcagcgcacaaaaagtccccactgtcttaacacctaagcccattgtagacagttttaccgtcgactggcaagttgcagatgtaaaatgcaaaatcactggtatgggaataattggagacacttatgctctcgctattcaagaaggtattgaaacggccctcaaccatggtcttatcggaaataccgtcggagacttccttaaaatgagattcaacactgtctggtatcccactggcaaagtctggcaaatgatggactggtgcaacggcggctccaccgacgccccaacaacagctgcaccatacacaaatgcaccctcaacagctgcaccatagacagatgcaccctcaacagctgcaccatacacttatgcagcaccagcccttttttaagcaaaaaattaatttaaaaaataaccaagaatatgaccacgaccgcttacacttttcctgataatgtggctagtttaaattctaacttcttgtacgatattgtggtggatgatacagactcaggattcgcttatattacggataacagtgctaaagatccaggtataatcatcttttctgtaaaagaccatcattcatggaaaatccgccattcagagagcatgcgggcagatccaacagcaaccacttttagagttaatggtgtcattattaactctccgctgaatttggcaagtatctcattaagtccacgagttcttactactagcgagggaaaacttgttgtgcatgacgacagagaagtgttttacagtcccatatctagtcttaagatgtactctattaataccactgtacttaaaaacgaacagaatggagctaataatgtaggatacccagggaaatgttattacaattggtatcaaagatc

SEQ ID NO: 2685 - DNA, 2304 bp, Diabrotica virgifera
cgtccgcacagccctttttccatttttccgccaacgcatctagaaacatgaagactacctttgttttggccattttagtttgcgtcggtcttaccgtcagcgcccaaaagaatgactttttgtgcgatacctgcgtaggaatagtaaaagtagtccaggactacgtacgaaaagaaattccattggaagaagttgaaaaagaagtgaaagaattgtgccaagttttaccaggagatttgaaaaaattgtgcgaggacaagttaattccagcaatcgaccaaatgtacaaccaggtggaagacactcctcctagagatttatgcgtagagttggaattctgtaattaatttgtttgttagaatattataataaaaactcaaaattaaatttggaaaaaaaaaaaaaaccacgcgtccgactagttctagatcgcgaaatgttctaaatgaaaaaaacataatcgataataaaaaaatattcagatcaatccaaaaaaaaaaagaatgatttaaacagtaaatacgtgggggttttccgtcatccggtgaaaaaattcaacattctctcaacccttcgctagattgaaagcgacacggtgttctcgaaagaagcaatcggtacgaattttataatatactcgctcggaaagaggagagctatcgcacatttatgtgttttgatgataataaaatcaatcaaaacgctgttgtttcgatcgtttttgaaccactcacttaaaaagcttgtaaagttctcgaatttagaaacatgaagactacctttgttttggccattttagtttgcgtcggtcttaccgtcagcgcccaaaagaatgactttttgtgcgatacctgcgtaggaatagtaaaagtagtccaggactacgtacgaaaagaaattccattggaagaagttgaaaaagaagtgaaagaattgtgcaaagttttaccaggagatttggcaaaattgtgcgaggacaagttaattccagcaatcgaccaaatgtacaaccagatggaagacactcctcctagagatttatgcgtagagttggaattctgtaattaatttgtttgttagaatattataataaaaactcaaaattaaatttggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggggccccttaaaaaaaccaattttttaccccgggggggggggcccaaaatttttttttagggggccccaaaattaaattccggggggggggttttaaaaacggggggggggaaaccggcgggggttttttggtgatataccaatgattggataagctgatctacttgtttgttcaaaccatactgttggacaattgattaaagttttgagcacccaacaacttaacatgatcaacttcatccaatacctcgttgaacaaggtaatcaagttgatcaacaattgtacgctgttcaaagaaatttttaccaacaagtccaaagacttgttcaacaggtagttcttcaacaatctcaaatcaaagaacaaatccaggtacttatccaacaagaacaaactgttccacaagaactagttttattccaacaattggcctaccaacaagttgaacaattcatccaagtattgatcaagcaattcatctaccaacaagctagccttagacaattagttcaagtttttgttcaacaaggtcgtgttgttccccaacaacttgtttccagctacttcctgatctacaaacaattggtccaattggttcagcaaggagatcttgttcctcaagaattaatcgctcaacaacaactgatccatcagcaagttgtactattactccaaagaggagttttgccccaacaatcagcacttaaccaattggtttctcaagaacaacagttgagcttgagacagccacaaatctaccaaagagtaccacgtgtgtactaaattttgttttctttttattattgatttttgagttttcatgttaattttgattgttgttttcgaataaatgattatctgtaaaaaaaaaaaaaaagggcggccgctcgccaagataaccatgaaacaacccagtatggactggaagaatcagcgcacaaaaaacccccacagagttaaaacctaacaccactgtagacaggtttatcgtcgaccgcgaagctggaaacgaaaaatgcaaaatcatt

SEQ ID NO: 2686 - DNA, 1003 bp, Diabrotica virgifera
cgactcagctcatgtgatgaggtttgttatcacaaagttaagtcgacagttttttttgtataaatacaagatctttttctaaatgcgcgccttcagttcaagacaagtaataacaacaatgctagctgctaaagttgtcttgtttttgggccttgcccttttcgtctcagccggtgaagatcttgacaagggttatgaaattgtggaatgtgccaattatgtaatgagagcaggagtacccgaattgggagtaccacaacacgacccctacgtcaaactcagggacctacaatggagtggaaacctcggtgttgccaacgcccatatcgagctccatgataatagatggtatggtcttgccgactgggaaattcaagcttaccaaatcagtgctgacactgacaacgaggctgtctttgactacaccacatcatggtcaaatggatttcaactctctatgaactacaatgcaaccattaaggaacttttcctttcacagcactactcaggaaccatcaagataaccatgaaacaaccagtatggactggaagaatcagcgcacaaaaaacccccactgacttaaaacctaacaccactgtagacagttttaccgtcgactggcacgttgcagatgtaaaatgcaaaatcactggtatgggattacttggagacacttatgctctcgctattcaagaaggtattgaaggtgccctcaaccatggtcttatcggaaataccgttggagacttccttaaaatgagattcaacactgtctggtatcccactggcaaagtctggcaaatgctggactattgcaactccctcgtgtccaccccagatgcacgacaagcctagtttgaatcaaataatcaggttaaataagaaggtattttcctttgtaacgataaaatacaattaaatggtaataattattatttaccaaaaaaaaaaaaaaattcaggtcaccatgaaatatactaaaaatagaacatcacattccca

SEQ ID NO: 2687 - DNA, 1914 bp, Diabrotica virgifera
tctagagggcggacactgtacaagatgaagtgtctagttcttctttccctagtaacccttagtgtagctgcctactacccaagtactggtaggcaggtgacagtaggagtagctggaaatgtgaaactagtcggctctcaaggttcccagattgacattcgtagaagtccttacaacccaagaactgtcgacgtcaccctcagaagtccaaatgctccaaccagaactctgcaaattgatgaagccagaaacggccaacaacttggttattccaacctccaaggtgtcaacaaccaaggtgtcaaccaggctgatgttcttgctgatcttttcagtcaatatgagggtattgtagatgaccagaccttctacagtttgttgaacaaacttcaacatttggtacaagctggagtcatcaacagagtagtcttggatgttgtaagaaactgggatcagcaaggtgtacaaggtgttagtgacattgtctctctgcaaggactctctggttatggcaacttccaaggacaatcaagaggatattccccactcagagagatcttaaagaatggagtacaaggaaggagcttcaatcaacaatggttgaacaattccccagtccaatctttgcagaccatcttgcaacagatccagcaacaacgtggacttcaacaagaattattgggacaataccaaaacttgccccaacaatatttgaactctgaatatctccaaaaccaagacattggtaccaaccaaatcttaaacctcatctacagacaacaacaacaacttggacaaggcagaccagtaccactaaaccaataccaagacattgataccaaccaaatcttaaacctcatctacaaacaacaacttggacaaggtagtgcttacccactaaaccaatacttggttagccaaagacaagttaatggacaacaaagattccccgttcctgaacaattcgtttaccaagaagtgttaaatcaagtatacagcgaaccaatccttaaattaaccaaatagcccaacaaactttgctggaaaacaacccaatagcttaatgggagaaacaatatggcccacatgtcaaaacgatgcattatagcaagagacgaaaaatacttacaatggcccagctcattcactttcgacaacagcggcattcttaccattttggtaaatcaactcaacaagttcatctacgacagaattgatatcaaccactgggaactatcgtcttatatcatcgcatacaggaggagaaagttatatttacagccaagcctacgattacgacgttcaacccaagcacaacgaagaaacaggaagaactggtacatcaacaccctaatccagatgaaattctagagcataaaagtgaacccgccgtaagtccagaacctacagctgaacccatcgcaacgatagtacctaaaccagcaccagagcctcaagccgaacctgaacccaccgcacaaccagagcctaaagctgaacccaaacctaaggcggaacctgagcctaaagcagaacctgagcctaaagcagaacctgagcctaaagcagaacctgagcctaaagccgaacctgagcctaaggcggaacctgaacctcaagcagaatcaacacagacgaaccaaacagtcacaacagaagaaaataccaaagataaatcatcagcttctacgacagtttcaactattttaggttttgttttagcttgtagtttattcgttatatgagtactttattgtataaagtgatgtgatactgttaaaaactattaaacatgtgttaccaattagaataagtacaaaagtgggttattgactgtgagattgatttgtttactataagctttattgtccaatattctgtaatattttaagtgtaaaataaacaaaaatttag

SEQ ID NO: 2688 - DNA, 1217 bp, Diabrotica virgifera
cgcccttttttttttttttgaaaaaaactaaacaacaatgcttgccgctaaagttgtcttacttttgggccttgcccttttcgtctcagctggtcaagatcttgacaagggcatggaaattgtgaaatgcgcccagcgagcaataagcgtaggagtacctgaattaggagttccatcacataatcccttcgtcgttatcagaaacgtatcatggactggatcaatcggtgttgcaagcacccatatcgaactcaataccaataaatggtatggtcttgccgattgggatatctcagctaagcaaatcaatgacgacgaagatttcgaggctgtctttgactacaccacatactggcccagttttagaatcgtaggcaactacgaagcaaccgttaaagagcttttccttacacagcactacaaaggaacctacaacataaccatgattaaaccaaaatggactggaagaatcagcgcacaaaaagtccccactgtcttaacacctaagcccattgtagacagttttaccgtcgactggcaagttgcagatgtaaaatgcaaaatcactggtatgggaataattggagacacttatgctctcgctattcaagaaggtattgaaacggccctcaaccatggtcttatcggaaataccgtcggagacttccttaaaatgagattcaacactgtctggtatcccactggcaaagtctggcaaatgatggactggtgcaacggcggctccaccgacgccccaacaacagctgcaccatacacaaatgcaccctcaacagctgcaccatagacagatgcaccctcaacagctgcaccatacacttatgcagcaccagcccttttttaagcaaaaaattaatttaaaaaataaccaaaaatatattttcctccagctttgtaacgatagaatacaataaaatcgtatccattatttactaaaaaaaaaaaaaaagagaggcggaaagctaaagaaaaagaccgctagtgcaggactacgtacgaaaagaaattccattggaagaagttgaaaaagaagtgaaagaattgtgcaaagttttaccaggagatttggaaaaattgtgcgaggacaagttaattccagcaatcgaccaaatgtacaaccagatggaagacactcctcctagagatttatgcgtagagttggaattctgtaattaatttgtttgttagaatattataat

SEQ ID NO: 2689 - DNA, 1267 bp, Diabrotica virgifera
gtatcgttattttcgtcactacctccccgtgccgggagtgggtattttgcgcgcctgctgccttccttggatgtggtagccgtttctcaggctccctctccggaatcgaaccctgatcccccgttacccgttacaaccatggtaggcgcagaacctaccatcgacagttgataaggcagacatttgaaagatgcgtcgccggtgcgagaccgtgcgatcagcttaaagttattcagagtcaccaagttatacgatgacgagcgaacccgccaccgattggttttgatctaataaaagcgctccttccgtctccggttggagctctgtttgcatgtattagctctagaattaccacagttatccaagtaaatgtgggtacgatctaaggaaccataactgatttaatgagcctttcgcggtttcaccttaatttggcttgtactgagacatgcatggcttaatctttgagacaagcatatgactactggcaggatcaaccagggagctgttgtattaactactcgaaaaagaacgaaatagataatagataatcagtctcctctagtttttaataagagaaagacaaacgtatcctaatctatcataattctttttcgtttgcgtgtttatttgcgtttgaagagatatactttcaaacgccacgcttacgaaaaaaatttatatgacaaaatagttacatacatttaagtctatatatgtccggttgactttataacgataaaggcccattcagatcaatccaaaattttcagaatgatttaagcggatctacgttacaattttacgccatccggtgaaaaaattcaacattctctcaacccttcgctagattgaaagcgacacggtgttctcgaaagaagcaatcggtacgaattttataatatactcgctcggaaagaggagagctatcgcacatttatgtgttttgatgataataaaatcaatcaaaacgctgttgtttcgatcgtttttgaaccactcacttaaaaagcttgtaaagttctcgatctcacagcaaaaaaaccatagtacaactgcgagagcgctacgatttatacgtattttcatacatacgaaacgtcatatataaatcagttgtcactgatttatacaaaatatatgatttatgaatcatatatttttatttgctactcagctgttgaatctacggtgcgaaaggaaaatataaagtacattagcctagataagctattattctctatattttcggcgcgtccggtgaggg

SEQ ID NO: 2690 - DNA, 2889 bp, Diabrotica virgifera
acaaaaaagctaaacaacaatgcttgccgctaaagttgtcttacttttgggccttgcccttttcgcctcagctggtcaagatcttgacaagggcatggaaattgtgaaatgcgcccagcgagtaatgagcgtaggagtacctgaattaggagttccaccacatgctcccttcgtcgctattagaaacgtatcatggactggatcaatcggtgttgcaagcactcatatcgaacttaataccaataaatggtatggccttgccgactgggatatctcagctaagcaaatcaatgatgactctgattacgaggctgtctttgactacaccacatactggcccagttttagaatcgtcggcaactacgaagcaaccgttaaagagcttttccttacacagcactacaaaggaacctacaacataaccatgattaaaccaaaatggactggaagaatcagcgcacaaaaagtccccactgtcttaacacctaagcccattgtagacagttttaccgtcgactggcacgttgcagatgtaaaatgcaaaatcactggtatgggaataattggagacacctatgctctcgctattcaagaaggtattgaaacagccctcaaccatggtcttatcggaaatgccgtcggagacttccttaaaatgagattcaacactgtctggtatcccactggcaaaatctggcaaatgatggactggtgcaacggcggctccaccgacgccccaacaacagctgcaccatacacacatgcaccctcaacagctgcaccctcaacagctgcaccctcaacagctgcaccacaacagatgcaccctccacaagctgcaccctcaacagctgcaccatcaacagctgcacccctcaacactggacccctcaacagatgcaccatacacagatgcaccctcaacagctggccccctcacaactgccccttcacaggttgcccctcaacaggtgccccttgaaaagggattccctaaacgacgtacccccaaccgtccgcccacgcgtccgcccacgcgtccggtctagttcttctttccctagtaacccttagtgtagctgcctactacccaagtactggtaggcaggtgacagtaggagtagctggaaatgtgaaactagtcggctctcaaggttcccagattgacattcgtagaagtccttacaacccaagaactgtcgacgtcaccctcagaagtccaaatgctccaaccagaactctgcaaattgatgaagccaggaacggccaacaacttggttattccaacctccaaggtgtcaacaaccaaggtgtcaaccaggctgatgttcttgctgatcttttcagtcaatatgagggtattgtagatgaccagaccttctacagtttgttgaacaaacttcaacatttggtacaagctggagtcatcaacagagtagtcttggatgttgtaagaaactgggatcagcaaggtgtacaaggtgttagtgacattgtctctctgcaaggactctctggttatggcaacttccaaggacaatcaaaaagaatggagtacaaggaaggagctcaatcaacaatggttgaacaattccccagtccaatctttgcagaccatcttcaacagatccagcaacaacgtggacttcaacaagaattattgggacaataccaaaacttgccccaacaatatttgaactctgaatatctccaaaaccaagacattggtaccaaccaaatcttaaacctcatctacagacaacaacaacaacttggacaaggcagaccagtaccactaaaccaataccaagacattgataccaaccaaatcttaaacctcatctacaaacaacaacttggacaaggtagtgcttacccactaaaccaatacttggttagccaaagacaagttaatggacaacaaagattcaccgttcctgaacaattcgttaaccaagaagtgttaaatcaagtatacagcgaacaatccttaattaaccagagagcacaacaacttgtagaacagaaccaaccaatttctcaagaaatttatgtccaacagtatggtttgaacaaacaagtagatcagctgatccaatcattggtatatcaccaaaatgtgatctctcaacaagttgagcaattcattcaacaaggacaacgtcttccccaagacttgctttcccaacaagtattagtctaccaacaagttcgccaattgattaaagttttgagcacccaacaacttaacatgatcaacttcatccaatacctcgttgaacaaggtaatcaagttgatcaacaattgtacgctgttcaaagaaatttttaccaacaagtccaaagacttgttcaacaggtagttcttcaacaatctcaaatcaaagaacaaatccagatacttatccaacaagaacaaactgttccacaagaactagttttattccaacaattggcctaccaacaagttgaacaattcatccaagtattgatcaagcaattcatctaccaacaagctagccttagacaattagttcaagtttttgttcaacaaggtcgtgttgttccccaacaacttgtttccagctacttcctgatctacaaacaattggtccaattggttcagcaaggagatcttgttcctcaagaattaatcgctcaacaacaactgatccatcagcaagttgtactattactccaaagaggagttttgccccaacaatcagcacttaaccaattggtttctcaagaacaacagttgagcttgagacagccacaaatctaccaaagagtacctcgtgtgtactaaattttgttttctttttattattgatttttgagttttcatgttaattttgattgttgttttcgaataaatgattatctgtt

SEQ ID NO: 2691 - DNA, 2878 bp, Diabrotica virgifera
  misc_feature (2086)..(2086): n is a, c, g, or t
ggaggaacccgcgcgcgcccctctttttttaacactgtacaagatgaagtgtctagttcttctttccctagtaacccttagtgtagctgcctactacccaagtactggtaggcaggtgacagtaggagtagctggaaatgtgaaactagtcggctctcaaggttcccagattgacattcgtagaagtccttacaacccaagaactgtcgacgtcaccctcagaagtccaaatgctccaaccagaactctgcaaattgatgaagccaggaacggccaacaacttggttattccaacctccaaggtgtcaacaaccaaggtgtcaaccaggctgatgttcttgctgatcttttcagtcaatatgagggtattgtagatgaccagaccttctacagtttgttgaacaaacttcaacatttggtacaagctggagtcatcaacagagtagtcttggatgttgtaagaaactgggatcagcaaggtgtacaaggtgttagtgacattgtctctctgcaaggactctctggttatggcaacttccaaggacaatcaagagtatattccccactcaaagagatcttaaagaatagagtacaaggaaggagcttcaatcaacaatggttgaacaattccccagtccaatctttgcagaccatcttgcaacagatccagcaacaacgtggacttcaacaagaattattgggacaataccaaaacttgccccaacaatatttgaacgctgaatatctccaaaaccaagacattggtaccaaccaaatcttaaacctcatctacagacaacaacaacaacttggacaaggcagaccagtaccactaaaccaataccaagacattgataccaaccaaatcttaaacctcatctacaaacaacaacttggacaaggtagtgcttacccactaaaccaatacttggttagccaaagacaagttaatggacaacaaagactcaccgttcctgaacaattcgttaaccaagaagtgttaaatcaagtatacagcgaacaatccttaattaaccagagagcacaacaacttgtagaacagaaccaaccaatttctcaagaaatatatgtccaacagtatggtttgaacaaacaagtagatcagcttatccaatcattggtatatcaccaaaatgtgatctctcaacaagttgagcaattcattcaacaaggacaacgtcttccccaagacttgctttcccaacaagtattagtctaccaacaagttcgccaattgattaaagttttgagcacccaacaacttaacatgatcaacttcatccaatacctcgttgaacaaggtaatcaagttgatcaacaattgtacgctgttcaaagaaatttttaccaacaagtccaaagacttgttcaacaggtagttcttcaacaatctcaaatcaaagaacaaatccaggtacttatccaacaagaacaaactgttccacaagaactagttttattccaacaattggcctaccaacaagttgaacaattcatccaagtattgatcaagcaattcatctaccaacaagctagccttagacaattagttcaagtttttgttcaacaaggtcgtgttgttccccaacaacttgtttccagctacttcctgatctacaaacaattggtccaattggttcagcaaggagatcttgttcctcaagaattaatcgctcaacaacaactgatccatcagcaagttgtactattactccaaagaggagttttgccccaacaatcagcacttaaccaattggtctctcaagaacaacagttgagcttgagacagccacaaatctaccaaagagtaccacgtgtgtactaaattttgttttctttttattattgatttttgagttttcatgttaattttgattgttgttttcgaataaatgattatctgttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaaacaaaaaaaaaaacagataatttaaaaaaaaaaaaatggagaaaaaaatatngggggggggcccgttcaaagaataaaaatttaaaaagggggaggggggaacaatataatttttttatggggcccaaaatttttattctcgggggggggttttaaaaacggggggggggggaaaaacccggggggaccccccataaaaagcccttgtggaacccccccccctttccccggggggggggaaaaaaaaaaaaaacccccaccccccccccccctcccccacaaatggggccgccctggagagggggaaaaggggggccccccccctgtggggggggctttaaaggggggggggggggggggggggtgaaaacccaaaaggaaaaaaaaaaattttttgtaggccgcccaaaaaccccccttttttttttttttttttttctttttttttttttctcaagaggggggcggggtttttcccccaaaaaataaaaaaaaggggggggccgacaattagtgcaagtctctgttcttcaaggtcgtgttccgccccacccccccccccccagtaaaaaaatgatctacaggggatggggggagttggttcagcaaggagagcttgcccccccccaattaatcgctcaacaacaactgatccatcagcaagttgtattattactccaaagaggagttttgccccaacaatcagcacttaaccaattggtttctcaagaacaacagttgagcttgagacagccacaaatctaccaaagagtacttcgtgtgtactaaattttgttttctttttattattgatttttgagttttcatgttaattttgattgtt

SEQ ID NO: 2692 - DNA, 1595 bp, Diabrotica virgifera
tttgtttatttattgattatttaaattgaataattttcattacgaattacgataatattgtaatctgcaactaagattatacaattattgaaaattcaggtccaagatatcttaccaaattagagttaaaattaaaaataaatagttttttttgtgaataattttctatgagatctagaagttggccaagatgttagcccatcaaatagaaaacgattctagaagccaggatgtagtggttgtagaaaacgtaacatttgactctttattattatcaggaaaagtagctcaaggattaacaaaaaatggttttaagaaaccttcaccagttcagttgaagtccattccacttggaagatgtggattcgatctaattgtgaagtctaaatcaggtacaggaaaaacattggttttttcattgattgccttagaatcacttaatagtaccaaattaaaaaaactggaagttttgatcttagcaccaacaagggagatagcagtccaaagtcatgattttatcaaacaaataggatgcttctttgaaggtctgaaggtagaatcgttcattggaggactaccattagcagaagataaacaaaagtgccaaaactgcaacatagctgtgggtacaccaggcagaataaaacatctaatattggacaagacacttaacgttaactctgtaaagctatttgtgctagatgaagctgacaaactgatggaaagtagcttccgtaatgacataaatgaaatatacaacagtctaccaactaagaagcaaatcataaccactagtgccacttatcctaaccagttggaagagtttttatcgaagtatatgttatcaccaacacacataacagcagaactagagagtcctctgctattaggcttaaagcaatttgtggttgtcactaaaccatattcaaatgtagctcaacaactcaaagccaaaacagacgcattggttgatatattcaataacatttcgtttactcagtgcctggttttttctaatttccaaaccaaagctgagagtttgagtaatattctgaaccagaagggatggccttctacatacatttctgcagctcaaactcaagaacaacgattggaagctgtgagtgtgctgaaagagtttaaatgtaggattatgttgtcgactgatttaactgccagaggtatagatgctgccaatgtagacttggttattaattttgacataccaatcgactctatgacttacctacaccgaatgggaagagcaggaaggtatggttcgtctggagtgtgcatcaacttaacgtctcaaggcaaagaattaactcatctgcaggaaatacttggtcaaataggaggaaacactttaacaataccaaagttaccgaaaataaatggtagcatctcagatttattaaaaattgaagtcccgttaactgatcatatcgctagcaaggtaaagaacgaactagacgaatctattacgaaaactaaaatgtatgaaaacaagacaaaacaaaaaagtccaaataaagataatgacgatcctgcaagatctgaagggtgtcatgatgatcaagaagcaatctcacaaa

SEQ ID NO: 2693 - DNA, 786 bp, Diabrotica virgifera
gttgagtaatcaaactactaatatggcaaattattctgaagatcagatggccgaattccaagaggcctttcaactgttcgacaatcggggtgatggaaaaattcatgttgcccaaattggagatgctttaagagctttaggacagaatcccacagaatctgatgtaaagaaatacacccaacaacacaaacctgatgagcgagtctcattcgaagtttttcttcctatttatcagcaaatttcaaaaacccggagcgctgacaccgccgaggatttcatcgaaggattacgtcattttgataaagacggaaatggttacatcagttccgcggaacttcgacaccttctgacatcattaggagaaaaacttggcgatgatgaggttgaacaattgcttatgggccacgaagactctcacggaaatgtaaattatgaagatttcgtcaaagcgattatgtccggttaagttatataatgcagctgtcatccacattttataaattatataaatttaatttaaaatatcgcatttaatcattttttttataaattttgtataagcaactccattccaattttatacccttttactaaaaccggtttgacatattatgttgtagtcattattttttaagttaataaaatatttacaatttgacggcatttttgaaaatgtcaggtgtatagactgaaaacttttcagtgttgaccgttttggtcgtattattgtttacacagttttattataagtattatttggtatagaataaaaaaattacttactac

SEQ ID NO: 2694 - DNA, 1093 bp, Diabrotica virgifera
ctaagtgtaatatgtgtgtctgtttttctgacaaatattcacattcttatcagttattttccataaatatatgtttaaattatgattgtttattattatttcaaattaaatttctttcaatattattatagcaaaatatatttttaatagttttccaatttatcgtaaactccttgtataaactagaaaattttaatatttaaacttcccgctatctctagcgttagaatgttgaactattacaaaatttgtgtagacgtcatttgaattttatttttgacagttgagtaaaatcaaactactaatatggcaaattattctgaagatcagatggccgaattccaagaggcctttcaactgttcgacaatcggggtgatggaaaaattcatgttgcccaaattggagatgctttaagagctttaggacagaatcccacagaatctgatgtaaagaaatacacccaacaacacaaacctgatgagcgagtctcattcgaagtttttcttcctatttatcagcaaatttcaaaaacccggagcgctgacaccgccgaggatttcatcgaaggattacgtcattttgataaagacggaaatggttacatcagttccgcggaacttcgacaccttctgacatcattaggagaaaaacttggcgatgatgaggttgaacaattgcttatgggccacgaagactctcacggaaatgtaaattatgaagatttcgtcaaagcgattatgtccggttaagttatataatgcagctgtcatccacattttataaattatataaatttaatttaaaatatcgcatttaatcattttttttataaattttgtataagcaactccattccaattttatacccttttactaaaaccggtttgacatattatgttgtagtcattattttttaagttaataaaatatttacaatttgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaccctttaaaaaaaaaaaaggggggggccccctaaaaggaacaaattttaaaaaccggg

SEQ ID NO: 2695 - DNA, 1154 bp, Diabrotica virgifera
cggacgcgtgggtctaagtgtttaagaaacgtagtttagtatattattccctcttctatgtcgataacgcttaaatatactaaactacgtttcttaaacacttagataatttaagcgttatcgacatagaagagggaataatataggaaaactgaaagaactttagataccaatccaaccaacattggcccaagaaattaaagaaccaatggaagaatcctaaaaacgtaaaaacgaatgaaaaggtacattaaggaagaatatttgaaaaaaagacttgaaagagcagaggctcagtacaagtaccaaataataacatagatggcgtaggtgacacgagcgtagaacggctacagaatgaataacatgacaaatgatacagtacaggtacacagtatagacatcacacgacagaacagaaaaccacagaacgatgacgtaaaaacagacatgatatgacagcagacaattgacaaatgatgtcagcctcgccatcttgaaagggggagtggctaataataggtaccatcgaaatagttacagtgtggttccttgatttcttggcaattcctttttcacggcaaaaatgccctatctttttttcaaaaaatgtgtttggaatatttttgttgaacttatttatttttttgacggtttccgtcatctagtttaatttatttatttttttaatatattacatagatataggctttaactacgatggctgtatagccgttatttttttttataattgttgttatattgtaagggtgtagtctgaagagtatgtttttgttaaatcttagtttaagaactaaaacggagacaacaaggataagtacacctttttatgaaatcattcgactacatgagatcatagttgttgctaatatggattatcgtgccaaaatttatgtatttaaaaaattatgggcaaatattatttgtataaggctgtgagacatatgctttcgagataaatcatttccccagcataaatgaacctctgctacccacatacacatgtcatgtgtcatcatactcatacgatgaaacataaaatcgtccaccattttgtgaaccagattatgattctaactatgattataatggctacctattttaatccaagaatcctattatagtcgctactg

SEQ ID NO: 2696 - DNA, 955 bp, Diabrotica virgifera
  misc_feature (843)..(843): n is a, c, g, or t
  misc_feature (874)..(874): n is a, c, g, or t
cgcccggaaatcaaatggaagcaatgtgacacctgctgatattaaagatattaaggtccgtaaaagtttagaagcagcttgcaacaattggtaccttgaagtcatcaaactgattaaaccaaaatttatagtagctgtaggaggttatatagacaaaaaaacaaaggaactgtttaaagcaaataatattgatgatatacaaattctttgtatgccacacccaagtccaaggtctgtgggaaatcaaaattggcatgagaaggcacaaaaatttatagatgataataatttgataggatatttccaagcctagaagatattttgttgtattcattttaaaacctaaacattgactatttgtttaattttattgtacacatttaaaaatttcttggaagtgtttatcaatattgaatattatattgtaaacaacagatttttgtagggtcattttaaaaatcttccaagaattttttgcttgacaatcacattttaaattttttgtttgttttatctgatggtttatcgttaagttttattttgttatatatttttaagattaagacagaaaatactcaaaacaattcttacacgtctgtcttttataaatgctaaaatgtcacagaatgaaatattgtctgaaaaagagtgtcttttcatggacaaagcattcttttttgccaaggaagctctctcggtccaagaagttccagtaggttgtgtttttgtatacaatgacaaaatcatagctttaggacgtaataccgttaatgaaactcgcaacgctaccagacatgccgaaattaactgtatagaatacattgttgaatactccaagacaancaatttagattataatcaagttttttcaganacttcggtgtatgtcactgtcgaaccatgcattatgtgtgctgcagctctctatgatctgaaaattaaacagatcattttt

SEQ ID NO: 2697 - DNA, 2811 bp, Diabrotica virgifera
gtcatttcccgaaaaacgtgaactgaactgtgccggtgtgatttcgcagttaaataaaagaaaagttcaaaatcgtgatcgaaaaaaccttttattatattaatacaattttttaaaatggctgcaatgtctgtgataggtatcgatttgggaaatgaatcctgttatgtagctgtcgcaaaggctggtggaatcgaaaccattgcaaatgactacagtttaagggctactccatcatgcgttgctttttctggaaagaaccgcatattgggagttgcggcgaaaaatcagcaagtcaccaatatgaagaacactgtatatgggctaaaaaggctgttaggtagaaagtttagggatcctcatgtcaaaaaagaaattcagtttttaccatatacagttgtagaagaaaaaaacgggggtattggaattagggtaaattatttaaatgaagaacataaattttcaccagaacaatgtttggccatgttgttaacaaaattaaaagatagtgctatgacagctctacaaactcccataaatgattgtgttatatcagttccttcttactttacaaacaatgagaggaaggcactattagattctgcagccatagcaggtcttaatactctaaggttatttaatgaaacaacagctacggccttgtcatatggcatttacaagcaggatttaccagctgttgaagaaaagcctcgtaatattatttttgtcgattgtggccattcatccttacaagtatttgcagttgcatttaataagggcaaattgaagatgcttaccactgctgcagatcccaatttaggtggtagggactttgatctcatcattgctgagcatttttgcaaacaattccaaaccaaatacaacatggatgcaaaatctaatccaagagcttttctaagattgctaacggaggtagaaaagttgaagaagcagatgtctgcaaattctacaaccttaccactcaacatagaatgtttcatgaacgataaagatgtgtccagtgacatgaagagagcagatatggaaactttatgtgctcatctgtttgaaagagttgaagtaagcttaaagcaatgtctcaaacaatcaggattgtcattggatgacatttacgctgtagaaatagtgggcggatctagcagagtacctgctattaaacaattaatagagaaagtattccacaaagtaccaagtactacattaaatcaagatgaagctgtgagccgtggttgtgctctacagtgtgctatgctatctcctgctataagagttcgggattttagcgttacagatgtacaggcgtacccgatctctgtagcatgggatgcaagtccaggaggagaatctgctggggagatagaagcattcccacttaaccatccggttccattctcgagaatgttgacattctatagacaggaaccattcaccatcagagcaaaatacagtggcaacatcccgtatcccgatcatgatataggtacctgggttataaaagacataaaacctaactctgaaggaaagccgcagaaagtgaaagtcaaggtccgtgtaaacctccatggaatcatgtcgatatcgagtgctagtttgtacgaagcaaaagagtcagttgaaccagaaagtccggaagaacaacagaaggaggcacaggtgaacagtaacgaccaacagaatggcggtgtgcagactaacgagagcggcgaatcgatggaaacgacaaacgaaggaacaggagccaacagtggagaaggtgctgttcctgaggtaggctccggcaccagctggacgaagaaaatatctgcctggttcagcggggaaggaagcgataaaaagaaaaagcaatcggtaaaatccatagaattaccaatcgaatctcttacgaccggcttctctcaggtggaaataaatcatttcaccgagcaagaattcaaaatgatcgcttctgatcgacaagagaaagaacgcgctgacgctcgaaatgcatttgaagaatacgtttatgaattgcgtaacaaagtcagttctgatggagatttcgcacctttcatgcttgagaacgatagaaatactttggtgtcgcaattagatgatatggaaaattggctttatgaggatggcgaagactgtaataaacaagtatatatcgacaaattacagcagttaaaaagtattggagaacctgttccaactagaaaaattgaatatgaactaaggacctgtggttattgaggattttgcttaaatcctttacaaattaatggattgaaaaagcttttgggaaatttggaaaaaaaaaccaaaaaaaaataaaaaaaaattggtccccccccccccactgggggggaaaaaacttttttttaaagaggggggggaaaaaaaaggggggggttttttttttaaaaaaattatttttcccccccccccccggggggggggggggggggggggggggggggggcccgcacaccccccacttttaattgggggggggagggcacttttttttgtggggtggggggcgcccgcgcccccccccctccacaaacaaaaaaataacttttttcccccccccccccccccccccacccccctttgtttgtgttgtgtggtgtggggggggggggggggccgctcaaacaacaaaagaaaaaaaaaaaaagaaaaaaaaaaaaaaaagaagggagttgttttgtttcatcaaaaaatatccaaaacacacaccccctcctcctcctcccataatatatataatatttttttttataattataaaaaaaaaaaagaaca

SEQ ID NO: 2698 - DNA, 633 bp, Diabrotica virgifera
cttttttttttttgatcggcgctcgactagtagtcggagtagggcagccaaagtaattttttgattattatagttaattggtttattttaaattaggtattaagaaaaaatcaaaatatggctattaatctacaatatgacgccataggcaaaagttttgtccaacaatattatatgcttttcgatgatccaaaccaaaggcctaatttggtaaacatgtataatgtagaacattcatttatgacctttgaaggcaagcaattacaaggatctgcaaagataatggagaaattaaattccttaggattccaaaatataaatagacaacttactgaagtagactctcaacctatgtttgatggtggtgtactgataaatgtattaggtagattgcaagttgataatgatccaccacacgcttatacacaagtttttgttttaaaaccattaaatggatcattttttgttcaacatgacatttttaggctgaacatacacaatagtgcctgattttattacatctcctctccttctttatgttgtatgttcgaatcaactgaaaatatgcaatttttaaaatctcctgtatctgtttctgcttaatatgaattcacaataataaacttattttct

SEQ ID NO: 2699 - DNA, 2430 bp, Diabrotica virgifera
  misc_feature (1810)..(1821): n is a, c, g, or t
aaaccttcctttttaacgaaaaatcgtgtgtaaaggtagcacacgaataatcatcttttaattttccctataatcctttcaggatggcaatcagaccagtttaccgtcctcaaatcatcaaaaagaggacaaagaagttcatcaggcatcagtccgatagatatggtaaacttaagagaaactggcgtaaaccaaagggtattgacaacagagtcagaaggcgtttcaagggacaatatttgatgccaaatattggttatggttccaattctaagactaggcatatgctaccaacaggtttcagaaaagttttggtacacaatgtaaaagaacttgaagttctccttatgcaaaaccgtaaatattgtgcagaaattgcacatggagtttcgtcaaagaaacgcaaggatattgtagaacgtgctcagcaattgagtattagggtcacaaatggaaatgctaggttacgtagccaagaaaatgaataagctattattttgtttaataaaaaatagaaaaaattaaaaaaaaaaaaaaagggcggccgctcgcgcccacgagttctacagtcggtgtctccagttgtttattatcaaacaaaaatgtctctgacaatgattggtggtgtgaaaatccccatagtggggctaggaacatggcaggctaccaatgaagaagaattggaagctgccgttgaggcagctctggaaactggataccgccacatcgatactgcatctgcataccaaaacgagcatgtcatcggcaaagttctcaacaaatggttgacgtctggcaaacttaagagagaagatattttcattactaccaagcttccaatgacacacatccatcccgatctcgtcgaaacagctcttaaagaatccttacagaagcttcagctggactatgttgatttgtacttggtgcattctcccatatacatgaaatttgttgaagctggaaagccaatggaacctctacctactgaccatctggctgtttggaagaaaatggaagagcaagtagatgcgaaaagaaccagaaccatcggtctctccaacttcaacgtaaaccagatcgacagaatagtgaagaattgtagaattcaaccagccaacactcaagtggaactgcacgtttactaccagcagaaaaaacttagagattattgcaagaagcacaacatcgtcgtcgtatcttacggctcactaggatcacctggattaaacgtatttatgaaaagactcggcaaggaagtacaaatccccagtcttcttgctgatccagtggtaaccaaaatcgcagaaaaacacaacaaagctaccagtcacgtactattaagatatttaactcaaaatgacatcgttgttattccaaagagtgtaaaaccagagagagtgaagcaaaacttcaatttcttggattttacacttgatgccgaagacctgaaagctttggaagctttggataaagacgtagatggaagactgttccgtatggatgtttttaatcccaaaataaagaacacccagagtatccatacaaaagtaataagcatgacgaaaaaaaaaccacgaaaaactgtcagaagactggtcgtcagtagttgcttgtaaaaagaaaaatttaataaatttgtgaaaaaaaagattttttattataccccttacaaaacaaaaaacataaaataaaaaaaaaaaaaaaaaaaaaaaaaaaaaaaaaaaaaattaaaaaaaaaaaaaaaaaaaaaaaaaaaaaaaaaaaaaaaaaaaaaaaaaaaaaaaaaaaggggggggggggggaaaannnnnnnnnnnntttttagtacagatatgcaatacgattttaaatatatctgattctttaccatatacgttatctttatttattaacaatatatatataattaaaaatttttatattattaacattagatatttttagggatgagcttagaaataaaactttattaaaatttaatttttaaataaaaattaggactaaatattttcatatcttaaaatatgtgattatttatttttatatattattatttttactttttataaattttttattaaaatataaatttaaatcatttagatttagcaatgatgatgatattagtattaaaaccattgtatatttaggaaaaatatataggtttaatacaggaattcggcaacatttttttcacctgtttatttacaaatgtctttttgtatgaatatacccgctcgcctgcccctgcttactttgatggccgcgtattttgaacgtgctaggtcccataatcattactttcttattgcacctgcactgcagggtgcatgaaaaacaactgtctttctttatccattaccattttatttttaattctaggaagtttaatttccttagaaagacgacagaccctatatatttttc

SEQ ID NO: 2700 - DNA, 867 bp, Diabrotica virgifera
atgaaaacgttatatgggactttgtgaccaaagttgatgatgctctctaattctaaagcactttttaaaaataatatgtattttaaatgccttatgcggtattcaggcgacaaactaacaaatctgttatatattctgaatatatcatacacccttcaatttattgtgtatcttgtataaaaagaaagaacatctttgaaaacaagagcgtcttgtatatctcttcagaagagcatgtatgatatcagcgtttatagtacgtcaaaaataatacaattcatcaacataagatacaactgaggcaagcatatctccctgtcgcagtcccgacatgcgtttcaaacgcttgtgattgttcaccttatatgcctactttgcaaacaactttacgcattttagccctaaccagtcttattagttgatcgggaatgtagaattcggctatgacttcatacaatttagttcgcagctcactatgatggctgatttaaaatctatgaagggatggtagatatcgatattgaattcgttggtgtttttggggctaaaatatgtatttgttttctccccacacctcttctgtcctctattttaccttgtattatgagctataggtgtcgtatttttatccattccttattttccagatcttggagttttttatcttctattgtgctttaacatatttttctttattcgttttaattaacatttcaatgttcgtaatgaaatcatcggtggaattttagactcttctatatgccaaaatctcaaagaagttaagtattttttatggaaattacatttacgggagaaatttggaaaggggccaaaaaacctttttggattttgagcccggatttccgg

SEQ ID NO: 2701 - DNA, 2179 bp, Diabrotica virgifera
  misc_feature (2153)..(2153): n is a, c, g, or t
ctaaatttttatgttataatcgatttccaagaaaaaaactagacggtgggtaagattaaaaaattggttgcatgaatattaatttaatcaatggtactggtatctattctgttatattttttgttcaattacgcctatcaattttgtttacatttcaatatttattcagatcttttaaaaagttttagtacatatacatatatccatttcttgtggtggtatcaattcggtaattatcagaaattaaaaacaatcagggaaaattcttgataaagaaagtttgacaaatttgacagactcatccagtcccgtatatcgagactgtttcgttctttgaatgccgcatatatactactatcatctttctgagacactcattaatgttcatctgagcggagtgctatattcgaggtgtgaaacatttggaacattttcgaggtgtgtaaacaaatcatttggatacggattattccataaaacaggtagatctcttgtttatggaatctcacacctcgaaaaataccactctcttgagctgaatgttaataagtctcttagaaggatggtagtaatatatcttaacgcttaatttttttgatatctaattgtgtcttttacaacagttcttattttaattaaagctaactacccttttgctaattaaatgttatttaaaacaaaaggaattacctaattccattaaaatagttaacccgtaaatattggtgatttaaaatattgtgatttatctttataccattgtttaatgttattattattattagagattatagaattattattattagaaagttagtgaaccatagtttacgttattgtatctctcatagtgttcagcatgactacatttccaactatctttagaatagtattatcatatctatcatacctatcagaagagttttctttatttctgatatcggccttctttgattagttttatttggccacttggtcttttcttcgcacctgcggtaaaatggagtactaccaccgtttaaccaacaaacagaaataaatctttttgaaaacattatattcaacctgggctaaatttttgatgattaaatcctgcaataacaaaaccttctcctacaacttattcactcatttacaacttaaccaatattaccaacaactgaatcaaaaagtgagcttcggattatattcttagttattagatacacatatttagaaaaagtttcgttttgtttcatgtgaacttccgcataatgttagattttttcttgttcccctactggcgaagcgtccatgtaaccaccgttaccattggtaacagttaaaaatcttgcaaataaatatttaatgactactatgaaataattccatttatattttttaccaacagaaatatttgttaatagtacctaattcagtaaatctaaatagctaaataaaactagatctaaatataaatctaactagacgcacgaaaatattggcgagaatatgtgaatccgttgcacgttattattatgttgttaccacttaccacttctgctagctcgtttctgaaaattttgaaggagcgacggctctagagacggtgcgtggacactctgtgtatatcagtattgtaaccattttttggtttggtaacgttggtttagtacaacctattacagattacagtgtgcgtgcatttaaacatggaaaagtgttgctgcgtattgcgtattgcatggaaaagtttgctgaaaagtcattcttcttgtatatttttttatatatataattttgaagaaaaaaatgagattattgaaaatggaagaattcaaatataaacaatagttttcaaaatctgttctttttcctacttgttcattttttatgttaattttatggtagaataatatgtttaatttgtttattatttattgttatacctattacatatacataattgcatacatatacaattttgcaatagtgatttgtttaattttatcccacaggattgaaaataaaaacttatatttgggaggttcaaaataatttttttaaataagatttttttacatctggttttggtaacactttagaaaaagtcatgcgtcgccactgtgttcctctttgtttaactggagtcaataaacacatgtgtgtgactntagttttatttagcatataactcttt

SEQ ID NO: 2702 - DNA, 975 bp, Diabrotica virgifera
  misc_feature (863)..(863): n is a, c, g, or t
gtgagattaacctattaaaatatttttacttgagtttttttcttagtttttacgaatatctttttggaatggttttatatttataaataccaaatggcatcttctgccggagtgtataaacgaattttatcgttattggaaaaatggccagtagataaaaataaacttggtggaagagatattggagaacatttgagacattacataaacacatcatataaagaaaataagtttgaaacaaaccattcctactgggacaaacagtatttagccattcaaagattagtaaataatacccacaaaaataaatacaaaagaaccctgaatacttccgcaacagggctaacagccgaacagtgcaacattgctttatcgaacgaatatctagacgaagttaatcagaaagagcaatcatttttccgtaaattgatatctattaaaccagacccttaataagtagtaaatattttaacccaaatatgttagctagatattcaaagatatttagaaatattagatatatgagtacattagccgaacaatgttcggatgtaaaaaaagttcctcatgtgccagtcatggcagaagaagtattacactatttgaaacctaaaaaaggagaattgattatagatatgacctttggagcaggcggtcatagtcgtaaattgttagaatgttcacctgacattaaactaattgctttagatagggatcctgtagcttatggatatgctgacagtttagctgaagaatttcctggtcaagtaataccattgttgggaagattttcggagttaccaaagctattacaggctaaggatattttaccaagtactgttgattgtatactctttgatttncgttgttcttcaatgcagtttgatgatggtaatagaggttttgcactttcacaaaatggaccattggatatgaggatggatggatgtagatttccagatcgcccacagctgc

SEQ ID NO: 2703 - DNA, 710 bp, Diabrotica virgifera
tacatggacagaggttcatacttttttaacgattagtgcttctaagaccgttttcacagccccacaaactaacgataccaacatgtcacatctagttaccagtgtcgtagaaaaatacaacgatatattagagcatggagatcctagggtggaaggatggtggatgatggatagtccattaccaactctatttatatgtatgttctacgcagttttttccaaagtgataggtccaaaattaatggaaaataagaaaccattcgatcttagggacgttttaatagtatacaattttctacaaactttatttagtatttggttaatgtatgaatatttaatgagtggatggtggggcagctatagttttcagtgtcaacctgtagattattcaaataatcccgtagctttaaggatggcaaggacgtgttggtggtactatttctcgaaatttacggagttcttcgatacgcttttctttattttaaggaagaaaaatagtcacgtgtccacgctgcacgtcatccaccacggttgtatgccattctcggtatggatgggagttaaatttgctccaggtggccacagtacattcttcgcgctattaaacacttttgttcatattattatgtacttttattatatgggtgctgccatgggtccagaataccaaaaatacatctggtggaagaagtacctgactaggttacaac

SEQ ID NO: 2704 - DNA, 932 bp, Diabrotica virgifera
ctgttctgttgtaatgttgttgccagttggttctcggagttaagtttttaagtttgtaaacgcaccgttggaacatcgctccttaaaaatggcaaaagaatctgcaagcaaaaaagggaatggtgctgtcactacatatctcctactttataatggaatacaaactttaggctggtcatatcttctatttcaagtaattatatattatttattcggatcgacaaaatctctctacgatacagtccaatggacagttaatatatttcaaaatttggcagtgttggaggtgttgcatgcagcaataggaatagtgaaatcaaatcccatcattacggctgttcaagtatcttccagagtagttgtggtggtcggtgttctgatagctacacaggcgcctcgggaatctataggtttaactttgtgccttctggcttggtccatcacagaaattattagatactctatgtatgctctctcattagtgaatgcagtgccatattttttgacttggttaaggtactccttgttcgtcgtgttgtaccccataggaatcacaggagaattactatgtttattttgggctcaaaaggaagttggggaaaatagtttgtattccgttaccatgccacataaatataattttatattcaattatcaacacgtactcgtttttataatgttgatgtacattccattctttccacaactttacggacacatgttcgctcaaagaaagaaagtactaggaggaaagaaaaaagagtaaggctgttctaaatgttctcactatcgatgatctatttttgttaacttttatgatttttacttaatttatttaaactgtctctattcttaaaagggtgatacagtaacatttttgtatcctcattgaacccgtgatgtatatgactaggtgaattaatttattggat

SEQ ID NO: 2705 - DNA, 1046 bp, Diabrotica virgifera
gggtcgacacacgcctccgtggtgaaagtgacgccatcggccatcgtagtatttttatttcatcagtaagccataatatccaaaaatggttgataaaattgaaatgagtttggacgacataatcaaatcaaaccgaacacaacgagtccgaggaggcagagggggcggaagaggtcgtggaggaggcggtaataggagcagcggtggcggtggccaacgccgtggaggaaatttcagaagttcaggtcgtcccggtggaaatgtgcaaagaagtcgtgggcgaggcggcatatctcgcaattacacgcggggagacgtaaacagtgcatggaagcatgatctatttgaagggtatggcccaagaaaagttgcagctgctagagctacagtacaagccactatgggaccaactaaacttttggtttctaacctagattttggagtatccgactcagatatacaggaattgtttgctgaatttggtgtcctgaagggtgctgctgtacattatgatcgatctggaaggtcccttggaacagcagatgttatttttgaaagaaggagtgatgcaatcaaagccatgaagcagtacaacggagtcccacttgatggaagagctatgaatatccagttagcaacatcagaaatacctgctccactaagaaggcctgccagtagtagtgttgatagaaaattccaaagcagaagtcctaggggaggcagcagaggtagacttcctagagggggaggacgtggccgtaatccaagaaaccagcaggcaaagcagccaacagctgaagaactggatgcagaactagatgcttacacaaaagaagcaaagtaaattcggggggatattagactttgatctgttttcacacgtgtgtaaagtttatgttttgtgagcgtatttttttttatgtctttcttaatacgctactaagaatatacgagtgtttgttcagtttacttttatatttttttgaaaggcaagaaaaaatggtttttgatggactaaaacgtttatcggttaaatttttataatt

SEQ ID NO: 2706 - DNA, 1029 bp, Diabrotica virgifera
  misc_feature (986)..(986): n is a, c, g, or t
gacgaagccataatacgacaaacgtactataagaaactgactacgccactgacgttgctattttgtaataaaacaccacattcaacatttatctcccatactttggacgagtctgattaaggtcatgtcatgagtgttgagtgtagctgtatgttgaaaacaaaataattattgttttaaatcttttttagagaaagaaagtataatttttttccaataaaaacaatatattaattaaataaatgaacaaattacgtgtctaatttgtaaagaagatggatacactcagtgcttatataccagatattgtgtctctcgagaatatacaaggtgcagtcggttatttgtttttagcgtctatgcttcgtctgttcagtttaaaaagtaatttgggaaacgaacaacattatcctgaagattatggaccaaaactgcgagacggagatgagtttgattttatagtaataggagcaggatcagcaggatcggtggtcgcgaataaactaagtgaaaatgctggttggcgagtgttagtgctagaggccggaggatacccttcctttctcagtgacataccagcattcctgttcagtttacaaggcaccgatgaagactggcaatataaaaccgaaccttcggaaacatcatgcttggctttcaaagatggacaatgtcgttggccaagggggaaagtgttgggaggtaccagcaccattaacgcgatgttgtatatgagaggagataaacgagactacgatcattgggcggaacttggcaacgttggatgggactggaatagcgtactggaacattacaaacagttggaaaatatgaagtatttgcatgctagtgaacagtatggaagagatggactgttggagttaaccaagtatgattcaggtcatcctataacgcaagccattaccgaggctaacgaacttttgggatatcccgtcctcgctgaagaaaatcctgaacgccctttnagtagcataataggggtcgatgactatctcagaagggtgcaga

SEQ ID NO: 2707 - DNA, 970 bp, Diabrotica virgifera
  misc_feature (905)..(906): n is a, c, g, or t
  misc_feature (932)..(933): n is a, c, g, or t
caaactagtgttattttgcgagttcttaatgtgttttagatcattttagttacgtttctttgtcattttattttgtacaaggattaatttaacatttttactggaagaattcatttaaatagataatatacctcatttcttttgagtattgaaatgttgaatgcgaagtaaccgtgataaagttcagttttatcgattaccatcagtgctgaacagtgcatttgaagcataaaactgaactaaatacagaaacaatggtaaaatgctataaaacgtcctataaaaatgctaaataacttactatttccatgttacttacgcttggaaaactctccactgtaggttaactcagactccctgagggaaatgaatctatattatttgctttgctaatcttttgcttgtataatctactagcaacatctgtattgtataccaacaaatttcgaaaatagtaacacatgtttatttattcattgcttaaaactaaataaagtcgttcaagtgcttctacaataaaaaactacacaaaattaacaacaaaatgtttgaaaaatacaactaaaacattattaaaggtaaaaaaacttaagaaacacaatgtggtacaaatataaacaaatataatgtttggcagtttgcctcccagcggtgtgataaacgtcaaaagtcttggaatgccctactgtatgcatctaacctaaaaagctgtagaatagtacattataaataacgattatgcaatttactttgtttattgcctgtatgaaatgttacttttttatcgattgctttctagtaagcatttttaagttattttaaagtgtaatttgccaataaaatattgttttctggtattaatcataaaaaagaactaaagaatataaacgtttagtgcctgaaannatgtaggtccagacaaatgatcgttnncataatatgggcctaaagcttgacataacaaaaatct

SEQ ID NO: 2708 - DNA, 954 bp, Diabrotica virgifera
  misc_feature (804)..(804): n is a, c, g, or t
  misc_feature (953)..(953): n is a, c, g, or t
gacgcgcgggtcgatgcaagactctagatagagtcgtaatattgtgccctttttcgtttcggtaaaatttatactaactagccgttagaaaagttactaattctcgagttatttaattgagaatttgactttattcgtcactagcgcaataactcagtatggtgattattaattcatttaaacacccggagtctcctattaggtatcaacaggacgatgttcaagtctacttagacaagaaagatttgggcctgggaactttatttgttagtgaaagcacattatgctggcaacaagaagagaacaatggttttgctattgaatattcaagtatttccttgcatgccatatctaaagatttaaacatccattctacagaatgtgtataccttgtgacagatggacatattactatgccaggtgacagccctcctgtaattaatgaagatgatgatagtgatgcagagtccactgaagatatatctgaaatattgtttataccgagaaattcagaatcaattccacaaatttatgaagccattaaagtttgtcaagaattgaatccggatcccatggatgaagtaggcgaagatgaattgagtgatgataacgatgacaacttatatgaagatgctgaagacgatatggaaggagaatataatattggtgaagaagggggaggtgatgcagatgtagatgatctttctagaagaatcctgagaaacaatctcaacattcaaataaattatacaaacggcacagctgaagaagatgactttcaagatgccgactgaatataccacntaagccgttttatacttttctaatttgtttaaaagttaagttgtttttttttattatttttgttatttactccaacatcctgtggatgcataaggagatatatatcacgagaaaactaatttaaaataaaaatcagttttttgtgctanc

SEQ ID NO: 2709 - DNA, 553 bp, Diabrotica virgifera
cagacgcgtgggtgcaccgaccacattaaggctatcttgagattgaggcctggttgaagtgaatattttcgttgcaccgtgtgtcaaactcgatttaaacctcacttaatttaagttttcttaagccgccgaatttgacggcttaaattgggtgaggtttaaatggagtttgacatacggtgcagcgaaggtatttactttgagcgggccttaatcttaagctagccttaatattatagtcggtgcaaatggcccataaagttcagttttatcggttaacatcaaatatatcaaatcttctttttaaaaatccctcagatcttatcgaatcaagtcaaacgcatcctatatatgtagagtatagagtgttatattaggcaggtggcagtttttgccacttggccaagttttcgcaagctgtcaattttcggcactttgtggcataatagtacaattttttatgtaaaacactagttttggcaagcaactcatacagataaacatacagggcgtagatttatacactctcagtttagatttgttttacaagaaa

SEQ ID NO: 2710 - DNA, 1217 bp, Diabrotica virgifera
  misc_feature (1045)..(1045): n is a, c, g, or t
  misc_feature (1057)..(1057): n is a, c, g, or t
  misc_feature (1095)..(1095): n is a, c, g, or t
  misc_feature (1128)..(1128): n is a, c, g, or t
  misc_feature (1167)..(1167): n is a, c, g, or t
atccagaatgcattccggtgaagatagctacaaatgatgaatattaatgttgacatagagcattccaacatgctgtcaaaattaaatcaatatggcggctgggaggcaaacataaatgttattctgttaattctgtgttttagatcattttagttacgtttatttgtaattttgttttatacaaggattaatttatcattttcactgaaagaattaatttaaaaagacaatatgcctcatttctctgtattgaagtgtagactgcaaatggcccataaagttcagttttatcggttaccatcaaatatatcaaatcttctttttaaaaatccctcagatcttatcgaatcaagtcaaacgcatcctatatagagtgttatattaggaaggtggcagtttttgccacttggccaagttttcgcaagctgtaaattttcggcactttgtggcataatagtacaatttttatgtaaaaaactagttttggcaaacaactcatacagataaacatacaaggcgtatatttatacactctcagtttagatttgttttacaagaaagaaaccttttgaaatttcaagggttgcaatttagaaaattttcattttttaatattcgaactgcgaatgaggtaatttgtggccctaaatttttacctatttaattgttagacataatttaaatatgtgggtcccaaaagctcgttctttatttaaatttgctccagtgtgggacagggatgattggaaaatcagaaatcatttaattcacctctattcatcccgccaattttttgcgtacacttgacgtatgacgttattgatatatcccaattatatgtgtcagtgacatatgacataaatctattatacgtcatacgtcaagtgttcgaaagaaaatggcggtgatcaatttacatatcataaattttctttacattttattgcacatgtagcttgtgttaagttttttacctcgcagtattatttaaattcatgctatttcttgtatcatttgcagtgacatatttacatggtcttcctanacttagtaatanattatattatacatattttaattgtttttggaaattangtataattaataatagggggaccatgtaaattnaaatgctttaatgttttttgtaagctaatttgtgctaantttatttttcatttcaagtgctgaaagaatatcataacccatcattaatt

SEQ ID NO: 2711 - DNA, 878 bp, Diabrotica virgifera
ggcgtatcggggacaaacgacaaaccaataaaactggtacaacttaattcaaaaataaataataaggtgttaaaaaagtcggattttaacttaggttgtgaaagattcactgtatatttgttaaaaatgtcggataatgaagatgattttatgtgtgatgatgaagaagattatggtttggaatattctgaagatagcaattcagaaccagatgtggatttagaaaatcaatactacaacagcaaagccctcaaagaagatgaaccgtcagcagctttagcatcttttcaaaaagtactagatttagagagtggggaaaaaggagagtggggttttaaggccttaaaacagatgatcaaaattaactttaaattgggtaactttgaagagatgatgacaagatacaaacagttgcttacatacattaaaagtgctgtaaccagaaatcatagtgaaaaatctattaattctattttagattacatttcaacctctcgcaatgtaagtatggaactcctacaaaatttctatgagacaactttagaagcgctaaaagatgccaaaaatgatagactgtggttcaaaacaaatacaaaattgggcaagctatattatgatcgtgaagattttattaaattggcaaagatactaaaacaattacatcagtcctggccaactgatgatggagaagacgatcttaagaaaggcacacagttactggaaatttatgcactagaaaatcagatgtatacagctcagaaaaataataagaaacttaagatgctatatgagcagtctttgcatattaaatctgcaatacctcatccgttgattatggggagtatacgggagtgtggtggcaaaatgcacctgaggga

SEQ ID NO: 2712 - DNA, 1287 bp, Diabrotica virgifera
gccgctctaagggtggatcccccgctctggaaaattctcacaatttcgcgagggccgccctttttttctgcgctctcaaggcagaaggtcttattgacaccaaaatccgaataatccacaaaaatgagaatctacaaagacattttcacaggggacgagatgttttccgatacctacaaaatgaagttagtggatgaagtaatctacgaagtctatggaaagctcatccaacgtaaacaaggagacatccaactcgatggagctaacccttctgccgaagaagccgatgaaggtactgaagctggtgtagaatctggtgttgatatagtactcaatcacagattatgtgaaacatacgcctttggagacaagaaatcttacaccgcatatctcaaggaatatatgaaaaaactagtagaaaaattacaagagagatcacccgaccaagtagacgttttcaaatccaacatgaacaaagtaatgaaagacatcctaggaaggtttaaagaactccaattcttcacaggagaatcgatggaaatagacggtatggtaggattaatggaatatagagaaatcgacggacaatccgtgcccgtaatgatgttcttcaaacatggactggacgaggagaagttttaggcattttaaattattaacattgttatttaatatataccgatcgtctacaatactttaacagtgttttccaacaattatttaataaagtgataaaatgtatgttgtgagagtgtttatatctcttaagaataaagtgattttgctatgaaaaaaaaaaaaaaagggcggaaaagcaaaatttttttttttacaatgatagaagatttaaaatattattttaaaaatttatttatacataaaaacctttttgaaaattgtacaagatatttaaattggttcgaatcaaattttgtacaaaaatgggtaactaaaaaaaaggaatgtcgaaaaacaagttccaaaaatggcacataggaaaaaagaaaaattaatatatgaaggacggatcccgaagcccccagaattttttaatttgccaaccacaatccgggaatcaatggtttacgaaaaccggaaacctctcgggttttttttgtttttaagttttaaggaattttttggaaattttttcaggggttgagtcccccttgggtaaaaataaggggacaacaatttttggggaaaaatttttttcaaaaaaaaaaaaaaattctctgggtaaaaaaaaggggaaaaaaaaaaggggggggggctccaagggcaacc

SEQ ID NO: 2713 - DNA, 754 bp, Diabrotica virgifera
gttgttggctggtagttcgaatatattacatcaatggggaatgttacatgcaaggatacagaaaaaagccatttttgcgtactttatagtcaattattatcaaagaagtaaaaagatttatacatttattagtacacacaataaaatttattctcatttctacgcaattcattagagaagcccaaaatttccgaccctctgctaatttttcagatcagtagtactgtacaagactacagaactatctgacatcgccaaggtcagccgatcgaaaactttgcggacgcgtgggcgtcagagtgggcggaattcaaagatttttctgttttttatttgctacctgtttcacaataaaatttctttctatgtatttcttcctgcatacattttaaaacaatgtattctaaataaacaactattcgacgattttatctggcaatgtcgcgaaaccactgatttcgtacacaatgcattttaaattgatgtttactctttgcaccaacgcgttcaactgagttaccttccgatttcagatatttctgtacaactgtaccagataagtgtctgccctcctcaacatgtcgctaaattgccatgtatatactgcacatgcacgacgcatttcatgtacctgactaatcatcaatgcgtgtggagcacgtatggttgttgatttctgcatatatccaattcacatatcggaattactcataacgtaatgttaaattatgactaacgtactttgacttattct

SEQ ID NO: 2714 - DNA, 1048 bp, Diabrotica virgifera
caacactctatagagagtcgtatgatagattctgtaggtcattctgttattaagccgtgtcagcacgcatcgcaataaaaaggtcgccgatgaatcactggaccaggtaatcaagaaatttcaagatctcgaaatttcttgagtcaagacaagatataacatgtcaagaaaacgtcaagacaagattttttaaatttcttgattttttctcaagacaagacaagaagttgttatcaagacaagaattcttgtcttgtcgacccctacacttaatgtcctatttttcacggcacttgaaatattcatatttacaaaaaatatatatattgaatgtattctaaataaacaactactcgaccattttatctggcaatgtcgcaaaaccactgatttcgtgcacaatgcattttaaatgaatgtttactctttgtacaaatgctttcaactgaagtccccgctccttgatttgctacctggatgatcttcgcagtttcagatatttatgtacaagtgtaggtaactcagataaaagctttagatttcctttatttcctaaattgttataacttccttatagttttcaatagcacaaatgtttcaaattttgagtagaaagtaaatttgcaagatctgccccttactggaatctctcttaacaaaatactcaatcattgtgtaagccaaactcgcgatgtgtgacgacagggtaatataacactcctgttactagttgcatgtacaacatttgtaagaaccaatcataattcttgagaagttaaaagtatcttttttgtttaagcactttttaaacaatgccagtgcatatacatatagaagaagaaacacctctgacttaccagtctgtgacaatatatagctttttttccagtggaaggacgatataagtttaaattttgtgccagtaaaccaaaacaggcaaaccactcgaaattcaaaatagtaagtgaactacaatcccttttgtcgtggcttgcctttttcgggtttactactactttgacaagtctatttcggtgtatttttgtac

SEQ ID NO: 2715 - DNA, 1388 bp, Diabrotica virgifera
gaagtcgagaagcagagcaagggtcaaggagagagaattattactatcaagggttcagcagatgccactaaacaagctcataaccttattgccacactaataaaagatcccgacgtcgatattttatccatgttgcccaaatcaaccaaaagtactactatagcaaccacactttgggacaaaactcaaattgggacaaagaagaatgtgggtaaaacagtggtagtaagctcgagcacaacgtctgtaactcacgcaaaggtaacacagacaacggctacggctacaatagcaacaaataggttttcaacgacaactgctgcgaagcctcgcactaccaataccaccgtgcaggtacgggcaacggccccaaggctcgtagcccaagcggaaaagaacgcagctgcacaggcgcagaatcaaagcgtgcgaacctcgatttctcacccaacctctgtatcgagccgactgccgatgacatctaaagtgataacctcatccatcaatcaaacttttgcagccaaactaacggagacgtcatcttctggccaattgatgatcaacaccagtcacagcgtgcctagcaaggtgtcccgggtgctggtcgtgccccaatccatacccggcccagtttcgccccagttaccatcttctagttcagctaatacacaatcttcgccaaataggaacgcaagaccgccgcctacggcgtcagcaccacctaacatgcagcatttccagagcccaggaaaggtggcaccaatgttctctgcgactgctcataataacactgccccacaaatggaaccaatgcctaacaacatcaggagttcgacgcctaacggtgcattacatttaagtaatgcggcagtacctcaacaactagtccaggaagaagcgcccaaccttcaagcgacctcggaatattctttgttctttgcgggcggagatcactggaaccgcagagagcaagaatctcagaaacccgttaatttcgccgccgtcaccggaggttcgaattctcagtcgaccgcccagcataaattcatcgaccaagaaccgcctccgcaggttgatgcttcgaaagcgcccggatatagaggagcggctgtttgttcgccggtgtcttcaaaggcgagcagcaacagcacaacaccgcccaatatatccgccaacaattacaattaccaagaacagaccaaagcgcagaatccattaccacccatcggcagcaacgtcgcccacaacaggcctccggtgtctcaaaacaatcccggggatctttgacgaattgttcaaacacggcggcaacaacattccaacatgctgaacttggccaacgacagtcatctgctgcagtctagctacaaccctatgccgaatttgaa

SEQ ID NO: 2716 - DNA, 882 bp, Diabrotica virgifera
tctcaagataatgtaacatcgaccacaagagagcagaaacgcgcatttatattagttgttgtttagttgtttagtgaagtgttttattagagatcctgacggacactactagctgtaaaaatcattatttatttagtgttatttatgctgtgctgtatataattgtgtttatatacgatattttgacattccctatatatttgctgttccaaaatcctatcaagagagtacaattagccaaaattgaaagggcgacaattgtagaaaaaggtgacaaatacatcacttacaagacgacaaagaagccttatcctacccactatgaaatcgacactgaacacatcgacactatggcaaaactgttggagcatgctgccaaaaaacataccgataaacgttgcttgggaactagagagattttgagagaagaagacgaaaaacaacctaatggcaggatatttaaaaagtacgatctcggtgactacaaatggctatcatttacggaagtgaacaacctagctaccagctttggtaaaggcttacgaaaactgggagctgaacctacacacaacatcatcatattagccgagacccaaacaaaatggatgattgcatcccactctgctttcaagcaaaacttttccctagtcaccatctacgcaacattgggagatgacgctatagcccatgcaatcaacaaaacagaagccgatatagtcattacgagcttcagcttgttgccccagtttaaacacgattagcatatgacagcgaacgtgaagaagcttgtttatatggaagatcagatctagagtctgagtctagaggagaaagatagttttaacagtgaggtacaaatagtaacttttgtcgaagttgcta

SEQ ID NO: 2717 - DNA, 1002 bp, Diabrotica virgifera
gcggttctgcttacatcttttggcaaaaagaggtgtccgattttacatcaaattactttctataattaattactcctgttattaatataccaccagaaaacatatagaggcaagaaaatgcatccagaagaagtaagcagcgtttggttaaacaggagatactatgaggatgccgaaatcgctcattatgaaaacttaacaaaagcagctttaaccccattggctggtgaagtagcaaaagctcgtcagaggttaatcgaaagtagggacacttttacatcaaacgttgattccatagacactggagccataaaatttatggagaagaaaatagttgaatatgaaaaaaccattacatctcttgttacacaattgaaagccttggaactaagagtagctgctttggaaaaaacagacagtcagaccaaacctgtacaccaaatcaacatacagtcagtaccttcagcgaaacctgccgttaatgatgatgacgacgacgacgtcgatctttttggttcagattctgatgaagatgatgaagcagcagccaaagttagagaagatagactcaaagcatatgaagcaaaaaaatcaaaaaaacctgtattgattgccaaatccaatgtcatcttggacgtgaagccttgggatgatgagaccgacatgaaattaatggaacaacatgttagaaaggttgaagctgatggacttttatggggtgctgctaaactagtccctctagcttatggaattcacaaattacaaatctcatgcgttgtagaagatgataaagtttctattgattggttaacagagcagctgctagaaatagaagattttatccaaagtgtcgacattgcagcattcaacaagatctaaaatgtgaaggtctctattatgaaatttatatcgattatgtttaattgatttaataaattaattaattacactcatactcaaaaaaaaaaaaaaaaagaaaaaaaaaaaaagggcggccgctct

SEQ ID NO: 2718 - DNA, 1253 bp, Diabrotica virgifera
ccggcaaaaagaggtgtccgattttacatcaaattactttctataattaattactcctgttattaatataccaccagaaaacatatagaggcaagaaaatgcatccagaagaagtaagcagcgtttggttaaacaggagatactatgaggatgccgaaatcgctcattatgaaaacttaacaaaatcaaacgttgattccatagacactggagccataaaatttatggagaagaaaatagttgaatatgaaaaaaccattacatctcttgttacacaattgaaagccttggaactaagagtagctgctttggaaaaaacagacagtcagaccaaacctgtacaccaaatcaacatacagtcagtaccttcagcgaaacctgccgttaatgatgatgacgacgacgacgtcgatctttttggttcagattctgatgaagatgatgaagcagcagccaaagttagagaagatagactcaaagcatatgaagcaaaaaaatcaaaaaaacctgtattgattgccaaatccaatgtcatcttggacgtgaagccttgggatgatgagaccgacatgaaattaatggaacaacatgttagaaaggttgaagctgatggacttttatggggtgctgctaaactagtccctctagcttatggaattcacaaattacaaatctcatgcgttgtagaagatgataaagtttctattgattggttaacagagcagctgctagaaatagaagattttatccaaagtgtcgacattgcagcattcaacaagatctaaaatgtgaagttctctattatgaaatttatatcgattatgtttaattgatttaataaattaattaattacactcatactcaaaaaaaaaaaaaaagggcggccgctcgcgatctagaactagccttttttttttttttttaaaaaaaaagaaaaccccataaaagttttaaaaaataattaataaagtttttttatgattaaaatttatttttaaaaataaatttatttaattggggggggttaaaaaaaaaaaataaaacttttttttttttttttttaattttaatttaaaaaaatttttttgaatccaaatttttttttgttttaaaaaaaaaaaaattttcctttttggggaaaaacaacgcgggaaattttttttgttggggggggagggtcaaaaactctctaaaaaaaaaaaaaatgcggggccccccccccccggtgggggggatttaaaggggttttttt

SEQ ID NO: 2719 - DNA, 1149 bp, Diabrotica virgifera
  misc_feature (1080)..(1080): n is a, c, g, or t
cttggccttggcagagtgcagagcagaacggtagttagagtgttttaaattgtttttgacaaactctccttttattaatttgtgaacgaaatggcacccaaatataaggtcacctacttcgatattactgctctcggtgaaccaattaggttcctcttaagctatggacaacttgatttcgaagacagacgtcttggtgtagacggcatcgagtggtcttctgttaaaccgaccactcccttcggccaagcaccacttttggaacatgatggaaaagtggcccatcagtcaattgccatcagccgttatctcgctaagcaagtaaaactggtaggaaccaacgattgggaagacttggaaatcgatgctgctgttgataccatcaatgacttacgcgcaaagatcgctgcttaccactatgaaaacgaccctgcagttaaagagacaaagaaaaaaccattgtttgaggacgttctcccattctatcttgaaaagttggaagcacaagtacagaaaaataatggttatttggctactggaaaattgacctgggctgatttgttcttcgtcgctctcttgcaatacttccagtttatgcttggaaaggatttagtggaaaactcaccaaatttgcaaaaacttaaagagaaagtactcgcattacccaacatcaaagcctgggtagaaaaacgtcccgaaactaaattctaaatcgaatttactcgttccttgtgaatttactcgttatggataaaatcaaaagtatttttaaatttgttctaaattatataataaataaatcaaagtgaaaaaaaaaaaaaaagggcggccgctcgcgatctagaactatcattatggacaactgtgaagaccttatcccagaatatcttaactttattaagggagtagtagactctgaagatttacctctaaacatttcaagagaaatgttgcaacaaaataagattcttaaggtcatccgcaaaaatttagttaaaaaatgtctggaactttttgaagagcttactgaggacaaagatggatggaagaaattctatgaacaattctcgaagaactcanattaggaattcacgaagatttcacaaacagagccaaacttgctgacttatttgcgtaccacaccctctg

SEQ ID NO: 2720 - DNA, 2029 bp, Diabrotica virgifera
ctcaacgaggtccgggaagaaccgcccgtaacgggatcggtcttcttttcattcagtacttgattcggccagttctcattttcttggctggtgccacgttgatgtgtgaatattttcaatttagtttcatatatcatttgtaggtttaacaggaaaattcgtcaatatgttccggaccggttttctgctggtattctttttgaatgctgtttttgccgctgaagatatcaaaaccgaagatggagttttggtcctcaccaaagacaatttccaaggagtcctcaacgataatgagttcgtcttagtagaattttatgctccatggtgtggtcactgtaaagccctagcccctgaatatgctaaggctgcccagcaactagaacaacagggatctaacatcaaacttggtaaagtcgatgccacagaagaaggcagtcttgctgagcaattcaacattagaggataccccactctgaaattcttcagaaatggcagtccaattgaatactcaggaggaagacaagccgacgatatcgtcaactggttggcaaagaagacgggccctccagccaaagacttgagctccgttgaagcagctaaagaattcatcgaaggacacaatgtggttgtcgttggtttcttcagtgaacaaaccactagtaatgaagttgccaagaacttcctgaaggttgcttctggtttggacgatattccatttggaatctcagccgatcaagctgtacgtgatgaatttgaagctgccgacaacagcatcgttttgttcaagaagttcgatgaacgtaaagtagcttacgaaggtgacgctgatgaagatgcactcaagaagttcatccaatccaatgccttacctttgttggtagaattcaaccatgaaacggcccaaaagatcttcggtggtgaaattaagagccatttgttattgttcttgaacagagaagacaaagacgtatatgaaaccatttccgaagccgccagatccgtagctaagccattcaaagaagaggttcttttcgtcagcatcgatgccgaacaagaagacaaccaaaggatcatggaattcttcggaatcaaaaagaacactgtaccagcagctcgtctcatcaaattagaagaagatatggccaaatacaaaccagcatctgacgatttgaccgccgataacatcaagaacttcgtccaagacttcttggatggtaaacttaagcaacatctattgaaccaagaattgcctgaagattgggacaaaaaccctgtcaaggtattggttagcagcaatttcgatagtgtcgctcttgacagctcaaaggacgtcctcgtagaattctacgctccatggtgcggtcattgcaagaacctcgcccccatctacgacaaactcggagaacatttcaaggacaacagcgacgttgttatcgccaaaatggactccaccgcaaacgaattagaacacaccaaagttgttaactacccaactatcaaattgtacaccaaaggcagtaacgaagccgttgaatacctcggcccaagaacattcgaaggtctttctaaattcgtagaatctggcggtaaagatgactccgaagactctgctgaagaagatgctgaagatgatgacgcttccaagaaagatgagttgtagagtgtaaaagtgcatttgttagtttaactataaagaactttacttatatttttttagatttgttttgtacagatttttgtgatttttttactattatcgttttttcagttttctcatgattttgttcaggatttagatttatttatattatcggaataggaaataattaactctccatttattggagaatgtatgagactggttgtgttccgtgctgtcattgttgacagttgtaaatcctccgaacatttttttataaagttgataatatattttgtggaattatgtataaataatattaaatgcggctaccactcaccccctcctcaaaaaacaaaaaaaaaaaaggggggccccccgccctctaaa

SEQ ID NO: 2721 - DNA, 3721 bp, Diabrotica virgifera
agtcatttgccagttagttctccttggcagagtgcagagcagaacggtacttgtattgagtgttttaaattgtttttggcaaacttgccttttatcaatttgtgaacgaaatggcacccaaatataagctcacctacttcgatattactgctttcgctgaaccaattaggttcctcctaagctatggccaacttgatttcgaagacagacgttttgctgtagacggtatcgagtggccttctattaaaccgaccactcctttcggccaagtaccacttttggaatatgatggaaaagtggctcatcagtcaattgccatcagccgttatctcgctaagcaagtaaaactggtaggaagcaacgattgggaagacttggaaatcgatgctgctgttgataccatcattgacttacgcacaaagatcgttgcttacggctatgaaaacgacgctgcagtcaaagagtcaaagaaaaaaccattgtttgaggaaattcttccattctatcttgaaaagttagaagcacaagtacagaaaaataatggctatttggctactggaaaattgacctgggctgatttgtacttcgtcgctctcttgcaatacttccagactatgcttgcacagcatctcgccgaaaactcaccaaatttgcaaaacttaaagaaaaagtactcgctttacgtaacattaaaaacgtaaacggaaaaatgaccaaattatttctgtgtattgcagtcttgtgctgtgtgcagtatggatttgctctattaacaccataaactgggcgaacatatcaacggaatacgtatacctcttcaaaggaattgcaagatattaacaggtaccacacaggagcagatagaagaagtaagaaaaggtttaacaggaaaattcgtcaatatgttccggaccggttttctgctggtattctttttgaatgctgtttttgccgctgaagatatcaaaaccgaagatggagttttggtcctcaccagagacaatttccaaggagtcctcaacgataatgagttcgtcttagtagaattttatgctccatggtgtggtcactgtaaagccctatcccctgaatatgctaaggctgcccatcacactataacaacagggatctaaattcaaacttggataccacagaggaacttgctattcaacattcccacgcgtccgcccacgctgagacagcgaacgtcacttgcggaagtgaatttccaaagcagaaaattatttcaaagcggtttttacattgtgacttgtggatattttgtgaaaaaactagtccaaaatgcctgaagaaactcaaagcgcagatgtcgagaccttcgccttccaggctgaaatcgctcagctgatgagtttgatcatcaacacattctactctaataaagaaatcttccttagagagttgatctcaaactcctcagatgccttggataagatccgttaccaatcactcacaaatccatcctgtctcgactctggaaaagatttgcacattaaaattgttccaaacaagagtgaaggaaccttaaccatcattgatactggtattggtatgacgaaagcagatttagttaacaaccttggtacaatcgcaaaatcaggaacaaaggcattcatggaggccctccaagctggagctgatattagtatgattggtcaatttggtgtaggtttctactcagcctacttagttgctgatcgagtagtggttgtatcaaaaaataacgatgatgaacagtacatttgggaatcatctgcaggaggtagcttcacaataagaccagatgttggagaaccattgggacgtggtacaaaaattgttctgtacatcaaagaggatcaaactgaatttttagaagagaataaaattaaggagattgtaaagaaacactcccagttcattggttaccccattaaattgcttgtagaaaaagaaagggaaaaggaactaagtgatgatgaagcagaagaagaaaagaaggaagaagaggaagacaaagataaacctaaaattgaagatgtaggagaggatgaagatgaagataaaaaagatgagaaaaagaaaaagaaaaaaactattaaagaaaagtacactgaagatgaggaactaaacaaaaccaaaccaatctggacaagaaatgctgatgatataacccaagaagaatatggtgaattttacaaatcattgacaaatgattgggaagaccatttagcagtaaaacattttagtgttgagggtcaacttgagtttagagctttattgtttgttcctcgtcgtgtaccttttgatttgtttgaaaacaagaagaagaagaacaacatcaaattatatgtacgcagagttttcattatggacaactgtgaagaccttatcccagaatatcttaactttattaagggagtagtagactctgaagatttacctctaaacatttcaagagaaatgttgcaacaaaataagattcttaaggtcatccgcaaaaatttagttaaaaaatgtctggaactttttgaagagcttactgaggacaaagatggatggaagaaattctatgaacaattctcgaagaacatcaaattaggaattcacgaagattcacaaaacagagccaaacttgctgacttattgcgttaccacacctctgccagtggagatgaagcttgttcactaaaagactatgtcagcagaatgaaggaaaaccaaaaacacatctactatatcactggcgagaacaaagaacaagtagcacattctgcatttgttgaacgtgttaagaagcgtggttttgaagtagtatacatgactgaacccattgatgaatatgtagttcaacaactcaaggaatatgatggtaaaactcttgtctctgtcaccaaggaaggtctcgaattacctgaagatgaagaagagaagaagaaacgtgaagatgataaggccaaatatgaaggtctttgcaaagttatgaagagcatccttgataacaaagttgaaaaggttgtggtatctaaccgtttagtagaatctccatgctgtattgtaacctcacaatatggatggactgctaacatggaacgtatcatgaaagcccaagctctccgtgacacatcaactatgggttacatggcagccaagaaacacctagaaatcaaccctgaccattccatcattgaaaaccttagacagaagacagaagttgataaaaatgataaggctgtgaaagatcttgtcatcttgctcttcgagactgccctccttagctctggttttactttggatgaacctcaagtacacgcatctagaatctacagaatgatcaaacttggtttgggcattgatgaagaagaatctatgcttactgaagaaaccccatctggcgaagctcctgctgccgaggctggtgatggagaagatgcttcccgtatggaagaagtagattaaatgcattcatttaaagagcatgtgttgtaatatgttcaaatgacaatttctctcattccttatttttgtaaataatttatttcttttttatacagagtattactagcatttgaaaggctactggaatagtctggctgtgtagagtactaatgaccaattgtcatcaacaactgtactgattttccgttaataaaccaaataattgattaaaaaaaaaaaaaaagggttgcccgactaaaaaaaaaaaaagggggggggccgg

SEQ ID NO: 2722 - DNA, 1148 bp, Diabrotica virgifera
  misc_feature (968)..(968): n is a, c, g, or t
  misc_feature (1015)..(1015): n is a, c, g, or t
cgacccaagaccctatactgagtcgtgttaatgatcgtgatgagtttgcgatgagttctctgtaaaaaatatattttcaacgaaccgtacgccaacagttcggctcgcataagtgtaccgaccttgggacgtataggatattcgcatttcaatttggacagtgctcccagcgatattgtctgttcgtttcgtctcatcgatattgtgtgacgtgttcctagtttgaatatagtgtatgtttttcgtgaacccaagttttccatgatggcacagtggcccgacgataaatgtattgaacttattgacttatatcacaacaagaggatactctgggatccgaaagaccgtgatcatttccaaaaaagcttaaaagatgacgcatggcgcgagataggtgagactatggatacgccagcagaagactgtaaatggaaaatgataaacctattggcatcttttaggcgcgagaagagaaaggtctccagaggaacctgtggaataggaaagggtagagacgaagcatatgaaagtagatggtttgcgtatgctgccatgcgatttcttgaagatcgggatcctccacgacgaagaaagactacaaaaaaggataatctacacacagaagaacagcgagatgtattagcagacgaaatgcatttagaagaggcagtgcaccaagaagaggagacagcaacatccagttcatctttaatacctcgccctgatccatcaagatcccctcttgcaactgccaacgaagatactccagctgttaagaagcgacttcataagaaggatacttcagactcagaaatgatgagcagtgcctttttgattttaaaaaatgctgcggaaagcctcaaccaggactctactgaactagatgaaatagatgcattatgcaagtatctttctgctaaagtacataagtactctcctgcaacgcagataggcgtgcaacatgctgntatggatgtcatcatgaaagcagatagagggttttttgattaacagntaagactctactctcatcacactttattcatacctttcccactgcagccactataccatctcctttctacatatactgtcatcacacttcatctacatctcccacacagcagaccacggattctactttatat

SEQ ID NO: 2723 - DNA, 878 bp, Diabrotica virgifera
gcccgggtcgatacaagactctatagtgagtcgcattatttaccacacaaagcacgtaaacaataaatgaaaaattccctatgacaatttcagctatacacgaaattgtttggagtcaatatacaacattaaacatgcattaaacattacaagcattaactctttaagctcctcccatttttgtgacgtcagacttgggctgtctggaatgaaaacgcgtttttaaacgtattttaatgtcattaagcttacgtatttaacatgacctataaaagacgtctatatgacgtaatgttcaaacacgtgtatatattcaatcataactgacgtttcctcgacgttatatgacgtcacttggtcgcctgggttgtttttcaagagtttattaatgtgcctattagcagtaatcctcggcaccaggtgctccgggggtagactctgatggcgtatccatgttcaatgatcctaaaaacccaccaagtaacaaaatctgtctcttaacatactgatcttgacatgtttatgcactgaaaatgtaggtatattttacacccacttttctactttagattttttcctgacgtcatcctgagcacaatgcaaaaagttgcaagtctatataggtgctgtatttatatcgatttattttttcctaaatgtactggtctaattaattcgaatatgctatttcaaccctttttgtgcttgtcttatagcataatgttccatataatagcgggacggccgtatatttcgcgaaatttatatggaataaaaaaactaaaaacttggaaacagttcaatatttttaaaaatctatcgaatgacgtaaattacgaccacccgtcggaatctttgaaatcctaaataggaacacc

SEQ ID NO: 2724 - DNA, 1576 bp, Diabrotica virgifera
acgttataggtgaactaaattgtttgaagtcaaaacaaacaagctttttaagctcctcccaattttgtaaagtcgactttaggctgtctgaaatgaaaacgtcttttaaacgcattttaaggtcatttaatcttacgtatttaaaatcacctacaaaagacgtatatatgacgtaatgttcaatcacgtgtatatattcaaccaaaactgacgtttcctcgacgttaaatgacgttacttggttgcttgggatgtaaaggcgtgtaggagaacgaattatggcgtagacgctataatttttagcttaaccacctttatagtgaacctagtattggtagatctatcaaaataaacaggccacttagagagaatgaatgagccgtcgaaacacatttatagccagagaccggatggagtgaggagaagaggcaggcccagagcacggtttaaggaccaggtggaagacacttgcgagtgttaggagtgcgaaattggaaaaccaaggtgaaggataggaaggaatggaagctgattctggaacaggccaagacccaccatgggttgtagagccaattatggtgagaataagaaatgcacataatatactatagttcctatcatttccgagactattcatcatcatcatcaacccgtactcgtccactgctggacatagttctccctcagctctttccatcttcctgttttgtgcggcttgcatccagttgccgacaatacgcttcagatcgtcagcccatctggttggtggtcgtcctctgctccgtagtgcttcttcttgtggcctccactcgacaatacgttttgttcatcggttgtctgacaatctggcgacgtgttctgaccaattccacttgagcgacgcgattctgtcgacagcgtccgttgtttttgttctacgacgtatttcttcgtttgggattcggtccctcagggagacacccaacatctgacgctccgtagccctctgagttatgcgaatcttgttcagtaccttttttgtgagtgttaatgtttccgctccataagtgagtacaggcaatacacactggtcaaagattttccttttcaggcatatgggtaagtccgatttaaatacatagctcactttaccaatcgctaaacgctaggctataaataatcctatgcgacgtgggagctcgcacgtctggttatctcttcccaaccgaatttcatgtcccaagtacttataagatgcagtctgttcaatatccattccatcaacaacaatattacgatttagcaccaaattagtcattatttgcgtcttgttgatattaatctttagtccgacctctaaggaagcgtgatataacttgttcaacattattattgcatcatccatacgattggctataaggacgatgtcatctgcgaatctcaaatgactgagcttctctacatttatattgataccatattcgttcagatctgcctctttaaaagtgtgttctaaaagggttgtgaacagctttggtgagatggtgtctccttgtcgtactcctcgctgcatacagaatttattagtttgttgatc

SEQ ID NO: 2725 - DNA, 304 bp, Diabrotica virgifera
tacctttttagcacatatggtacccatcattcttacactgtggtgtgattgtgctgcttgattaagacgcacttttaatattttcctaccctcctcgcgaggggctgaaaccgttctttggtagaattttttaatacttcgatgttcacatgtcatgaatgttttttcaagttttcggtttcgataagtgtccatgatgtatatatacgttagtattgtatcgtgtatgatcacgatttggtatattgtttgaataagtctcgttttaaatccaggcatccgaatatgaactcttctattgcac

SEQ ID NO: 2726 - DNA, 1371 bp, Diabrotica virgifera
  misc_feature (1295)..(1295): n is a, c, g, or t
ggtttgataggcagatctctggatagtatcggtggaaaccgattgcttggtagaagtattgacccaattgaccacggtttaataggcagatctctggatagtatcggtggaagtcgattgcttggtagaagtattgacccaattgacaacgggctgataggcagaagtatagatccaattgatggaggaagtttaatcggtagatctctggatagtatcggtggcaaccgattgcttggtagaagtattgacccaattgaccacggtttgataggcagatctctggatagtatcggtggaaaccgattgcttggtagaagtattgacccaattgaccacggtttgataggcagatctctggatagtattggtggaaaccgattgcttggtaaaagtattgacccaattgacaacgggctgataggcaggagtatagatccaattgagggaggaagtttgatcggtagatctcttgatagtatcggtggcagccgattgcttggtagaagtattgacccaattgaccacggtttaataggcagatctctggatagtatcggtggaaaccgattgcttggtagaagtattgacccaattgaccacggtttgataggtagatctctggatagtattggtggaaaccgattgcttggtaaaagtattgacccaattgacaacgggctgataggcaggagtatagatccaattgatggaggaagtttgatcggtagatctctggatagtatcggtggaaaccgattgcttggtagaagtattgacccaattgaccacggtttaataggcaaatcactggatagtatcggtggaaaccgattgcttggcagaagtattgacccaattgaccacggtttgataggcagatctctggatagtatcggtggaaaccgattgcttggtagaagtattgacccaattgacaacgggctgataggcaggagtatagatccaattgatggaggaagtttgatcggtagatctcttgatagtatcggtggcaaccgattgcttggtagaagtattgacccaattgaccacggtttgataggcagatctctggatagtatcggtggaaaccgattgcttggcagaagtattgacccaattgaccacggtttgataggcagatctctggatagtattggtggaaaccgattgcttggtaaaagtattgacccaattgacaacgggctgataggcaggagtatagatccaattgatggaggaagtttgatcggtagatctctggatagtatcggtggaaaccgattgcttgngaaaagtattgacccaattgaccacgggttaataggcaaatcactggatagtatcggtggaaaccgattgcttggt

SEQ ID NO: 2727 - DNA, 835 bp, Diabrotica virgifera
gccgtgtaggagtcaagggtcgacgacgcgggttcttggtttagtgttttgatttttgataaatcttttaagaactgtggggtaatgggaagtgataaaaaacgtcgttctcgaagccgagataaagacaagcgtaaacgttcccgatctagaagcaaagaacgttccgatagagagaaaattcgcgattctgatagacacaaaagacatcgctctcgttcaagagaaaaagattaccccagtagtagcaaacatgataaattcgacaaggaaaaatataaaagcgatagagataaatacgacgacaaggacaagaaatataaagatgccaaaaaagaggaggaagaagaactggagaaggttaaggtagaaaccaaaactgaagttaaacaagaaccagcgaagaaggaacctctttcgttggaggaactgctaacaaaaaagaaagcggaagaagcagctaaaagtaaacccgtgtttcttaccaaggaacaaagagctgcagaggcactgaaaagacgccaggaagaaattgctaaagtgaggaaacagcaggacgaggaaaggaaaattgtagaagctgttcaagctggtcgagaagtagaagttaaacgagacgatagggattatagaagaaacagggatagagatagagaggaggagaagcagaaagataaggacaaagagaaggagcaggatgctattaaagagaggtatttagggcttattaagaaaaagaggcgagtgaggcggcttaatgataggaagtttgtgtttgactgggatgctgcagaagatccttcgttggattattacaatttgtataaagagagac

SEQ ID NO: 2728 - DNA, 1549 bp, Diabrotica virgifera
catacacagattcttaacattcatacgtgctcacaatgcgaactctcacggtgtgtattctttcgttattggcgatttttgtgtctggtacaggcctcaaagaagaattcacttggcacaggatcacttacgcttggcccagaggtcaaggcaatggacctcgtaacagggtgcaaaggtacgctcagtacgctggggctgggggtagtagcagtcctataatctacgaggatcccaatttgcccaacagcggatggaatccttcagaaggaatcgattataatcatgttacgaacattcctatgggtgcaaacgtatggaggaacaagctcttcatcacggttcctagaagacgactaggagtgccatctacattgaactatgtgccattggacagtccaagaagacacaacgttccgctgattccctacccagattgggataccaatatatatccagatcccaaaaacagcggtgataattttgtgtcagtatacagagtagctgtggatccctgtgataggttatggtttgtggatactggactggtagaagttcttggaaatgtcagtcgtgtgcggcctaccactttagtaatgatggatttgactactgataaaatcattcgatcattccaaatccctgcagaccaaatccggccaaccagtggtttagctagtgtaaccgtagatgtaactaaagacacctgtgatgatgcctatgcgtatatacctgatttaggaggatatggacttatagtgtacagcctaagggaagacagatcctggagaataactcacaactatttctacttggaacctctagctggagagttcgatatctccggtcaccgttttcaatggaacgacggtatattcagtgttgaactaactaatgttaaaccagatggaaatagagacttgtatttccattccatggcaggaacgcatatgtatcgagtgcctacgaacattgtaaaaaaccacaccttttaagctacgaggtcataccatgggagaggatttccagaatcttggagatcgtggagccggatctcagacctcttccgcagacatccacaaacccagcggtattatgttcctaggtctagtcaaccaaaacgccctaggttgttggaacaccaaaaaacccttgagtacgatttctgtagtacaaaaagatgacgccaagatgatctatccttgtgatgtaaaagtaagcaacgacaaagtctacgtcttgactaacgccatgccagagtttttgtacggagctctgaactatgaccaaattaactttagaatttggtctaacaccataagtaaggcagtagcaggaactcaatgtgcgagcggagacagtgcatccattacatatgctggtcctgccaactatgcccaaggtggatcatacggaggaaataagcaaagaggaccatacaagggatattagtggatttatttatatttaggaatatatgactgtacttttataattgtttgtactttttagatgaaaaagaaaaaaataaaataaacataaggacatc

SEQ ID NO: 2729 - DNA, 1006 bp, Diabrotica virgifera
cacacactgccaaaggttgcttctgttgttggtaaggcgaaggcggtaatgttgtgttagttttatgtgtaacttattatatacgaaacatgaaacataaacttatattcctcttcgtatattttgtattttacaacgacgtatatgctcaagttggcgatagatgtacattcaaaggaaccacaaaaagaggggtttgcaaagaaattactaaatgtccagctgcagaggcgcaagccaagcaaggaactgatgatgtaactttatgtggttttgcaaatgatttgattactgcgattgtttgttgcgaagtgactgtggaaccaaatgataatctcctccctgccgactttgatacaaatggagaaacaagtccaccaggaaaaatgactgaaagaaagtgtcaagaatatagtaaagcaattacatctgaagtacaagttttatccttggtctcagatgcgacacctatgtcttaccgtactcctaaatgtgattataacactgtaccattaatagtgggtggtacacccgcagaggcaggggaatttccatttatggtagcaatcggattcaatacaacttctgatcgatggagatgtggaggaacattgataagcactagattcgttgttactgctgcacattgttgttatacaagagatgctgggaaaccgagtgtagtacgtgttggagaactcgatttagcatcagatcaggatggttcggtgtatgcggactatttaatttcacgagtaattgtacatccaggatattcagctccatataaatataatgatatcgctcttctagaaacacaacagccagtagtttttacaaattttacacgacctgcttgtctcaatcttaaccataacgtagctcaaagtcaagctatcgctacaggatggggaaaaactgattttgctggtgatgctagtgatagactattaaaagtcactttaaatctatacgacaatcagagatgtcagagaacatttccccc

SEQ ID NO: 2730 - DNA, 888 bp, Diabrotica virgifera
cacaaacatggctttcaaatttttggcatttgccgcttttgtctcagtcgctcgtgcaggagtcattggagaagcttactcctcaccactcgcctacgctgcaccagcagtagctaaagtagcctactcaccagccccagcagtctcatactccagtatctcagcacccgtagcatacgccgcagcaccagctattgccaagatagctgctccagctgtatcatatgccgctccagctgtatcatacggcgctccagctctttcatacgccgcaccagtcgctaaagtagcctactcatcagccccagcagtctcatactccagtgtatctgcaccagtagcctacgccgctgccccagccatcgccaaagtagctgctccagtatcatacgccgctccagctctctcatatgccgcaccagtcgctaaagtagcttactcatcagccccagctgtctcttactccagtgtatccgcaccagtagcctacggcgctgccccagcttacgccaaagtagctgctccagtatcgtacgcagccccagctgtttcctacgccgctccagctctctcctatgccgccccagcccttaaagtagctgccccagtagcttacgccactcccgttgccaaagcagtttacgccgaaccatcagcaccagctcactacgattttggatatgccgtaagcgacccccataccggagacagcaaaagccaacaagaatcccgtcgtggtgatgttgtccaaggcagctactccctcatcgattccgatggtacaaaacgcaccgttgactacaccgctgacccacacaatggtttcaatgctgtcgtacacagggaacccccttggtgtcgctgtcaaagctgtagctgctcccagtg

SEQ ID NO: 2731 - DNA, 899 bp, Diabrotica virgifera
gtcaaacatggcattcaaattagttgctttcgccgcattggtagcagtagctcgtgctggtgtcatcggagaagcctactctgcaccacttgcctatgcagctccagcagtagctaaggtagcctactcagccgctccagctgtatcatactcaagtgtgtcatcacctgtagcttacgcagcaccagctgttgctaaattagctgcacctgtatcttatgctgcaccagctttatcttacgctgcaccagtcgctaaagttgcctactcatcagctccagctgtctcttactccagtgtatccgcaccagtagcctacgccgctgccccagcctacgccaaagtagctgctccagtatcgtacgcagctccagctgtttcctacgccgctccagctctctcctatgccgccccagcccttaaagtagctgccccagtagcttatgccgctcctgttgccaaagcagtttacgccgaaccatcagcaccagctaactacgattttggatatgccgtaaacgacccccacaccggagatagcaaaagccaacaagaatctcgccacggtgatgttgtacatggaagctattcccttattgaagccgatggcagcaaacgtaccgtagactacaccgctgatgaacacaatggttttaatgcagttgtacacaaggaaccagccacagttgcggttaaagcagtagcaccagttgtagccaaaattgccgcccccatcgcctacgctcaccagccctcaaagtagcaactccagttgcctatgctcattctgctcccctaggatatgctgcaccctcatactatcactaatttagttactaatagaaaaatattttgaaatatttatttcctaaaaaataaattaaaaattttttttaatg

SEQ ID NO: 2732 - DNA, 916 bp, Diabrotica virgifera
ccgccctttttttttttttttcttttctgacaactcaataaataggacttatgaagattattaattaaattattctttaagaaatagtagtaaaggctgtaattatagctatgcacaatttaaacccagacggtccttatgtcaatgtaaacggagccactaatacggagagagtgtgtattctagatgctggtgcacagtatggcaaagttattgatagaaaagttagagaattatgtgtggagtctcagatcatacccttggacaccccagccttcaacataaaagaagctggttacaaagctatcattatttctggaggacccaattctgtgtatgctgaagatgctcctagatacgatgcagatattttcagaataggtttacctgtgctgggaatttgttatggaatgcagatgatgaacaaagaatttggggggacagtcattagaaaagaaacgagagaagatggaatttataatatcgaagttaattcaaaatgtttgttgttcaagggtctcgacaaaattcagcctgtactactaactcatggagatgcaatagataaaatagccgaaaattttaaaccgattgcacaaagttcgtcattttgcgccggtatctgcaacgaaaagcttcaattgtatggcgttcaatttcatccggaagtagatctaactgccaatggtaaaacgatgttaaaaaattttctgttcgatattgccggtttgaccggaaactatacgatggatggtcgtgaatcagaatgtgtgagatacataaaggaaactgtaggtaacaataaagtactcttattgcttagcggaggagttgatagtaccgtgtgcgccgctttattgcacaaagccttaaatcccgctcagattatagctatacacatagataatggttttat

SEQ ID NO: 2733 - DNA, 1354 bp, Diabrotica virgifera
  misc_feature (1296)..(1296): n is a, c, g, or t
ggagaaggattcattgcgaaagattaaattagaattatatgtggcgcttattttattattatttaaaaggctgtaattatagctatgcacaatttaaacccagacggtccttatgtcaatgtaaacggagccactaatacggagagagtgtgtattctagatgctggtgcacagtatggcaaagttattgatagaaaagttagagaattatgtgtggagtctcagatcatacccttggacaccccagccttcaacataaaagaagctggttacaaagctatcattatttctggaggacccaattctgtgtatgctgaagatgctcctagatacgatgcagatattttcagaataggtttacctgtgctgggaatttgttatggaatgcagatgatgaacaaagaatttggggggacagtcattagaaaagaaacgagagaagatggaatttataatatcgaagttaattcaaaatgtttgttgttcaagggtctcgacaaaattcagcctgtactactaactcatggagatgcaatagataaaatagccgaaaattttaaaccgattgcacaaagttcgtcattttgcgccggtatctgcaacgaaaagcttcaattgtatggcgttcaatttcatccggaagtagatctaactgccaatggtaaaacgatgttaaaaaattttctgttcgatattgccggtttgaccggaaactatacgatggatggtcgtgaatcagaatgtgtgagatacataaaggaaactgtaggtaacaataaagtactcttattgcttagcggaggagttgatagtaccgtgtgcgccgctttattgcacaaagccttaaatcccgctcagattatagctatacacatagataatggttttatgcggaaaaacgaaagtagcaaagttcacaactccttacttaaaataggactcgatgtaaaagtaatcaaagcagcttcgacttttatggaaggtacaacgataatcccagtagacaaacaagaaagcagtagaacaatgataacgaaaatgctgtgccacacgacgaatcccgaagaaaaacgaaaaatcatcggcgacattttcgtcaaaatcgccgacgaaatagtcgccgatcttaatctcaaagctgatgaggttttcttagctcaaggtactctaaggccggatctaatagaatcggcttctaagttagtttcatcgaaagccgatacgataaagacacatcacaatgattctgaacttattagaaaacttagaaacgaaggaagagtggtagaacctctncaagatttccataaagacgaagttaggtccatcggtagggatttgggtttacctcccg

SEQ ID NO: 2734 - DNA, 824 bp, Diabrotica virgifera
  misc_feature (56)..(56): n is a, c, g, or t
ggaaagtttttgatggtgttagtagtataatatgttcacgtcacaaacagtgtatntaagatcactagaataaattaaaatcctataatttttcttttccacaaattttattactttgcaaaaaaagtaaaagatgctaatgagtaaattatataaaaacgatatttttcaacatatttgttgcaaggctagtctataaccttaaaatgtaaagtcacaggaatgagtgtttgctcatcaaagtgtcggaatgaaagtcataagttacagaacccattggatgtaccatttttacctttacagaaaaaggggttcatgggttttcttacaaaagcagtttttaaagcgtgaccagtactgtttgaccctgggacctcttactaccttatacatatttagtatcattcattatcataatataacctatatagagactaatgacgccaaaaataacttacactttcaaatttacaagtatataagaacctgaagtgatatgtgcttattaaatatttaagtatcattttgtgcattttactcattatatattacactttattatgaatcattacttaattaaatcatacggttaccacacaatgattaggtttttacaaagcttttgaaaagctgtactgttctgtcaattgtgtgatagaaagctttaagtatcactcactttgtgtctgtgaatattgttttaaataatgcattacttttttgttatgtaaatatgaattaaaataatttaaaagtattattatattgtatattttcagttcatacatttgaaggttgtttttcgagtagacacattcccttgt

SEQ ID NO: 2735 - DNA, 1940 bp, Diabrotica virgifera
atgatttgcaggggtgtgtggtgtttgatttggtgaaagaaaaatgattttctacttaacgttgacgactttgttaatttccacagcactaggtgctggggaattttcagtgctgcatcatgctccaagtcttacctttaggggccatgatgcccttaaagaaagcactttaaaggatgtttacgctgcagcccttggtttttccactgaacacttctcaaactggaagggcatgttcctgtcagacccttttggagtggcccaggctatagtaactgtgtatgtggatggggtatctgatatagaccaacaaaagggccaccactttcctcttaagactgacataggcgaatctaaggtctacagaagtattgaaagaagaatcgaagaacattatcctaatgaagatactaatttagtcagggttcgtctagctaatggattagaagatatccacaagtacaaaatctttgaagacatcgcatctggagactcaaaacaactcaaccataagtccttgaaattggatgttgatgaagacagaaaattcatcaaagaaattacaattttaaatgaaattgcccaaagaatcgaagaaggtgaaatcaagagagataacatccctgatttatactggttcgaagtttcgtctcttcatgcagtttcagacttgtacggagagaattctacacaagtcttggaagcgaaacaacttcttaacgaatgtattttaagacttaactctgctttcaataaactttataacggatatgtccttgtcactgttgtaacaagtgatgccagccacactaggagaggcagaagcattcttgctgctgatgaaccaactgatgataaaaccaaatacaacttggcaagttactacagcaaggactaccccgtcatctttaatctcatcttgtggtttggggtagtgatgttattttccctcatcgctatctgcatggctattggtactatggatccgggccgtgattcaatcatttaccgtatgaccagcaccagaatgaagaaagacaattaagtccactttgtttttcaatgttcagttaggagctaaaatccaagtttagtacagtcatatatatgagtgttttctttttgtcatcaatacaaagcagtttttaaaggacatgataaatagctgaatgttgaaaatatatttcttagatgtggaaagtttttgatggtgttagtagtataatatgttcacgtcacaacagtgtatttaagatcactagaataaattaaaatcctataatttttcttttccacaaattttattactttgcaaaaaaagtaaaagatgctaatgagtaaattatataaaaacgatatttttcaacatatttgttgcaaggctagtctataaccttaaaatgtaaagtcacaggaatgagtgtttgctcatcaaagtgtcggaatgaaagtcataagttacagaaccattggatgtaccatttttacctttacagaaaaaggggttcatgggttttctttacaaagcagtttttaaagcgtgaccagtactgcttgaccctgggacctcttactaccttatacatatttaatatcattcattatcataatataacctatataagagactattgacgcccaaaataactttacactttccaaatttacaagtatttaagaaacctggaatggatatggggcttatttaaatatttaaagtaatcatttttgtgccatttttactccttatatatttacccttttttttatgaattctttatcttttattaaattcattacgggttaccaccagaaatgattttagggttttttacattgcttttttgaaaagcttggactggttttggttaaatttggggggataaaaaaagtttttaggcataccctccctttttgtggcctgggaaataatttttttt

SEQ ID NO: 2736 - DNA, 958 bp, Diabrotica virgifera
gaagaacagtatgcgcagtatgtacaacagaaattgaacgagaagattgacaaacttcctgtatttgaaaaaccaaaatccaaagataaagcttctgcgccaaaattcatcaagaagttgaagcctattataaccccagatggttacactgtccaattcgaatgcaaagtagaaggattccctcgtccccaaattacgtggttcagacaaactcacataatcaaaacttccaaagatttccaaatctactacgatgaagataacgtcgctacccttattataagggaagtattcccagaagatgctggaactttcacttgcgttgctaaaaactcagcaggattcgcctccagtacaacagaactcatagtagaaggtccgttgtcatctcatggatccgaattgacttccatttcaaggaagagtctatcaagaacatcttccttggctgatatattagaaggtataccaccaacattcgctaagaagcctctaccacagtgtgttcctgaagaaacagacgtcgtagttgaaagtacattagtaggagtaccacaacctgaaataaaatggttctgtaatggtagacgtgtaactgaaaacgtcagtattgtgtcaacttctgagctatatacttacaaaaccactctaaaaatcaagaaaatcaagaagactcaggaaggcaagtttaagatagtcgccaggaacagggaaggagaagcctcagtaacatttactctgaaagtaattacttcagagaaagaagcacctgaggtcttatcacctctagaatctattaccgtaaggaaaggagaaccagttacactttccactactatatttggaaacccggaacctactatcgaatggttgaaggatggtaaacctttaaccagaccaaaattcaaaaaagacggaaacacatacactttaactaatcccaagacatctacagatg

SEQ ID NO: 2737 - DNA, 1484 bp, Diabrotica virgifera
  misc_feature (1423)..(1424): n is a, c, g, or t
  misc_feature (1440)..(1440): n is a, c, g, or t
aaaaaatccggttttatttctaatttagtttacactctttattatagaactatttaggattaatggatattaagtattaagggatacaatggcctcttctcaagatgcctggtatctgtctcttctaggcttagccgaatattttaggacttcgagtccccccatgataaaaacatgtattcagtgtctccaagctgtttttaattttaaaccacctcagagagtcgaagcaagaacccatttgcaactcggaaatatccttttaactcatacaaagaacatagacctagctaagaactatttggagcaagcatggctgctttctcaagcaattaattcatttgatgatgtcaaatttgaagctgctagcgttttggctgaattatatgaacaacaggatcagatttcattatccaagccaatcttaagaaaagccattgagttgtctcaacataatgtgtactggcattgtagactaatatttcaacttgcgcaaatccacgcaactgagaaggattacactttagccagcagtttattgggcgttggagtagactatgctcatatttcaaatgcttcatacacaagagttctgtttctcttaagtaaaggaatgttactactaatagataaaaagttacaagaagtccaacaggtattaaaccaagcaggacatttaatagaaacttggacaggggctgtgtaccagaaggaatatgttaaagtctactatttagtgttacaggtctgtctttacttaatggctggacaagtgaaaagtgttaaaccttgtctaaaacaattacagcagagtattcaaactataatggctactgatgacgtatttatgggacctagtgcaggagacatgtttttgtggatgccgaaagaacatttatatgttcttgtttatttggttactgtgatgcacagcatgcaagcaggatacatggaaaaagcccagaaatacactgacaaagcgttaatgcagatcgaaaaactaaaaattgtagataacaagccaattctatcagtatttcaattgatgctcctggaacatataattatgtgcagattggtgatgggcaataaaacacaagccctacaagaaatatcgtccgcagcaactttgtgtaaacaatgtcccaaattattagaaactcacggcccacagttacacacattgttgggtctttattccatgagtatgaactgtatggaagcagccgaggctcaatttattgctgctttaaatacatctagagagagggaattatggacttttgccaacttaaaccttgctatcgtatacttgagaggtaaaagggaagcagatttcaacgcgttacacgaaagaatcaacccagaaagtttaccgtcccattcgcacagtctcagagcagctgcctattatgtacaaggnnctgcagcattcttccnaggggacgtacacgaagcgaagagatatctgcgagaaaccctga

SEQ ID NO: 2738 - DNA, 780 bp, Diabrotica virgifera
atcataaacagatttatcaatagcgaaaatgtttaaagttacgtcacttgtactgatcatctcaattcttgctccttttgcaattgcaggacaggattcagctgttgaatggagaccttataatggagtaccagatgaccatgcaataataattcaagttcaaactgaatatagcccagctgtttatattggcctagcacacgtgattgataatgcagcgcagtctgaagcttatcttcctgtaaatatagttgaaggcttcaactatgcaaacgtaactttaaatgataaaaactatatggctgacaatcttcagattctatgtttcaaaaaccctgatgcattgggatggcaatatacaaaagcagcaaactttgatgacttattgaatgattctaaaattgctcccatagtagctggttgggaggcacattcagtagtatacaatgcaacggtatatatgggagtgggttacattccagctttgggaggcaacaatgtaggaaaagtatatcacgggcttccacaaacacaaaacagaagggatggtagtttatacatagataggtcaggtgtgtctgctgaatattatcttgctggtggtagtttcaatgtgccagtttattataaataaatgcaatgtaaagcaattctgaattaaattactttataggtagtcttagttctagatcgcttgaccgtgctaaggtagcataatcattagtttttttattgaaagctggaatgaagggttggatgactctaaagctgtctttattt

SEQ ID NO: 2739 - DNA, 412 bp, Diabrotica virgifera
agaattgatccaaattgtcacacttacagtcaaaatatcacaactttaaaaacagatgaaatggttcccgaagtgaaaaaaggaattcttgcacttgacgatgatcctctagcagccttagctactgctgccttggctgaaaataattcccatgatcctgaagtgcctcttaaagacacttggtatactgtcggcttcattcgagggaatagttgtgatgtaaagagttatttcttgttaaatgaagacactgagaatctgaccttagacactttgccttctactgtaaattaccccgcgggattcaatcttgaaccgggcactgcatacaagttcagagtcgcagctatcaattcattaggtcgaagtgattggagtgaggtatcagcgtttaaaacttgtctaccgggct

SEQ ID NO: 2740 - DNA, 1236 bp, Diabrotica virgifera
  misc_feature (1093)..(1093): n is a, c, g, or t
  misc_feature (1177)..(1177): n is a, c, g, or t
  misc_feature (1186)..(1186): n is a, c, g, or t
  misc_feature (1218)..(1218): n is a, c, g, or t
accacgcgtccgcccacgcgtccggttaaaacaagaagcaatatatcaaaagtggctggacattgagaaaattggtatatccttccttcctaatatgggcgaccagacaacgcaagatagatcatggaaggataaaagcatagacctgcttgaaaaaaatagaggcttggtcgtcctatttttctgtttgccagccagctttattttcgatctgctacttaatctacgcaagcagatataccgctatctgttcagtggtgaccaagaccacgacaagggtaatggtgcagttcaacaacaggtgcagcaatggaacaaactacccaagcaagatagaaaattactatgtacctcgagaccaaactggcagagcttatcgctaactttcttcaggaaggacctgtgtcatcaagttaacgtagatctttacaatgtattggaattagacgagaaaaatttgacggttaaggtggaaccgatgatgagtgtaggcgagattactaaatatctcgtaccaaaagggtacaccctagctgtaactttggaaatagcagatgcaactgttggtggacttgccatgggcacaggaatgacaacccactctcacaaagttggtttataccatgaaaatatcgtctcttatgatgtagtgttaggagatggtagtctagtaacagcttctagtgaagaacatgaagatctgtataaatgccttccttggtcacacggaagcttagggttcctagtagctcttactcttaagattgttaaaatcaaaccctatataaaaatgagttacattcccgtaaagggagaggataattactgtgatatgattagactggtatctggtgataacggagctgattaccccgttgcagattatgtagaaactactatatttagtcgcaatgaagctgttataatgacaggagattactccgattatgaccccaatttgccaattaatacagttacgagttggtacaaaccatggttttacaaatacgtagagtcttttctcaaaaaaggaaagcacaccgaactgatccctcttagagagtatttgttacgtcacaacagagcaatattnttgggtggtagaatctatgatacctttcggaaataatcctctgttcagggtggtatttggttggcttttacgcctaaccagctntcttgaaanttacacgacaccggggataagaaaattcacgnttatgaagcaagtattcc

SEQ ID NO: 2741 - DNA, 532 bp, Diabrotica virgifera
agttttcaatgctattacaagtttcttttgtataattttataaatattgttaatcgttaacatagtcctgtttacaaaatgtttcctacaagaagtgaatacgatagggggagtcaataccttttcacccgaaggaagattatttcaagtagaatatgctatagaagctattaagttaggatctaccgctattggaatatgcaccagtggtggagtagtgcttgctgtagaaaaacgcattacttcccccttaatggaacctactacgattgagaaaattgtagaagttgacaaacatattggatgtgcggtttcaggacttatggcagattcaaggactatgatagatagagctcgtgtggaatgtcagaatcattggtttgtctacaatgaaaatataagtgtagaatcctgtgcacaaggtgtatcaaatttggctattcagttcggagattctgatgaagatggtgcagccatgtctaaacccttttggagtagcaatttggtttgctggtatagatgaaaaaggacc

SEQ ID NO: 2742 - DNA, 1347 bp, Diabrotica virgifera
agcgttgagcttttgccagtgttgttagtgagctccaatgacttttataaaaaatacaagttaaaatgaatcataataataatatgttacaattgtgtagactgtgtttagttaaggacgaagttaatataccaatttttgaggaacaaggtgatattaggcaaatattcctgaaaattagttcgtgtctaccggtgaaggtttcccgagatgaccaactgcctaaaaaaatatgtgatggatgttcctataagttagatatgttgtatgaattttggaatactagtgcgaatgcagagaaacaattgttaacatggttgggagaggcgggcatgacatctcagatgacagatggaaccatttcagctgtagcacaacaaatcaagccagcagatgcatttgtaaaacaagagacaatagacccgccagatatccttaaggatgatgatgatgaggatgaagaggataaagactatatgaaacaggaagagagctcgaataatgttgaagagcctcctccaaaaagggcgaggcggacagctgcagttaaagctgccatcgccttggaccagaatagtgatgacgacgatgattcaggagagccaatgactaaggttgaagatgacaccgacgatagtgataatgacgatggacctccgttcgttgatgtaccatcaactagtgcagatgatcaacctggaccctcgggcgttggcaaagatggagtagaagcaccgtgagtacttgttttatttcacaccaaattgtaccttttacctgggtgtacgtcacacggtgctggttctgtcaatatttttggttgttttagtttttttcgatgatagtttcgcgaagaatttacgattttattagaattatttctcaaaagaattttgctgcgttattaatttgagatagatatttattttatcagtttttcgtgtaatgatttatcaattttgtcggtcagttatcacttttgaagaaaatgaattatttaatgataggaagtgtttaggtctagggatggtatttttttatttgatgtggcaaaaccagtagttttttttgttttcatgttttttttattgcagtcatttttcaattgtttatgtataaagaaaagtacatccaggtaacctttttataccatcagcaaaaggctaaaaatggaattgccttgaaaccctttaaaaaagttccttccttcctcctttttccgtgggggaattttttgggaattaaatttggggaaatatggtttttgaattaaaaaaggggtggggggatttaaatttttgcataaaaaaggagaagtgaatttttcgggctcacgtccctttctcc

SEQ ID NO: 2743 - DNA, 1423 bp, Diabrotica virgifera
acccacgcgtccgcccacgcgtccgcccacgcgtccgcaagcgttgagcttttgccagtgttgttagtgagctccaatgacttttataaaaaatacaagttaaaatgaatcataataataatatgttacaattgtgtagactgtgtttagttaaggacgaagttaatataccaatttttgaggaacaaggtgatattaggcaaatattcctgaaaattagttcgtgtctaccggtgaaggtttcccgagatgaccaactgcctaaaaaaatatgtgatggatgttcctataagttagatatgttgtatgaattttggaatactagtgcgaatgcagagaaacaattgttaacatggttgggagaggcgggcatgacatctcagatgacagatggaaccatttcagctgtagcacaacaaatcaagccagcagatgcatttgtaaaacaagagacaatagacccgccagatatccttaaggatgacgatgatgaggatgaagaggataaagactatatgaaacaggaagagagctcgaataatgttgaagagcctcctccaaaaagggcgaggcggacagctgcagttaaagctgccatcgccttggaccagaatagtgatgacgatgatgattcaggagagccaatgactaaggttgaagatgacaccgacgatagtgataatgacgatggacctccgttcgttgatgtaccatcaactagtgcagatgatcaacctggaccctcgggcgttggcaaagatggagtagaagcaccgatactaaacactccaacttttttgttcgacacgttatcgtcttccaagagtgccagccttcaaaatcttcaagccttgcctcgattactacgtgtcaaaggagcacccaagtattatattattttaccaaaggactctgtatctgcggctgtgccattacagtcccaactggtgacatcaaaaactgctccacgtgcacgtaaagtagaaccatcacaaaatcaactattggtaaaaacaaagtgtccttcatcggtatttaaagtaatcccgaaacatatgatgccatcaattactgttggatctggatctccaactccactgaaagtaatcgcatccaaagatatactaaaacaaccgacaattttgtcaaatgtacgtccaaaacccaaagtcgtaaccaaaagtagatatgcttcgtctacatatttgaatcctttcgactatactccttacataaaaaatactgtatcgtcctcccgcagacaaaaaatagagaaaaatttaacgcaggcaatggtgttcccatgggattgtaaaatttgcaccaaagtattccatgacaaagaacttcttatggagcactacgacatgcacaagaatggcacagatgagcttggtgatatcgacgaaaataacgatgcata

SEQ ID NO: 2744 - DNA, 2021 bp, Diabrotica virgifera
caaatggaatactcttaccatcattgaggcctatgcttccattgctagatctgcatggagttagaagactggattttcacatgtctgtagtagaggagctaagggaaaaactgataaaccatattaatgagattggcaagcaagaaggtaaagaacgtgatcacaaactgaaagaactattagtgaaaagttttcctgtaataagggttaaagctatgagacccatcgttatggctattttgaaaaatattcctcagattgaggaccactatttaaaagtcttagttagggatagagaactatatttagatacagatacagaagacagatatggaaggacaatcagtctctttttggagatgaagtatcacctttactcagccaatacattagtgagaaggaaaatgtactatttgatcattcaaatttagcaacgcagttttttggaccttcaccaaaggtaagaagacaaggagaagtcgtccaaaaactagcccacatgataggtaacagcgtcaaactgtacgatatggtacttcaatttttaagaactctctttttaagaactcgcattgtccattattgcacactacgagccgaacttcttatggcacttcacgatctcgaagttcaagatatcatttctatagacccttgccataagtttacttggtgtctggacgcatgcatcagagagaaaaacgttgacattaaaagatcgagagagttacaaggttttttggacaatgtgaaacgagggcaggagcaagtgcttggcgatctatcaatgacactatgcgatccttacgctattaattttttagctacttctgctatcaagatcttgcaacatctaatacatatggaaggaatggctagagataatacaattttgattcttcttctgcgaatgttagccttaggtttaagcgcttgggtaatgatagactcgcaagattttaaagaacccaaattagacgctcaagtggtgaccaaatttcttccagcgttaatgtctctaatggttgacgatcaagtgcgacagctgagcggcaaattaccccacgacgaacgtgaagctgctatcaccgtcatcgaacattctggacctttgcccgacgcggtagaggcatatttgcaagacagtactgtggctagtattcttgccatgtattacactttgcatgctgcgaggctaaaagatagagtgggactattgaggatactgactgtcttggctaattgtaaagatgacagggcgtttgaggatccatttttacattcttttgtgtgcttactcattcacaactcggatgaattcaagcggaagatttttgtactgctcttttcgacgaatttttcttcgctggtctctctagagacaacgtaactaggcaccttcttaaacttttatggtacgttcatcaaaaattaccgacgagtagattacattctctaatgaaagccctacagccaactcatcaacacagtgaaaaggttcatctgctgtacaaactgctccaagacaagatagtttcgcaagaagagactgtgatacctcctgaaatggatattgatattaattcaccgttaatgagtgtgccgactcctgccccctatcatcatacattgtaaaggttatgaagaggatagaggacaagaaaagaaaggaagaaaagaaatgtacaaatcatacataaaaaaacacaaccctttgctatagtttcaaagtttcttttccgaccagtcaaatattgcaaatcatttaacaaaatatgtgattctcattagtttgacggatttcgaaaatcaaattttgacttatgttttgacaaaataatgttgcatgtttcaagccacgacccactggagagaattatttcttttaaatgaaaaaatttctatatattctttttatatattagatatcatgttttcaataacaaaccttattctgtgattgtacaacaaaagttgtgtgataaatgatgaaaaaaattgatccgaaaaaaaaaaggaga

SEQ ID NO: 2745 - DNA, 1338 bp, Diabrotica virgifera
gttccagaggagtgcagaatgttttattagtgaagcctttaaacaggttttttgtgtgaataaaaccggtgtatattattgtgaataaatgtgtcaaatataggatatatacctgaaacagattaactgcacttgtttaataaaaggcactactacttactaacacaagatgtccgtattgggaatggtatcagccgtagcgggctttgtcaaagtccgctacttggttgataaagctctaatcgacaatatggtgtttagagcccactatagagtcacgtcggccatattgtttttatgctgtatcatcgttactgcgaataatctaattggtgaccccattcagtgcatcaacgacaggggtgttccaggtcatgtaataaatacgttttgctggataacgcatacttttacgttaccacatgaacaaggaaaacgcgtcgggacagaagttgctcatcctggtcttggtaacgaaaatcaggataagagataccacagctactaccaatgggttccattcgttttattcttccagggcgtcctcttttacatccctcattggttgtggaaaaattgggaacaaggaaaaattcgtatgatcaccgaaggtatgagaggatcgatggtcggagttggggaaaaggcagagagagaacatagacagaatagactcgtacaatatcttatcgaaacgatgcacatgcacacttcctatgcattcggatactttatttgtgaagctctaaacttcgttaatgtgatggtaaacatattcatgactgacaaattcctcggtggagcgttcctaacctacggcactgacgtagtttccttttcgaacatgaatcaagaaaatcgcacggatcccatggtagccatctttccaagggtaacaaaatgtacattccacaaattcggtccttcaggatcaattcagaagcatgacgccctctgcgtgttagccttgaacattctcaacgagaagatttacattttcctatggttctggtttattattttagctatactgtccggtttggctattgtgtattcggcagctgttgtattactacctagtacaagagaaacgattttgaagaggagattcagattcaaggtacccaatgctgttgagactattgtcagaaaaacacaggttggtgatttccttttgattcacttactgggacaaaacacaaaccaattggtatttggcgaaattttggacgaattcgtaagaagactgaatttcggtagtaacagcaacttaccgtctgctcccagcacgttagaactgagtccaatgtatccagaaatagttaagtacaaggagac

SEQ ID NO: 2746 - DNA, 1264 bp, Diabrotica virgifera
gacaattaaccatgctgttcttgttttctttcgtgaatttttaaaaaagttaaaaatgagtaaattgtgacttaacttactgcagaaatcgttaaatggttacaactgatcgtatgtatttttatgtagactgttaaattacaaatatggaaggaaaacaacaaacagatatacatctcaaggcgatgctgagcaatccctccaggtttactccagctgttccagttcctgactggaatacaccatctacttctacaaatcctacaacaccctcacaagtacctcttataaaaccaaatttatgccttatgacagtagcaatgcctggttcagcagtaggtgaaccacacacaaacataatgttacagaattgtctatctactgtagatcttcaagttaatcttgacttggaaacaatcaatgctagaacaagaaattctgaatttaatccttcgaggtttcatggagttattatgagattaagagaaccaagaaccactgcccttattttcagatcaggaaaaattgtctgtacaggagccagaaatgagtatgatggattgttagcatcaaagaaatttgccagaatcatacaaaaattaggatataatatcaaattttgtaatttcaaaatacaaaatttagtagctacctgtgacctgaggtttcctattaaactggagaatttaaatatgatgcatggacaatttagcagttacgaaccggagctgttccctggactagtatacagaatgattaaacccaggctggtgattttaatttttgttaatggtaaagtagtgttcactggcgcaaaatcaagagaggacatcaaagaagctttaaataatatatatccaattttaagaagtttcagaaagaattaaagaaaataattggaaattgtcacatcacacctttgtaaaattaggattatctacagtcaaatttaaagcagctctgaatagacttatacaccagtcagaaacatattgtaaattacttcatgaataattgtaatgatttcagaatgtctgtaatcagcagttgaggtatattggacccccattctttattttggtttgagttaaacaaaactccgaatttttattaattaaaacccgccttttttatattcctgattttaaaattttaaaaaataactgtcaaatggtttcaaactggactaactccgtggaaaatattcttttctgttggccgagaaatcttttattttttcaaaaatcctttcttttatttttaa

SEQ ID NO: 2747 - DNA, 430 bp, Diabrotica virgifera
gcgggtcgacgcaagcgtccactgaacaggttctaatgtactttttcgtacatcgaaagcaacaggcgatggctgttgccaaatttccgcattgtgcaaatgataatttttcaaacaatgtatctttagcatttttaaacgctcatgagagcgtaacacaggcggttcctttagtacctaatatgattaatattggtggatttcatatcgatccccccaaagaattaccagaagatttaaaagagatgttagatggtgccaaggaaggtgtaatctacttgagtttgggttctaatatcaaaagtactgatataaaaccagaaatcaagcaggctcttattagatccttaggaaaactaaagcaaaaggtactgtggaaatacgaagatgaagattttaaaacaccgaaaaatgtggagattagaaaatg

SEQ ID NO: 2748 - DNA, 441 bp, Diabrotica virgifera
acaatcttcagtaaatgggaaacaacgagagaaagagacacgcgtccggacgacttatttcaatttaaatctttgttttttatttgttaattcttcttcttcttcctctttataagcaattctgcttgttcactgtgtaattgttaattatgcgcaaaaaaggtgatttttggaatttgttttaaaaattgtttaaacaatttgtgcccaaaaacttcgcctgactcccttcagatttgattaaagggcatattttttaacatgaatccgcaaagacaccgaaacatttttcttaagggaaaactcctcataacctggacaagtagtagaactgtagtaatgtctttcgcttctcttgcttaaatttttttaagtttctgtatcataaaaaaactttcttaatataaacctcaattagtaaatcaagcctagaaaagaatg

SEQ ID NO: 2749 - DNA, 1035 bp, Diabrotica virgifera
gcgagcggccgctcgcgccctagcattcggcaagataatgatatcttaaaaaagcttcaagtaatgaattaaaatatacactcagatttaaatatattgtcaattatgctaaaacgatgttaaccggtgtattaaaacaatgtctagtttgaattggaaagaactctttccaacgaaattaagtttgattatctttatcggctacatacttttatttgttaatcaaggaattttggtaacagcttcacaacgctcagacaacaactacaactataatatcgtaacagtagtactattgacagaagttttaaagttagtcatctcgtcagtcctatattgtaaagataattctactggtcaactgatctctgaagtagtcaagcacaaacatgtattactcctctactttgttccggcttttttatattgcttatacaacaatttggcctttttgaatttatcctcgtttgatccaactacttattttttattgctacagttgagggtagttgtaactggtgtgcttttccaggccatctttaaaaagattttaagcaaaagacaatggatttcgttagtgatactaacgtttggctgcatgctaaagcagattaacttgacgcagactacctcgaatacctcgtcaagcaataacaccaaagccgcttcagtttccttaggaatagatgccatattcatatttattcagataatatgctcctgtctagcaggtgtctacaacgaatatctcctaaaagataaaggtgcttctataaatattttcgtgcaaaatgtattcatgtatttggattctatagtttgcaatgttcttctgctcatactgaacggaaacatcttagaagcgttcgtttatgaaaatattctttaagtttacattataagtcttattagtgatgttcaatacgcagcgataggactgtaacagctcctttttgagaatctgattctatcttgaaaacgttcgccagtgctctagaactagtctttacggctctattaagttacctttttttt

SEQ ID NO: 2750 - DNA, 1175 bp, Diabrotica virgifera
  misc_feature (963)..(963): n is a, c, g, or t
  misc_feature (1027)..(1027): n is a, c, g, or t
  misc_feature (1123)..(1123): n is a, c, g, or t
agggagttaaaaaaatcagttttcaaaacagaaccaatgaaaagcccaattaggagcaaatgcttttttacaaaaataaaacctcaaaaataaaaaatgaattaggaaatgagaaattatccaaaaatagataaaaaagggcctgcggttaagaaaaataaatgactgtattccttttattataaatttatactctattcttttatattacagcttttggactttgagagttaaatcataaacgtgtttatcacaccataccgcctaaatttctattgtcgtatttttatattgttttatatatgaaataacgcattaacaaaaatatttacacgctgtaatttggtttctttattttacttaagttgaaagctttgatccgtattagaacctactcatactcattcttacttatgccactttctataacatagaactgaacaagttacttagatgtcactattgtataaagatgattaacttttttagaaagtcacaaccaagccaatagtgacgtcgctggtggtgataatcaccggggaccaaatctggagtatatgttgtgtgcagaagcaattcaaagcccaattcgtccattttgccatcgttttcatcgacttgtgacaagtaaagcattgtcctggtaaaacaagaattctttatttaataaatgacacccattctttgcaatttcggccttcaaaactccaataaattaattgacccttacctgttgagtgtttctccatgttttaaatattcgatgaaaataattccttgtggagtccaaaatacagaggccaaaatttattcgaaggtttgttacatctttggtcgctttggacagctttcttggagcgctaggcactcagatgactgccaatttgattccggagtgaagttatggatccatgctttatccgttgtgacacccatgcaaaaactctgatctattcagattanatatctccaaacaatgccgcgattcatcgtcgtatgtaagtctcccttaggtgtgtccattgantttctgtcgttgttttttgcaccattcgtagccaggcattcgcttgatgtcaccatcttgaggtctgcctctacttctcttattgctcccatgggntgtctcccattccttccatatgtcctgcccagttaacattgcaatctttttg

SEQ ID NO: 2751 - DNA, 1311 bp, Diabrotica virgifera
ccagatattgccaaaactgagaaaaaagttgctggtggagatttaagaggggcgtacaattacattaatgatgatggaaccgaaatcaaggtcgaatattgggacgatggaactggattccatcaaatcgataatgttcctaaaatcttacccaagccaattgaagagtctccggaagttaaagctgaaaaggataagtttctagcaagatggcatgaagaggccgagagaaatcaacgtccagttgcttccccctacgatgctgatggtaactacgctagcggaccattatcgctccaaggacaagctgaatttaagaaaatgtttgaaaatcaaccccaaggtcagtactaccaacaacctagctctagttctggagtttaccagcaaaacggacaatatcaacccgctggacaataccaacaaactggacaataccaacaaactggacagtaccaacaacctggacagtatcatcaatctggtcaaattaaacaagttcaacaaccaggaccccttcaacaaggtcaatattatcaatcatctaaatcgcaatcttctggtcagcaccaacaacctggtcaataccaaccaactggtcaataccaacaaactggtcaataccaacaaccaggtcaacaaggttctgttcagcaattaaccaatccgaatcaaatcgattacactggagcatacagtgaaagccaaaactcctacgcaaacccaactccaaacaaaccatctggtcaatacacgccagttgcttcaagctccaaccagtacagccaacaaggaggatatcaacagcctggacaacaccaacaaggtgcatatcaacaaagtggaacaaatcagcaaccaggatcataccaacaaggtgcataccagcagagtggagcaaatcaacaaccaggatcataccaacagggtggtcaataccaccaatctggacagtaccagccctccgataactcaaaatcaaaccaagttgataattccggtgattacgataaaagctgggacaacgagggccaatatgataaaaaatacgatgaagaagaaggctccactgggcccccaaagggattcttctataagtttgattaccctgtaggaaaaattgttcagaaaggagaaatcgctagagttggagatctgaaaaatgcgtatagtcaaaataaagctgcgtacgaatcccaagtaagttcaggccactcgggttcagctgcttcccaaagcagttactcatatggttcttaactttaagctgtgataatgtattttatagatttttaggagaataaaaaatat

SEQ ID NO: 2752 - DNA, 794 bp, Diabrotica virgifera
atgaacttgatttacctgaccttaataattaactgcaaaatctgtgataattcaatacatgactaaatttctcgtgcttatagataaacttcatcataatctgtgttgacatgtctttatgtagtttgttgtagtcattaccttacatatttttatgtttatggaagtttattacagtgaaaataagttggaggaggactccgatgcaaacaaacagttttgtcttacctttttgttaaattgtaacaactaaaacattattactgcatataaagtatgtaaatgtactaaaaaatggcatttctatgcccagtgagaatcagacgaggtaaaaagaaaaaagcctcgaatatagatttagaaaaagaactgactagatctaacaatggtgctacaccaggaatgggaagaattactggctctgcgagtatcgaaacactcgttagagttggtatcgaaaaggaacatgagatatcgcctgatagcaaaatggttgtgttacatgattatactccttgtgatgattatgatctagaattgaagaagagatgattagtaatatattgtatctttaaaatgattatatatgatctaatacgagtgaatcgaaaaaaattattacgcctgagtattaaaaacttgtctttttgtatgaaagatctagtctctgctgcccactgattaatttgaatgaaagcgatattttgaccgtgttaaggaaccatattcattactttttttattgaaagttggaatgaaaaggttgcatgaaaaaaaaactgtctttatttaat

SEQ ID NO: 2753 - DNA, 1521 bp, Diabrotica virgifera
tcgcctcaggatattgaagttagtgtagatggtaacactttacattttttgatctgccttaaggtagattgctcttctctcgccagaatatcgtacaaccgatcatatacaagggatccaacttattagatcatcgtgctcgtacaatcaaggagatgattttgcacatttggtcacaatcgccaagctagatggttctcgctctacccactccattcagctatctcctagattagaacaagtattaggagggttccgattcaataatacagattttaagaaagatagttcactcgtcggacgttgtctcactggtttctaagactctagatacacgattgcagcaagttgccgatcattttaaattgaagaaaatttttattactaatttagcagcagcatgttttagaagtattattgaatatgatgtactcacttacaataaggctgtttttctttataatttggatgactataactgtttggtgacagttacaataggtcagaaataccctatagaaaaacctactgtagtactgtcatcagtgtattgtccggaatcaaaagcatgcagtaccactcttaccaaatatccctataaccccacgttgaagccagaagttaatgtggaacatttaatagagttcttgcacgacgccgttctaatgttcaagaatcatagacattaattataatattttatataatatatgtatactgtgctgttcgaatgaatagacaaataaaaaacaaatttttataaccttagcttttaacccgccgttacacgcgtcttctattgtgacgtggttgcacgcgttgcatgagcgtcgccctcacctacataaattcgacttatttcgagaaagaatgaatgtcaacatgtataaatataaaatgggttgtactcacatattatagaaagtctcgtaaaccaattttttttattaatttaacaaaacaaaagtaaaaataatatagatcaaaagcaagttttcttaattttcaatttcagcaagccactgaagaagttaacgttctttaggcgaattaattttactaaaaatacaaattaaaattaacaactgttctgaagctatttctttatggcatttatgtaattaactattaatattttatattttgataacgacgtccgaggtggaattcgaaacgtcaataaaatcaatttttcaagttaaatattgtggcttatttcccaattagaataggtaaatttaaaaatgggttcttaaccagtggcgcacctagaattttcctctgaggggaggggggtttgcttgagcaccgaaagttttttgtattatttgtgaaagacaagttacattttcctaccttcttttatatatatttctatatgctctgggagacaattttaacccccaaaactaccccttcggtgcaccactgctacctaacctaatgcactagagattatttttgttaaaccaactttaatactaaataaaaacctaaaagtcattgtcgattccctttatg

SEQ ID NO: 2754 - DNA, 1697 bp, Diabrotica virgifera
  misc_feature (1602)..(1602): n is a, c, g, or t
aaaatatcagaaccaaacccgcgtcagttgaacttgcgtgcaatttttttttctgtggtagatctgttttgttgatagtgatactacagttgggaggttgaggaccctcatttaaaccggttccattgttcatgtgcttcaaccaaatcgtaatacactcatggaagtgactcaattagtgacttaaattttgttgactttttatcgaaaactactgtgtttataaatagcaaagtaacaagaaatcaaactaaacaatattagaaatctgtgggaagttgacaattgttgctctcctgtaaaatacagtaattgaaaatgaagatcttagcagcccttgtcttattatgcacactaaactatcacagcagtttggctagcgatgacggatttaaaggcattatttccccaacaaaccaaaaaatgtatggacaagccttagaagccatctttactatgggctttaggcttcaagatattctaaatatgtcaacagaacaaaatttagttgtttcacctctcagcactgcagccatcattggacagttaatgataggagccgatggtgaatttagagaagaacttcacgaactccttggtctacctccttctttagcttcatttaacgtaacccattttagtaaagaaagaaacgaaagtcaaatcctaccttacgctactttccacttgcaattagcgattttaataaaaaatctgagacaaagaaagccaggtgaagaatttgtcttaaatgtggcaaatgcaatgttttacaactcagatattgatttaagaactgtatttactagtagcctcaataaaatgtacgatacggatattaccccattggatttttcaaaagacacgactcgaataattaaccaatgggcagcggaccgcaccaacggcttaatcaaatcctttttaacgtctccacctcccaggaatactgcttccatgtttcttaattccatctacttttacgctgattgggaaacaccgttttccgactcattgaatcacatggatacgtttacagtgagtcccacacacaacgtcagcgttctctacatggttggcaaaatggaagacgtaccatacatcgaaacgaaaaattacaagctggtttgtttaccttacaaaaatagagaacttggaatgtatgttttccttcccagtatacatcatgagcacaaatacgatatcaaaaagttctttgccagtttagatccaaaagaggttgtgcactctttattgaatatgaaaaataagtcagtcgatgtaaaaatgccaaagttacatttaactaacacaatcagtttactcaaacccctacaaaagtatgcgacgtacaaaaaaattcaagataacaaaactcacgtaaggcaaggaaacatcttagataatttagttaatcaattaaggcagtaccaaaatttcactgatccgaaatacacagatatttatttggataacgccgctcgaggtgttaatctgcaagtgtcggatatttatcaacaaacaatattctccgttaatgagaaaggtacggaagctgcttccgttacagcaggcactaccttttacgagggagggtccaanagtttgttcttaggtaggccattttcatttttcatcaggcatgaagaaactcaggctgccatttactggggtacgatatccaatcctgataaaca

SEQ ID NO: 2755 - DNA, 1709 bp, Diabrotica virgifera
tgcgttttgattttattcaaggaaattaaaaagattaattaagaaaaacccatgggctcatacgtaatgagtacccaggatcaggatagtagtcaaaataacatatctgatgatgatgtgtttaaaatattagtagcaacggatatacatttgggttacgcagaagaaaacccggtaagaggacatgatacattcgatactttcgaagaaatacttcagcatgccgttaaaaatgaagtagattttattctgttaggtggtgatttgtttcaccacgcacaacctagtccatattgcatccaaaaatgcttggagctcatgaaaaaatattgcttgggagataggcctgtatccatagaatttttatcgaatccttcgcaaaattttacccaacatgcaaatgagaccgttaattatgaagatccaaatttgaatgtttctcttcctgtattttctatacatggcaatcatgatgatcctacaggcaagaaacatatatcagctctagatataatatcaacttctggacttgttaattactttggcagatgggaaaacttagataaagtagacataactcctattctactccagaaaggaaaatctaaattagctctgtatggactttcccatattagagatgaaagattaggaagattgtttatagaccaaaaagtagaaatgttgtccccaaaggacaaagacgattggtttcatttgctggtttggcatcagaaccgagccacaagaggatcaaagaattttatacctgatgattgtcttccagattttttaaatctagtaatttggggacatgaacacgattgtagaatagagccagagaggaaacttaatgatgtttttatatctcaaccaggcagttcagttgctacttctttaattgaaggcgaatcagttactaaaaaagtaggaatattgaaaattcatgaaactaactttaaaatggaaccagtggaactacaaacggttaggccttttaaatatgcagaaatgaatctaagtaatgaagagctattggttattgacaaaaaatcattgagtgaacaagctatgcaagttgtaggtgccaaagtagacgaaatgatacaagaagctaagaacttaaagcatactaaaaaagttagcgaaaagccgttgatcagattaattgtcaaatacaaagatgaggatgttgtcttcaattctatcagatttggacagatgtatgcagatagagtagcaaattcagataatatgatcaaattccagttaattaaagaatgttctacacgaaggagactcaatcaaaatcaaggagccgatgagattttggaagggccagtattagtcgatcgagttgaagatatggtttcggactattttacggaacataaagttctaggtttatttccgttaaatatattaaatgaaggtgtaaagagatttatagactcgaatgatactaacgcaatagccgacttaaaagacaatgttattaaagagatgatgacaaaactcgaactggatcttcctgaagttgaagacactctggctgccatcgcagcgataagggatagtatggaagcagactctcttgcttttgtaaatagagttttgggtgacccaaaaagaaagaagaagaagaaagctagtgaggataatgatgatgaggatgatgggtcaatcgaagaagaagcagagataacaaa

SEQ ID NO: 2756 - DNA, 893 bp, Diabrotica virgifera
cggaagtagaaaagaagaaagaaaaaattaaggtagatgagttgatgttgacaaatattgacaaaatatagtgataaacattgaagacaaagagttattaacagttattaaatattaccttctatattgtttcttattaatataaattttgcaaattgaaatgggttgtgatggtggtaccattccaagacgagacgaacttgttaaagttaaaaagaagcccgaagctaaagataagaatgcagaactagcattcaagtggagatgttgttttataactcaagaagttctccaacaaccaattgttgtttgccacctgggaaaattgtacaataaaatgtctctaattgaagccttgctcgatagaagttcattgccagagtcgatcaagtacattaagagtttaaaagatgttaaggatcttaagttgaccccaaatccagaattcttgaaagacgaaggcaagaaggaaggttctttggacaatagagctgcaccttacatttgcccagtattgggactagaaatgagtggaaagtttaggtttgtagcagtttggtcctgtggatgtgtattttctgaaagagctttaaaagaaattggtacaaaaaattgccacaaatgtactaaaccatttgaagatgatgatattgttataataaatgggaatgaggaagatttagagctaatgcgtcaaagaatggaaaaaaaagacgtcagaatacgaagaaaaataaagaaaagaaaataaaacaagaacccgaagaagttgcagggaagtccttctgaaaccataaactactgaaaacaaaaagcatttaaaagaaagggcaggaatcatcccaaaaccagaagattcaaaaaaagatgaaaaattgaaggattcacctttc

SEQ ID NO: 2757 - DNA, 1163 bp, Diabrotica virgifera
caataaaaaaactaaagattagctactttagctcggtctaaatctctcggccatacgaatttaatcagcggccaggcgagactttttatttaattcatagaggcatttttttaattgacaggtgaaaaaaatgtttccgaattcctttattacacctatatattttttctaaatatacaattatggaattatcatattatcatcattaatatttttaaataattttaatttatattttaataaaggttatataaaaaatagatataatattatataagaagaaatcatcgacctttttcttcagtttttcatggttaaaaaatatttattttttattttttggtcaaattgtggtaaattgtcacgtaagatacttcctttttcggatgccgtacgatttttttgtttcagagatcccaatcctgagtagtccgccatcggaactactttttttcgaggcctcgacttttgcgccctctacaatattggtgtgcgtgcataaatgaaaaatagttatttatgaaacagttcgggaagtatgctttttgcgaacgcacgcgatgtttagagcacgagcgacagcggagcgagtgatatacttcgcgcaagttcgcaaaaagtacttcacgcacagtttcatacaatattttatctactgataaacaaataaaaaaactgtaactcttcgttactggaattcatttctattctacaatttttagaactttggcatttaaaaattctaacttctttcaaaccacaaaactgtcaaaacatttgttgtaatttatttctcattatgtcatcaccatgacaacgcgaaagttaaggatatttgattatatgaaagtgtaccaaagaccgtgcgaaaaagtaaatcccgtttaaaatacattgttacttcacgcacactttaaatccttcacagactgctatctgtaatgacagttttcacaaactaaaaacttatacataatatgacttagagcagataaagatttttttgtactctctgagagttggatattaatatgtgaaaagttttatgttcatttttgacagaggttctgagaaaggaattcttgaaaaatatccttaatttggtggtttaacatgtaccactaaactaaaccggtttggtagaatttttttcgctttattct

SEQ ID NO: 2758 - DNA, 973 bp, Diabrotica virgifera
  misc_feature (820)..(820): n is a, c, g, or t
aactaccaaaaaatatatgggaaaaggaagaactaccgatggaatggaagcaagcagtgctatgtcctctttatcctcttcagccccaagaaaaaagtttttattattttaataatattttctattttctctcctcatttgtgaaaacaataaacgaacatctataaaaactttaaaaatagttatttatgaaacagttcgtgaagtatgctttttgcgaacgcacgcgatgtttagagcacgagcgacaacggagcgagtgttatccatcgcgtaagttcgcaaaaagtacttcacgcacagtttcatacaatttttgatctatgatgaacaaataaaaagctgtcactcttcgtcactggaattcatttctattctacaatttttagaactttgacatttaaaaattctaacttctttcaaaccacaaaactgtcaaaacttttgtcgtaatttattgctcattatgtcatcaccatgacaacgcgaaagttcaggatatttgattatatgaaagtgtgtcacaaacagtgcgataaagtaagtcccatttaaaatacattgttacttcacgcacactttaaacacttcacgtactgctatctataatgacagttttcacaaaataaaaacttatacataatatgacatagagtagaaaaaattatttgacacacataatatgacaggttcagcataatggacatcaggacttagctttcatataatttaactatgaaactgaaaaaacgttatggttcaggagaaatacatatatacattttgcattttgtacaaaagaatctcgtcttcttagtgncatcccagtggttaggcaacgcgatgagaattcctattgctgacagagcatattggcaaatggtcattactggtttttctacatctatagggcgtaactggtaaactgtagactttttacagggagtatgggcactccatcttaagatgtctc

SEQ ID NO: 2759 - DNA, 1444 bp, Diabrotica virgifera
  misc_feature (1262)..(1262): n is a, c, g, or t
  misc_feature (1341)..(1341): n is a, c, g, or t
gtttcagaggtcccaatccgttagattaactgtccgccatcggaactacttttttcgaggcctcgacttttgcgccctctacaatattggtgtacgtgcatggatggaaaaggatatgtttttgtattctctaagagttggatgttaatatgtaaaaagtcgttatgttcgtttttgataggggttcggagaaaaaaaatcttgaaaaaatgcttatttttggtcttctaaagtgtactaataccaaagctaaaaataagcctttggggctatattacgtaccgttttcggaatggctataattacatcttgagtgctccttagaaggtatacatggataaagccacttaaaatatatgggtgaaaaccctttaaacagcatagaattgtaattatacaacattatgtacataaaactgtatgatattttaacttgaacttgaattacatcatgacaacgcagaacttccaactatgtgagattggtagcccggaaaaaagctgtctgaccgttctctagatagcaacaggcaaatatttttagaggcagtgcctatctaggaccagaaaacagttaggtcttttaaaaatgtcccaagtcggcgcaaagattaaaactgtcctatataaaataaaccaacttggctcatgggatattaaatgtttcaactgttaagaacacagaagataaatcgacaatctatttttattttaaaatggctaaaaagctgaatctttacaggttttacgtagaagctaaattaggtataatttcaagataaaacgtaatttcttttgactacatgagaagtggcgtagcagacacccaaataataaatatgtttcaaacatctaaccaagctttatcccatgtatcagtagcgaaatcgattccacggccaagattcccaaccaagagaaactgtttcttaaattcgcaaaaaaacccaaaaatttttgtacaatattgaaggaaggggttttgaggactccaaatataaaatttacgacaatatacgttacgacagtattagtaaagcataagaagtacgaaagtaaatggctctaataattattccaataaacaacaatgtaatttgcaatttactttcgttcttcatattttgcacaataaaatattcgttgtcgagataatccaacacagtcgtatgttcgtggaatagggtatacctactaatggggtactaatacctacctgttaatcttcgagccgacctgatcggattgtaaaatttacctgnggtatcataaaaaagaagagatgggaataccccatttttagtgactttaatataccttgtaatcagcactgaagatganattgtcaatcggaaatcgttctgtgatgtagcgcgaaagggtgctttcgtaataaatatacaaatttaaatgatttttttaataattttttttcagaattctt

SEQ ID NO: 2760 - DNA, 1524 bp, Diabrotica virgifera
gacaacacttttttctatgacggccattttgtgaaagctgaatttggctcagtggtgcgtgcaaagtggaagttaaaaaaatatattttaaaatatgtattaaatataatagtaaaacaatatcaaaatgactcaatttttaccaccaaatctcttggcgctttttgccccacgcgatcccataccatacttaccaccggttacaaaattaccccatgagaagaaaaaccgaggatatttgggtgtaggacaatttttagatgatttcgaggatcctaaagacacacctccaccaacaagagtggaaacgagggaagaacggttagaaaggagacgcagggaaagagctgaacaagttgcatacaaactggaacaggaaattgctatgtggaatcctactgcagcacccaataatacaacagatccattcaaaaccctatttattgctagaatcaattatgacacttcggaatcaaaacttcgcagagaatttgaagtttatggacctattaaaaagatcgttttgattcataacagcataaatggtaaaccgagagggtatgcatttattgaatatgaacatgaaagggacatgcactctgcttacaaacacgccgacggtaagaaaattgacggcagaagggtattagtagatgtggaaagggcaaggacagtcaagggatggttacccaggaggttaggtggaggtctgggtggtacaagaagaggtggaccggacgttaatatcaaacactcgggtcgtgaagacaacgaaagagaaagggaacggtataggttagaacgcgaaagggaagagagaggtttggttagggaacgcgatagggatagagatagagttcgtgatagagaatttgaaaggcgtcggtccagatccagagaaaggaggagaagaagcaggtcaagatcgcctagaagagaaaagaggagaaggagtaaggacaagaacagggacgaaataactattgaagatgatggttatgataggagagatagagaaagggatagggatcgtgataaggataggaaacgaaggagatccagatccagagacaaggatagggaagctcgtaagagagaacgtagagaaagaagagaaaaggataagatcgaaagagttgaatttattaagaccgatgatggaggtgaaatgatcagagttaaagaggaacctgtagatgattatgactacgcaaattaccaaccacctgcatatgattcagcaaaggttaaatatgaggatgaagatgagcacaagtatgaacctcttgatacaaacggtgctagaagatatgaagatgagtatgaagaaggcgaatacaactaatttaaggatatatttttgtttagataatagattatgtagatttctaatcttttgaacttgtaagtgaccaatttccactttgtaagttatttataatttatgtttttagataacgtcttctgtttgctttccaagagttatcgttagaaattgattattgtaataaaatgcatcgaggg

SEQ ID NO: 2761 - DNA, 444 bp, Diabrotica virgifera
tccaggcctcacgatagacttgtacgggtcaattaatatgatgcctgcgctctacacaatattgttattaatccggcggtggactgaaaataaagaacttacaaatcaccacaagacagttgcgatttattaagtagccacagtttagatatttcggacacacagacacgagcataatttcgaaaaacacttgtagtctacatagtcgcaacataaggggtccctatgttgcgactagactatcgtattctcaggttaattcactagtaatcactggcagactagtttgatagtcaacagataacagaagacaattatttaaaatcaatttgatatactgacgacagctttaataactaaaactgcacctaagtgctacgaagaacctactattattaaaatgcctctactaagacgtctttttggaaggggtaaaaacttttt

SEQ ID NO: 2762 - DNA, 1014 bp, Diabrotica virgifera
ttcatttcacttagtttctgtgcccagtcatcaactgtgtagtagttttaaatcaagtgaatttgtgttcttgtgaattaaatcttcaagaaaaatgtcgaaagcacaaaataaaggttttacaaaagaggaagaacttctccttcaagatttcagccgtaatgtatcaacaaaatcatcagccctgttctatggaaatgccctgattgtgtctgcagttccaatatggttattctggagaatacacatgattgatatttattcctccttgatcttgttcgcagtcatcacagctatttctacctatttattggctatggcatacagaaacacaaaattcaccctaaaacataagattgctgtaaagagagaagaagctgttaccagagacttgagcaaaaaactagcagaagacaagaaaatgagcaagaaagaaaaagacgagagaattctatggaagaagaatgaagttgctgacttcgaagctactactttctccatattctacaacaatgccctatttttagccattgttattcttgctagcttctatttgcttccagcattcacaccagcagtcaactacaccctttccattggctccacatctgcgttattagccttattgtcaactggatcacattaagacttgtttattgaatctgtggtattgttttatagtaccattttgttcaagtgtaaataagaggatgaaattaacatcaacaatatctaaatatcctgtaaggtttgagtagagctgttgaaaatatatgtatatattgtttactttttggaaaacatatggtttaattgacatcttttctttaaatcatgtatattatcaaaacgtaaagaattttaaagactatttattatgattttctgtataaactagacattaggttatataaaacaagtgactatttcatacttttcattacaccgttaattgagctctatattcatataatttatactgtttcaataaaaaaaccattttttttttccccc

SEQ ID NO: 2763 - DNA, 665 bp, Diabrotica virgifera
tcgcgggtcgacacaagcaagttacttcgaggattgtaaaacaaaatgttcgggattttcgttttcgccattttttctgtcgctgttgcttcagctggtgtacctaaacatcagcacgtgaaagtcgtagttcccgaacaacaagcccaatcctcgcataccctggaaattgccgaaggctatgaaagtggtggctatgcgcctggtgaattggaggcccacgcggcagccgaagcgggagccggtggaagtggaaaaggcagttcaggagcagaattgacaagtttggctcataattcggcagtgcaggctaaaaatgcggtcaggaatcaacataccgccggaagccaagccgcttttggtgtcaaaagtagtttagccagtgctgctgttggagctgcccaaaccgcccaagctgccctagtgggtaaacaagctatcgtgcaaaaccttaaaaagcaagccatcgaagcccagcagcaattgctagccgaaatttcacagtaccatcaactcgaagccgtatcacaagttgcagctcacgcctcccaagacggccatgcccaactgaacactctcactgctgcccttgcatctgcacaggacggtgcttcacactctgaacaagtcgcagccgaagctgccaatgctgctgccgcccaaca

SEQ ID NO: 2764 - DNA, 1068 bp, Diabrotica virgifera
aaaagtaataaaaaaaaattaataaaaaaaaagtaataaaagaaaagtaataaaaaaaaggaataaaaaaaaaagtaatagaaaaaaagtaataaaaaaaagcaagtattatcaaggaatctacctgccaaatttcaaaattttcggatcaaatttagagtgttttaacaacaaaaaacccattttttgtactattttttacattatataatttattctgtgcagtgtttattgagatatagttacattttaggaaatatattgataaagtattagcaaggaatctacctgccaaatttcaaaattttcggatcaaatttagagtgatttaacaacaaaaaacccattttttgtactattttttacattatataatttattctgtgcagtgtttattgagatatagttacattttaggaaatatattgataaagtattagcaaggaatctacctgccaaatttcaaaattttcggatcaaatttagattgatttaacaacaaaaaacccattttttgtactattttttacattatttaatttattctgtgcagtgtttattgagatatagttacattttaggaaatatattgatacagtattagcaaggaatctaccagccaaatttcaaaattttcggatcaaatttagagtgatttaacaacaaaaaacccattttttgtactattttttacattttttaatttattttgtgcagtgtttattgagatatagtagaaaaaaaggaaataaaaaaagaaagtattatcaaggaatctacctgccaaatttcaaaattttcggatcaaatttagagtgatttaacaacaaaaaacccattttttgtactattttttacattatttaatttattctgtgcagtgtttattgagatatagttacattttaggaaatatattgataaagtattagcaaggaatctacctgccaaagttcaaaattttcggatcaaatttagagtgatttaacaacaaaaaacccattttttgtactattttttacattagttaatttagtctgtgcagtgtttgttgagatataatcacat

SEQ ID NO: 2765 - DNA, 997 bp, Diabrotica virgifera
gtatttttgatcaaaatatggggactaatttattaactttggaacaaatccatatttatttacttgaaaatggtggcaaagttaaaaatcgtgatattgttcgttattttaaaagttatttaacagatcctgtaactaaagatgagaatagatcacggtttaagtcctacattaacaaattagccgttacaaaagcagaaggcgatgaaaaagttattcttcttaatctaaaatacagcagttacgatacattaccatctccggcatcacacaactccgtcttctattcaccacaacatgatcctcgcaattctgttggacttccgttatctccagcaggattaggagtggtagattcatcggtttcatcgccttcgacaccgtcgcgacagcctcctccatatcgagcaccaccgccacctcccagttcagcatcaatgaattcgttggatacaatgtctttgggatcaacaacgtccttaaacgatcttcaaaaaactccccagcctcctcctagagaaaaacgaaaggattcggaaaatagaaatttccaggaagacgggacgccacaaaagacagatgtagatgatcctaatgttgaggataaaaccattagcgtaaaagaacgaacacagaaattcaatcggttggcttcggtagatgatgagctcagtccacgaccgccaaaatctgctgagaagaagagtaggggggcagacgaggatgatggcgtatctcttaccccgatcgatcctaagaaatgtgtagaatggtatgtgacagcgagcagaggtgactatcaagaattactaaagctggcgaatacagaacctcgactagttaataaaaaggatccctttacggctgtaagtattatagatttaaatatataatttctatgatgatataaaacattagattatattttcatatcggatatgtcttcgtgtttaaaccttaataattaatatgtttgcgcaaaataaaccacaaagac

SEQ ID NO: 2766 - DNA, 1302 bp, Diabrotica virgifera
tttttcgtccgacttgaattgctttcaaaatattgcatcatttgagtcaacttaaccttcatcacaagaatactcagttgaagatatcattggaatttttactcgaaaatggctttaatgttagcttcaagagtgtgtagggcatctaccctagcgaaaacgactgtttttgttaaacagcccaatacgatcaccgtgtaccgagcttttagtgaaggcaaagatgcagctgcaagaacagctagacaacaagttggaataaaagagaaactcatgcaacctgcaggagatacagctttcagaatgggcagaggagccttagcaggagcatctgcacttggcattggagctttggcattctatggtctgggattaagcagcgaagctagtgcacttgagaaacaacatttgtggccccagtatgtgaaagacagaataaaaaccacctacatgtacttcggaagctcgattgctatcaccgctgcaagcgctctagcagcagtccgctctcctgctatcatgcgcctagttatggcaaatggattcatgggcttcgccatcagcttagctgctatcatggggactggtattctttgccaaagtattccatattcagaaggctttggaagcaaacaactggcttggatgctccacgctggaaccatgggtgctatgatagctcctctgtgtttcctaggaggacctcttttgatcagagctgcatggtatacagctggagtggtcggtggactcagtacaattgcagtttgtgctccaagtgaaaaattcctctacatgggcggtcctttagctatgggtttaggtgttggggggtttgggtcatcaattggttctgtatttctccctcaactacagcattgggtgctggcttgtactcatcagtttgtatggggggttgatactgttttcggcttcttgttttatggacttcaaaggataattgctcaagttgaaaaatttctggcaatcccccaggcattggaaatcggcctttagatccctatccatgcctctatgggaaaatttttggaccctccggaaactccttccttcggaatagcaacttttttaaacgggaggggggcaaaaaaaaaaagaaaaaaaataagttttttgtaatttcccccagggtttccccccggtcctttttttttatattcaaaaaaaaaaatctttttgggaactggggccatttggccccccgggtggggcacctccttcttgaaaaaatttatcgccggctttttataagggggggtccttcttctaaaaaaaaaacaa

SEQ ID NO: 2767 - DNA, 1574 bp, Diabrotica virgifera
gctccttgtaacattcaacgtgtcttgggttgtttatttctagtgcattttttttataattttagtatgggctattccacgaatatacgactatcttggattatcgccacaacgaatattttagtgtgcaacataagaagtgcgaaagtaaatggctctactaattgttccaataaacaacaatgtattttgcaatttactttcattctttataatttacacagtaaaatattcgttgtcgagataatccacaacagtcgtatgttcgtggaatagggtatataaatctttatctttaatatctaatttattatcaaaatacaaaatatttagtatcaaaatacaaaatatttaataatacatttaaaaatacaaattgattatgctgttttgttaaaattatcaacattagacatgttaattacaggtaaaacataatgcagtggttatataactcataattgtgtggtggcagacaactcaatttttgagaaacatttttatttatgaaacctccagtggacagcagccatatggaaatacaatgtaattttatttcgcctgtccgctgcagggttaaaaacacctaaaacaataatctactgctgaaatagatgacagttcaaaatgttaaatgtctagtttcatatatgaaatagtgatctttttcacactcacgattttagctttaattgaatgggtccgccgaataacattgtaagtatcccattgttcgtttttgagaagttgaagaaaaagttttaaaattgtgataatggtgagtttatacattttaagggtgagtacaacctttaaatgtataagtttgccattgttataattttaacactttttttctatttcttaaaaacaagtgattaggcacttacattattcagtggacccgtcaaattaattttaactataaaactgaaaagttgacttgtctgcttgtgtcccctaaccacacagttatctatgtgatctgtttttattaaatagttaattttcccgtaaatttacttgaaaatatcaccaaatcattgactcagtaaacatacaaacatctgccagacagattaaatgaatattatgacaggtctttataaaaaaaaatacaatgtacttgtagacaactcgatatactgatgtgtatgcaagttacagcgttactgtaacagatacaggtaaacctagttttgtataagcttatacattatgctggtacaacacttcgctatgtgctatttgttacgtggctactctgtatgcacccaaatatttgtcttttgaagtgtgtaaaaactgacaactggatggataggcatatttgccatgtatgcttatgtgctatgtgtgcacataaagcgaattttgatgaatgaaccctccacacgtcgtcctatgtagctgaagaagtaacataacaataagacgaagagatgctaaccaaatttatggtatgtgtttattaagtactaaataggataatgtgaagaattaataaaagtggtatgtgcaaaatattttacttcaactcacagtgtatggtagctggtaatacataattatga

SEQ ID NO: 2768 - DNA, 1203 bp, Diabrotica virgifera
acggacgcgtgggccaccatcagcctgataaggacattgcagcattaggagagagtacccgaagtgatatttctattgactcaattgaaagaaatggtggagaagaacgaggttttggaagaaaccaggaaagtttccttgaggacttacaaaacagaggcgctaccatcgttcaagttacatatcctagaacagcgaataatgagaaagagttgactgtcgttcggggagaatatttagagatattggatgatagtagaaaatggtggaaagctagaaatagcagaggacagatcgcccatgtaccccatactatagtaacaccttatatttttaataatcccttacacgctactcaaaactacagaagaaatgactcgccagtagaaagatttaaccgtgatcatagcaaccaagatcactcccctcaatctaagagtactacagattggatcagaaacgaaaggaccggtaagaagggagaatttcgctatttctgagtgcagcttccaaagtatttcgtccgctttttgtgtttgctaacattttcgtttgtttgatgagcataagggatcgatttttcaaacttcattaaattgataattgtatttttgaaaaacatacgtcgaatgattgtgccagtagtcagtcagttaagcatgtatcatagtttgctagcaaattactatttgaaaaaaaaaatcaattaaactaagtttcattgacatgaataagaatcaagtattactagattcaaaaaaacatgtttgaaaaacacttgttttgatacgacggatatctgtttcttcattctttaaagctgatctacctgtttccttaggcaggccgcacatcaaagaaacatgaaacgtaaattacgtttcatggaaataaaccactgctaaacaaatatatgtccggccatttatgaaactctccgaaaataaaaatgtgtcatgagcatgaatcacactcgtttcattggtaggcggactttgagatttgtttagcagtgttttcttttcatcaaacatgtttttcgtttcatgtttcatgtttttcgtttcatgtttctttggtgtgcggcttggcttagagttctcatttttaattccaactattttttacatcataatctcagactgaagattaccgatttttttccttgggtcctttttgccatttttgggatgatttaggtct

SEQ ID NO: 2769 - DNA, 924 bp, Diabrotica virgifera
agtactgtttgagaaaacttgagcggtcacgaagtacgatttatagacttttggatcagaagcatactgcaaaaactctgctattctatcggttaaaattcgaatccactgccttctgtaagagtgattctccatcaactccgcaaacttattatagctgaaccgtcctttgtcatccaaaaacactttaaacgacttctctgcaccaagagccgctatagtgttctttcccatttcagaatggataaagtgatcaaacataagatgtaatttgtccaagaatggaggcattaaggatgagtgcccagcgtgacttttttctctgcttctcgcttcaggtcctacgaaggcgttcatggtctgaagaattgttggaagtagagataagaaattgcttccgcctttctttccatcttgaccagattggcctaggaaactaccagctagtgataatatgtcatttaggttaaagtcagattctgctttagggtctccttttcgtacttttttagaacctgtaaagaaaatgggttaaatcgattaaataaataattatatttttatattacttaaggtactagtacactttagaagaccaaaaataagcatttttggaagattatttttctcagaacctttattaacaatgaacataaaaccttctacatattaatatctaactcttaggcaggacgcacatcaaagaaacatgaaacgtaaattacgtttcatggaaataaaacactgttaaacaaatatacgtccggccatttatgaaactctccgaaaataaaaatgtgtcatgagcatgaatcacactcgtttcattggtaggcggactttgagatttgtttagcagtattttcttttcatgaaacatgtttttcgtttcatgtttcatgtttttcgcttcatgtttctttg

SEQ ID NO: 2770 - DNA, 1624 bp, Diabrotica virgifera
cataaaaaagggtttttttttaatccaaccataaaataacctaacaaaccattaattatgttgttcaaattgaatatttttttcaacaaatgcataaaatcattttcttacctatttatagtatataaacttacatagtataaaaatattagcacattgacgtagataatctttgaaacatcaaaacagtagtcccaaaattctcaattacatcaaaagttgcttaaaacttactagtttctatatagaatttgcactactacgaacatgaaagccgttgattcatagaaaactaataatagaccacattgatttttctcaatattatacaaaactatcttttctgtaacataactgaatatattaaaaataagtagaagacactctgctgaaaggttccagccgttaggcaggccgcacatcaaagaaacaagaaacgtaaattacgtttcatggaaataaaccactgctaaacaaatatacgtccggttatttatgagactctccgaaaataaaaatgtgtcatgagcatgaatcacactcgtttcattgataggcggactttgagatttgtttagcagtgttttcttttcatgaaacatgtttttcgtttcatgtttctttggtgtgcggcttgcctaagaaaacgagaaaaactagcttgttttgttagaaaaattaattgtttttaataactctaataattgtttaaagatattccattggcccgattacttcttcttaggagcagcagcttttctagctttaggtgaacttgcagcagccttggctttttcgttgtcatgcccttatttgatttcttcgccttggttggtgttttggttactttggcctacgcggaagtcggaactgcggatgaaaacgcagttttatgtgctgacttctttttaactttcttcgtatttgccggctttttctctgtctttgtctgtctttgatgcagtttcttagccttagtcactttatttacaggtttttgcctgtagcagaacgtttggtagcggcgacagttttcttcggtttagttgttcctccaactttcttttttttctcctgaactaggcttggcagattcagaagacgacgaggaggtcaacgctaacttaaaagatcctgatgctccctttccttggtctgcaccaatgatccagtagcaactgcagcttttaaatattttttgataaacggtgcaacttttccgcattaactttgtaatttttagcgatatattttttgatagcaaagagaagaaccacctctttccgtgagacattgaggtgaacattgttcaccatttcagatgttggcggataggaaggttttggcagtgaagatgtttgtggcgttccagatgcagacgtatccaaagcagctgatgattggttttttgtatctgccactgtgttgggacatatataaaatcgtaagttaatatgcggtatgtggccattcactgactgaagagcgaaaactatatacacgtagaatactctacaataatatatatattgaaaatataagatcaaaaaagatacaatgaggctaactcaatactcccttcccacaaacaagctataaaatcaagctttaataataaattttt

SEQ ID NO: 2771 - DNA, 2665 bp, Diabrotica virgifera
tgcacttgttttgattttattattgggttgtgcgttgcgtttatctagtaggtacaggcttttaattatcgtagtaaagtgaaacagttaattccgtatttttggaagaaaatttcatcatgggaggaggctatgcttgggtgacgttagcgacgaatgattcctattcgttgggatcccttgtcttagctcactctttgaaacaagttggtaccaaacagcaactggcagttcttattaccccaggagttacaaattccatgagatccaagttaaacgaagtattcaacgtagtaaaagaagtaaacatattagactcaaaagacgaggcgaatctccgtttgttgaaaaggcctgaactaggaatcacctttaccaagctccactgctggcgtctcacgcagttcgaaaaatgtgtatttttggatgcagacacgttgatattagaaaactgtgatgaattatttgaacgggaagaattatcagcagctccagatattggttggccagactgcttcaattctggtgtttttgtataccgtccgtccaatgaaacttacgaaaaactaattcaatttgccctagataagggaagttttgatggtggagatcaaggacttcttaatttatatttttcggactgggcacacaaggacatctcaaaacatttgccttttatttataacctagcttccacagcctgttactcatatttgccagcatttaaacaatttggcaaaaatgcaaaaattattcactttatcggcgcatcaaaaccgtggctacaatatttcaacacggaaacaaggaaggtacatccttctgaaggtttgcaacacttggccatcatcctccaacactggtgggacatattttgcaacctaattcatccagcccttactcctgatatgaggaaaatagccggcttagcaggtgcgttcgccaatctgaccttgggtcaaccaagaacacctgaacaacaagccttagacgaccatttaaggaggcaaggctgggaggtaggaaatatagactacctaggacgagactcattcgacaatatatggagcaaaatttgcgaaacattggcacttgcccctgatgcagctccaacagttgagcaaccccaagaagctgcaccagtggtactgtctgcagctgtcgaagtttctgatagtccacaatcgaagatcgaatcacccacagcagtaattccccctcctcaaaccccacaatctgttccgtctgaatcaaaagcacctgaacccacagaagcagctcctaaaataccccctgtacaatcggttcccgatcagccagaaagtcaacagcctgttgtcgaaatactttcggcaggagttgcacctccagcgacaggagctacacctcaaccggcaggagctgcacctccagcggcaggagctgcacctccagcggcagtagctgtacctccagcggcagtagctgcacctccagcggcagttgccattcaacaggagagtcctaaatcagaaacgcctattcaacaaccaacattacctggacaagaaagtcaacaggtacctgtagagactagtcaagttgtacaaccttctgaagttaaagaaccaagtacaggtgcacctagtccagctactcaaacggtcgaacctgtttctactgagctacccaaagtagaaccaactgtagttcctgaaagtcctaaacaagttcctgaaactcaagccgatctgccaaaagctgtagattcgtctaaagaatctactggtaccgtaactgctcagtcagtaagtgaaaaaccactcacagaacctcaaaccgtagtttcccaatctccagaaaaaccagaagaacaaaaaccaacaacagaggatcttaaaagcccagaagtcgtaagcgatagtcctcaggcagcaacacaagagcctgttaaggaggctcccaaagactctacacaggaagttcaacaagaaactcccaaatctccagaggaggctaaaaaagtaacacctgcagaatctccaaaggaatcacaaaaagaggtacttacacaagctcctacggaggctccaaaagaagtgcctcaggtacaaccaaaagcagttgtagaagcacctaaagaacctcccaaggaagctcctaaagaagcaccgaaagaatcccctaaggaagcaccgaaagaatcccctaaggaagcgccgaaagaatcccctaaagatgcgccgaaagaaacccctgctcaaaaagaagcgccgaaagaaacccctgctcaaaaagaagtacgagtatctaaagaatcacctaaggcagctcaaaaagatgcgccaaaacagtctcctaaggagacacaaaaagattcaccaaaggaatctccaaaagaacctgaaaaacctgcacctaaagcatcgacacctaagcaatctcctgcatctaaaaaaggtaaaaaggatactcctaaagaagaatctaaacaaaaagagactgctgaattacctagttccaagtaacagaacctacacctcccacgacacccgtctctccccctgtatcacaagaatctagttcccctagtccgtttctaaagcagaactacaagttaacgccagtgtaccagaaacaccacctccagccccttcaacagaagccgcaaaaggccctactcctc

SEQ ID NO: 2772 - DNA, 1096 bp, Diabrotica virgifera
ttcgtgcggtgaatgtacattgaccacagagacgattgtactttccgacatttttgcctaatttgaaattctcgctccgccgcagttttcaaatgtcgatgacgctgtttttgttgtgattcgctattcgctttcggcatttgactgggagaatattgagataagcaacgttaacatccatgaccttttttacaaaactgacaacgatataatagttccttgatcggatagaatatgtatctagtttgatgctgaacttcaaccagtaagatggcaaccgaaaaacactcacctagtggaaaccaaattgtgataacagtgatagaagtgataggttttttgctgtattctcttgcgctaatcgtcaccgctatttacaaagcctgtttaccgtcagcttatcaacataggaaaaatataaatggcaaaatttctttaattacgggtggaggaggaggactaggaagattactggctctcagattggctagactgggatcaactgtggtattatgggatgtgaatgaaaaagctgtggaggaaaccgtaggattagtaaaaggagtaggtggaaaagcctatggatacaaatgtgatttagctgataaggaagatgtatatagagtagctaagaaaacccaagaagaagttggggatgtttctgttttaattaacaatgctggtgtagtatctggacacacgttgctcaataccccagaccatttaataaaaaggacgtttgacgtaaacgtggtagctcatttttggactgttaaagcgttcttacccaagatgatagaaaaggacaacggtcacataataacaatagcctcccttgctggccacattggagtaccaaaattagtagactattgctcgtcaaagtacgctgctattggtttcgatgagtccttaaaaatagaattggaaaaccagggtattaaaggtgtaaaaacaacagtagtttgtccttatttcattcatcaaacgggaatgttcgaggacgttattctctattccttcgaagactgaaagcaatcgatgtaaatggcagtactatcgatgctttatagatacatcaacatacagaaattgt

SEQ ID NO: 2773 - DNA, 2022 bp, Diabrotica virgifera
  misc_feature (1916)..(1916): n is a, c, g, or t
  misc_feature (1988)..(1988): n is a, c, g, or t
cgtagcattcttgatttctcattacacgtcctagatattctaattttttcgttacgatggtcacgagaatttcacactctttccccattttacgcagtacttctacattagtaattcggtcaacccaggatatacgtaagatgcgcctataacaccacatttcgaaagcttcggaccgattcatagatgcaacagttagtgtccacgcttccattccgtaaagcagaactgtgaacatgtagcatttcaacagacggtattttgtttttaatgatatgtctagactattgaaaatgggtctcattctaacgaatgctgcttttgcttttattattcactgtttaatttctgttgagtggtcccattggctatttaaattggtgcctagatatgtatatggctacactctttcaatattctgttgtttgattgtaagttgagcgtttagtatgattttcctaaactaggtaaaaaacacattgatttgatacctatatcatatgcaataaatcaaaaattcgattttttgactttgaggtcggttgatatcgaaatggtttttaaatttggattcaggagacaaactgcataagaatccatcgtagatcgactcacaagtatttcaggggcggcgatgtacaaacgaacgaatcaacgaacagactttgcgaatttatatacgaaaacgaagttttcgttgaaaataaatgaattcatcgattaagctgtccttagtagcaaagtaatgtaaagcatgtagtgctatcaaacgctgtattgcgtatgccagtggcggctcgtatcactttaagtaggtagtgccagaattcgggcagctgcctaaatttttagtgacgtgttcacaatattgtcaaaaaaggtataaaatagaaattaaaaaaaataggtacggatatttttacattatgtaggtatataccatttctggggtgtcaagaaatttaaacatttaaaatgcattcagtgattgatttgacatcatgtccgtccaacaagtaaaatctccaaaatctctcaacttgtcgccttttacacaaatatcgcaaaactataactaactgaaattcaccagcgacgcgacgtctgtcgtttcatcggcaatcactgcaacacaaagataattttcaatttctttccttatttcctcgtgataaacatctaagatgcactgaaggagttcattttgtgttgttttgaggtacatgcttttaaagatttggaactttgaatattaaccgaagtcgttgtctaattcggctaacattgaacagttccataaagatgcctatattttctgaattttccttttcgtcgtgatttctcaaaactaactcgaaagctccacaaaaccatatacttagatataatttttaatttgattcaaaacatatcgattcttaatccacttcttgttcattgtgtttaattagactatcacgataagctgaatttaactcgggttttattaaaaattttaaattacttaaaaatataatagtttagaataaaaagtttaatcattaaaaatgtaataattataaatacaaaaacgagcgagcgagcgcgtaaaaaaactcgaaaagataatgtaggtactaccctgtacgagaagctttttggatctgatctacgatccactattcactatgatgagcatagtaaaaaatattagatcttcctgccttgtcgggccaggcacgaatagtttcatttaaacgtgtattaaaagtgcaatatagctctatctctgtcacttacatagaatgcccgtaaaatctttctcttttcagctgagccatctaagcttttggcacgatgcgatgcgatcatcccgtccgctgtctgtgagtggcgagggttgtactacactgcacagttgccagattttatataantttataagagaaaagaaatacgcacaaaaaatggaacgggcattaaaacgggtttaagataaaaaaaatatngttctgcataaaaataggtagtgtcatggcacta

SEQ ID NO: 2774 - DNA, 1673 bp, Diabrotica virgifera
caacaaactcccaccataataaacacaacgcatacccaccacagataacatctcgacatttagatatttatctaagtatcgcttagaaataaaaaacggtggaaatggtacctatcaggcagtcgacttaattgatcagctagtgaaagttttgttttggtgaatgattgattattgatagtgctggtgtgtgttgacagaaattatttatttataatggatcgaagtctgcgaaatgttatgctactagggctagcatttatgctggtttttacggcatttcaaactatgtctaatatacagcaaactataacagacagtatagtaaaagatgatccaacatatgacggagacgcatactacagtcaggctatcatatatggattcttctcgctatttaactggtcagcgccatcagttgttagtataattggtcctaagttttcaatgttcctagggggtacagtttatgttgccttcatactacagttcctagctccaaaagcatggggaatgtatttgtgtagtgccttattgggtataggagccgctatgatttggactggtcaaggcaattatttaactttaaactctacgaagaaatacatcacaagaaattcgggaatattttgggcgttacttcagttaagtatgtttgttggaaatacgttcgtcttctttgcttttaaaggaaagacagaagtagataagagcacaagaacattcgtgatcatcacgttggctgcagttggcgctgttggactgatagttctattcgtgctaccgaaagcttttaaagaagaagaagacgaggaagaggaagtagaagaagcgaagccacaaggcccagtggaagctttcctcggatcagtgagactgtttttcacgatgaggatgtttttgctcaatttcgcgtttttgtatacaggtttggaattgggattcttcagtgcgatatatagttcatgccttggatttaccaaaaattttgaaaatcgtaaagaacttgttgggatatctgggatatttatgggactaggagaggttctaggtggtggaattttcggaatattcggtcacaaaaccgtgaaatggggaagagatcccgtagtaagcactggattcctgttacatatcctagcattcgtactaatatttttgaatttgcctaacaactcgccatttgcagacactgatgatagcgcaattataaccagcaacgccattttagctatattttgctcattccttctaggattgggagactctatttataatactcagatattctcgcttttgggaaccgtatacgctgataatagcgctccagcttttgccatatttaaattcagccagtctcttggagcagttatcaccttcgtttcagccaaatctcttggacttcattaccagctagccatcttgctggtcatgtcagtactaggtactttatgtttcattaaggtggaatggtacgccaagaagaaagctgctttgttgtcgagccgaaaagagcgggaagagcgaagaagcgttgaccggtccagaatgagacaaatagaagatttttagtgaatgtgattttaattgtatattttgtttggacgattttttacgagaaatgtcaaatatttttttaaataaagaatttatttttaaaaaaaaaaaaagga

SEQ ID NO: 2775 - DNA, 895 bp, Diabrotica virgifera
cgcccgcccgccggttcgttcggtcgcgtggggttgtgaaccgtgaaagtcgccttggtaaaaaatctgcacagttcaaagcaagccgataaaaattgcgacctttttcaaaatgaaaacttcaacaaaaagattaacaataggtgctgcgatcgtgactgttatagttatcgtcatagttgtagtagtattggtgataaacaagaggaatgaaggaaaaagggttggcgcagtgggtagcagtggtcatggctgtgcagaaattggggtatccatattgaaaaaaggtggaaatgccatcgattcgactattgcaacactattttgtgaaggcgtgatgttgtcggaaagtatgggattgggtggtggattcttcctggtgctatataataaaacaacaggagaaacctgggcattggatgccagggaaacagcacctgctgcttcaagagaagacatgtacttgggtcaaccatccaacgcttctttaagaggaggaaaatccgtagcagtacctggtgaacttaggggatattgggaactatacaaaaggtttggtggtggtcttccatggaaggatttaatccagcccacaatcgatatctgcaaaaatggacaatatgtaaccaaacacttacattctagatttattatgagaaaacaattactatggaatgaccctattatgagggacacattctttgataagaagactaatgatacatataaaataggtcaatatttcaagagaccaagaatggcaaaaactttggaaaataatcgctaaagaagggggtgacgcattacacaacggttcacttacagcagcatttgtaaaagatattgcagataagggaggataataactatcgaaatatgaataatacagacccct

SEQ ID NO: 2776 - DNA, 1091 bp, Diabrotica virgifera
agaaaacggtggaagtcttggttggtaaatgtaacatctgttcactaactcctgttgtttatcacattgttgaaaatagcatacgattgctttcaacagcaatctatgcttgtagcaaacatataatttaagtttattattttagttttctagtgtgccattacttttttccaagatatatagatataacttttatatatattttttagttaataaggttgtttctaggaacttagaattagatgtcaatgaaatttttgatgtcaaattagtcccatcccttctgtcagaagttatttccttaatcgtgtattagtatcctaatattttagaagtatttgatattaaactagttaagatactgcttgaacaatgaatattggaattaatggaaatagaacaatatgtaaatttaacctcaaaggaatgtgcagatttggcacaagatgttggaacgtacatgagattcctgaaaagagccctcacaagattatagaaaaatatgagccaaatgaagaagacggagcttgtgctcttcctcttattaaagaaacagaactgtcacctaagaattatggacctggtacatctacaacagaaactgctataaatttggttaagaaggtatcagaatctgaagaaaaagtctgtggtatttgttttgatatagttttaaaaaaatcaaggtctcagcaaacatttggtatccttcctaattgtaatcactgcttctgttttacgtgtataagaaagtggagacaaagtaaagaatttgaatttgaagtgtcaaaagcttgtccagaatgtagaattacatcagattttgtctatccttcagaatgtggatcgaaacaaaagaagaaaaattaaacttcatagatggccaaagacataaaatgaaaaaacaagactgtaaaaatttccgccaggggcaggaaaaggtcccgtttggaatacttggttaaaatttccttgcctatcaaagggaaaagtggtagaagaaggccccccaaactaaaaaacaaaaggggggggggggaaaaaaaaaaaaaaccaaaaaaaaattaaaaaaattggtatgggggaagggg

SEQ ID NO: 2777 - DNA, 1157 bp, Diabrotica virgifera
gcattacaaacgatttttgaggttgtcggctagaagttcgcaaagtaaatctaaattccaacaattaaaccgaaatagttctttaaaaaagatgtttcgaaaccaatacgatagtgatgtgacagtgtggagcccccagggccgtctgcatcaggtagaatatgccatggaagcagttaacctaggttcagccacagtgggactgaaaagtaaaactcatgctgtacttatcgctttgaagagggcttcttcagaactgtctgcctaccagaagaaaattatcaacatagacgatcacattggtatcaccatctcgggacttacagctgatgctaggatccttagtagatatatgcgaaacgaatgcttgaattataagtactctttggatacttatatgccattgaataggcttatcagtattttaggtaacaaaatgcagacatgtacccaaagatacgaccgcagaccattcggtgtaggtcttctagtagctggttatgacgaatctggttctcatatctaccaaacgtgcccttctgctaatttctacgattgcaaagctatgtccattggagctcgatcccagagtgccaggacatacttagaaaaacatctggatgaattgccatctagttctttagaagaacttatcaaacatggattgagggctcttagagatactctacctccagaggttgacctcacaactaaaaatgtctccataggctacactggaaaaggtcagaccttcaaaatccttgaagaagaagaaacttccccctacttgtcccttattgagggtgaagaacgtagaggaggaggagctgcagctgctgcaattgaggaccttcctgcagatccattgagagatgatgcgggggacgagcccagggatgcagtcccagctgtggaaactttctgcatggatacacagaatagaaggattagatacagcattaaagcccccggtgatcaggaaagtgggtattgaaagggaatattgccggggttggtttttgttattttaaaaaaaactgaaaaagtcccgggaaaaaacatcgttttggtttatttcataactgggtttttttttaaacttttttaaataaatattttttgtattaaataaaaatttaaaaaatttcccttttctt

SEQ ID NO: 2778 - DNA, 1277 bp, Diabrotica virgifera
aaaaatcctgatcacatgctttaaatttacaatcagtgcgacaaagcccaatttaaccgacatcaaaattaggcggctactgagatgatcaacaatcaagtagtagctactagcacaactctagtagccggagctgcggttctagcttacctcggattccacttttttcaaaagaggaaggctgtgaaaataccgacaaaatgggaagaaataggttcagtatctggactatatttatatccattgaagagtggtcaccgaaaggagctaagtcaagccgaatgtacccgtcttggtttaaaacagactgaagaggatgaaaaagtacttcaattaagagacaggggtttagtagtatacacagaaaaagataaagaatttagaacagctagaacatatcctcaactcctacagatagacatatctgtacacgatgagaatcattttgctttggatgctcctaccatgaggactctctatgttaaaattcccagcaaagaaactaataaatctgttaccatcacgctacatgtaaaagaaccttgtagagcgatcgattgtggagatgaagcagcaacttggttatccagactaattttacaaaaacccactggtctacggttagggtttcatgatggtatttacaaaagggatattgagaaggcacacaaagaggatatatcattttatacaagtgtttcaaatttctctgcaggactatatccggatcttactagtatgtctttaataaaccagcgatcaatagacgacttggttaaaagatagggaatggtacagtaagcgttcccaattttaggcctaacttagttgggaacggcccccccatgaaagctttggacaaaacattggggaagggccaaaatggcgaccttattatgaaaaaggtaaaaaaagccccaaatggtggttgactaccccaaaccccaacctaaccataaaaaatatttttatggaaccctttgatttacattaaaaacttacccgaaaggggaagggccccgggggttttttggaaattttggggggcccttttgggaaataaaacaaacagggtatcaaaaaactttggggggaatcgtgtaatactttttaataaaaaggaaaagggggggcaccaaaaaaaaaacccttgtttgggggggttctacacaaatccggtgaatataatttggggtgtaaagggctttaatacataaatatttttttataaaaaaaaaatcaacccaaaaaaattattattattttgtcgctaatac

SEQ ID NO: 2779 - DNA, 426 bp, Diabrotica virgifera
acccacgcgtccgctgtttcggggtttttccttgaagtcgccggtttgcgaagtcacgaacttgttcctttcatttgcaccatactgtatacacatgcaacggtggaaggtggtgtctcgcactcgtgattagaaattgaaaagcgaaggagttctgaatgttgtattgcaaaaggactcttcgggatttcatcaatcgatgtttgaagagtgtctacctaccttggcagcattcaaattttgagtttttcacgtggtttttgagggttggaaatggccgatttcgcaatttttcggtttttgatcgcttgtatgtcagaagctatcaactttagagaggagtcactggagaccttttctgtttggaatgatccaagaaacctgaagggactttgttccatgcagaaaaataataagggaaaaacg

SEQ ID NO: 2780 - DNA, 1792 bp, Diabrotica virgifera
atccacgtgtcgcgagcggcggcccttttttttttttttatgttattctagttcagtcgtaaaaagtcgatcaaatagtggtagtttcattgcaataaagatttattgtgttgttattaaaatattcctaacctttaatttaacgcaacaatatgagtaacgtaaatattgaagatactattaaaaaatcaaaaagtaacctatctttttggtcgcctttaaacgatagttttaacccccctaataaaaaatcaaggtgcagttggcataaaaatgctagcagggagtcaacacctcatacaacacaagactggaaacgcacgaccaaaattctgcctaacgcactggaagcaattggaaatacccctctcataaaattaaataggattccacaagctgaaggactgaaatgcgatgtctatgtaaaatgcgaatttttcaatccaggaggctcggttaaagacagaattggcaaaagacttatcgaagatgctgaaaagcagggtctgctcaaaccaggctacaccatcatcgaaccatcttctggaaatactggaataggtctagctttagcggcagctatcaaaggttatagatgcataatagtgatgtctgaaaaaatgtcaaacgagaaagtgtctgttttgtctgcacttggagctgaaatcgttcgtacaccggtaaatgccgattcaaattctgctgaagggatgtttggagttactcatagacttaggaaagaaatacccaattctataattttggatcagtattcaaatccaggaaaccctttagcacactacgacaccacagcggaagaaatttacttccagtgcgacaaaaacgttgacatgattgttataggcgcaggcacagggggcaccatagcaggtattggaagaaaattcaaagaaatatctccccaaacaacgatcgttggagctgacccagtaggatcgatcttagctcaaccagagtctttgaataacacagatgctggcttctacgaggtggaaggtataggatacgacttcatacctaccgttttagatcgagatgtggtcgacgtgtgggtgaagacaaccgaccaggagtcgctgcctttggctagaaggcttataaaagaagaggggttattagtaggttcaagttgtggtgcagcaatagcagctacaattaaagcagcgaaaaatctagaagcaggaaaaaaagtggtggtaatcatgccagatagtatcagaaattatataacgaaatttgcctctgaccaatggatggaagctagagatctaatgacgcctgtcaacactatgaaccattggtggtgggacaaaaaatattttggagctagatctgcctacattgcacgtagctacctgagagtatgacttgcgaaaggattttaaaatatgatgaaaaagggctgggatagatcaaacacctgttcgtgatagtgcaggaaatatggtgggggatgttaacgttacagaattttgatggcagggcctacttaaaaggaccataaaattcttaccgaaacggggggaaccaatgggggggggcaattttatcctaaaagttaaaaaaacagcaaagcaattcggtctttattttcaaaaaaattttggaaaaaaaaaacttttttgttgtgaatttctcgattccaaaagaacttgtttaaaaagccccttggggaaaaaataacctggatttggaattttcttaaaaaaaaatatttccaccaaaaaaaaaaaacaaataaaaaaaacaaaaaattttttcttgaaattaa

SEQ ID NO: 2781 - DNA, 1065 bp, Diabrotica virgifera
  misc_feature (955)..(955): n is a, c, g, or t
  misc_feature (1053)..(1053): n is a, c, g, or t
ccgggccgacccacgagtccacccacgcgtctgcggacgcgtgggcgcgaacaggcgagaaaagacctcaaaggactcgaagacactgtcgccaaagaactacagactctgcacaacctgagaaaattgttcgtgcaagatttgcaggcacgtatgaagaaaaatctttcgtcggaagacaatgaggaagacggcggctctctggctcaaaaacagaagatatcgttcctcgaaaacaatctcgatcaattgacaaaagtccacaagcagttggtacgagacaacgcggatctgcgctgtgaacttcccaaactcgaaaagagactacgagctacgatggaaagagtcaaagcactggaaactgcactgaaggaagccaaagaaggcgcgatgagagaccggaaaagataccaatacgaggttgaccgcattaaagaggctgtgaggcagaagaacctcgcaagaagaggcccagcagccacaatcgctaaaccaatcagggcagggcaacacaacacggttaacgtagctggtaaccccgtcattagaactggaggcatcaacatggccaacagatcgaccgacgaccagaaacgtaggtctgttattggtggagataaagattgagtcgccagccatcttgtcaggtgcttgagacgtttttagtaagcaaaatccataaaactgtaataccaaaaatattgccgatacttcgcgcgagtctgtcgccagcagtttttggaacagacaagaaaaaaaattgctcctccagactcgctcttcaatgtgcttacagcttagatatttctgtagtataaggtgcacttcattgcattgaaaatgaaacaaattaatcgagtattgtaacagattgttggcaaattgttttaataaatcgttcattttttgttttcgatcacttctagcttcctgtcgaattaagtgttaacactanaaaacaatttgcttgctgttttatccttaaaacgttgcaacgtttacggcgattttttgagttaggtaattctaatttttgtaccgcgtttttatttnaactgaggtact

SEQ ID NO: 2782 - DNA, 287 bp, Diabrotica virgifera
agcacattatatcttcaaaccagtacctttctttacctaggttatcgtctcaagccgttttagaagcgctatgtcccgaagagtttaataaacccagaaagaggctgtgcgttgttttagtaacaacgtcttcttcgtattatctcccttacagacaatcatatttatattttgcacaacagtcgccttacagtgtcaaaaaagtgaaattggttaacattaattacaacaaacagtcagagttggttaattcttaatggcaaaaaggtgaaataataaagccttaa

SEQ ID NO: 2783 - DNA, 877 bp, Diabrotica virgifera
gaaaaatattggattcttgatgctcgaaatttggttagaagaataatacataattgtattgtttgctttaaatatagttgtgttccattgcaacctctaatgggtgaactcccaccagaaagagtaactccgactcgaccattttataatacaggagtagattatgctggtcctttcctgataagagatcgaattacaaaaccctataaaagtgtaaaagcgtatatttgtctttttgtctgcatggccacgaaggctgttcatcttgaacttgtaggggaccttactacgcactcgtttttgtcagccttgagaagattttcttctagacgaggcaaaccttccgtaattttttcggataatggtaccaattttgtaggtgcctataaggagcttggttcgtttcttaaacaagccaataaaacaataaatattaaattatcacttgaaggtatatcgtggaaatttataccggctaaagcacctcattttgggggattatgggaacggggtatcaaatcggtcaagtttcatttgaaaagagttgttggaaccaatgtcttgtcctatgaacaatttttaactgtgttgatccaaatagagggaattctgaattccagacctttgcatccgttgtcatcagaccccaatgatactgcaccacttactccatcacactttctcattggggaagctattacaagcattccggaccaaaattatttgaacgtgcctagcaacagacttaagcatttccagcttattcaagcgatcacccagaagttttggtctcaatggtccagagactacattagtcaacttcaaactcgagtgaaatggaaaactaatgcaccgaatcttcttcaacctggagctt

SEQ ID NO: 2784 - DNA, 875 bp, Diabrotica virgifera
tcgcgggtcgatacacgccatctgagtcgtattgtgaccttcgttttagtttaatagcattaataaacacttcaacgacaataatatttgtcattcatccttatcaaaggttacttccacgtatttaataatttgtatgatatttattgatattgtaaaagtaagaagaaccggtaataattattattaataattaagaaaatggcaagaataatcatatttggttgcactggaatgaccggcatttgtgctgtagaagctgctgtaaagaaaggactaaatgtaaaggccttcgttagagatccagcaagactacccgagcatttaagaaacagtgttgaagttgtcacaggaaatgtcctggactacaaatccgtattggatggcataaaaggtgtgtctggagtagtggtagccctgggcacaaataatgatttgaaacctaccactgatttgagcacaggattgcaaaatattattaaagccatgaaagaactgaatgtcgacacaatttcagtgtgtctatctgcctttttgttctacgaagctggtaaagtgccaccaagattccaggatttaaatgctgagcatcaacgaatgtatgatgtgctaaaggtctccgggctaaaatatattgctggtttccccccccacatagcagatgaacctttaggggaagatgccacaaacacgatgctgttccaggagcccgaagtattttaaacgcagtttgggagatttttaagtgatcccctcatcacctggaaattacggaaaagttgcggaattcgaaataaaaaccccaaaaaaaatactttatttagagccaaagtaataaaggactgtattttgaaaattttattaagtccctgggg

SEQ ID NO: 2785 - DNA, 707 bp, Diabrotica virgifera
gaaggaaggtccacaaggccccccaattccggattaatccaccaaaaaaggccaagaaggttaaaagaacgtcaatttccaaaaccaccttgtaaactttggtaaccaaatcagcggccaaaaagaaagaatttgtgaaggtcttataaaattaaatgcgccaatattgctttatgttattgacaatacgccagaattaactggacaagacatttgtggcatatctttacaagactatggttgtaatggatctaaacgacttgaatggagtattgatataccaccaaaaaccaatattaaacaaaatgagacaccagcaactgaaaatacaacatcattcaacatccttcatatctcggatatccactatgatccgaggtataccactaacaaaaccaccaaatgtggagaaccaatttgctgtcaagatgaccaagcggatggtacaacggaaaaggatacttgtgggtattggggtagttatacaaattcagatataccgtggaggactgcaatcaatgctttagaacaaactaagttgcacaaatacgattatgtgtacttcactggagatattgttgctcacagaatatggaatacaagcttggaagaaaacactagagttatatcccaagtattagatacgtttgctgatatttacaatgtccctgttttcccaccgtttggttattatcgaacgcatcctt

SEQ ID NO: 2786 - DNA, 688 bp, Diabrotica virgifera
acggaagacacgttgagaggtgcatttgcaggatgagttccttaaaacttcagaagaggctagcagcctctgttatgcgatgtggtaaaaagaaagtatggttggaccctaatgaaatcaacgaaattgccaacactaactcaagacagaacatccgtaagttgataaaggatggtcttattattaagaagcccgtagctgtacattcccgtgcccgtgttcgcaaaaacactgaagcccgcaggaaaggaaggcactgcggttttggtaaaaggaagggtactgctaatgcccgtaccccacaaaaggaattatggattcaacgcatgagagttttgcgtcgtctccttaaaaaatacagggaagctaaaaaaattgacagacatctataccactcactctacatgaaggccaagggtaacgtattcaagaacaagcgtgtccttatggaatacatccacaagaagaaggcagagaaagcccgtgccaagatgttggcagaccaggccaatgccagaaggatgaaggtaaaacaggctagagaaagacgtgaggaacgtatcgccacaaagaaacaagaagttttgcagaactacatgagggaggatgaagctgcggccactaagaaataagttaattgttttataagatgactatattaaaaatttaaaaaataaaaaaaaaaaaa

SEQ ID NO: 2787 - DNA, 811 bp, Diabrotica virgifera
aaattcttttacggaagacacgttgagaggtgcatttgcacgatgagttccttaaaacttcagaagaggctagcagcctctgttatgcgatgtggtaaaaagaaagtatggttggaccctaatgaaatcaacgaaattgccaacactaactcaagacagaacatccgtaagttgataaaggatggtcttattattaagaagcccgtagctgtacattcccgtgcccgtgttcgcaaaaacactgaagcccgcaggaaaggaaggcactgcggttttggtaaaaggaagggtactgctaatgcccgtaccccacaaaaggaattatggattcaacgcatgagagttttgcgtcgtctccttaaaaaatacagggaagctaaaaaaattgacagacatctataccactcactctacatgaaggccaagggtaacgtattcaagaacaagcgtgtccttatggaatacatccacatgtagagagcctgtcattgctgtctaaattcgtttatagttttttaaatacgacaattgttttttatctctaggcctacggtaaagactgtctaatttgtacatagttggtaatatagaataaaatgtaaaatcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggaaaaaaaaaaaagggggggggccccctaaaaagaaacaaatttaaaaaccggggggggggaaatttaattttttttt

SEQ ID NO: 2788 - DNA, 953 bp, Diabrotica virgifera
  misc_feature (882)..(885): n is a, c, g, or t
catgcatgtctcagtacaagccaaattaaggtgaaaccgcgaaaggctcattaaatcagttatggttccttagatcgtacccacatttacttggataactgtggtaattctagagctaatacatgcaaacagagctccaaccggagacggaaggagcgcttttattagatcaaaaccaatcggtggcgggttcgctcgtcatcgtataacttggtgactctgaataactttaagctgatcgcacggtctcgcaccggcgacgcatctttcaaatgtctgccttatcaactgtcgatggtaggttctgcgcctaccatggttgtaacgggtaacggggaatcagggttcgattccggagagggagcctgagaaacggctaccacatccaaggaaggcactgcggttttggtaaaaggaagggtactgctaatgcccgtaccccacaaaaggaattatggattcaacgcatgagagttttgcgtcgtctccttaaaaaatacagggaagctaaaaaaattgacagacatctataccactcactctacatgaaggccaagggtaacgtattcaagaacaagcgtgtccttatggaatacatccacaagaagaaggcagagaaagcccgtgccaagatgttggcagaccaggccaatgccagaaggatgaaggtaaaacaggctagagaaagacgtgaggaacgtatcgccacaaagaaacaagaagttttgcagaactacatgagggaggatgaagctgcggccactaagaaataagttaattgttttataagatgactatattaaaaatttaaaaaataaaaaaaaaaaaaaaaaaaaaaaaaaaaaaaaaaaaaaaaaaaaaaaaaaaaaaaaaaaaaaaaannnncggggggggggggggccccccccccccccccctaagggggggggtaaaaaaaacccgggggggggttt

SEQ ID NO: 2789 - DNA, 1647 bp, Diabrotica virgifera
ccatagcggccgggtgcatttgcaggatgagttccttaaaacttcagaagaggctagcagcctctgttatgcgatgtggtaaaaagaaagtatggttggaccctaatgaaatcaacgaaattgccaacactaactcaagacagaacatccgtaagttgataaaggatggtcttattattaagaagcccgtagctgtacattcccgtgcccgtgttcgcaaaaacactgaagcccgcatgaaaagaaggcactgcggttttggtaaaaggaaaggtactgctaatgcccgtaccccacaaaaggaattatggattcaacgcatgagagttttgcgtcgtctccttaaaaaatacaaggaagctaaaaagaagtcttttgacaaacgaaaaattaccgacatttgaaacgatgaaattcgcagttgcatttttggttttggctcttgctgcctgcgcctactcacaggaagagaagccagtattaacaccagaacaagtaattgacctcatcaagcaaaaccaacccgccgtaggttgtatcaatctgcaatgcagactttcatgtagaggccaaggacacagagctggatattgcgctcctgatggaacctgcacatgtatacctgtcattgctgtctaaattcgtttatagttttttaaatacgacaattgttttttatctctaggcctacggtaaagactgtctaatttgtacatagttggtaatatagaataaaatgtaaaatcaataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggccccttaaaaaaaacaaattttaaaacggggggggggggaacaaaattttttttttaggggccccaaaaatttttttccgggggggggtttttaaaaggggggggggggaaaaaccggggggtcccccaattttttccctttggaaaccccccccttttcccccggggggaaaaaaaaaaaagacccccccccccccccccccccccaaatgtgcccccccaaaaaggggaaaggggaccccccccttgaccggcattttaaagccggggggggggggggggttttaaccaaaggggaaccctattatatttttgggggcccctaaagccgccccttttttttttttttttttcttttttttttttctcccaggttggggggtttttttccccggaaagattaaaaaaggggggggcccccctttttgggggtcccttttttttttgttttttaccccccccccccccccccaaaaaattttttttagggggggggggggtccccgtggggggggccccctcccccctaaaaaagggttttttttccctctttgtggcggggggaaccccccctttttttaaataaggagatcttttttgttcccaaacaggaggaaaaaaacacccccccccccccttttctccccccctctttttttttttttttttttttatgagggggtattttttccgcctctttctgcgcgctctttttgttgtgtgaaaaaaaaaaaagaagagggatgtgttttatat

SEQ ID NO: 2790 - DNA, 1449 bp, Diabrotica virgifera
gaacaaacaaatattgacattgctgaagtggctgaacacccatatacttaatttactttttatttgcgcaagtataattagtagacattatgaaaaaacacaaaaaattagctttaaatcctacccacacctctaattctaaaatcaatccagcaaatttaattttgtcgacgatgaagttttagtttttttagatttcaagtattggtgctcctgttgttagaatgctttctttctctaacaatttttgtgctttctctctttccctctctattttccgccattttatttcagctttcttggtgtcgtcacttgtggtgagttgctaaaataaaaatattatattatagagtatataatatataaaaagaatatagtttattataaaagtatcaagattcgttcaaatatgagttacggtagaccaccgccgcgtattgacggcatggtctcattaaaagtcgataatttaacctatcgcacaactccagacgatctaaggcgcgttttcgaaagatgcggcgaagttggcgatatttatataccaagagatcggttcaccagagaaagtagaggctttgctttcgtaaggttctatgacaagagagatgctgaagatgcgttggacgccatggatggcaggatgttggatggaagggagctcagagttcaaatggctcgctatggaaggcctacatcaccccatcggaggtacggtcgtcgccgaagtaggggcagtagaaggagccgctccaggtcacatcgtcggtctttcagtagaagcagatctcgctcagacagcaaaagctccagaggacggtcaagatcgatttccaaggatgaaaaggaaaggtctaagtcactcagcaaatctcgttcaagatctaggtcttaggtgttgcggaaggtgaaggagtgcagtgcagtaaattaggcgcctgctctctaaaggtatttataaattaccacctttgacctaagaacctttttattttatcagattttttgaaagaaacatttcggatgtgttgaaaatgtttgaaaattcagtaaaaatgttttgttttctatgtaacattagtgttttaagaagtattttgtgtttattattgggtgttacttgataccatttggtgtatcaacaaacctagtatttagtgtccctaggaatatattcaaatacatagttcacttaaaatcacttttgacttaatcttacgtaaatgtaggaaaaaataaatcatttaatgatatttgcctaggagactttaacaaaattgtatattgtttaaaatcatttttagcaattttaaaaacaggacgttatactttgaaaatggaactttaggttagtttagttttactgtaattgtaaatcacttggttttatgaaaaatgtggaaaaaaaattccatgagtttttttttttcaattttttgcattggcaat

SEQ ID NO: 2791 - DNA, 939 bp, Diabrotica virgifera
caaacatataattaagttttgataaaaatctttaaccaattttccactctgttgaaaatatgtccaaaagaaactacgatagcgcttttagcgatacaaaatttacaactaaagatactggacgtcaaactaacaaaaaacatactttagatagtgatgaggaagatgacgagattgaagaggataatgtcttaaatactgatgatatcgagggagaggaagacggaatagccagacaagatggagaacaaaaaatgacagcatttaacatgaatgaagaaatggaagaaggtcattttgataaggacggtcattttatttggaacaatgaaaaagaaataaaagacagttggcttgacaacatcgactggcagaaaatttaagaaaacgcaggaaatgacaaaaagtacaaagtatatgaagaaggcttgggtgctgaaagtgattctgaaactgatgacgaacattttgatgaaattggttcatacaaaaaaatgttgaactatatgaatcccaaagagaccgttaataaagcgttaaaacgcttagggggtgctgatatgaaattatcaagtgtagaaaggctaaaacgtaaaaaggctggaactttaactagctctaaagatgttacagacctcactgaactagcaaatgaaattttaacaaagctaggtaatatggatatttatcaggaaacttacgagcatataaaaagtaaagttgacgctagtgaaaataaaaaacagaaagttgtcaaagaagctgaactagatatgtatgctgatgattttgatgagaaggagaagggcaagatagtaacaacttcgagtaacaaagaggaacatgatgatacagatgttcccaaagcaacagcaccattaatgtgggaattcaaatggaaaaatgaggatgaagacgtacaagggacgtattctactt

SEQ ID NO: 2792 - DNA, 869 bp, Diabrotica virgifera
caacaattattttccattatgtctccagtggagtcatcagttgaaccccacttttaccacatcttatcattgtagctttcagttccacgtgtgattagaggattattcttttgttgacgggagatgatttttaatatttttaaatgtttgtcttttgttgattattttagaaacttctggttttgctctcttttctttattgactccaatgtagaaatttacatagtttccgtttatttccttttcttgtcgtttccaggttatttagcgactcgctatcatgttgaatgttgatagttcattatagacctcagaatcatctgatgtcttcttcttttcccatcaagtattttgtcaatgaaatgatcatatctgtcgtatcggaggtaattatttaacagtcccgatagaagtctgtggacctgatgattttcatggtgttttgtacgttcataagtaatattgcgctacttctatatgaaaattcaactgagaaaaccaacaaattttcgacatattacccatgcaatatcattttttgcacgattgatcatttttgactgtttaccgtgacagattttacgtcagtaggtgacatttactagcaactcgacggtaagtaatccaactcgacggtaagtactccaactcgacggtaagtaattcacttaccgacgagttaaaaaatctcttaattttaatttattttttgatagaataaagaaaactaacgaattatttattaatattgaaacttatggtacaatttgataaattattttgcagaatttctaagtatggaattatatcgtctggattataacgactgtacgagtacgctggatagtcgtttatgtattgagtacttt

SEQ ID NO: 2793 - DNA, 2610 bp, Diabrotica virgifera
gacccacgcgtccgctcccgaaaaattgaaacatatccactctaattactcgcagtgtttttctacttttttctcttgaaattgaatattttcacgaggataatcgaacgctcacgaatggacgcttcttctcttctggcacccaccagatttgtaaattttagatctatgttaatttaattgtttcagtcttgtgaacacttttagctaggatttgtaaggctgaaaagaccagcgaagttatcactcacagcgaagttcacgaaaaagtaaccagtacacagaccactaaacagcaagtatttaggccagtcgaacttagtaaaatcccattgctcagtaccggaggaaacgtaacagccgaaataaagatgcccagcggaaacattgacaaaccaattatcgaagacaatcgtgatggtactgtaacaattaaatacgatcctcgtgaagaaggtgttcacgaacttgctgtgaaattcaatggagaacatgtacaaggttctccatacaaaatccacgtagactcaattagttctggttacgtaactgcttacggtcccggtcttacccatggcgttactggagaacccagcaacttcactatttccaccaaaggagccggagctgggggcttgtcgatggccgtagaaggtcccagtaaagctgaaatcagttgtcatgacaataaagatggtaccgtgtcggtatcgtaccttcccacagctcctggagagtacaagatttcagttagatttggagacaaacatattaaaggatctccattcaatgctaaaatcaccggagaaggcagaaaaaggaaccaaatctctgtgggttcatgtagcgaagtatccttacctggtggtaaaatctctgacgcagatatcagatcccttaacgcttccattcaagcacctagtggtttagaagaaccatgtttccttaagcgacttcccacgggaaacatcggcatatcatttacccccagagaaataggagaacacgtagtaagcgtaaagaaaatgggcaaccacattacgaattccccattcaaaattaatgtttgtgaaagagaggtaggagacgccagaaaagttaaagtaactggtagtgccctaaaagatggcaaaactcatcaagataacacctttaccgtcgacaccaggaacgctggtttcggtgggttatcactatcaattgaaggacctagtaaagctgaaatacaatgtaatgataacacagatggcacattaaacatttcatacaaaccgactgaacctggatattatattgtaaatcttaaattcgccgatcatcatttggatggatcaccattcactgttaaggtcactggtgaaggttcaaacagacaacgtgagaagatccaaaggcagagggaagctgtaccagtcactgaagtcggtagccagtgtaaattgacattcaaaatgcctggcatcacttcatttgatttaagcgctactgtaacgtcacctggtggtgtaacagaagatgcagaaattaatgaagtcaaagatgggttgtatgctgtccacttcgtacccaaagaattaggagttcacactgtctcagtcagatacaaggacattcatatacctggctctccattccaatttactgtaggtccatacagagatcacggagctcacttggtaaaagcaggaggtgctggcttagaaagaggtgaacaaggtgaactaaacgaatttaatgtctggactagagaagctggcagtggtcaattggccatttcagttgaaggacctagcaaagctgagatcaacttctctgaccgcaaagatggttcgtgcgatgtttcatacaaagtatcagaacccggtgaataccgcattggcttgaagttcaacgacgagcatgttccagactcaccattcaaagtatacatttcacctgctgtaggagacgctcatttactcgaagtggctcaattcccagaaggttgtatccaagcagacaaaccatctcaatttattgttagaagaaatggagccaagggagacttggacgccaaaattatcggcccctcaggacatgaagacgattgctttgttcaaatcattgatatggaagaatactccatccgattcatgccaagagaaaacggtattcacaaaattcacgcgaaccttaatggagtacatatacctggatctccattcagtgttaaagttggtaaggacactgctgaccccagctgctgtccacgcgagcggaaatggactaaaggaagttaaaatctggtgtaaagacccattttattgttgataccgtgaatggtggtagtggcaccttaagcggaaacattgacggtccaagtaaagaaccgatggattgccagaagtagaggaaggaatacaaagtcaaataccctccattagcccccaggagactactactttagtatttaaatataacaatccaccatattgtcggttcccccctttcaaagaaacaaagtaaaaggagaaaaaaaggtcagcacatttttggtgggcaggaaatcatttttcacggtggggaaaaaaccgataccccaaacaggaaaaaaaccaataacaaaccaaa

SEQ ID NO: 2794 - DNA, 1443 bp, Diabrotica virgifera
  misc_feature (1338)..(1338): n is a, c, g, or t
  misc_feature (1379)..(1379): n is a, c, g, or t
atcagttagaaccaaggaaattaggaatcatgttctgcgctaatagacctagtaccatcttctctttggactttgatggtaatttcgttagcttaccccttcctggaaaagccgtgaaatctccaatattttctcccaagggcgactatattttatggcttcaaagaaactcgggtggacctcatgcctctgcgatggaattagttaaggctagtgttcctttgaatgaaaatacagtcagtaaggtagtaattgatattgtggataccgagaaaaaaatagaaggtggtaaattgttttacggtttatacaacacaggattttttagaagaccatgggcgagcaatgaccgactaatacttaatactaaccaaaagtatacaataaattcatatgttgtaaatattaatactggctcattaacacagctggaatataatgagggcagcttaagggtactggacgttcatgaagatacaattcttgctgtcaacagacattttctgaagcccgacaaaatcatactgggtaaattgcctgcgccaaaccaggaggctactattgtctgggaggagctcacaactagtgaaaccgtacccggcctagaaaactcgaaatatgaatatttggaccttaaagcaccagaaggtgattttaaagatttcaatgccatttatattggccccaaaagtggtagcaaccattccgtccctctgatagtttggcctcacggaggacctcattctgtctttggaaactatttgtttttagaagaagctatgtacttgctaagcggttttgcagttctattaatcaatttcagaggttcgttgggttctggacaaaaaagtgttgactatctgccaaaaaaagttggaacagccgacgttaaagactgcatccaagctaccgacgaagcattggcccgatacccttggttgaatcctaaacagttagcattggctggtggttcgcatggcggatttttagttgctcaccttagtggacagtatcctgataaatataaggttgttgttgcaagaaatccggtgatagatgttgcttccatgagcattaattcagacatacctgactggtgtttcgttgaaggaggaaaggagtatactcaaaagggagagattgacaatgatgcacttacttttatgcgtcaagtatctcctatcgttcacatgcacaaagtaaaagctcccactttacttcaaattggttcgaaagatttgagagtaccaccgcaacaaggtatagagtaccatttgcgacttaaggcgaatgttgtcgttacgagaatgaattatacgatgacaatcacccactggngaagtgtccaaatgaatttgataccctaatcaatcgatganttggattgaaaagcatttaggaattgaggattaagactatatcattttcctatatttgaatttt

SEQ ID NO: 2795 - DNA, 1107 bp, Diabrotica virgifera
ctgagaagagaccaattccacattaaaaatgaagatttattttattttaccgattgttgcaattacattttttgaagtacaagcttgggtaggaacactaaggtctgatcctggtacagagcatcttggtgactgctattcatcctctgaaggtgtaggtgctatgaaatttggcgaagagaaacgattagaaggagaatgtgttcaattagtctgttcaaaaaatagagatatacaagaaataggatgtggttctgtaggaatagcacctccgtgcaagataatgccaggagatttgtctaagccttatccagactgctgttatgaaatatcctgtcctgcaacaattcctcttcctaaaggaaaggcttaaaaagtccttacttaccgaatatgaactacttgttaactaattgtaaatataagttttctgttagtctgttcaaaaaatagagatatacaagaaataggatgtggttctgtaggaatagcacctccgtgcaagataatgccaggagatttgtctaagccttatccagactgctgttatgaaatatcctgtcctgcaacaattcctcttcctaaaggaaaggcttaaaaagtccttacttaccgaatatgaactacttgttaactaattgtaaatataagttttctgttgtaaaaatttccaaagtttactttgtagttttaagcaatgtgtcactaacggctgtgttctcaactccctattcagcatttcatgtacggaacgccttggccaacgtatttcttatggacatagcgcgccgatgccacgtactgattatgaatatatagtagtagccgcatcactgatctacgctgtcgtcacagattttttgaataaaaaagttggccctcgtttacgttttattggtccataattattcccgatggtacaccgcacgacaaagtaccacacggaaacactacctttaaagttgggcatataacggatatactatgttgatcctttatatacggaggataaagatacagactgtcgtgaccccttatgttgtccaaatgtcaagcagatgccacaataggaacaggatgtttgcgggcattttgatacatattacc

SEQ ID NO: 2796 - DNA, 932 bp, Diabrotica virgifera
  misc_feature (761)..(761): n is a, c, g, or t
  misc_feature (770)..(770): n is a, c, g, or t
  misc_feature (885)..(885): n is a, c, g, or t
cctttccaacagtatcacaagaaaagtaattgccaactgaagatgttcaggtttttcgtactagctactgccttaacaacgatctcagcctcaggatctaagcagcagaagaatgaacccgtagttcttgaaccgtttccagatggctcttacgtttcttacagtcacttcgatgaaaatagcgtaggcggacatggacatggaggcggcgattatgatactggcaaagcaactggtgctgaattggctagccttgctcattcgtcggcggttcaagcaaacaacgccgttcagagtcagcacacagcgggtagccaagcggcatttggtatcaaaagtagtttagctagtgctgcatatggggctgctcaagctgcccaagctgccttggtcggcaaacaagccctagcaggtagcataaagcgacagctcgcggaagctcagcaacagctccaaggtgaaatagcaatatcaacaaactcaagctacggcccaagctgctgagaatactgctcatcaagcccaatcccaacttagtgccttaacagcagccgtaactgctgcccaagcgggcgctcagcaagcgagccaagccgccgccgaagccgcacaagcagcagctgctcagcatgctatggtagtggaagctaaacagcgcataagtcagttatcggcccagcttcaaaactgtttggccgatttacatcaaacagaagccgcagcacagaaagcagctgcggcagctcatcttgcacaatcanatggctgcnggcagctggtgcagctgccgctggacatggtggacatggtggtaaaggatatggaggattcggttccgattatcatcattagtggttagagttttagagttatttttttatattnttttatgatgttttttaatgttttttttgtactacgcttttcataat

SEQ ID NO: 2797 - DNA, 806 bp, Diabrotica virgifera
  misc_feature (670)..(670): n is a, c, g, or t
ctcgcgggtcgatacaagcctctacacagacgtcgtattaacgcgtccgccaaaaccgacaagttttcccgaacggatttgttgctctcaggttggcaaatggtcgaagagaatttccctcttccgattaaaggattaatggaacgaaagtatcagggatacgtgttaaccaaggaaaagtacaaagatgccacgtcgttcagtcctatgtttgctgtcgattgtgaaatgtgtcggacctctacaggtgatttggaattgactaggatttcttgcgtgaacgaaaagctagaagtattttatgacaccttggtgaaacccgacaacgaaatcatcgattacttaacaaaatggtccggtataaataagagtatgatgaaaaacgtgtctaaaaaactgaaagacgtccaagaagatctacaaaaagcgctaccaccggatgcaattctaataggacagtcgttggccaatgatttacacgctcttaagatgatgcatccctatattatagacacaagtgtaatctacaacctgatgggagacagaacaagaaaaacgaaactccaaaccttggcccgagaatatctaaaggaagacatccaagttagtcgcaaaggacattgttcgtcagaagacagtttagcctgcatgaaattggtccagttgcggntaggaaacacctatttttcggagatgctgtgatgggtggcgtaaagaaagacgtcagaacgtacccagagatgggtaccgctcagtacgccacgagtatgttgcgacagtcggtgaaagttgacaagactgccaat

SEQ ID NO: 2798 - DNA, 994 bp, Diabrotica virgifera
tcggtgtcggttagagcgacacccttttcatcgtcatcaaccctttcgatggtatccctgccaccactgattttcaatgatgccataatagcagaatcataatactatgtcataatacctaaattccaatgacaaggtagaattgagatgggttacagtctagattttcgaagaagagtactggcatacaaagacaagcatgcattgacattcgagcaaacccgcgaccactttgaggtctctatccgcactctgtttcggtggtgcaataaaatagaaccctgtatgacacgtgataagccgcccacgaaaatcagtgatgagacacttatcgccgatgtcaaaaattatcccgatgattatcaatgggaaagagcaaaacgtctgggtgtctcacaatcggctatccattacgccctgaaacgactcaaaataaccgtcaaaaaaaacgcacaaacatcccgccgctgacgaacacgcgcgtcaggtatttggcgagcgtatccgccatcatgagcaggcgggcaaacagattgtttatctggatgaaagcggctttgagcagtccatgccacgtacgcatggctattcgttaaaagggtcgcgctgttttggtttacatgactggcagcacaaaggccgtattaatgccattggtgctatcattaaaaatacctttgtgaccttaagtttgtttgccggaacccttaatgcgaatgtgtttcatgcctggctgacacgagatttgttgccgaagctccctaaggggacagtgattgtgatggataatgcccctttccatagacgcggtgacacgcgacaagcgataaccgatcacggatgccagttgcgatggattccgccttacagcccagattgaatcctatcgaaacaaatgcgctgaatcaaaacagcatgagacgagaaagatgctctattgatgagctgatcacaaagcatgtgacttatgtctgattatattgattctgctata

SEQ ID NO: 2799 - DNA, 1007 bp, Diabrotica virgifera
cgcgtccaatgaagtatgaaacaaataacagcaaacagttgaggttaaatctttaggggctgaaaaattccatttataaattatcattcttatgtaaacacaacactacaaaataagacaataaactatgtccgatcgcatgccaaaaattgatttaagcaaaatcaaaaagaccgatttagacttcataaaggaaatagaaaaacgaaatcaagagagggtgctgaaactaaaaaagcttagaaggaccaatttacttactgctgggtttttaactgctggtattcttggtatttatgggtattccatgtatgctgtgagacaagagagtttcctagacgactttgatgaaccggctaagaccactcaataatggctgcaaatgtacaacatgttcgtttaccccctttacctactattagagatttagttaagttatatcgccttcgagctcttagacaactatctcaaaattttttaatggatgaaagaatcactgataaaatcgtacgggctgctggtcctttaaaaaatcactatgtttgcgaaattggcccaggacctggaggtatcaccagatccataatcaaaaagaacccaagaaaacttattgtcgttgaaaaagatcccagatttcttccaactctagagttattgcagctttgttgcaaggatgttactgatatgaaaatcgagattgctgatataagaacatatgatcttaagcagtgttttcaaggagcacctgaaatggaatggcagcatgctcctcctcctgttcatttaataggtaacctcccttttagcgtttccaccaacttaattatcaaatacttacagtcaatatcagaaaaaacatcggcttggcactatggtaggtcatcgatgaccctaacatttcaaaaagaagtgggagaaagaatggtagctccaatcatggacaaacaaagatgccgcctatctgtcatatgtcagatgtggtgtgacgttcagtataaatttaccat

SEQ ID NO: 2800 - DNA, 1016 bp, Diabrotica virgifera
atgcgtttctgaatcaaataggagaatatatattgctgcgcttctaaagctacgattattggaagcttttttaattggcacgcaatcaattttccaaacatatcaaattcgtcttcctcttttggtgctatttttttacttaatgatgcagaaatgtccatacacctagcggagtaccggttgcgtcatgcgatagatctggagtaaacagggttgatgataatgcaaaatcaggatgtgaaggtggcggcagtgcttacatgtgcaatagtcaacaaccctgggcagtaaatagcactttggcatatggttttggtgctgcatctttcagtaacggaattgatgtatccttatgttgcgcttgtttcttacttagcttcaaagatcaaatttcaaacaagaaaatgatcgtacaagttacaaatactggttctgatttaagtcataatcatttcgacatcgctcttcccggaggtggtgttggaattttcacacaaggttgtcatgaccaatggaatgccccatggaacggttggggtgaccaatatggtggagttcataacagaggggaatgtgctactcttcctcaagccttacagtctggatgctacttcagatttgatttctaccagaatgctaacaatccaagaatgcatttcgaccaagtccaatgccctgctgaaatcgttgccagatctggttgcagtctttaaatataatataattatttgttttaaaacaattatgttttatttaggtacaaatgaaataaaccatatgcttgcatgtcaaaaaaaaaaaaaaaaaaaaaaaaaaactaaaaagtaaaaaaaaaaaaaaaaactttgggccaatttttgcccaacttttccccaaattttgccccaggggggggcccgaaacccattttccctttttggggggggtttaaaaaaaaagggggggggtttttaaaaatggactccattaacctattacttcctggatgttttatacctggaattaagtgatcaatt

SEQ ID NO: 2801 - DNA, 1010 bp, Diabrotica virgifera
gcgtccccccacgcgtccgcccacgcgtccggcaacacaacatgaagatcgctatccttgtttcagcccttgtggctcttgcagtagctacccctttagaacaaagtccagaaattaaattcattgagaaaggcattagtggagagggaacaactacccgttattgggattgttgcaaaccttcctgctcatggaggggaaacgtccatacacctagcggagtaccagttgcctcatgcgatagatctggagtgaacagggttgatgctaatgcaaaatcaggttgtgagggtggcggcagtgcttacatgtgcaacagtcaacaaccatgggcagtaaatagcactttggcatatggttttggtgccgcgtctttcagtaacggagttgatgtatccttatgttgcgcttgtttcttacttagcttcaaagatcaaatttcaaacaagaaaatgattgtacaagttacaaatactggttctgatttgagtcataatcattttgacattgctcttcccggaggtggtgttggaattttcactcaaggttgtcatgaccaatggaatgccccatggaacggttggggtgaccaatatggtggagttcataacagaggcgaatgtgctactcttcctcaagctttacagtctggatgttactttagatttgatttctaccagaatgctaacaatccaagaatgcatttcgaccaagtccaatgccctgctgaaatcgttgccagatctggttgcagtctttaaataataatataatataattatttgttttaaaacaattatgttttacttaagtatatactcaatttaaacttaatttttaaaaaaaaaaaaaagaacggccgctcataaaaaaaatttatttaattatgcataataatattataggacaattcggtgttggtttctacagttcctttatggtagctgataaagtaccagttttttcaagtgatgttttttggggggggggggggggcagccccccccccc

SEQ ID NO: 2802 - DNA, 1139 bp, Diabrotica virgifera
acgaaatgaaatattcttttatttctagtattacttacattattataatagtaattagatagatctaggtataatagtatctagaataataataataattctagtattatatttctagtaatataacataaaaatcatctattcttatacatcagcttgatcagcagaaccaacttctttgtgatggtatatccgcatcactgtgggaagattccatagcactatctggtgaagctgcatcatattgtctatttgttcggcgaatgtgttcgatgcgtttctgaatcaaataggagaatatatattgctgcgcttctaaagctacgattattggaagcttttttaattggcacgcaatcaattttccaaacatatcaaattcgtcttcctcttttggtgctatttttttacttaatgatgcagaaatgttcttgagttctgataaagttctatctaaacatctttgataatttgttgcagacgtcttagctttttttcgtgcaggctccgcagtatcacttgtaaatgtgcgtttagaagtactaggtatggcctctgtactaacgccgggaacagcagttggtggagtaggatcaaccataacagtctctacgacatcgttaacgcttgattgtgtttctgaatctgcaacgccaatctctgttggttgtatctctcttaattgaaccactccattcaaaattctatcagcaactgggaaccatggtaatttcggcttatatacgtcatcaggacctgctgctaactttttgcttcttaaaatcttggctaattccaaggtgtaagcattcctcagtgaacgtattttagctttaacatcctctaccaggaatccatcaatttccattgctgttgccatagcttcatatgcatttattcgtgtattcctgtctttgtaaccctcagaatgaacatcccacaaacacctatgttgttcgtacatttcaagaaaacttatagtatcctgagaactccatttacctcgtgcactgctcattttaattgatatttgttaaaactgtttaagcacaaaatttaaaaatattttaatttaaaataaccacaagaacacgatgatttagattgatatacacgtgacacgtgcaagtagaccttca

SEQ ID NO: 2803 - DNA, 842 bp, Diabrotica virgifera
tcttttcgcgtccgaggaactctatgtaggaacagacagcaactgggttttaactttgttattaaattttgaaagtcatttttaaaaacattttaatttaaaagtagtatttttaagatttttcattttcacaccagttcataatggcatctggttcaatatacgacgctgcacataagggagattttgaatatgtttcccaaaagattgaagaggatccactaattataaaagcaccagactctagtaaaaggcttctaattcattgggcagttctcagcggaaatgtaaagcttgttactcatttactggaacttggatcttctgtgaacccctcggatgatacagatatgacaccattaatattagcttcatcggctggccataccgaagttgtcaaattgttattaaaaaaatgtgatgatgtcaatcataaaaatgcacagggtcattcatcacttcagtatgcagcctccaaaggttggaccgagatctgtgccctattacttgaaaaaggggctgacgtcaacattaaggatgaaagaggcagcactccactgcaccgagcagcctctaagggtctcctgtccattctaggactgttactgtctattagtgacattaaagtaaatgttaaggatatttatggtaatactccccttcattatgcttgtgaggaggatagaaaagaagcagctgttatgttaggtgaccatagagctgatgttgaaattaaaaatagggaggataagtcgtgtctggatttgtgtacaccagttttagctaggcttctaaaaagaacgcagagtgttacatgattatataagattaataaagttata

SEQ ID NO: 2804 - DNA, 1079 bp, Diabrotica virgifera
gagaagacagtttgtttcattttcattaatagtttcttacaaatttttcaatatgcttgttttaaaaagttgtttttctacaattgttgacaatttatgcaagatttggatattaagtgaagcctattcctagacgtgtctacgtttggattctagatcaattctcaaccgaccgagtagtttacttgattggttgcttagtttaagaacttctacatcctgtttacttattttggaacgttatctaccaaatcgagaatatggctaccaaggaccgttctctaggatcaggcatctccatcccacaatggatgaagaccaagagtagcaaattcgacttagacccaagtactttttcaccaactgaactggacgacagcttcatgttgtactacagaagaccgaaaccggaatcgaacttttccaccaccaccaccataacaaccactaatctacctgaaaacatcacggtggcaacagtgacaaagaaaaagcaagatttctcgcaacatccagtcccttgccaaaaatatctgcgaagcggtcaagacgtaccacctcaaacgagctcagaaatgaaaatcaaatcgcccggtactgacgacggattcaaaggagaagcggccaaatgcggttcttccataatcaaggtggcgtcgcagatgatttccaaccaaggtctgggcctacgaatctgttatccggtggagcccatggaggagaaatacgacggcacaaggcgacgcaacagcaagtctttaccggcttcacctcttacttctcccggaagcagtcctaaagcccacagaagggtcaataagtatttcactggggcttttacggatgtggacaatctaaaggtagtaggatattgtcgtgtctatacgccaaacgagaaatcaaaaaatttccccaatttagtggggcaaaaaaaaagaaaaaaaagcaaaaaaaaaatctttcaaacccccccccccctcaacaaggggagtcttacaagaaaaaaaaaaaacaaaaagccaaaactaaaaaaaaaactcccccccttggtttttcgagactcaaaacccttataaaaa

SEQ ID NO: 2805 - DNA, 1593 bp, Diabrotica virgifera
ttgatccatcgtgttcaaggagttcgcttttttccatccattggctccttgtttattaaattagtttatatttgaattatttcttgttttaggtaaaaatgtattctgtaatagaatttaaacaagaagaagatggtggtggactatctatagtaaattcaacttggttgacacctagaaaaactgaagtacgttggccccctataaaagataaccttcaatttaaaaaagtgctacgcaaactagaacctgaaattgatgaaacttggaagatatatggtgtccagaaaattttttattcaacagatgattttgaaaaggccacaaataaattaaaaagagcagaaataacatctgatctacaaactgatcttgaggatgataataccagacccagaagaaagatcctgaaacgaaaatttagttcggatgaggacagcaacgaccaggtttcgctatttaagcctggcaaaaagtcgaagcaaattttaccatggcctccacctgtgggaattaataaactctatacaaatccaagaggatcgtctcaagaattggaatctgggacagatgagtctgaccctggcataccttctggctctcaatttatgaaaagcatatccacaccaagggataagttatcatttcagatatctacaccaaaatcttcatcgtcttttggtaggcaagaagcaactgaaatacaaacaccgactctgaacgagtctctaaattttgataatagtcttcaggatacaaatggattgaaggttctacttaaacatatattaacaattagggaacagaacagaaaaattctaaatattttggagaaatcaaaaccatttgaaaattcagatttacctgatgacttcaaaataaaattgccaatagaatccttacaagacctggaagaactagagatatatttgacagaagaagagaacttcaacacttttaaatcatactgtgcctcaatttcaaacctgaaagatgttacccagaagaataataggatattaagatctcttttgacagataatattgcgaagcattttaattacttcggtaacaaccgggggcaagacagagtatcaaataagcgaccatttaatcaactgcgcttaaacaaagtggttctagatgcggtaaaacaaggaactgactttacaactcatgaagttgagaacgctattaagcgctggttaaaacatgctcctaaccgtaacaagaaaaattactaatttggaattgttttaattttagttttttatttgattaaacatgcaaaggttttataaagaaactgtaggtgaacgccaaatgtgtaggagggtggctaaggaacttaaaaatacgattgaaggtcttaatagtaatttaaatcaggcttcttcccttgttagtaaaacagtagtacatagtgataccatttagtaagtttttaaggataagtataaaatttgcaagatgttgatgtgtaaaatgtaacatctttatttaaaaatagtcaaaaaatttaaaaataaaaatattctcgattatgttcaaaaaaatttaaattttttgactatttaaaaaaatatgttttac

SEQ ID NO: 2806 - DNA, 1312 bp, Diabrotica virgifera
tcctaagagatagccggcagcttttcgaactgatatgtcttgaatggcagcaagcgggtttatcatggttcactatcctgaaaaaacgggaaggttatagaaagagtttccatcaatttgatccggccagcatcgccagaatggatgaaaccgatgtggaaaagctaatgaaagaacccgccatcgtgcgccatcgcgccaaaataaaggccattatccataatgcccacgcttaccttgacatggcagaacaaggtgaagatttcagcacgtttatctggcgctttgtcaatgacatccccttggttaaccactgggaaacacccaaagaagtgcctgctcaaaccgatatgtctgatgccctttctaccgcactgaaaaaacgagggtttaaatttattggcagtacgacttgctacgcatttatgcaggcagcaggtttggtcaatgatcacattgcaaattgtgtatgccggaaataagtgatctattagatagtccgaaaatgaaaatcagtgcataaaaataaacaaaaatatcacttcaaaatataaagctggattaatgacaaatatccagtttttcaattcaattgatgatcacaatacgatatataagaacatagaatacctatttttccccattgcaccctaatagtgagcggagtatggtgtcttattctcatacaaaaaaacagacgaaaaagccgtcatgaaattttcgcaattcggaaacaaatttacgcaagattcgggaattacccgtctgatgactgatcttaaccaaggtctgagaacacccggcgcgattatgctgggtggaggtaatccccgcacatattcctgaaatggatgaatattttcagcaaatattgaccgatttagtctccagtggtacaattaaatgaaatcctatgtaactatgatgggccgcaaggtaagaatacactgatagcgcctctggctcaaggattacaaacaaaactcggctgcgaaatccgtccacagaatattgcgctgaccaatggcagccaaagcgactttttttatctgttcaatttattggccggccgtgcagaagacggttcgatgaaacgtgttttatttcctcttgccccagaatatatccggtatttaaaattccgggtcggggagaagggaaattttttgcgaaaaaaaccccaaaataggaaataacgccccaagggggccattcaaaaaaaacccacattgtattttctaccttctttgaaaaatatcttatggaaaaaaaaaacacccccggggattttttgggtttctccccccccccc

SEQ ID NO: 2807 - DNA, 800 bp, Diabrotica virgifera
  misc_feature (780)..(780): n is a, c, g, or t
tccttctgattaatgcgaaactcaaatgagtggccttttgccacaggcgtttcctgtatactcagcggataaccttccgccactcgcaattgttcaataaccagatcaatacctgttgtttcttctgtcaccggatgctcaacttgtaagcgagtattgacttcaaggaaagacagtgctccatctgcgctgagtaaaaactctacagtgccagctcccacataattggcttccacacaaatagcttttgctgattgatgaattcgatctctttgttcctgtgttaagaagggtgctggcgcttcttctaccagtttctgattccggcgttgcaaggagcaatcacgcgttccgagtacgacaacattaccctgtttatccgcaatcacctgcgcttcaatatggcgaggattattcaagaattgctcaataaagcattctccacgaccaaatgcagccgtcgcctcacgtacagccgaatgataaagttctgccacttcatccagacgccaagcgactttcaaaccccggcccccaccaccaaatgccgctttaatcgcgattggcaaaccgtgtgtttccgcaaaagcaacaacttcttgtacatccttcacgggctctgctgtgccaatgaccaagggtgctcccactttctgagcaattctacgcgccttaatcttgtcacccagttcatcaatagtttcaggatgctggccaatccacataatcccgcatcatcactgcacgggcaattccgcccttcagacagaaacgtatccnggatgcacatgtcgctcccg

SEQ ID NO: 2808 - DNA, 647 bp, Diabrotica virgifera
gatgcgatggttctatggtgttagaattatttgtactggtacttggagtattttctaatggcctgctgttatttttaaaatttggaaaatctctcgggttataaataaatttattatttgagatgtatgattttggaatagcttcacttgcctcaaaaaatgtcaaattttcatacgccatcagttctttaatattcttttgtcttgtatattctgggcagctcttgtcaatagatttgtgagagtccttgcagtaaaaacattttgtcatgcatacgtcttcatgcttgttgtttatctttaaaaaacatctttactttccctttacagtttgtttttgtgtggccaaatctaagacagttatagcattgtgtcactggggcaatatatgtgtccactagtcttggtatgccataaaaaaacagttttgggcataagaacgcctcgaaatgtaaatagtgtcgtacctgtgggttcataagaagttactccatctttaattactcttctatttaatctttttatatgtaaaatttcaatgtcatttcctgtatcgcaacaccgaagaagttctttttcatcaatatctgtatcaatttgtctgacgatacctttgcaggttacgaagttaaaagcggacgcgtggg

SEQ ID NO: 2809 - DNA, 1649 bp, Diabrotica virgifera
ccccgagcgaaacgatagaaaatctccagtgtacgacttgacctttgttgaaagaattacctgtcaaatgcttaaaacttataacgtttatattcaatgccatattaaacttaggttactttcctgatcaatggaaagtgtctcaggtaataaccattctaaaactggggaaacctcaagaagaaactacatcgtatatgccaattagcctcttgccaatcacgtctaaagttttcgaaaaactattagtaagaaaactcgaaccctggatcaaaaatctaattccagaccaccagtttggatttcggcccatcactcaataatccaacgagttcgcaaagtggtaaaacatataaatgctgattttgaggccaaaaggtactgttcagcggtatttcttgacgttaggcaggcatttgacaaggtatggcatggatgtcccctatacaagctaaaaaggacattaccgcacagattttacattcttcttgagtcaaatttgtcagataggtgttactttattaaatactaagatgcaatttccaactctattctatcaaagcaggcgtaccacagggtagcgtgctgggacctaccttgtatctcttgtttaccgcagatatacctccaactcttcagaaaccacttgaggagagaccacctacagaagaaatgatgctaggaacatttgacgacgatactgcaatcctagcctcacacactgaccctatctatgcctcgcatctccttcaagcgtatctagacagagtacaagatttggtttttggaatggaaaattaaagtcaatgaaggaaaatctattcatgttacatttacaacacgaagaggaacttgttctcctgtaagtttaaacaatcaccaaataacatcagccaacgaggtaaaatatcttggtattcatttggacagaagtctcacatggaggaaacatatccggaccaagagaaagcaactaggtctccaattcagaaatatgtattggttaatgggccgttcatcaagactatctctggataataaattgctgctctataaggcaatacttatgccaatctgcacatatgggttggaactatggggaacagccagtcactccaacatcgaaatcatacaacgcttccaatcaaaaacgctcagaaccagcactaatgcaccttggtacatcaacaacagaattattcatcgagaccttaaaactgatatggtacaagaagtcatcacaaaacgtagcgctgcatacattgccaagttggaggatcatgaagaccagtttgcacttttgcgtaggttaaagaggttcaaaccactggaattaccatttagagtaaacttttaaactaattagttagtagttataaaatgtaatgattttctacacaattttgtaaaaattgtactttgattttaccagtgagtaaaatctttcttgtccttagtcaatgtcattacttttttttattgttgacacttaacagattgcaaaatacttttaaataaataaataaataaataaataaataaataaaagtacttcaaagcacaatttacgtccattaagacaccaaaacagtaattcaaaacataaaacagctaatacaatgcttcataagcagatagatttcataaac

SEQ ID NO: 2810 - DNA, 1062 bp, Diabrotica virgifera
acagatgcttagaaattgaaacaactacaccagaaccaactactacagaaacggttgaatatactgaaccaggaaatcaggagattttacaaacatgtaattccgatggttgttattgtccttctggttatgtaatagaaactggtacgccttattgcgttttagaaactacaactttaccaactactgttccgcatccaactgaaagattaccaggttcttgcagtgttgttaacaattgccacgcaaacgcctcatgtctctactcagatatccttcgtgattatgaatgtatatgtaacgaaggtttcgaaggaaatggatactcgtgtgagccagaagtaatttcctgcactattgttgataactgcgatcctcaggctacctgtgcgtacgacgaaactttgggtaaatcgaaatgtatatgtaatcctggatatgtgggagatggatactattgtactatcagtgttggatgtacctctaatcaagattgtacggttacagaagaatgtgtcataacaccttcacagaaatatgagtgcatatgtagggaaggttacacccgtgatacccagaaccaatgcgtgctcatcgcagggtcctgcggtggtggtacatgcgtcgataatgccgaatgcatatatgatgaagaatacgaaacattcttctgtcattgtaaaaatggattcattggagatggaattactgaatgtaagaaaaaggtcatcggttgcgacacccttaacaactgtggagaacacgctacctgcaaatatgtagaagaagaattagcttataagtgtttctgtatagacggattctttgataacgtatttgactgatatgccgaaagaaactgccatatacatcctaccatgtgccatcaccaagctgtatgtcttacatacgctagcagacaattcttgtgtcagtgcgaacctgtgtatgatgttcatgttaccatgtgtaaagcaatatctaaacatgaaggcatctatcttctccttaatcatgaaatgatactttacaatttcccttgatagaatttaaacaaggtga

SEQ ID NO: 2811 - DNA, 651 bp, Diabrotica virgifera
gtgaccgagaaaaacgtgcaccaagatgaaagtgcttcttgtcttcgtgctagtagcggtttgtaaagtgaactcctattgtataagaagtgtgacaacggctagtgggccctttgcgcccaaaaatatatgttcgggtgatctgatatttgaagataatttcgactgtttaaatttagataaatggaaacacgaagatacgttggctggaggtggaaacaacgaatttgaatggtacacaaacagcagaaacaacagctatacttcaaatggaattttacacataaaaccaacttttgtagctgatgagctaggagagcagtttttacaatcagctaccgtagatttgggaaacaagtgtaccaatccacacaattctggttgtaaaagaactggctcaccaggtgaaatactaaatccagtcaaaagtgctcgtcttagaacattagataccttttcctttatatatggcaaagttgaagttagggctaaagttcctacaggagattggttatggccagcaatttggttgctacctaataaatggatagaaaacggagactggatttcctccggagaaatagatattatggaaacacgaggaaacaaagaactgataaaacctaatggtcaaaatatcggtacaccctt

SEQ ID NO: 2812 - DNA, 1516 bp, Diabrotica virgifera
ggctacttctcgtagctctgcttgttgaattttaaaatattgaaagtagtaaatattgaagaaagtattaataacacaatcatggcaaagttcgacttaacttcgaagatgggccagtatttagaccggcatctcgtttttcccttattggaatttctgtccgcaaaaggaatttacaatgagaccgaactgttaaaagccaaattagatattctaagcaagactaatatgatagattatgctattgatatcagaaaacaactgtaccctgatcaggaaatacccgaggacctaaaacagaggcgtaatcatgttgtgcagcagctagcagagctgcaagaagaggttaagcctatccttaagattatggagtctgaagaagttatgaagaatatggaaaacatgagagattcgaaaacacttattacatatttgtcaaaagaattcaagtttgaaattgaattgatcgacagtcttcacaaactagccaaatacagatacgactgtggcaactacacagtatctacatcctacctgtacttctgtatgctggtattacctcccaatgacaggaactatcttagtgccttgtggggaaaattcgcttcagaaattctgtaccaaaactgggattcagcactggaagatctcaacaaactgagggaatatattgattccagtcccaatcagttttctggcaacagtttgcagcttctccaacagaggacttggttgatccattggtctctctttgtgtttttcaatcatgttatgggcagagaattgattattgaaatgttcttgtatagaccacactacctcaatgccatccagaccatgtgtcctcatatcttgaggtatttggctacagctgtaattattaatcgtggaaggagatcagcactgaaggacttagttaaagttattcagcaagaaagctacacttacagagatcccattacagagtttgtggaacacctttacgtcaacttcgatttcgatggagcccgtcaaaaattacacgaatgccaaacagttttactaaacgacttcttcctaatttcctgtttagacgaattcgtagaaaacgccagacttatgatcttcgagacattctgcagaattcatcaatgcatcagtataggcatgttagccgaaaagctcaacatgaatccagacgaagctgaatgctggatcgtgaatttgatcagaaacgcacgattggatgctaagatcgattctaagttagggcatgtggttatgggtgctcaacctttatcgccataccagcaacttatcgaaaaaattgattccctttcggtcaggtcagaaactctgtgtgctcttatagatagaaagctcagagcgaggactgacgtaagtttctaaaggtacgttaacgaaatgatgcaagaatttgtcatttttgttacagatacgttggggaaatccagatttttaaatatctgttattttgtaataattttattggatacaaataaaagatctttccagt

SEQ ID NO: 2813 - DNA, 1209 bp, Diabrotica virgifera
tccctggcgaatagaaatgggcgcaccaatgcacctggtgaccctttattaaaaatctgtaccagtctaatgtagcgacagtacgactagatcagaagttcttaaaccaattcaagaccgacagaggtgttagacaaggatgcgtgttgtcacctgacttatttaacatttatgttgaacatgtcatgaggatggttttagaaggatgggccggtggagtaacagtagctggtagaaaaatctccaatttaagacttgctgatgacactacacttatagcagcaaataagcaagaaatgtttgatcttctgcgaaaagttgagtacgaaagcaataaagttggtctgaaaatcaataaagctgagacaaaaataatggtggtcgacagatttgacactattcaactgactaacatattacaggaataccagatagtaaacacctttgtctatctcgggtctagtataactaacgatggtaactgtgaagcagaagttcggagacgtattggaatggcaaaaaatgcgatgagtcgcctaactaaactttggaaagacagatctctctctcaaaatatcacgatgagactggtgaatgcccttgtattctcaatatttctatacggagcagagacttggactcttcgcgcatgcgagcgccaaaagattgatgcctttgagatgtggtgctggagaagaatgctgcgataccttggacagctcataggaccaacatttccattttaaaccaactcaatattaaaaaaaggctgtccacattatgtctgcaacgaattctgcaattctttggtcacgtggttcgaagaggtgacgacagtttggagagattaattgtttctggaaacgtttcggggagaagatctagaggacgatcaccgactagatggtctgaccaaatacgaagctcttagagcagctgaagattgagaccaatggagaaacattgttaggaatattggaagaaatcacgatcctcagtaatggggaaacgacaggagagagagagagagagatcatcatcaacgcctatcaatccggatggaatgtttgcctttgttacttagagctctctgattcgcttattgcggtgaatcactccgcattccccttagataagcagtacatacagagagtatcgacaatgcattgaagtctgttacatcttcttgtagctccttttgctatctga

SEQ ID NO: 2814 - DNA, 1276 bp, Diabrotica virgifera
cccacgcgtccgaaaaatctaggaaacaccatcgccatcataaagttgctaacaaaatcagataggtagttgatgtggagtagggtagagactttattttcttctgttttaaagacctgatttctggaactgtacaaaggaggtttgacatgatggacctaggatgttttatagtttttgtacatcattgtttggcatctttaatagaactctgaaaatatatcaaaaacatgctcggatttttatcatgtctaaattttaccataaaaaaatagaatatttataattaaaaatgccaagcataggttctgaggctgaggccctgtaggaaggattattttgagttagtttctttgcggattcctgttcaaaaatatcccctttgaacaaatctgaagggtactaggagaactttgtggatagaaattgtttaaacattttttaaacaaatatcaaaacccaccattttctgctccgaaaaaattttttaggtttcttggtctctttttatttttccctgcagttgataattttcgagctataagcgatttatttatttatgtacctatttatttacggaaagtatctcaacaactatctgaaaaatacgaaaatactcattttggcatttttcggggcttggaaactcattaaattattatttttgaggttgccaaatgcttaactttgagtttaaacattcagtttaaagtttctaaagagtaatggcgacagtagctggtaggaaaatctccagtttaagatttgctgatggcactacacttatagcaataaatgagcaagaaatgtttgatctcctgcgaagagttgagtacgaaagcaataaagttgggctgaaaatcaataaagctgagacaaaataatggtggtcgacatattccacactattaaactgactaaaatgttacaggaataccagatagtggacggctttgtctatctcgggtctagtataactaacgatcgtaactgagaagcagaagttcggagacgtactggtatggcaaaaatgcgatgagtcgcctaactaaagattagaaagacagatctatctctcaaaatatcaagatgagactggtgaatgcccctgtattctaatattttaatagggggcagatacttggacttgcgccaaaaattgatacctttgagatgtgctggagaagaatgctgcgcataccttggacagctcataggacaaacgtttccattctaaaccaactcgagattaaaaaaaggttgcccacaatatgac

SEQ ID NO: 2815 - DNA, 2381 bp, Diabrotica virgifera
agatagtgaccctgagagcacttggatctatctataagataaggtaatcgaggctgcaaaagactgtgaggcagcggtttccactggccgtaagccatggatatccgataatacgtggactgtgattcaacgcagaaaagaacataaaagtagatacggaacaaacgatgaatacagagcgttatcgaaagaaatcagaaaacagtgccgcaaagataaagctgattacatctctcaaatatgcagagagatagaggaacatggctgtcgaaatgaaccgagggacttattccagaagatcaaactccttaccagagaatttaaacctcaaacgtggtctgtaatagataaggaaggtaatttaaagaccgatactgatgaaatattggaaacatggcgaaactactgtggcgagctatataaaaataacgaggtatcagcagaaaatcagtggccttctgactaccctagagaacctactgtcttactcgctgaagtcaaagatgcaattaaatcactaaagagaaataaatccccaggcattgattcaataccatgtaaaatattacagttactaggtaacaaaggattacatatcatccattctatctgtgtcgctgtttggaattcaggaaaatggccatctgattggtgtacctcaatttatatcccactacacaaaaaaggaactactaccagatgtgaaaactaccgcacactgtcactaataacacatgctagtaaaatcttgttgcatatcatcaaaaacagattaaaaacctatctacattaccaaatacctcaggaacaagcggggtttgtaaagggtaaaggtacaagggaacaaatcctgaacttgagacaactcattgaaaagtctagagaatttcaagtacccatgattatatgcttcgttgactaccaaaaggcatttgattgtgtaagctggataaatctgtggtcaattttaatagaaatgggcgcaccaatgcactggtgacacttattaaaaatctgtaccagtctaatatagcgacagtacgactagatcagaagttctcaaaccaattcaagaccgagagaggtgttagacaaggatgcgtgttgtcacctgacttatttaacatttatggtgaacatgtcatgaggatggttttagaaggatgggccggtggagtgacagtagctggtagaaaaatctccaatttaagatttgctgatgacactacacttatagcagcaaatgagcaagaaatgtttgatcttctgcgaagagttgagtacgaaagcaataaagttggtctgaaaatcaataaagctaagacaaaaataatggtggtcgacagatttgacactattcaactgactaacatattacaggaataccagatagtaaacacctttgtctatctcgggtctagtataactaacgatggtaactgtgaagcagaagttcgaagacgtattggtatggcaaaaaatgcgatgagtcgcctaactaaactttggaaagacagatctctctctcaaaatatcaagatgagactggtgaatgcccttgtattctcaatatttctatacggagcagagagttggactcttcgagcatgcgagcgccaaaaaattgatgcctttgagatgtggtgctgggaaaaaaatgctgcccataccctggacagctcataagacaaaaggtttctattctaaaccaactcaatattataaaaaaagttttcccaaataatgtcttcaaacaaatttttgattttttttgtctccgtggtttctcaaaagggacgaacggtttggaaaaaacagattgatgataaacgtaaatctcgtctgtcaaaaaaactgtaaaaaaataattctattagtttaacatgtcggaccctgtcgaacgctttttcgaagtcgacgaaacaggaataaatatccaggttcgtatataagcatctttgagagaggacaataaacgcaaacaatgcctctcttgttccaagtcctttgcggaacccaaattgggtatcatccatatcatattctagctttttgtataatcttccatgaatcacctttagcaatattttgagggtatggcttattagtgatattgtcctatagtccgaacaatctttggcgtatattgtttttggtattgttacaaaggtggacaccaatttctgatttttccggttttatatacttcattacgaaaataattacttatctttatttattcactgtttaaaaataaataaagtcgttcaagtacttctacaactaaaaactacacaaaatcaacaacaaaatgttctcaaaatacaactagacaactaataaagtgataactattttcaatgggaaataagccggacgaa

SEQ ID NO: 2816 - DNA, 1827 bp, Diabrotica virgifera
  misc_feature (1192)..(1192): n is a, c, g, or t
ctatattacaaaaagatcgtattataacgtaacatcacaaattataccttgcttttgtttgtttaaataaagaaatgattacatttaaaaaaaaaaaaaaaaagggcaagacctgatttctggaactgtacaaaggaggtttgacatgatggacctaggatgttttatagtttttgtacatcattgtttggcatctttaatagaactctgaaaacatatcaaaaacatgctcggatttttaccatgtctaaattttaccataaaaaaatagaatatttataattaaaaatgccaagcataggttctgaggctgaggccctgtaggaaggattattttgagttagcttctttgcggattcctgttcaaaaatatcccctttaaacaaatctgaagggtactagagaactttgtggatagaaattgtttaaacattttttaaacaaatatcaaaacccaccattttctgctccgaaaaaattttttttaggtttcttggtctctttttatttttccctgcagttgataattttcgagctataagcgatttatttatttatgtacctatttatttacgtaaagtatctcaacaattatggcatttttcgaggcttggaaactcaataaattattatttttgaggttgccaaatgcttaactttgagtttaaacattcagtttaaagtttctaaagagtaatggcgacagtagctggtaggaaaatctccagtttaagatttgctgatggcactacacttatagcaataaatgagcaagaaatgtttgatctcctgcgaagagttgagtacgaaagcaataaagttgggctgaaaatcaataaagctgagacaaaataatggtggtcgacatattccacactattaaactgactaaaatgttacaggaataccagatagtggacggctttgtctatctcgggtctagtataactaacgatcgtaactgagaagcagaagttcggagacgtactggtatggcaaaaatgcgatgagtcgcctaactgtcatcaaccaagacagatctatctctcaaatatcaaaatgagactatttaatgccctggcctatattttaatctttcacggccatgtgctgtttctggaaaaatcataacttttgttttttgctggtttatttttagtccgtaaccaatgcaataatcgttaattctatntagcaattcttgtaacgattctagggtgtctgccattataacggtgtcatcagctaatcttatgttatttactattcttccgtttatagagattccatcacttagctccgctatcgcttcctgaaatatggcttcactgtacaggttaaacagtagcggcgacagaacacaaccctgtcttactcctctctttatatcaatattctcggattcttgttcttctatctttatattggccttttgattccaatacagattgatgataattcgtaaatctcgtctgtctatatctctgtttttcaataattctattagtttttcatgtcagaccctgtcgaacgctttttcgaagtcgatgaaacaggaataaataaacaggttcatatctcagcatctctgagagagaacattaaacgcaaacaatgcctctcttgttccaagtcctttgcggaacccaaattgggtatcatccatatcacattctagctttctgtataatcttccatgaatcacctttagaaatattttgagggtatggcttattagtgatattgtcctatagtccgaacaatatttggcatatattgtttatggtattgttacaaaggtggacaccaaccattcttgagggattt

SEQ ID NO: 2817 - DNA, 2411 bp, Diabrotica virgifera
  misc_feature (103)..(103): n is a, c, g, or t
agtattgagtactgagtaccctccaatacatcaatcaacgatacggtattatttaaataagctgttaacaaactgatgatgaccaacatggttaccaatatcnacaaaaggtagaccccaacagaagaagtagtgcatttctttttactaaacattttttgagttcgtgggcaaatcatccggttgtcattttatatagacaacagatcttcttcttcttcaagtgccctgtccgttgcgaacgttggctattaacgtggcaatcctgatcttgcttgcgtcacttctgaatagttcgactgatgtgagcccgaaccacttccgcagattttggagccgcgagtgtcttctcctgcctggtccacgtttactgtctattttcccctgaacaatcaattgcagtagacaacacatctttaacacgaacgtatattttctctaatctgtagttttatacttttttagattcttgttgaatctatgcgctaatacttcttcttcttcttcttcttcttcttctttttcttattcttcttcttcttcttaaagttccttctgctatcggaggttggatatcataatggctgtcactttgttggctgctgctctgaatagttgtaatgaactacagttaaaccattctctaaggttcctcagccaggagatgcgtcttcttcctatgcttcttcttccttggatcttttcttgcataataactctcagcaactcatatttttctcctctggtaatgtgacccaaatattccagttttctagtttttatacttttcataatttctaactccttatttaaacgtcgtagcacttcaacattggtaatcctttgaacccactgaatttttaatattctttaagctttaggcttcaagcttccattccgtatagtaatataaaaaatatgtagtatcttagagccctcaatctgagaggcaactgaaggtctttgtttgtaagcagtgtcttcatttttataaatgcttgccttgcagtttcaattcggactttaatttctttgctttggtcatttttgtcatcaacccaggttcccagatatttgtatgtctttacctttttctattcgggtttgctctagtattaacctttcatttccatgttctgtttttgagacaatcataaatttagtttttttttcttgtttattttgagtccatatcgaatgcaataatcgttaattctatttagcaattcttgtagcgatcccagggtgtctgccattataacgatgtcatcagcgaatcttgtgttatttactatttttccgtttatagagattctatcacttagctccgctatcgcttcctgaaatatggcttcactgtacaggttaaacagtagcggcgacagaacacaaccctgtcttactcatgtctttatatcaatattctcggattcttgttcttctatctttatattggccttttgattccaatgaagattaatgataattcgtaaatctcgtctgtctatatctctgtttttcaataattctattagtttttcatctgggaccctgtcgaacgctttttcgaggtcgatgaaacaggaataaataaatgagaagacagatggcctcaaaactactggccggctataaaacactaataaaacaccagtgctaacatgtgaagtagaaacgtggtcacttgcacagaagaaccaggaactgcttaaacgttttaagtgaaaaatcatcaaaagaatctatctatcgatctaattagccttcttcggtccatcttcagaagtaggcctcccattcttctcttattcgctacagtcatccacttagagcccacgtgcttcttggtatcatctgcccatctcagttggggccttcctttgcttcgtttatactcccacggtctccaatttataagaattttgttacattggtctttttttgttatatgttgtgtcttatctaactaacatcttatatttacttcactttttatttttatccgttagtcttatgtgcaacatttgcctttataaacgtgcacgtttgggaaccataagtgagaacagggagtacgcattgattatataccttggtcttaagatgttgtggacatcttttgtttttaaggatttggcttagtttgccaaatgccgcccatactagtctaactcgtcttttgatctctgctgtttgttttccttgtgaagttttataacttgacccagatatatataatggtggacttgctctatttcatcttgtccgatcctcattgtgatgtccttatctgtatttggtatgattttggtcttgatgtaattcatatctatctttccagcttctatgaccagttcttttatcatttcaaacaattcttcttttttatcagttatcaatacgatgtcatc

SEQ ID NO: 2818 - DNA, 1009 bp, Diabrotica virgifera
catatatatagtaatccaatgagaagaagacttgtgttacgagaccagacggttctatagtaatcttgagattagcaaagactcctacgagtgatcttaaagtaatgaaaaaggggtgtattcaactgacgacgaaaagcaaacttccgtaaaaaaataacgaaaatcagtacatcatttcggcaatcctagatagtattatttaaatcgtcttagagaaaactaataacaagtttttctaattacgccactgtttgaatggttacaagaacgtattaagctggggtccaacggaacgttgagcggcacgccacgagaaatataaaatatgtaatagaataagataaaaactaaagacgggagtcatgtaacgtgaaatagcgtaatttccctcaaaatttgtggtttacggcccttaagctaggaccgaaccctatatttatggatcggcgcgaagtctctcatcctttgtcggtacatgatcaagatctaaaggaagtcagaagctgatacagactaggtacgtacctctccaaccctttcgatcggctagggactggtacgatcagtgccgtgataattttgctatggagtggtctaacgacgttgtcttcgaatttatatcattgcatgaattaaccaacttactaaactacctaaaaaaactataatgtggcaatccccagagaagaaaaaacgaggaagaccaccacagagctggaatctgggagttagaaaagcgattagtgctcgaaatctaaatgaagacctaactcaggacaggatacagtggcgtttgggagtcggacaacgtcgtaagtcattatgaaaccgaatatatatatactaaaatagctatcgcccacattgacggtgtaccttcaatacgcgagtggacgtattccatcgaaaaaaaaaaaaaaattttttaattttagattaacattgggccgccattgtactcccttttcctttcactattatatattttctacttctgtttgcctac

SEQ ID NO: 2819 - DNA, 2038 bp, Diabrotica virgifera
gatcattgagtgtgtttcaaagatctacatcttttgttttttcatatatatatatacacatatatatatacacataccccatatcacatatatatatcatatatacacatatacacatatacatatatatatatacacatatatacatatatacatacatatacacacatatacatatatatatttgtacaaatataaaaaaaatatatatacatatatatatttacaaatttaacacgttgacggacagaacgtctatagacgtgttatgttcgtgtaaaactcccttaaccatgaatgtaggttggtactactgtcatctgaacgacagctgtcatatactcaatacttggagtgataaaatggaaaccatgtgcataattctttaaaataaagtattttacatcgagtattatttcattacaaatacttacgtcctttaagtacaaaggacttgacatttggcgacgaggataatggatacaaatattacagacactacatcaactacaacgcttccaactacagccggtacaaacacgagttcctcgactacaactacgatagttgcacctgctacagctccagtaatgtctacacaagtttctacattccagttttccgttgaaccttttaaccagacagctacaaaatggtccaggtgggtaaaacggctggaaggagcatacaaagtttttaaaattccagaggaaatgaaattgccctatttactacattacatggggtcggaagcatacgatacactgtgcgataaactagctccagaggtccctgaagacaagtcatatgaggatacagttaagttaatggataatttttacaaccctgcaccacttgaaattgctgaaatatttaggtttcaatcaaaaagacaagcagaaggcgaaagtatacaagaatacctacattctctacagaaacttgccataaactgcaacttttccacatatttaaaaagtgctatacgaaatcagtttgtttttggtttacagtcaaagaggattcaagccagactattagaaacaaagggattggacttggaccgagccgtagaaattgcagcaagcatggaaacttcagaaaaggatagtaatcaattttctcacaacaataattacaatcaggctagtataaatgttttaaatgcaaaagcaaaaagttttcataaaaatacaaacactagtaaatttaatgataataatacagtaaataatcatagtagctctcctaataatacttttacaatgtcaaataaccgtaatagggcttgttatagatgcggagacacctcgcatttagccgataaatgtaataaaaagcatttaatctgtaacttttgtaaaaacgtcggacacattcaaaaagtttgtttaaaggcacaacaaaattcacacaggcaagtaaattcagtaaactctgctcaagaggtcttagaagtaaatgctgggaattgcaaagataaattttttataaatttaaaagtgaatggtaatattttaaattttgaaattgattctggcgctgctgttacaatcataaataaaaatatatttgaaaaatattttcctgcattacaattacaaaaatcggatgttaaattaactacatactgcaaaaataatttgaatgttttaggtttagtttcagtggaggttgagcaccaggaattaaagcacactctaaagttgtatgtggtggatggtgacggctactcactggttggtcgagagtggatacatgctctggaaatcaatttacatcaggtaatacaattctacatggtcgaggataaagtaatggaagaactgatggaggaaagcggtcaaccactaaggcctactatgctcgatgctatattattacttatcttaccttttccaatgatatttgaaattgcaactttgttagataaatataaacatttatttgaaaagtcagttggtgaaataaaaaggttaaaggctgaaatttatctaaaaccttggaactaaagcaaaaattttgtaaggcccgccct

SEQ ID NO: 2820 - DNA, 1034 bp, Diabrotica virgifera
  misc_feature (963)..(963): n is a, c, g, or t
gaggacaaagagtagttatacctactaaattgagaaataaaattttgacagaattacatactgcacattttggaatagttagaatgaaatctttagctcgtagttattgctggtggcctcacatagaccaggatattgagtcactttgtaaaaattgtttagagtgcaataagcacaagaacaacccaattaaagataattctcatatatgggagccaccaaaattttgttttgaacgagtgcatgctgattacgctggacctttcaatggaggttattattttatattggtagattccttcagtaaatggcctgaaattcattttacaaaaaatactactacaaaaactactattgaaatttgccgaaaaatttttacaacttttggtattcctaaagtttttgttacagacaatggtagacaatttgactctcatgagtttagaacttttatgaaagataatggaattacacaaaaatttactgcaccctaccatcctgcaactagtggacagggagagagatatgtccaaatactaaaaaaatgtttaagggctatgcgaagtgagggaaatgacagggagtttgaattatgtaagctacttatgcaataccgcagaagcccacatacagttacaggtaaaagtccctcagaacttatgttaggaagacaaataaggaatagattagatttacttaaaccttcatgtagtgatagagttacctatactgatatgagtctaagaaactttgatataggaactagggtttccgtgagggattattttcattctaaatggcaatttggcattattgtactcagattagggttattgcattatttaattcagttagatgatggtagaacattggaaacgtcatgtagaccaaatacggcaatttggggaatatactccatctcaaaataaacccacatgttacattccggataccattactcancatttgattccgagggaggcatcaattccagagcacagtgtctcacaccacctaccgaaagtgatactgat

SEQ ID NO: 2821 - DNA, 1545 bp, Diabrotica virgifera
accacgcgtccggacaaagagtagttatacctactaaattgagaaataaaattttgacagaattacatactgcacattttggaatagttagaatgaaatctttagctcgtagttattgctggtggcctcacatagaccaggatattgagtcactttgtaaaaattgtttagagtgcaataagcacaagaacaacccaattaaagataattctcatatatgggagccaccaaaattttgttttgaacgagtgcatgctgattacgctggacctttcaatggaggttattattttatattggtagattccttcagtaaatggcctgaaattcattttacaaaaaatactactacaaaaactactattgaaatttgccgaaaaatttttacaacttttggtattcctaaagtttttgttacagacaatggtagacaatttgactctcatgagtttagaacttttatgaaagataatggaattacacaaaaatttactgcaccctaccatcctgcaactaatggacagggagagagatatgtccaaatactaaaaaaatgtttaagggctatgcgaagtgagggaaatgacagggagtttgaattatgtaagctacttatgcaataccgcagaagcccacatacaaaaagtttgtttaaaggcacaacaaaattcacacaggcaagtaaattcagtaaactctgctcaagaggtcttagaagtaaatgctggaaattgcaaagataaattttttataaatttaaaagtgaatggtaatattttaaattttgaaattgattctggcgctgctgttacaatcataaataaaaatatatttgaaaaatattttcctgcattacaattacaaaaatcggatgttaaattaactacatactgcaaaaataatttgaatgttttaggtttagtttcagtggaggttgagcaccaggaattaaagcacactctaaagttgtatgtggtggatggtgatggctactcactggttggtcgagagtggatacatgctctggaaatcaatttacatcagaacatggaaacgtcatgtagaccaaatacggcaaattggggaatatactccatctcaaaataatccaacatgttacattccggataccattactcacaatttgattccgagggaggcatcaattccagagcacagtgtctcaccaccacctaccgaagtgattactgatgaatccgaaatttcaaacaatatggaaagttcgaatagtgtacctggggctcaaactgaaactgaggaacccattttaaggcgttccactagagtaaggaaacctgttaccagactgaatttccatggtaaaacaacactgctgagacacgtagcacaacgtgcatttgatattcccccaaatatcgatattctctattgtgaacaagaagtcgtggcagatgataatactgctgaaccgtcctagcagccgatgtcaaacgtaatggattattagccgaatgtaaaaaatacgctgctaatagtggagatttaaaaatttttttttttttt

SEQ ID NO: 2822 - DNA, 1593 bp, Diabrotica virgifera
  misc_feature (1536)..(1536): n is a, c, g, or t
caatgtcatacttgattgtaaaacagaaaatattttaccaatattagctcaagcaaaatcattagacatggtagacattcggtacaactattttctaacatcattggatgcccatacgattgacttttctagtctgaatgtgactgcaaacattaccacaattagaatttttgactctgacaatgagaactttttaagcgcaatacaaaaatggaatatagcggctgttgagtttaacagaaaaacaatgactattgatccagatactctaaagactgaaacattactctttcatgatgctctggtttatttatctacaacattgaaggatatgccttacatttccaacgcaaaagtaaactgttttggaatggatatatatttggatggtccggatattattagatcaacaaaagagaaaaatgacttggctaccataactggaccaataaagtttgatgacagcggcaatagagaatactttaatctgtatgtgtacacccaattagacgaccaacttatcgctacatatattgctgaaaatgaaactcttaaattgatgagaacttcagaagaaacaaatctagcagctatatcaagcttgaaaaaagttaatgtcattgtttccacaagagttggtgaaccatatttgatgctagctgaatctcccgatggaaaaatattggaaggaaatgataggtacgaaggctataccaaagatttaatgaacgaaattgctgctattttggaatttaaatacgaaattatgatcacagaaaataacgtttatggaaaatatctagccgacgaaaaaagatggaatggtttaattggcgatttactagaagggaatgcacatttggctctctgcgatttgactatcaatcaacaaaggcgatcaatagtcgattttagcatgccatttatgactttaggaatcagtattctacataagtcaccccagaagagtgattccaaaccatttgcatttttggatccgtttgatacgtcagtatggatttattcagcaacaacgtacctggtagtatctataatacttttctttatagcaaggatgactccaggggattgggaaaatccgcatccttgtgatcaagaaccaactatggccgaaaatatatggagcttacgaaattgtcattgggcaacactgggtactattatgaaccaaggatgtgatatattacccaaaggaatatcgacaagattagcgctagccatgtggtggttctttgctcttattattaccaattcgtacattgccaacttaactgcctttttaaccaaagccaatttggattctcccataaaaagtgttgatgaccttggaaagcaaagtaagatcaaatatggatttttagaaggtggagccacagaacagtttttcagagaatctaacaattcactataccaaagaatgtacttaaatatgaaatcggcaagaccaagtgtgctagaaaccgataatttagatggcgtacaaagagtacaaaatacaaaaaatgaattatatgncttttttaatggaatccacaacaaatagaataccatactgcaacaaaatgtaacttg

SEQ ID NO: 2823 - DNA, 922 bp, Diabrotica virgifera
  misc_feature (776)..(776): n is a, c, g, or t
gtaaaagctgctgttcctaatgattttacagattatattgaataatatgcaataaggaaactcgcaaagtgctggaaatatataagtattgacttgacagtgacgtatttattctagaaagggtaagatctctcagtttacatttttagagcagatttgatattaaccaagccacaagatggcggttaagcagaaagtggtagagtgtgccacacccacaaaggaggcaagattacaaataatacttcgggcactacaaggactttcagcaaatgatggacttcaagataagttttgtgcacaagtagtaaggagcttaggcactgttcccatcccatcagatcctggtagttatatgaaatttgttgaagatatcaaaaaagtacaaaacatcctgtcgaaagagtgttcagaacacgtattcattgctttaaaagcactacttgatgaaatttcaaatccagatccacaaaagcaattatctcccgctatgtctatagtacttcaactaatagatgaggcaactatacctaatgctgtaaagtacatattaaactgtggctatccagaacaacatcttgaaaaagctttcttcaccttgtccatctggttgacgcaatgtttttgggtagaaaatttaggccctcttgttcttgctttcatgaagggactagaagcagagcaccactatgaaattctaattgaagttactctggtgactatagaacctctttttaaattagtcatgtttcccaagatcagaaagagtgtggggncggttgttctttacatgttatccagaaaccagcacaacaatccacaaatatttcataagactataccattggctaaaaccggttgtgacaagttagacaaagaaagaagtgattccaggttaaggtttcttcaagaaattgttcag

SEQ ID NO: 2824 - DNA, 939 bp, Diabrotica virgifera
tataaagttcacaaaatacagcaaacgaaatccaaaatagacaaaatacgacgataaacaatgaaaaatagatattagaaacatacataacctctaactttttgtatgccaaccagaagtcacgtggtttggattgcccaaatagatacacgcgcggcaaatttgaaaatgaacgcaaattgaatagtaaatggcctctcttaaaatataggacattggtagtatgttcatagaatgtcttgtggtaacattccaccaataatttaataagatgttcaccgaatgttccttgaatgtccaggacattcaaacattaatagaactttgatagtacattcctggaatgttttgtgttgttagggttgcaatccgaaaattgtaaaaaattattgctcgaaaatgttctcggctaagatccatttttcgacagactttctaatttcaaaaattcactgtatctatacgacttattgtatcgcagtgaaactctgtatgtatgtcaacaattgaggctacattttttgtcggaatgttttattggtagcgccctctaagcggctgtatgcaaaactaaaaaggcaaatctcgtaattaggcaactgcatatctggaacttatacttgtaataactaggttgaaaatttatgattttttagtattttaaattcatttgttatcataaactctttgtataataatatcatttattttactataacaagatggtacttttcagcatctgcagtaattctgcagacctaaacaggatttacttttaacatgaagatactttcagtcttgtgcaataattcagaaacgacgatgaatgtaacaaagagagaaaagcagctattggtttgggtctacattatactaatcgtaatcagatcatgcaatttacagggtggtacaagttttagcaaaatgcaaaaacatacg

SEQ ID NO: 2825 - DNA, 1031 bp, Diabrotica virgifera
  misc_feature (971)..(971): n is a, c, g, or t
gttttaagtgaaaaatattctgattaaatttttgaatgagtaaacatactcatctcagaatcaacaaaataatgtgtgacaacacattacgtatgtgggtatgtgcggaaatcatagttgatgcgatttgtttacatgttgaaatgatataaattcactttatgctctctcgcttaccagtacaattaaacacgtatgagcgcaaacatcaccaagtaaatataattagtgagtgtgatattaattaattagaacagtgtagctgatattgatcacgtaaagctatctagacctttgactccaggagctttattgaattgattattttagtgtcttaatcatgtccttaacaaagaacttatcgacttgtggaaaatgtgttgtaaatagagtaccacatagaaatattgtttcaaaaaggaagcaataggagccagaactagtcaaattttagtatcgatcagtttagctgataatgaaactatgaaaattagaagaattgaagatttaatatctcatttagaacaatatccagaagccaagcataacgctgtaaaggaaggtggaatccgttcccttttgaagataagggatactacaaaaaatcctcagcttttaagtagtttgaatgtagcaattacactcttaggttacacagatccagtacctggtgttggtataaggatcctctctatagatggaggaggtgttagaggcatactagtaatagaaatgctcagaaaactcgaggaactatctgggaagccgatctatgaaatgtttgattttatttgtggcgtcagtacaggggccatcatagctaccttgtcaggactgaagcaaaaaagtttagatgaaatatcagaaatttacaaaagcattagcactcaaatttttaaccagtctgctttctttggtaccagtaatttaagtttggagtcactcatattatgatacaccactatgggaanagttattgcaggaacaatggcaagatatgttactgattgagaccagacgcaacttgaaag

SEQ ID NO: 2826 - DNA, 1376 bp, Diabrotica virgifera
  misc_feature (1267)..(1267): n is a, c, g, or t
  misc_feature (1335)..(1335): n is a, c, g, or t
cgaatatagaatccgtcaagatgcaagccaaaaatattgttctaaatcaatggagactcatcaatgaattaaaaaagtatttttcaaaatttaccaatgataaaacatttgagactgcactaaacaaagaatttgcacagtttctgcaaaaaattgattctaaaacgtatgggaagggtcttgtgaaatattttacatcacagtcaacagacatagtaaaaaatacaccaatgcatgaaactaaagtagaaaaagatgtaaaacaggagcaaagtataccaagtcgtctatctttacctatacaaaatgttctaagtggcttaagtataaatattaagagtaaggaagatgaaaagaaagaaattatacccagatggaaaactgtaacaaaacccattgtatcacaggaagcaataggagccagaactagtcaaattttagtatcgatcagtttagctgataatgaaactatgaaaattagaagaattgaagatttaatatctcatttagaacaatatccagaagccaagcataacgctgtaaaggaaggtggaatccgttcccttttgaagataagggatactacaaaaaatcctcagcttttaagtagtttgaatgtagcaattacactcttaggttacacagatccagtacctggtgttggtataaggatcctctctatagatggaggaggtgttagaggcatactagtaatagaaatgctcagaaaactcgaggaactatctgggaagccgatctatgaaatgtttgattttatttgtggcgtcagtacaggggccatcatagctaccttgtcaggactgaagcaaaaaagtttagatgaaatatcagaaatttacaaaagcattagcactcaaatttttaaccagtctgctttttttggtaccagtaatttagtttggagtcactcatattatgatacaccactatgggaaaagttattgcaggaacaatggcaagatatgttactgattgagaccagacgcaacttgaaagttcctaagttttgtgctgtatctgccgtggtcaatcaatccaggttatcagcttacatattcagaaactattctttgccatgtaaggttcagtctcagtacaaaggaggttacaatcatcaagtatgggaagcggttcgggcatccgcagctgctcccacttatttcgaagaatttaaaattggaaatatgctacatcaggatggtggtattctagtcaataacccaacagctgtggctatacatgaggncaagcttttatggcctaacactcccatccaatgcgttctatcttttggcacaggtagaactgtcccanatccagttttaagctggtatcaggacaaagatgccacaatt

SEQ ID NO: 2827 - DNA, 1491 bp, Diabrotica virgifera
acggacgcgtgggcggacgcgttgttggggtaacacgttgacaagaaagtgacgtttcggtgtgttgaaatttgaaagtgataacaaataattgatcaaaaatggcttttatgatgccagtggtgaaaaacgattgggatatctacaaagccaatcgttctcgaagagtttccgaatgcgcgaaccctacatcatgccgttcgagaaaagtgtcagagtgtaaatcagaaggtccaagtctgtcgacttctcctggatcggaattcgtaacatccccgatccgcagttctgtgcccagcaatatgtcatcgagacagtactccagagcaagttccagaacaagtgaaaccagccttcccagcccagtgaggcatatgagtgtagggtcatcgcccccgaagaacgactcagaaccgaccttgaacaagttccacaacagacttctggacaaactgaagaagtctttgaggagtgggtcagagagcgaaaaaaccagttcatgagacaaggaaaaggaagggtcgccatcaaaaggtgacgggaaaagactgtagaggtgattttttgtttacctaaccgggccatcgagctacgtatgttcaggtatagcaactgatctgttgtcctgtgatatgtagtgaatatagtagctttaattgaattgtttaagtttgctgctcggttagtatacatattgttatatttatttgattttttcacagtataatagcgttgaaaaagcataaggatttataacaccatataataatctgtattttttaacctatactgtaatgcgatattgagaacttattgttctcgtagaatagggatttagatttataaatgacaagactgcagataaatttatacataagtaattataatattcctcaaaactgaaaggaatcaattattttttattttttcatccaaattcaacataattttctttataggtacctatttcctttcttgttcaccaattaatgttgtggttgcataataattgctgttaaaaattacataacatcattgaatatcagtaaaaattacaataaattattgattacccgtaaaaattacataaaattgttgaatatcagtaactatctaattatctaacatttctttagtgatattgtaaaaggtggtcggaattgttgataacatctggttctttttatttgataaatcttttagtatctaacattatttcatgttttaaacaatctaactttgactgtttgtaagataaagctgctataaaacaattaagactggtttgatatacaacagccgttgcagaatcactacagattataggtgaaagtttctacttaagtttttcttttttttttattaatgttaaaagtatgtacccaatataatcaataattacataaaatataattcttccttttttgaggatcaaccagaaaatatatacagatgttttagaaagaaacaactcacttctaacggtgttca

SEQ ID NO: 2828 - DNA, 958 bp, Diabrotica virgifera
gaaactaagcatgtgctgagtgatagtactttttactagccctttcgtccggttcttagtaattttatcaagtgttgttgccacggtgtggactttatttgcagctggattgtatttttatcattatattattgaagttgttttagatcttcctttaaccggccaacaatcaccatgtacagcacatgcagcattaaagcagctcatagaaaaacttctccaggaagtagcaaatttaccacaattacagcgacctcaacaggggacagcaataccaccagatctgaataatagaacatacgaggacttacttgctacggccatattaaataaggttatatcaaattcccaaaatgctcgtccgtcatcttcagctgcaagcgtttctagtagaatatcaaactcctcccacattaaagaggataaaggattcttcttcggagaagaaacgttggacagcaaatggaggcatccagatgtagaaacaacgtcagtttcaagcatagaagattggctacatactgattccagtttcggatcacgaaaatacgttgacagagttactcttacgataaaacaagatatcgaagaagtatctcacgccagcgattcagatcatgaaggcaacgaagacgatgacaatgagtacttccgtagcaaatcgtcattttggagcgatgatgagcccaactggtttttacagaagcgaacttttcaaggaacgcattcaccggtaccggtaccaatgttggtgccgaatccaacaatagaaagtaaggtactaatacggcgctaacaattaaacgatacctcagattattagaagtaaaaaccgaatcccgagacacgaaatagtcccagcagaaactattttatttttcaattctaaaaactttaatgaggaaaaaacacctttgctataatggattcggaaatggggaaaccgaaactcaatttt

SEQ ID NO: 2829 - DNA, 1996 bp, Diabrotica virgifera
  misc_feature (816)..(816): n is a, c, g, or t
  misc_feature (832)..(832): n is a, c, g, or t
  misc_feature (863)..(863): n is a, c, g, or t
  misc_feature (1982)..(1982): n is a, c, g, or t
cggacgcgtgggcttctttggacgagacccagtgaatgcatgtagaaatgtatcggaagaagaattgttacgcgatcgcactaaaagtaaacaaaagtttgtgaatattccgcgttcatcgtcttcgtagaggttttgcctgtagttgattttatgagaaaaatttttattgaatggattttacaagaaaaagtgtttttagtgcgggagggtatttggaaaatgcctgcagatatggtgtcgtttgccgtttcaacagggctaggagttagtgttgtcgctgggattatatctggagtatgctatgttttggcttatgggtcccaaaggaaaagtagtcgtaagagtaaaagtaacctgcattgcgacgtctgtggagagtattttcggtctatagatcacatattaggaggtgattgcagcgtatcatgctcaaaatgtcaaaagaatgtctgtcaaaaacgttgtgccaatttcgacgaacaacaaaatgtttggacctgtaaaaactgtcttcgaccaccagagtcctggtttcaaggaatattatatgcaattcaacccaacaaaaaggacttttctatggattctaataatgttatggaatctagtcaactaaaaaataaggatcatgttcaaaaaagtaaagaacaagttcaagattttatcgaaaaattagttaactctatgttaggacaaaacattgatgatgctaacataaccaaaatgtacaacgatgaacattatcttcctttaaccggccaacaatcaccatgtacagcacatgcagcattaaagcagctcatagaaaactcnctccaggaagtagcanatttaccacaattacagcgaccctcacaggngacagcaataccaccagatctgaataatagaacatacgaggacttacttgctacggccatattaaataaggttatatcaaattcccaaaatgctcgtccgtcatcttcagctgcaagcgtttctagtagaatatcaaactcctcccacattaaagaggataaaggattcttcttcggagaagaaacgttggacagcaaatggaggcatccagatgtagaaacaacgtcagtttcaagcatagaagattggctacatactgattccagtttcggatcacgaaaatacgttgacagagttactcttacgataaaacaagatatcgaagaagtatctcacgccagcgattcagatcatgaaggcaacgaagacgatgacaatgagtacttccgtagcaaatcgtcattttggagcgatgatgagcccaactggtttttacagaagcgaacttttcaaggaacgcattcaccggtaccggtaccaatgttggtgccgaatccaacaatagaagcaaaggtactaataggtgataaagaagtagacgatacctcagacttatcagacgtagaatcggaatacggagatacagaaatagtcccagcacgacacagcctacttgtcaattccaaaacacttataggaggaaaaaacccattgcaaaatgggagtcggagatgtggaatccgaaagtgaatcttctgctgattcgggtgtaaaagaagtcgatagaggccagtctgtatacgatgaatccgaatttacggatagagcagaaggcggcagtcaaaatgaagatgaacatcatacgtcttttgtgtctaaagcagatattacaatagatgacgataacgtagaagatgcatcactgatgtcagtatacagcaacacagaacaggaagcagaatacacagagagatatgcatcactaccaagaaaaatagaaaaaataccagatcctgacccaaggtcttcagaaaaaattagaaacgattacacgaactacgaaacagtaaataaagtggaagatgacgataaggaagctgaagaagtgagactggtacaaaagcatttttcaggtagttacagtaaacgggagaaagaaaaatggaaaaatgccgtanaaatgaaaaaatat

SEQ ID NO: 2830 - DNA, 1671 bp, Diabrotica virgifera
gttgtagccgctgctgacttaaagaagctgagacaattgggatgtgacctcgaaggtcatcctacacctcgtttgaacttcatcgatgttggtactggatccctaggacaaggtctcgctgtagctgctggtatggcttatcttggcaaatacatcgaggaagccccttacagggtttactgtctaattggcgatggagaaagcgcagagggatctatctgggagtcagtcaacttcgctagccactacggtctcgacaacttggtacttattttggatgctaacagacttggacaaactcaacccaccatggtcggacaccaaatcgacatctacaagagaagactcgaagcattcgatttcaacaccattgcagtcgatggacacgatataggtgctttggtgcaggccttcgatgctgctgcttccgttaaaggaaggccaacagctatcattgctaaaacttataagggaagagattttccagacatcgaagataaagaaaactggcacggtaagccccttggaggagaaaccgaaaaaatcctcaagcatctcaaaggccttatcagaaaccaaggtaaactgaaatacaacattccaccacccctcgcagaagtcgcaccagtaagcattaacaacgtaagactctcctccccaccaaactacaaacaaggacagatgatggccacaagagcagcctacggtaacgctttggtcaagctagcagaaaccaaccccagagtagtagctctcgatggcgatatgagcaactcaaccttctccgaagccatgaagaagttcggaccaaagaacttcattgagtgctttattgctgaacaaaatcttgttggtgtagctatgggaattagctgcagagaccgtaccattgctttcgtgtccaccttcgctgctttcttcacaagagcttttgatcaaatccgtatggccgccatttctcagtccaacattaacatctgcggttctcactgtggtgtttccattggtgaagatggtcccagtcagatggctcttgaagatctcgctatgttcagatctgttcctggaagcactgtattctacccatccgatgttgtatcagtagaaagagcagtagaattagctgctaacaccaaaggaattactttcatccgtacagctagagccccaactgctgttgtctaccccaacgaccaggtcttcgaagttggaaaagcccttgtaccaatctccagcaacaaagaccaagcactgatcatagcagcaggaatcaccctccacgaatctctgatcgcagcaaaggatatggccaaagcaggaattcacgtcagagttatggatccattcaccatcaaacccatcgacaaacaaggaatcatcaacaacgcccaccaagccggtaacagaatattggtggttgaggaccattacccagaaggtggtatcggagaggcagttttatctgctttagctgaagagagaaatattattgttaaacacgtagccattccaagagttcctagatccggtagaccagcagatttgttgaactactataagattgatgctaagaatattgtaaaccatgttgatgaattactcaagaagtagatttttaagttaataaatgcacatttttctaacaaattaacttaaaaaaggcggccgctc

SEQ ID NO: 2831 - DNA, 1099 bp, Diabrotica virgifera
tcgcgggtcgacccacgcgtccgcgggtgccgagtgtcgacgtgactgactaaaaatggcgggaacagcaacagatttgcaaactttgaaggacctggctacacgcatcaggatacatagcgtggaatccactacacttgcaggttccggccatcccactacatcctcctcaattgccgacattctctcagtcctcttcttcagaaccatgcgctacaaagtttcagctcccagagacccatccagcgaccgtttcgttctttccaaaggtcacgctgctccagctctttacggagcatgggtcgagaacggcgttgtagccgctgctgacttaaagaagctgagacaattgggatgtgacctcgaaggtcatcctacacctcgtttgaacttcatcgatgttggtactggatccctaggacaaggtctcgctgtagctgctggtatggcttatcttggcaaatacatcgaggaagccccttacagggtttactgtctaattggcgatggagaaagcgcagagggatctatctgggagtcagtcaacttcgctagccactacggtctcgacaacttggtacttattttggatgctaacagacttggacaaactcaacccaccatggtcggacaccagatcgacatctacaagagaagactcgaagcattcgatttcaacaccattgcagtcgatggacacgatataggtgctttggtgcaggccttcgatgctgctgcttccgttaaaggaaggccaacagctatcattgctaaaacttataagggaagagattttccagacatcgaagataaagaaaactggcacggtaagccccttggaggagaaaccgaaaaaatcctcaagcatctcaaaggtcttatcagaaaccaaggtaaactgaaatacaacattccaccacccctcgcagaagtcgcaccagtaagcattaacaacgtaagactctcctccccacccacctacaaacaaggaaaaaagatggcccacaagagcagcctaaaaaaacgccccccgtcagctcttttttgttcatgattataaaaaaaaaacacaccccacacaaaaaaaaacccccccccg

SEQ ID NO: 2832 - DNA, 1009 bp, Diabrotica virgifera
  misc_feature (154)..(154): n is a, c, g, or t
  misc_feature (895)..(895): n is a, c, g, or t
ataatggagaagcagctgacaatgaaaacaaccttaacgaaaactacacaaaaacaacacaattaatcgaaacacccaagaaaagttaaaaaagaaaaaactaaaaaatccaagaaaggagaaaaaggaaacattcagtaaatccacttagtanatcgatccctcaaaagaagaatgttctgtgtggtcgagttttgttggtatcaaagagaaaaatggaaatggaaggtacacaaatcgacatgacaaactgcaaggcttgcgcgaagcaagtctttcaaatggaacaaatcaaagctgaaaaagcagtttggcacaaaaactgtttcagatgcacggaatgtagtaaacagttaaccgttgaaacatacgcgagccatgagggcacgctctactgcaaaccccattttaagtccctcttcgcccccaaggccgttgaagatgacactccatcaagcgacaagcccgacttgggtctcgaggaactccagagtttaaatgtaaaagaacgcttccaagttttccaacaaactcagtcggagactcaagagatggacagaggacccactcctgtcaatgttaaaaagtcaccctccattttatcgaaactcgcaagattccaagctaagggcatggacgtcggtgtatccgacgaagcattgaatggaatacctatcgaagagtcctcttctgaagccgaggaagaggaggaggaagtgcccgaaggagaggatcccactctgtacagggccaaaagggtgcaaaaggaaaaaccgttccattttactaatctgaatgaagtgaagaataaatgggaacagggagagcaaaattcgaaagatgagagacgggaggaaaggaaacaggagatccaatccattaggaataaattgtntttgggaaaacaagggaagatgaaggaagcataccagcaagctgtaatccaatcagaatcttgcacaaatctcgtaaaatcagagaaaatagagtcctgtgataccagtctctg

SEQ ID NO: 2833 - DNA, 1322 bp, Diabrotica virgifera
agtcggtgtaagaacgcgatccgtttcgaaatagctcgagtgaatttttgtttagtaaatattttggattaggttaattaattacttgactagtgactacaatgcatcctgaagcaagcgacaagcccgacttgggtctcgaggaactccagagtttaaatgtaaaagaacgcttccaagttttccaacaaactcagtcggagactcaagagatggacagaggacccactcctgtcaatgttaaaaagtcaccctccattttatcgaaactcgcaagattccaagctaagggcatggacgtcggtgtatccgacgaagcattgaatggaatacctatcgaagagtcctcttctgaagccgaagaagaggaggaggaagtgcccgaaggagaggatcccactctgtacagggccaaaagggtgcaaaaggaaaaaccgttccattttactaatctgaatgaagtgaagaataaatgggaacagggagagcaaaattcgaaagatgagagacgggaggaaaggaaacaggagatccaatccattaggaataaattgtttttgggaaaacaagggaagatgaaggaagcataccagcaagctgtaatccaatcagaatcttgcacaaatctcgtaaaatcagagaaaatagagtcctgtgataccaagtctctgaaagagagattcgaaaaaggagaattggtaatagaacgagaagactccaggaacggagactcagatgataccgaagtgttccaaaagcgaaattagtaagaaatctaggtccttgttccttgaacttgatgccaatgctgccaaacagccccagagcatatcacctgttgctgtacctaaaaagtagatgtgaaaaagctcgagagtctgacactcccgaccgggaaatctaccacggatccagaaattaattcgtctgatgagataaccgaccgattcggaaattgctagggctttccacacccgcttccaaaatggtaaagcaaggtcaaaaaattggaggaaaacttttttcagggacccaagaaaccaacaagggcctttaaaacatttgaaaaaaatttccccccccccccggagccccccaaaaactgaaaaggaaaaaaaagggaaaaaacgggatccggggttaaaaagggaaaaaaaaattaagggttttccccattcacccccaatttccctgggaatttgtttgaagacacaaaaaaggcaacccaaagttttagacagcttctggagggcaaattttgtaaaaaaagggggaaatctctcctcaaaaatttataaaaaaaggagaacaaaaattcaaac

SEQ ID NO: 2834 - DNA, 1028 bp, Diabrotica virgifera
  misc_feature (942)..(942): n is a, c, g, or t
  misc_feature (973)..(973): n is a, c, g, or t
  misc_feature (999)..(999): n is a, c, g, or t
ccttaagggtttacatgtttacgtttacagattacaatatttacgtagtgaacctgtagattaaaccaaaattaaactgttaatttttaatttagttatcaattcttgaattgctttatatcacaagttagatacaattccattagcatattagtgattaaaggtctaaaatcttaatatattatttcataatgttattaaaatggggaattgcagcagctggtaaaatatctaatgattttgtcacagccttaaaggccttgccattaactgaacataaggttgtcgcaattgcgagtaggtctcaaagtaattcagacaaattcgctaaaactcatggtattcccaatgcttacgagggttatgataagttggccaaagatgaaaatgtaaacatagtttatgttggggtgttaaatccacaacattatgaagtagtaaaattaatgttggaaaatgggaaacatgtactctgtgaaaaaccatttaccatgaatgagaagcaaaccagaaagttgttggatatctctaaagaaaagaacttgtttttaatggaagcagtgtggtctagattcttcccagcctatgataaaatgatagaagttattaaatctggagaaattggagaggtagtacaagtaactgtagaatttggagtacctattagtcatgttgatcgtattaaaaacaaagatctgggtggaggagttattctagatctaggtgtgtacattcttcagtttcaacagtatgtgttcaacggtttgaagccaacaaaagttgtagctagtggacatctaaatgaagagggcattgatagttccgttgcagctattttgactttccctgaagggaaaactgctgtactttctgcatcttcatttacgaaacttgcctgtgaaggtgtggtatatggcacaaaaggatgcattaagatgcctnaagttttggtgtcccacaactctagaagtanatggtgtagtcatagaatttcctttngataaaaatgaaggcgagttcattactga

SEQ ID NO: 2835 - DNA, 987 bp, Diabrotica virgifera
cggacgcgtgggttgaaatatacaaaaaaaaaagataaaagtgaacgacagttcatgtttccttacgattcagagaatatccaccatccctagacagctgtttctgtctctagacgtcttcagtagggctacgtgaacacttctgaaccaagacgaaaataaactgcgtatttaagtggaattataaaaagagatgcagtataatacttatttatttaatttttgtatttgatattttactagttttatcttttaaaggacgaactaataactaattgcaaaaatatgttgcttatttgtcttcttcgcatactaagcatcaaaaaatttttgaaggttgttaatgttttcagttgaaaaatgcgcaaattaggaaagtgttacctctagtattaaatacataataaaataacagttttctaagaaatttgttagatcagttatataatgtcagcattgattgttatatattatccgagatttagtggaatctgcgagtaaattattaaaatataaatttttcaaaatatattaggtacaatattttgttgtaacgtccactattgtttagcagagaataatattgacatgaaaatatctgaatagacagattctttaagagaacaagaagtaattttccaataaaacggacacatttcattgtttttctttcattaaataaaagttgtaaacggtgtttcattcttcatcatcaattgacaatcaatcttgagcctcaatcttcatgagtgtgttttcccagacgttacaccgtccttctactttagccttgacttttccatactcattttctcatggcaaagattccattgtatatatattcatgtttcgttactgcaatatacagtcaggtgcaaaaacattgatccacgcctatttgttagagaagaagagaaatttggagtttattttatttggcaatttagtacctactattacataaatagattacaggtatcaagcaaa

SEQ ID NO: 2836 - DNA, 1064 bp, Diabrotica virgifera
gtcaaagtccaggtttaattttatagaaaatcttatttgtaaatttgtaattggggtccaagggtttgtgtttgatacattaagtaaatacagttgaaatgtctaccatacgttttttgggggcactttctagaacgtccaaaaattatattcaagcatacaatctatgtcaaacgagatgtatgtcttctttggaacttaaacatttcaaattgaaagttgttgataatgtgggagttataactatagattctccaggagttaaggttaattctttaaatgaagacgtccttaaagaaattgaattattgcttcccaaaattcaaaatgattcccaaattcaagcagccgttatcatttccggaaaaccgggagtcttcattgcaggagcagatgttaatatgctggaaacgtggaatgatgccgatgagggtatgcagaactgcctccgaggacataaacttttacaagatatcgaggacagcaaaaagccattcatttcagctattcaaggatcatgctttggtttaggcgccgaattggctttggccacgcattacagaatcggcgttaaagataagaagacctctatcgcactaccagaaattatgctgggtcttcttccaggttgtggtggcacacaacgacttcctcggttactgtctctaccaaatgccatggacctcattttaacaggaaaagcgttaagagcagataaagcgaaaaagatgggcgtattagatcttctagtcgaccctttgggccccggattggatactcccgaagcaaataccgctaaatatctcgaaacagtggctattggtgtagctaaggatttggcatccggaaaattggtacctaaaagagagaaaagcctaacagataaaatcttagcgtatgcattgcaattctattttgtcaaagaccaagctattaataatgatagagaatatgttgcgtgacaaactcgcagatttagcaataatacctaggatgcactggagggactatgagtcatattttacagctgtgaaatagtcggattcaaagaagaagctcgggct

SEQ ID NO: 2837 - DNA, 1009 bp, Diabrotica virgifera
gttagacacgatagaagtagcgaacatagaatcaaggtgaaaaagcctgttcaagtcaaggcttatcaaactgcggtaggtctagacgtggattgtctcgaaggaagaatttattggagtgatatcagtggaagggctatcagtagctcagctttagatggtactgataaagaacattttattgtcaatgatataggatcacctgaaggtctagctatagactgggtagcccgtaatgtttactggactgattcaacgttagacacgatagaagtagcgaacatagaatcaaaattacgccgaacccttttcaacactggcttagtaaaccccagaggaatagccgttcacccccaaagaggtaagattttctggacagactggaaccgcaaggatccaaaaatcgaatggtccaacgctgacggctccgatagaagaattttcttgcaaggttcggatgtgtcccttcccaattctttaactatcgacttcgaaacagaacagttatgctatgcggatgctggtacaaagaagattgaatgtgttaatattgatagtaagcagaaacagactatagccagtaactgcacttatccatttggtattaccactacagataaggagatattttggtcagactggatcacgaaaaaaaaaattgaaagagtagaaaaatacaacttaaagaggcttccacccctacctgtcccactaggaggcaccggaaacaggctatttgcactggtagctgtagcaaacaagtgtccatctttaaccaacgtctgcgagtactacaagaatcaatgtcccaaagatcacatctgtcttccaaatggcttaggtggcaaacagtgtctgtgtggcaaagattcacaaaataacgatgttacaccaagttgtaatttatagataaattgcgtaaaccgaaataattctagaggtgtaagcacaagaattgaacaatgttcaatgaatcgtcatttcctgaattgttcttgtagttctctcc

SEQ ID NO: 2838 - DNA, 953 bp, Diabrotica virgifera
cgggggcccccccccctccccccgcgatttttttttaaaaaaaaaaaaaaaaaaattatttcgacaaagcaaaaacataaccagtgtcacacaaagaccaaaatataccaataactattggataacaaagctaataagttaaaggaaaaaaaagaccattacgatataagaaacaaacaaagtttaagcttaaaaattgctgatagaaattatatcattaccattgtatgttcaacaaatggtttttgaatctatttaaggaattgcagaatatatttaattcatttagagaattcacaagtttaagtgttcgtggtaacaaattgttgtaagtatggttatatccatggaagcttatgtgaaaagtttttgggtagaatgaattgttctctcagaaacgacgcttgaagcgaccggcgattttgaataacgcaggctagatcaattttttaaaataaaatttgtattttaaaagatattgaatttttcccattgagttgatacaaattttatttaaaaaatttatttcgcggtcgtatcaaaatcggcggttgcttcaaacgttgtttctgggagaacggttaattcttctagacaaaaagtgctaataaacatttttgttgaaaatcatctctgctatatttcttgtttgaaacattttttttatggcgtacagattcttggtaaatcgatttaccctccccccttaggagagaggttttagtagaaagcccgggagtaagagtggcaataaattgacatccctagcaaaattcagcttgctcatgtgatttttataggtccagtggtatttttgtctctagcgactggaacatgttattattttatttaaaaaatacggtttttgtttgtttttatgtaaatttaagataataaagagtatattctgccaccaaaaaaaaaaaaaaaaaaaaaaaaaaaaaaaaaaaaaa

SEQ ID NO: 2839 - DNA, 499 bp, Diabrotica virgifera
aacacacgtccgcgcatattaacgacaagattactttaccaaatgcacaagcaactgagatagtgatatcaaaagctctagagtcaattatgtctgctccactcgcagtttctgacaacgttccaaatcaaatctgcgaaacctgcaaaaatcaaataattttcatagctacaagtcgatttgccttcgaaaaggccaatgccatcttacagttgcattctgctggtcgtctagaaaagaaaccaatcaacaaacaaaacaccattgagagagataatactgaaatcaataatttaccacaatgcaaagtggaggaaatagatatatttgaagaacctttaattgatctgcagagtccggaacaaattgattatgaattggtagacagtgtcaatgacgatttggtttctgatggggattcccatgaatctgacaaaagcgtagcgtatgtatcgaaagtggacccagtgctactacgaccagacattagcatcgaaga

SEQ ID NO: 2840 - DNA, 1049 bp, Diabrotica virgifera
aaaataataggcgtttcgggaatttgataaatatttgattctcattttctcatttttacagcaattttattgggataattttattaagaaaccgttacaatgactgactcaaaatattttactactaccaaaaagggagaaatatttgaattaaagtcagagctaaataatgataaaaaggagaagaaaaaagaagctgttaaaaaggttattgcctctatgacagtaggcaaagatgtttcagctttatttccagatgtcgtaaactgcatgcagactgataatttggagctcaaaaagctagtttatttatatttaatgaactatgctaaatctcaacctgacatggctattatggcagtaaatacttttgtaaaggactgcgaagatcccaatcctctaataagagcacttgctgttagaacaatgggttgtattagagtagataaaatcactgaatatctttgtgagccactgaggaaatgtctaaaagatgaagatccttatgtaagaaaaacagcagctgtttgtgttgccaaattatatgacatttcgtcaggtttggtagaggatcaaggctttttagaacagctaaaagaattgttgagtgattccaaccctatggtagttgctaacgctgtcgcagctttgtccgagataaatgaaagcagtcctactggtcaacctctagttgaactcagtacaaacactattaataaacttcttaccgctctaaacgaatgtaccgaatggggccaagtgttcatcctcgattcactttcaaattacacccctcgtgatgagcgcgaggcccaaagtatttgtgaaacgtattactccgagattggcgcatgctaatgctgctgtgggtttgtctgctggtaaagttttgatcaaaatgatggagattctagctggagaaactgattttctgcatactttaagcaaaaaaaaaactccccccttgggaaacgtggtttattctgaaccaaaaaggggaaaagggggctttatgaaaatctacttttttttttcaaaaaaaaccccca

SEQ ID NO: 2841 - DNA, 871 bp, Diabrotica virgifera
  misc_feature (823)..(823): n is a, c, g, or t
  misc_feature (831)..(831): n is a, c, g, or t
  misc_feature (840)..(840): n is a, c, g, or t
attcattccattactcagggaaagaatctacacgaaaaacccattctccagacaattcatcatttcatggatatcagtattgaattctgaaccaggccttgacttaataagttatttaccagaattactggatggcttatttagaattttggacgattccaatcttgaagtgaaaaaaatgtgtgaaacaattttgggagaatttttaaggaaaatcaaagcagagccatctaatgttaattttggtggcatgatcaatatacttattaatcatgcccaagaaaaagggggatcttgtacagtttacagccatcacttggattaaggagtttgttcaactctctggacccgctatgttgccgtacatgtcgggaatatttacagcagtattgccgtgtctatcctacgacacagaagctcggagaaacattaaagagactgctacagccgtcaactttactttgatgaaactaatatcattaaaggctgatacagaagaaattataagaccaacagcagtctgtgatgacaaaatgccaaatgaattagatttgcattcagtattagatgttttgaatcagtatctcatgcataattcgatacaaacgaaagtagcagtcctgaaatggatacacgatttatatacaaaattaccgaacaagatgggagaatatttcgatattctcttccctgcattacaaagaacactttctgacgaatccgaccaagtggttcaacaatgtttggtagtaatagctgaagttatttcatctccaggaccagaagaagttaataacagaggtgcaaattcgtattataatanatttatgntgagcttgntgtttttgtttaataatgaaaaaagactact

SEQ ID NO: 2842 - DNA, 1403 bp, Diabrotica virgifera
aaagtactgatacagaatttaattgtaaaaattatcaattattacagtattcaaattataaaaaatgacacagttaagatcactaagtagaaagtatattcataacgaacaagtgagagaaaaaagaacacccagtaatactgaaattactacaacaatttttgaacacgtgtcgcttatggttaggtaaataggtcaaatcttcaaaataatacaactgttgcaacacatgtaaaaaataatgtgtcagacatctacgatgtcgtctacactcaaaaatacgtctgggcatactcctaatgagatgattgctttcctcttgacgtatctcgtcccaggtgacttgcacctcgaatcaaagtgccgctatggtcgacggagaatgaagtaaaaggagtcatctttttcccataatggtgggttggggaatatccgtatataaagcagaacatgtggatccaccaaacaatgttcaacatgctgtgggcacatccacatgcccgaaggaggattagtcagaggtggatcaaggcaatctaaatgataaaaggattcacagaagtcgcacgaaatcagtggtgcaactctacaagatctcctacattcactgcattttttagccggcagaggtactgttccacctggtcccttctcgtgcgccttggacatcttgaacgttttccttcctaccttcgagtacgggatttcaactttatctgttccaggaaatacacatggaacactcatacttctgggcaattcaaattgtttggggttcatagcattggcagcttcaatcagaacttccatcgggctaagtttttgcttttttgatggacatttggcaactgaagaactaggcggagtactattggatcttttgcttcgaagttgtggaacttctgaattactgctactttgttttttataatatctacaagattgacacaaccattcacccattggtatgtccttttcttcgagaggtgggtcatggcatccaaaatgaaaactataggggcatttatcacaacatataagatctcctccttcaccacaagcatcacagctatcatgattgtggcctttgccaggtcttttgtagtatggatgctcaggttttttactgtcattttcatcattatcatcactcttaggaggtgctatcaatgcttggatttgattcattaggcccccagaggtatctagatcatacttaacagtagccattttatgtgagaaaccgtccttactatttctattttcaaccttttactagaatttgatcaaattccgatataacgtagattttttcttgttggttaatcaatgcatttctttattatttctctctaaaattatgtctatatgcctacacatttagaataaatcggacgcgtggg

SEQ ID NO: 2843 - DNA, 2570 bp, Diabrotica virgifera
gtgcatccttgaacgttgttggactgttatgtgattggtcacactattaattagtatcaaaaataaacttgtttataaaaatattattgatatgttaaccagtgttatgtggattgaatattaaataacaaggaatcaaaaatgttgcaattagtactagtcttggccgctttggctgtattgttctattattttgccgtcaaacccatgagttactggaaggaaaggggaataaaacagacgaaacctgtatggttgcttggcgatagttggggtactgttataaagaagcacagtttagtggattttgtccaatatatctacgaccaagttcctagtgtaagatattttggatgctaccagatggtaacacctactcttgtcatacgagacccagatcttatcaaaaatattgccgttaaagacgttgaccactttatggaccacagacaaatgatcccagcaaatgccgaccctctattcggaaagaatctatttgcattaaaaggtcaagtatggcgtgacacgagaccgatccttagtccaaccttcaccagcagcaaaatgcgtgccatgttcgttctgatgtctgaatgtggtgagaacttcataaaatatttccagaacaataacaaagatatcatcgaaatggaaatgaaggatacttttagacgttttacgaacgatgttattgctacaacagcttttggcgttaaaacagattctttaaaggacagagataatgaattcttcactatgggaacgagagcagtagattttggattctggcgaagtcttaagttttttggctactttctgataccgaaaattttagcgtttttcaaagtttcaatatttggcaaagaattaagtgacttctttatagaactgattgataagacagttcgaactagagaagagagaggaattgttcgtcctgacatgatacacttactaatggaggctaaaaaaggagttcaacaaaaagatgagaaagttatagatactggatttgcagtagtagaagaagcggatttaggaaatgctaaaggtgccatagaaatcaccaacgtcgatatagctgcgcacgctatggtcttctttttcgctggttttgatgccgtatcttctttgatgtgctttacaacctacgaattagcagtaaaccctgatatccaaaatagattgagagaagaagtcgaagatacgctgagagaatgtaatggcaagctaacatatgaaggtttattgaaaatgaaatacttggatatggttgtttcagaaaccttacgaaaatggccaattggtgtaatggccgacagaatatgtaccaaaccttacaccatcccagctgcaacacccgaggaaaagccgcttgttcttgaaaagaacacagttcttctctttcccgtatgggcgatacatagagatccagcattctacgaaaacccagagaggttcgacccagaaagattcaacgacgaaaacaagtcaaaaatcaacccttacacgtatcttcccttcggcattggtcctaggaactgtataggatctcgatttgctctattggaagcaaaagtggtgttgttttatctcttgtccaattttatagtcgagccttccgcaagacttacagtaccactgaaaatttctaggaagcagatcaatgtgacagctgagggtggtttctggtttaacttgaagaagttgaagaattaaaacgtacctaccgactaccgaggtgtatatacctattattgttacatgatataaactgagttgcgtgttttaacaattaccaactcatctttgtgcggattactgcgtgtgaacaacaaaaacttcatttactaaaatttttacccgacatcactgcttttgaaataatcgaaggtactgatttctttttggctaggtactagttgttttaaatgcatatatttagtagttctcggacatgtatatgtacctatatgtataatactaattattattaataataagtctactaggtacgcttaatatatttttactttatatgtgctatatgtgtgctaagaatagctattgttgttattacgatgtttgaagttatacttctttaggcgcgattgagattgagggtgaatttatattgatctgcgcgcatgcgcacaccgacagtatggtattagtcgttatacgggctctgattgggtgttgaaatgatctgtcaataataaataattgttcaatataaaggtaaacaaatgtataatatattagttttattgttgtgaggacagaaacaaaaaagtttataattgtagtgacttttaaatagtttttaaagcaaaaggtacgtaataattgtaaatgtgtcataggtacctacctatttgaacctaccaaaaacatagtatgtaatacttttatttacataatttgcttaccatcaaaatttctatcaatattcacctaacatattgttctcttactctatgttttgttgtattttttcattctaaatcatttcaatttgaaatcaaaataatttgatttatgtaattcaaaaatgtcaaaagtttaat

SEQ ID NO: 2844 - DNA, 1001 bp, Diabrotica virgifera
agcggcgaatcgattgagggtaaaatttgattgatccgcacgcatgcgcacacagacagtatggtattagtcgttatacgggctctgattgggtgttgaaattttgaaatgatctgtcaataattgttcaatatggaggttatcggtaaacaaaaatattgtataatattagtttttattgacgtgtggacagaaataaaatcaaatttataattatagtgactttttaaatagttttgaaaagccgcaggtacgtaattctaaatgtttcagttggaaatacctaatagtttcaatacctatctatttggaaaatgtaaacaaaataatgtagttgttacctattagtaggcaatgctttaatttacataatctgattacgaacaaactttctacaaatcttcatctcatatatcgttttcttactctatgttttgttgtattttatttcgacaaaaatcaaactaataattttattaaattcatataaatttatggtgtaaacgtttagtttgtgtatattcccacatgacgtacacgcgaatgtggtgcagtttgaaatgccgtcaactttcgtacggcgcggtagacgtgaagtgggttcaagccccaagcaagttattctttttttattttttttatagattttatgattgtaagtatattattatataatttttgaagatattcttcttttttgaaagtggtagataagaaagttagtttgatttttaaataaaataagtacaaataaccttttaagtatatttacttcgtttaaattacctattatataatagaatatctccgtacgtgcgtacaaagtacacacacattctttttttatttatcagatgatctacttttttcttacaattttaatcaactttgatttgaaatgccttctttttgaggtttttttatttgaacacttgaacgtaattggagccacaactattttttttaattaattattaattatttcatatggtttgatttta

SEQ ID NO: 2845 - DNA, 1046 bp, Diabrotica virgifera
ccacaaaaaaattttaatcccggtcccattttaataataacaatatttttaaaaaaatacaaataaaaaaacataaaaatgttaaaaagtatattccttgggaatgacataaacttagcagaatatttcgttcccattttactcacaaataaattacaaacaatgacgtataatacctagactcacccaatgctgtcctaatttgattacttccggtaagtactatagttctgacgaatagaaacttatttgtttattttcacgagattacttactgtttaactttttatttttgaagttatacttctttaggcgcgattgatattgagggtgaatttatattgatctgcgcgcatgcgcacaccgacagtatggtattagtcgttatacggggtctgattgggtgttgaaatgatctgtcaataataaataattgttcaatatgaaggtaaacaaatgtataatatattagttttattgttgtgaggacagaaacaaaaatgtttataattgtagtgacatttaaatagtttttaaaagcaacaggtacgtaataattgtaaatgtatcataggtacctacctatttgaacctaccaaagtacatagtatgtaatacttttatttacataatttgattaccatcaaaatttctatcaatgttcacctaatatattgttttcttactatatgtttttttgtattttttcaattctaaatcatttcaattcaaaatcaaaataatttaatttaattcaaaaatttcaaaagcttaatccgtttagttagtcgatcttcgcacataatgacacgttgtctccgtggcgaagcgtttaaggcgaatgaaccccaatataccaaccgcgctgatagctggttggaatcccaataaaaacttttattttttattttttttatatattttatgactgtaagtatatttattatataattttattttcagaaaatacgtatttagttaaaaaaattttccgacaattaatgttcagaaatcatttgtggcatttttaatgtgtttgtgtgtgt

SEQ ID NO: 2846 - DNA, 1351 bp, Diabrotica virgifera
cggtattcaataatgaaggtagtgtaccacgccaaaatagccacggtgtaatttcataatatagtttaattatagaatttaattcaagttctaaatattcgtgaacgtagatatagtttaataaagaaatttttttaaattaatcatcggtttttaattcgatagaaacttacaaaataccttttcaggtagatattgattattccacaaacgcaaatattgcaacaaatatgtgtgtcaagtgtcaacaatagaaatagcaggaaatttcttagacagttagaaattcgattagcatcttttattttcgacaaaaatttggcatccacgcccaaaattctgcttaaatttttgtagagagtagaaagacttccggagtggaaattgaaacaccaatcagtagtaaattaagaaatgcaattttctttacacctacaacagtggctcaatcccatatgaacataatactacattaaatatgccacaagaaaacagtgtcagaacttagcagaaatacataagttgattaattattatattctattattataagtatataaattttttttggcagtagtaccccaatattggaaaattaaatactaaaatggtaaaagaaatttatatgatttaaaagaattctctattttagaatgaactaaaaatataaaaataaaatattgcctcttttaatttttcaatcattaaagtgtatgcttcattctctacttttcaccttccataatgcatgccagctcaaaaatttgtacaactcttcaattaagaataggtttgcaatgcttctaatatcactcatttcgactgtccaccttgaaaacttttgccggactgaacttctgaccacacttcaagtaaaactgcacaggtaaaatcttcagcatgttgacgagagtacaggcggcgcttggaggcttacatgtgataccgtcttgctgctcttacctgcgcaaatgagtctctgcagacatggtctcaggcaaaacgtagtgtgtagccagtgtattatactacagacctcaaggctctgaggatagtcggcataatttagattgctcagatttctgcattatcattatgaatgatatatgtacaacgttatgctgtcatgacatttgcaaaaaaaattgtttgtattgatggtacctatggaactaatattggtgaaggcgttgctgtgacgatacgatgatttcaaatagaatgaatactacaatttctacctaataatatcactacagatatgtttatgagagatataatggaaactttttataacggatggacggaagtgataatgtgacagctgtgtctaatcgattattttgttcct

SEQ ID NO: 2847 - DNA, 699 bp, Diabrotica virgifera
tccccccccccccccctcccccccccccccccccccccccccccccccccccccccccccccaattaataaatattttattaaaaatcacacgtcattagtcttccgttgatgtattgttattgttactttttggaacaaaaatataaatactgtaataaaagcagtttaataaaaattacactatattctgatctttttcttcggtgacattcattggagctaatacttcaccgtctacttctttaacctttttattaaaacaaggagtactcatgctaataattgatgcaatcccgaatcccgctgcacacacgaagaaaggtatagtgtaagactttgtcaagtcatatatcgtaccagctagtggggtaccaaacaatgcggctgctcctctgaagagtatcattagaccaaaagcgtttgtcagtttatccagtcccaaaaattccactagaatgatagaagttaacgagatgtaacccgcgatgcctacgccgaataatacagacaaaaatgccaaagcgagtgaagctagaaaataatggcattgctgctgtagaaacggctgctaacgataagggggcagttattaactagaaagttatttacggctgggaaatctgctaggtaaccaacgagctaaacgactaacaatattagttactccgaattatggaaattaatatggatccctgag

SEQ ID NO: 2848 - DNA, 1236 bp, Diabrotica virgifera
cgttcgttcgtttattttattattcgtacgtgataacaaatataatataatgtcaaaccaatcaaatacaccgctcaaaatgatcaaatcgtactaagagtcgtatcacttttttaggaaccagctacattcttataaattttaatcgcaacttccgtttggttcttgaagggaaggccatataggcaaccgcatcatgccacaagcctcttttcctctgattaatttaaagtatccctcttctccccaagaatcaccccatgagttttttaaaatccagtaatcagttccactgccgtcactaccatcattgccgtaacctatgataacagcactccaaggttttctccacgttgaaggatgtggaataaagctgcgcggacagtttgaaccatcaattattccttgcttataaaatggcagatcgcctccatcgaaatagatggttacgggagcaagtagtgctatggtttttttaattaaatcttcactagataaatagttatgattaagacatcggcctttgcagattggtttacattcaccttttccatttttgaagggataatctatttcactgggtattccatcatagtacatttgattgtacgcctcttgataactttcagtacagtcaattagaaattgggtacttaaatattcataggtaagattgtgccatgcggtttctatttccatagctgaagaaattgaaaatgcccaatgctcttcaagatcacccatatccctcggtggcaaaacatatccttttaatctaagatcgactgattctggaacatcatcatcgtcctcaaaattttcaaagtgccgataaggatatatgctttcgttattgcgagtaatgaggaataggagatctagaagttgttgattcaagtacatcgctagaagttgtggattcaacgtcatcaaaattgtcaatgttaaattcttcgaaccttcttgtaagctccttatatgatttgtctgaaaatctagtaatttccgatggtaaacgatgtttcgtgtttttcgtatttaacgattatgttccttgattaactttaaattttcctgaaatattgcaaacctttggctttcttctactagtgtcgcgtaaactttggagtatttcgtcttaaatttttcccgttcttgatactcacgatttgctgcgacgaagataaaatcgaagattacgaactattcttttcgatatttaaacgaatgtctttt

SEQ ID NO: 2849 - DNA, 1204 bp, Diabrotica virgifera
accaaacgtccgcggacgcgtgggcggacgcgtgggtttgtctgtgcgaacttctaacctcatttttacagccttaacatacgtttgacgtctgttaatgctttttaactaatagagattgtctaaaatggcagtaatcgtttacttttgtttcttccgggatgctcaaaaaccatcaacacagtttgtataggaactaagatttttggggagactgaaggagacgttgacaggggttctcatacctgcctagagaagataatacaataatacattttatatatttattaataatatagtaataatgttgcgcgtgcgttgtctactaagcattgtggatttggtcgatcttccgatttagtttaagaaataaaaatatatgggcaacttttttttggttttgtttcctggccttggtgtgaaaccttagccacgtaattactataactatctcgggggagtaatgtgtagtgtgtgttgagtaaatgggttgttacttagtaaattcggcttcgtaaagacaaagtttctacccagactggattcgaacttattgggttcaaaggtaggctctcttaccactgagccacggaagcttgtacccgtctttgttaagattagtttatagttggcgaagaacatttcagtaagtttagctcgcgtatttcgcctctaatcttggaaaaaatatatggacgtgtttcaaatttcaaacaaattgtttattttaagaaaaacgttacgaaaacatatttagttcaaaagtactaattcctcaatatatttcattatttgaactaacattttttttatcctgattattgatttagagatgtgtacaaatcaacaatgcattagtgaatccttcactctctcttagtgtacataatttgaaacaattaattttacatccaattataggtccatgacatgtgacacattcatgtcatatatcattaagtagcaattgctcaattctatgctttcgaaattataaagtaaatcctttctgcaccagtaaaacagaattgaacaattgtgtcagcagaaacatatatttttggatagtaatgggagtcgaatgagtgtccttagataggattttgttatgattaaagtaaactttattgtaacttactgagcatggggatacgtgagcgtggggatatactcggacatttactcaaataatccttatttttga

SEQ ID NO: 2850 - DNA, 1362 bp, Diabrotica virgifera
cctataaccttttgatttatggcacacagccacgtttaatgaattcctctaacacgttaagtgtcacaacaaaactaacagaaaatgttctgtttaacctataaattagttgaagtggttgttttgcttataaatataaataatatatgaaaaatctgatccgtaatactaaataaaaaaaaaatagaacgaaaaaatagagcttctgagaaaaaaatgtgcttatttcaaacacaagaactacgagtaggtggacctttctgatttgaaaattaatatgtgaattcttaaagattaggttggcgcagttgctaatttttatcggaaattagtaataaataatatctatttattattgtcaataaaaagtgtgaaatattttgagctgcttaagttttttttaagattctcgccaaagactttaagttggtaacaagagaactgtcatcttagtcactgtcaaaattatattagcagatctattttgtttcgtgaactttgtttaatatcgagaactaactgtattaatgggtaaatatcgagttgatggcttggcgagaaatctaatggtactcggatgcatcagttacgaatatttgaaatgcctcaatatttcgatccatccagctttacaatagaaaaatacaaaataaacaacagtaacttgttgtgttgtagatcataaaacagaacacaacacaaataaccgaatcaaccctctgtaaaaatgccaaaaaatcgaaaaagaaaaaaattagttttcaaaattttaaaacattttgacgagttgggcaacatcaaccgcttggactgggtatggcgggtgtgggcgctggcacgaggaactggcaagagccgcctttgatacgcctgcgcatgaggttgctctcgctgggcgggctcaggccaaacatcttcgccgatgcgcacgtcttcattcctgaccgaacaggacagtcaggatacacgttcggtctctccaagtagtccaatttcatgctgaagtgttgttgcaccactctattcacagccattgcggactccgcgaactgggacagttccaacgcagagttgttcttcttgatgacagctggggtagttagcgcagctgtatcacttgcgcactgcagccacgggtgctgcagcaccttttccgcgctgatgcgctcgctggcgttctttaccagcagactcgagatgaggtcccttgcttcatccgatatggtcgtccactctggctccgggaaatcgtatcttccttcctggatgctctggaacaaaagttcctgacaggcgttgcgagttatcgcctcgttcccggccacggtctctaccacactttccgtaaaacggcgggtatcc

SEQ ID NO: 2851 - DNA, 940 bp, Diabrotica virgifera
caagtcacaggaatgaacagcaaatttttgaagtgtcatactgtttttatttagcaaaatagttaattgggaacaaagattttattagaataatataccgaaaatgccgagtcaagaattaacaactaataaagtaatagtccaccctttggttcttctaagtgtggtggaccattttaatcgcatgggcaaaatcggcaatcaaaagcgtgttgttggtgttcttcttggctgttggcgtgctaaaggagtcttagatgtttctaacagttttgcagttccttttgacgaagatgacaaggataagtctgtgtggttcttggaccatgattacttagaaaacatgtatggaatgttcaaaaaagttaatgccagggaacgagtagtaggttggtaccacaccggccccaaacttcatcaaaatgatattgccattaatgagttaatcagaaggtattgtccaaattccgttctagttatcatagacgctaaaccaaaagatttaggtttaccaactgaagcttatcaagctgtagaagaagtacacgatgacggttcacctacatctaaaacatttgagcatgttcctagtgaaatcggagctgaggaagctgaagaagttggtgttgaacacttattgagagatattaaagacacaactgttggtactttgtcacagagaataacgaatcagcttttagggttaaaaggtctccattcacagttacgtgatattagggactatttggtacaagtgtgtggtaaccagcttccaatcaatcaccaaatcatctaccaattacaagacatatttaatcttttgcccgatataaatcaggatgcatttaatacatcgttttacgtgaaaaataacgatcaaatgttagtcgtttatctagcagctttagttagatctattgtcgctctacacaatcttatt

SEQ ID NO: 2852 - DNA, 1097 bp, Diabrotica virgifera
aaatgaaatattataattattattattcaaatatatacaaattgtatgccttacataatctattttaacttaaaaactagtaaatacataattttcattattatcttcagctttttcaaatgtttaataacgctattcacaagttagctgttttgactaattcattatgcctcacgtcaaaattcggatcatcatctatggaatatctgctgagtttagacataacaaagaagaacattacaataataaatataaccagtgctcccagcatgcaatatcgccggcaaactgattttcttcctctagctcttagcggtgctccgaaagttatcttgaaccaatttccgaataattcagaaataggttttcttttatacttattatcgtcatgatcaaaaacgtcaggtttgatatctctaatgtcctgaaatatccgccgatttgaagaatgctgaaaactatctgctctgttgaaagcaccaatatcttcatccacagagaccaccgaatgggcggggctcggagttatcctaggaggcatgctcatattatggtttattgtgctttttatttcacgttcctcagacaacaatggcagtcccaggccagcccgagcccagttaactccagccagtttttcttttagcacatctgctacaggacttattaaattagatggcggaaacaatggacttttgcaggatggacaggtgtaacctctgggtgcagtggtaggaggtagctgtcttgaaaagtgatccaaacatgaccaatgaaacacatgatagcaggttaatcggatacagtcttgactacttaattctttactacacaattcgcatatcgagttataatcactgtcttgtaaccattgaaggtatgactgaactatacaaattgtgtgatttgttaccatacagttttcgcaaacacagactctatgctcgaagcagaattgattcgttactcgtcgtttcggacatttgcacagccccattttagctctattttatatatgaaaattatttaggtagaatcacatcaatattttaaaatatgtgagactacaaaattgttcgatccagggccggccacgt

SEQ ID NO: 2853 - DNA, 1355 bp, Diabrotica virgifera
gagaaaaaacgctttattataaatattaaatattaaaagaaatcacagtaatatatcggcttaaaaataatcttaaaaatcgtttaacaataaaattctataaaaatagatacttcttaactaataaatacaaatatatagaattaagtacacataaaaatatcgatctttaaataaaatttgattcacttatacaaaatataacttttataaaatatctttttagttaggaattgtttagctaggaattgtttctagggtcgatacaaatatttataattttattatttatatttatatttatatttatatttatatttatatttgtctcatgcttccgaaaaattccctatatggttctattttatgtactgttttacatgtttaaattatttcttataacatttattgtccaatcaaggagcattttctacttactctcaacttcaaagttgaccctttgccgtagagtgctttatcctgaggggacgcatcgctttctcgcacggggtaattttttattaaaaataatatatataattgaatattaatataattgaatatattaacgaattttaagcaaatgttgtcctatacttagaatggtggattttgatgtccctcgccccaatataagcggagtaaatctttatttttatttgttataaaataatttttataaaacctctaggtcttaacgatctggttttcatatagataaatataagcagaataaaccttcatttttatttctttaaataaaaattaaattttcttccggaactacaaaaaagatgttttccataaaaaatgcattgattacaattttggaatttgacgaagaagaaccaatattcataatgtctttttcttgttaaaaaattgacattttcacttgcaaataagacgtaaagtattgccttttagaaaaaatatacagtgcggtggaacaagtgttgcccccccccccgttaacttgttcacttaaagaatacaagcaaaacgctcggacaggtcgattcttaaaccaaccatagcacattatagcatcaacgtttcgaactttacgcgatccctcttcaggtgacagccataactaaagtacatcatgtaacacctcatttaacagcttttgaaatactgatttcaaaaatgtataatactccaatcctttctgagatcgtaggcgcaaaatttcggtcgaacacctcttgaacgcatccactcctctcgaattctgagaaaaccaataagtatttttgaaaaattcaaacgcagaatgaaagattagattattaccgagggctgacggtcccttagaataaatagaaagtttcttttgaatgatatatttg

SEQ ID NO: 2854 - DNA, 706 bp, Diabrotica virgifera
tcccttcttttccctatcttttttttttttttttttttttttttttttttaaatgccatgatgcaactttattgaaaatttttaacaaaaatagactgtttcagatgaagtaagaaatgatatccgttaagtagctcccgttattgccttgaaataatttgactatctaaaaatgagtctatataaaaaatataaaaagtaattattcaaatacagccaaaaacgttgatttagcttattaaaaatatctaatttttaaacggatataaaagtagggcaaatgatcagttgaagttactgctggactgcccataggcatgaaccatgcaatcttaatagatcgctctattttggatcgcaaatgacatgaagagcttttgttaggtgtgtcctctacatatgaccaagacgaagaatggataagaggcatgagcttgttgcatgtatggattgatgcgtcgtcaagaaaacatgaaaaaggaggtgaatacatacgaatgtgcataagtgagtgtttccaaaagagatgtgactgaataaaacggatgattaggggagcatgtatagcagtgatttggaggaccttggcctttacctgatccagatgttaaacgaggaggtcccaatagagtggtagagaagcacctctctcgcgctgacaggaagggtgtgtcgtgtggctacagaatcatgcgtctaccaagac

SEQ ID NO: 2855 - DNA, 414 bp, Diabrotica virgifera
atcatcaaaagttttatagtgataataataatatatgtgattttatcagatttgtaaaacagataactatgggattggacaaagtaccatggaggtttattagagtaaagggggatgataatgtaagtggtacacaaattgaagatagtcaagtgagttcgagaaccagtagagagactgtaaactcgggaaatgctttactatcaaaaatatatacaagaaaaatccgatggagggaaggacaatattccttaatcattataagtgcagtattaacagttttcggattggtgcagatactatttcctccatttgatttactcctggatttacgaatacgaatgacccctggtcttccagcatatgaatggtgggtggttccgccaaaagatgccatagttaaaatataccttt

SEQ ID NO: 2856 - DNA, 1296 bp, Diabrotica virgifera
aacagaaaaagagaattaatttagccggttttccgcgagttctacaagcggtttttttatatagatagtaaaacgggttcgcgaaaatgcttgggaaagcatttctttttttgagtgctctgttggttgtgcgagcagcgcagtctgatttttacagtgaccttagcctcttccatgagctccaacaaccatacagggcaaattggaattggcacaatcccgtcgtgaatccaagacgcgcgatcgaagaggaactagcatctgcagaagacgacagcgatgaacgcgaacctctagccaaagactacaaagatccacctgctgccagttcggagcaaaaacctgtcttggtgcccaaaccaaagcccaatctgaaatcgatacccgaaaagcctgaaatttctgatttacctgagaatccagaaagacctttaactgagcttcttccgggtggtgtggtggatgttaattccgatggttttggaggtcctttcaatccttttgggccagagtttgacttttcttcgtcttttggagttggaaactcgaagcctttcggaattggagatttgtttaattcgttccagggcagtcagtggtggaagggaaagaacgtttgcatcgaaagagaagagagtaccgatgacgatgaagacagtgacgaggaccaaagcaatgaagaaggcaagaaaaattcaacatcttcaacatcgaaggcctcaaaagctcttcctgacttgttttccacttcaataagcttgtccaactgcttcgaaactgcatccaaatatgaatgtgtcacaaaaataaataaccatggcgtcttcatgacttttacagttcgctacaagtgctgctatggatatactacaactagaggaggtggatgcgacaaaaaggcagatcttaaacctattttggagactttggacgacatcaaggcttccgagtttataaatttaatcataacaagtcacctatactaaaaattcacggatagcaactgttctttgttcgtgcctacggatgatgctctaactgagtaccgtgataaaatggtagagatgaacatcgttgtaacaacacggagaggactcggtctacatctttcaacccgcgatctggtattacgtcacgctgtagaaggttcgttgatttaacggatctatcgtgtgatgacgtgatatatagcgtgaacaacaacagttctatctgagtcaacatatatccatcacacaccagggaaagacttgttactgtcgactgcgctagagttaacacaaccatacgtcttga

SEQ ID NO: 2857 - DNA, 1301 bp, Diabrotica virgifera
ggggggggggggggccttctttttttttttcttttttttttttttcccccccacccccgcgggggggaaaaaaaagggggggggggaggtgtttgtttcaacaaagggggcgaatttaaaagtttgggggaaacccccccccgggggttttttccccccttcccccggccggtttgttaaaaaaccggcgggcccaagggaaaatggaattttaggggggcccccttttgaaagaaaggttaagacgttcgccatcccccgggtacttaaaacttggttccttttagagcggccccccccggcattttaaaattaaggttaaaaaatatcatatatgattatagtaattttcctaatgaggtaaccttactttaggatataatggaagaaaataaacaagaaaaaaaatgtttgaagctttttcaaactaatagggataaaataagaaaacactgggataaaacagagtcagaggtggaggaagttttgacgaaacttagagaatgggcaagtaggaaagagtttccagaaataccaagtgatagtatgctagaattttttgttacaaataataaatataatatagaaaggaccaaggacaatattaaatcatattatgcagtacgaaaaaatatacctgaattttttaaaaacgcacatccgagattacctaaaatgcaggaatgttgggaaatgggggtttatgttcctctagctataccacatgaaggactttacagagtatctgttctcaaactattaccctataccgccaaatttcatgctaataggtatcatgcgcatgtatcaaatctatttgaaatacggatttgtgaagacttatcagttggtgaaatacttattgtcgactacaggaacctggcatggagtcatgtgtttaaaatatctccttttgttgtacataggatggcgatggtcgttgagagtatgtcaagaacccgattaaaagaaatacactttgttgagcccccgtcttcaataaatatattgttaacaattgcgaagacctttttgaagaaaaaaattgctgacaggatcagaattcataattccatggaaactttattggaacatgttcccaaagatatattacctgaagactacggtggcgatggcaaacctttaagtgaacaagttgatctagtgaaagagaagctcatggaatattatgaacgatttgatatgcttcaagaatattccaccaaggattcttagtaatttatttatgataaaattatttatatttagtttaatttttgtgttaattttttatactttgt

SEQ ID NO: 2858 - DNA, 1282 bp, Diabrotica virgifera
ttttcgtccgctttacatcaacaataggttgaataacttgttgtcaatttcttgtccaattgttgttgatgtaaagtggacttttgtcaatttcttgttcgatttgttgttgatgtaaagtggacattatttgtactgttgcaaaatttgtgttgtggttgtgatttgtggtggaagatgagacaccactgacactgacagtgacatcatagaggttaggagttagaagagttaaatttaaaatgaaaattctaaaatataattttagtgatttggaaaagtcagtaatacttatttacaaattttaaatatattttagtttatggttccagatgggtagataagaaatacaacaataataatcccaatcatgtcacatctttgtttagagaacctgtcaactgaaattcttataaaaatattttcatatttagatctaaatgatttaatgcaactaccatacgtttgcaaaaggattaggcaaattgttctaaattgggataacttactttttaaacgatttcccacacctttagtgacaaaccaattcagtgatgaatttttggctagatgtaacagaaaactaagtagttttgaaaaagtaagaatttctcgtaattggatagaagctaaatatactgaatcgccattgctattttccaaacgaaaatttctaccttatcttcagctatctaagaaatatttgtggataagtcgtggaggagtcattttttgttacaagagacgttatcgaaatctacatgcagctaatccacactatgttttatcacctccagttcagcgcagcaaggcagatgttgttaattttcacgttaagaataatttgatagtagcagggatgagggatggatcactctggatgaaagacttacaagatagatatagcaaaatatttatgctaaaaatatatcatcaggatgatgtgcactccgtagccctaaataacagctgtagcttattggcgtctggggctagaggaggtgatgtaattgtttcgaaagttgaacctagtgttactccccaaaatataaataaagtactttcgtggtcatatcacgatgtaatttggaaagttggattttcagtggaaaacaaattagcaattggtacagcgggtcgccattactacagttatctctatattcgcaatgtagacaggattgacgtagaagaacttgtcttatcttatcagtcagtaaaagaaggaatccatgatataatatgggatggaccgcataagatatggacgtgtggttatgat

SEQ ID NO: 2859 - DNA, 1161 bp, Diabrotica virgifera
ctaaaacaagggtataagatgcagggagattacgatgacgaatcctcctcttcggggggcgagctgacccccacaagaaaaaacaacacaaaccatcaccagatagttcagagcaatccgtcaatcttatcatctctgagaagtgttctcattgtcctgagtacagctctagtgtgcttcgcagcagctagaaactccatcacatggcattgtcagagattctggggcgcttccggagacttctggcaggcccaatgggacaagtttcttgatttggtaggtgaagatcccttcaatttgtgggtgttttactcgatgtgtatcacattcggcgtctattggttatttgggggcatatacactttcatggacgttaccaatatgcctggagtgataagaaaatataaaattcaaccgggtacgaatgagccagttgatgacaagaggttgaggcatgttatatattccgtcttgtttaaccaatcagttgttggtatacctatatcctttttgatgtactgggcaatgaaatggaggggatatccacccctacgcgaactacccaccttccactgggtattatttgaattggcagtacacatcttaacagaagaagtaggattttattattcccatagattacttcacagcaaatatctttacaagtatatccacaagcaacaccacgaatggacagcacccatagcagtcacagccatctattgccacccaattgaacacatattctccaaccttatcccgcccttcttaggagttttcctgaggggatcgcatgtactacggcttggttgtgggtcacgttgccactactgcctactttaaatgctcattctgggtatcatttgccaattttcgcgttcacccacgcccccgcgttccagcccccccggtttaacaccattttttggggccttgggggggggggtgggagtatcccaaacatgattggccccccccccccattcagaactaaattccaaccattcgggagggtgagtttctaaccgcccaaaaaaatttttcctggggggggccccctgccaaaaaaaaatttgggggaaaaaaagggggaaaaaaaaaaccctcactttaggggtttttatttttaaggggggaggggtttttttctatttttttggg

SEQ ID NO: 2860 - DNA, 633 bp, Diabrotica virgifera
ctcctcttatgtggtcatctgtcatttaagtagtaatttcattccaaaatgaagatcggactttgtgcttacagcgggtacaaaatttaccccggacatggcaaaacaatggttaaagttgatggaaagaccttcactttcctcaactcaaaatgtgaaagggcgcacttgatgaaaaggaacccccgtaaagtaacatggactgtcttgtacagacgtaaacataagaagggtcaggaggaagaagccaccaaaaaacgtaccagaaggacacagaaattccaaagggctattgtaggtgcttctttaaatgatatcatggccaagagaaaccaaaggcctgaagtaaggaaggcccaaagggagcaagccattcgtgccgctaaggaacagaaaaagagcacaaagacagccaagaaggctacagcccccgccaaggccaaacctgctcctaaacagaaagtaaccaagaatcaacccaaagctgcacctagagtaggaggaaaacgttaatattgtataaacgttatttaataaaataagtttttttccaaaaaaaaaaaaagaaaaaaaaaaaaaaagggcggccgctcgcgcccacgcgtccgaagaactaaaaccggaaaatttgat

SEQ ID NO: 2861 - DNA, 1054 bp, Diabrotica virgifera
cccacgcgtccggttcaattattcttctactattagttggacaaagttcagcacttataccaggtctattgaagggaattttggacctaatccttggttcagtttcttcgaaaataattttaattccgtccgctaatatttccattccaaagaatttacaagacattataattggtgacttaaatttaacccaatttcatgtatatggattagacactttcaaatacaaggatgatgtttacaaattggacacagatagaaagtcatttacaaggaacagaatttctgttaatacaactctggataaacttggattggaaactgagtatgttttggatatgagtttactagatgccgttccattgtatgggaatggaagatttagtcagaaataacaggcttttggagcaatgtgaaagttagcgcattactcacgaatgttataaatattgttgagccctttgtgtgtatgtggtacgactacgaacgagaatgtctggattgtgttatcagcaaacttgcccagtttgtaataaataaattagtgctgaaagctattactaacgaagacttcattaaatgcgaatgtttgggggtaagtactcgagaatttagagccgatatgagcttagatcttagagtagcagactatcaacatttttttacatttatctgcgtctgttaatttactacattgaatgagaaattcaaaaatgattttgattttaaaatatctcagtggagtattatttttttattaaaataactgtgaccattacccatatgtgcgccaatgatgaatataaaattgcagaatagctagaggtcccgtcattttggatggccctaatttgcatattattgcacttatagatacatataagagtcacaaactttgaagtaatacgaaagatagaaaaagtctcagaaatttttttaacgataaaacgaagaaaactcgaatatttgggtcacctgataagagaatataaatacgtattacttcaaaatatataatgcaaagaaaaatagaaggaaaacggaatccaggccg

SEQ ID NO: 2862 - DNA, 952 bp, Diabrotica virgifera
  misc_feature (886)..(886): n is a, c, g, or t
gacccccttttcccgccagagcaggatgaagaagaggaagaagaacaatgagaagaagaacaagggaagcagaagtgttagaaaattatgaaccagtttgataaatttccctcttttttaatttataccgctttatataaagtttaatcatttttaacccttgccaatatcaattattaaatagctttaaattaaacagaatcataacagatccgtggaataggcctactggggaaaccacgttaaaaaaacgcgcgaagtacactacctcaaaggtggtgtggaaacgtgtgcgcatattatgacgattaccactctttgaatcgttatatctcagaaacggtaagttttatcgtagaattaggtctaacaaaggatgtacaataaataattatctataaaaaatgtcttaatagtttttttcctaagaggcactgtttttgagatacaacgattcaaagagttgaaagacttctaatcgtcataatataaatatgtattagtacaccaggtataggtatatacatcactgaagctgtaatacaagtatacataatattctacggtcaaattaacttatattacacataataatataagattataaatatgataatgtttctactatacagcttgcggtctaccgggagatgcaatccataagctgtattatattacagtgccaacaaaaaaatctttacaaagtgaatgtaatgcgaaaataataagaattatttggattttacggcttaatcccaacaaaaatacacaacaaatgacaaagtattaacttataataattctttttatttatgcgcctttgtcggaataaacacgttcgtcagctaatctaatcgccctacctattctcttctcagaagggttngaacatataatgaagacactttctaggcaaatttttattgctagtactataaatactatgcaaata

SEQ ID NO: 2863 - DNA, 433 bp, Diabrotica virgifera
aacacgcgtccgggccctttggagaaaaatggttccaatgagagtcattcgaagctcttcacatgtcgttggagcaggtatacgacgtcttacaagccttttgagaaggctccatatatgctcaataggattaaggtctggactttgagcagactagtgttacaatccttgacgtgtattttgcctacatctaaaccagactgaaccctacctatcggaaaaaatttgtttattaaacattttattaaacataaatcattaaaaaagttaattttgatggtgctgtagcaaccaaaatccaaaaaaactcttacagttatttttttaaggacatgtagacctcaaattagaaaaaggaaatattttgatatggaagtagttcaactgtgtagaaaattagttgaatttgaagcgtttactaattggtgaaatt

SEQ ID NO: 2864 - DNA, 1715 bp, Diabrotica virgifera
ctttcacttctccacgaacaaggaagacaacctcacttcacgcgcaaattatgtgaatgtgtgtatttatttttagaagtggtacctgaattaaatcaataattatgatttcaattactatttaaatacgttaaacaccattaaagatattggtccagcaaaaatgcatttattcatggatacctacctacaagaacgcaaacgttttaagaaactcttaacacgtctttccaagaaaaccaaaaatgataagaaatacactctcacatctactgccaaaaaggctgctaccgatcacagcccaaaaaacaaggaaatcatcgacagttatatctccttctgttcgtataaataggttactgtacatattacaatatttgtaaatcagtaagcaaataaatgaattgaataactccaaaaaaaaaaattgtaaatgtagattagtggcgaaaccttacttttcggtggcaagtggtggcggaagtaacttagctaacatacgttaatatagcagtaacatttttagtagtaaaaaaataaaaatcaacaaaaaaatggtaaaacctgtaagaaaatctgcaaataaaaatccacctattttgagccacgaatttgttattcaaaatcatgccgatattgtgtcatgtattgctatggtgtttgtagttggccttatggtacaagctacatctccaattgcttcaatattcataactctgcagcacaatgtaacagaagcaggagaggtgcccctttacagtcctggtgtgaaagattgggcttgtatatttttctacaccttgatttgcgttgttatccatgccattattcaggaatacatcttggacaaagtctccaagaaactccacctctccaaatccaagttagcagtcttcaccaccagtggtcaactgacgatattctacttaatatcaactttgtggggacttgacatcatcatcaaagaaaactttgtatttgatatagctcgcctgtgggtagattacccagctccaatgacattcctgatgaaattgtatattattgtacaattggcttataatgtccatgagcttcctgaactatatttccaaagggctaagaaagaagaatatattggcaaagccacacaaagcttggcagctgtttcactcatatttatcccttatttcctcaacttcaaccgtttactagtctctcttttggtccttcatcacatttctgaattggtttaccactttttccaattgatccagactgttgacaaagacgaaaaattctctaaagttaccactttagtgtctaacagctttaaattggtggcccgcctcggcagcatcatattgtccattcttaccctttggtatggtttggctctcggtgaacaacgtgagctagacttgacaactggatactacaatacccccgtcgtccgtatcgctgtattggctggtatattaggacttcaaatgtacttgactttcaatgtcatcagtcaagaaattgcaagatctcgtgaaagtaaaggagcgagcgtagctccgaaagccaaacccccaaaaaagagaaatctatgaaacaaaactaaaaaaaaaggctgaaaatttgttttttcccaaaaaggaaaaccaaaaaccccaacccagaattttttgaaaaaaaaaaaagaaaaaaaatatttcttcctctttttttttttcccccgtttttttttt

SEQ ID NO: 2865 - DNA, 313 bp, Diabrotica virgifera
  misc_feature (273)..(273): n is a, c, g, or t
ctcatgccgaattcggcacaagatgagcaatcataccggtactcacgttttgaattatgccttgcgtaaagtactaagtacgttatactcagtgactaaggcaccgatgctgaccagagaggttcccttgtagaccagataagttacgttttgactttaccaataaaggtgcaatgacgactgatcaagttaaaaagactgaggaaaactcaaaagaactcatctccagaaataacaaagtcttcgctaaggattcaagtttaggcgtagcanaaactatcagaggacttcgtgctgtctttgaagagactta

SEQ ID NO: 2866 - DNA, 1618 bp, Diabrotica virgifera
atttaatcaaaagttattcaaggaaaaagatagataagggtgctgctttatgactatacattgcaaaaataagtcattagtccagttttggagctttataatatatttgtaggcaatgttattgttttggtcaatatttgatcctttttatccaataaaataaaagcttataaatatattatcctccaataagttgatttctttgtaaaacattaatttagtaattaagtttcacgtggtttcactaatatgtttgtatattcactaatggaaattttttgtgcgagtacaaaagtccattgcttaaaatccatttatcggatttatttgttattttcttaccatatattacgctatagctctttctagaatgttaaaatgtgccttgtattttgtaattactacttttaagtgattgcgttttgtgataggcgatctcaggggtatgttttgaggaggatattaagaagagctgtccgttacgctacagaaaagttaaatgcaaaacctggtttcttttccggcttcgtcttgattagtctcaaaaaagattcagcaacaaagactccaatggttttggttacatcagacatagaaatgagaactatgtggtgaacaaatgatagagttagaagttgaggaaagaggaaacccaaggagaagatggaaggactgagtggcagaggactcaagaaagataacgatttaaatgaagaagacacctttagctctatgcggaattttgtaacctgacgctcttgcccaagaacaattatttaatcacttgtgccttttccttcattaactgcttgtcagttactatttcaaatcatttactccatttcaaactgctctgtaccttgagttttcattattccatttaaatatgatgtctcggtattgtatcttatactggttgtcaattatagtgcctatctttgtttttgatctagcttccatataagccaatggaattcttcaatcaataggcatttaccgttttccttggatcatcaatataaatataaaggctaaaatttattgtgacgattaactcgataatgtatttttgcggcttatgagattactgttgttttgtgtgtttatcatttcttatcacgtcaacaatttaaaagttggtgcatttaccaaactcctcgaatatttgtgtttaaggtgataagtaaacagtaaatttgaggctcaatttaatactattcatcaattatcgtcgctaaaaagtcctatcagatatctttgaatataatgttgatggcactctctcccactgcgattatcatgtctcatgatgaaaaatctattttattttggaattttgtgggccttcaataaaggcccaactttaaattggcccaacactgtagtccgagattctgggtgatacctgtcctgattgggggtgaaaatatccccaaagtgtcatggacaccttcaacgaggaaaaaaattaaacttaatttctttttgactacgttgtccaaaggtaaaaaaatctcccttaaccgaacaatcacttaaatttgaacaaaaaaaataaaggggggaacccggagatggttgattgggcgattaaaatgataccttcacggttttccct

SEQ ID NO: 2867 - DNA, 1075 bp, Diabrotica virgifera
ttttgtgcgagtacaaaagtccattgcttaaaaatccatttatcggatttatttgttattttctttaccatatattacgctatagctctttctagaatgttaaaatgtgccttgtattttgtaattactacttttaagtgattgcgttttgtgataggcgatctcagtgaaagagttattgctaataaattctcacatctatagtttctgtgactccatgttctcagtaaaccacacatggacaaattagagatggaacatattaaacatacatgttacaatgtaaatgcattgtagcgcaatggttatgtgcatagtataagcagctagttaaataaagttttgctttaagctatcgggacatatcctatgtgataagatatataaagaattgcgtaacctacagggtgtccccgagaatggtgccttcctttggtatggatataatacacaatgaagaacaaaaaagtcctatggcattttttttctaaagttaaccgtttccaaaaaaatacattgttctccatataagcgaacttttatttcataaaattaaataatctggcatcactgtacaagaactctttgtaacttacgttattgacaccagaaatgtaggtcagacacctgcaaaataattataccaccccatgtttgaaaatcagacaaacaagaatttgtttgtttgttgagtaacaagaatactttagtattctacctataccgttagggacgcactgttttcggggacaccctgtatatcggaccctttcaacaacataatataccggatcgagttcactctttagtgtaacattagattgatgtgcatagatccagaaagtctccaaattctcaaaaaaaaaaaaaaagggcggacctttcagttcaaggacacttatttgtttgaaccaccttttttatatgggatcaatcttctaaaattctaaacgcttcgcacagaccgaaataaaactggttgataaacagagaagggttcatatgtttcgctctaaagtgtttctattatattttttacttacactatacctaccaacaagttctcgataaagct

SEQ ID NO: 2868 - DNA, 932 bp, Diabrotica virgifera
caatatttgatcctttttatccaataaaataaaagcttataaatatattatcctccaataagttgatttctttgtaaaacattaatttagtaattaagtttcacgtggtttcactaatatgtttgtatattcactaatggaaattttttgtgcgagtacaaaagtccattgcttaaaatccatttatcggatttatttgttattttcttaccatatattacgctatagctctttctagaatgttaaaatgtgccttgtattttggaattactacttttaagtgattgcgttttgtgataggcgatctcagtgaaagagttattgctaataaattctcacacctatagtttctgtgactccatgttctcagtaaaccacacatggacaaagtagagatggaacatattaaacatacatgttacaatgtaaatgcattgtagcgcaatggttatgtgtatagtataagcagctagttaaataaagttttgctttaagctatcgggacatatcctttgtgataagaaattatataaagaattgcgtgacctacagggttccccgaaaatagtgcttcctttggtatggatataatacacaatgtaaaacaaaaaagtcctatgacattttttctacagttaaccgtttccaaaaaaaatacattgttctccatataagcgaacttttatttcataaaattaaataatctggcatcactgtacaagtactctttgtaacttaggttactgacaccagaaatgtaggtcagacacctgcaaaataattataccaccccatgtttgaaaatcaaacaagaatttgtttgtttgttgaggagaaagacagggtttaatgtaaatactaaaggcccatactgcaactatttttgaattgtgattgtatatctttagatttttgtatacatagttgtcaga

SEQ ID NO: 2869 - DNA, 2055 bp, Diabrotica virgifera
gtcatcgtgttggtaaaagttcggcgtttcgtactttctcttagaaaaattagatcaccttcagtcgatctagtttatagatatatttgtgctttaagaaagtgtcttcatataaataaacaacggccatatcaatcgacagctaaggaggtgcgaaacgcctatatagattttttcaaggaaagggaacatcgtgtatcgtacattcttcatcaactataccattagatgatccaacgctattattcgccaatggtggtatgaaccaatacaagtcaatttttttggggacagttgacccaaacagcgatctttcaaaacttattcgcgctgtgaacacccagaaatgcattagagctggaggcaaacacaatgatttagatgatgtaggtaaagatgtataccatcataccttttttgaaatgatgggaaactggtcatttggagactacttcaagaaagaggtttgttcctgcgcatgggagtttttgacccaaaaattaaaactagaagctgataggctctatgtaacatattttggaggggatcctgcatctggattggagcctgacaatgaatgtaaacagatatggttaaatcttggtgtcaagccatctcatgttcttcctggtagtatgaaggacaacttttgggaaatgggcgaaacaggtccatgtggaccatgctcagagcttcattacgatagaatcggtggcagagaagtccctgaactggtcaacatggatgatcctgatgttttagaaatatggaatcttgtgtttattcaatacaatcgggaaactgatggcagcttgaaatctttgcctaaaaagcacattgattgtggattgggtttagaacgcttggtatcagtcatacaaaataaaagatcaaattatgatacagatctttttgtaccgttgtttgaggccatccagaaaggtactggcgcgccatcttatcaaggcagagttggtaaagatgacacagatggaatcgatatggcttacagagtattggctgatcatgcaagaactctaacaattgcattatcagatggtggcaacccagataatacaggtagagggtatgttttgaggaggatattaagaagagctgtccgttacgctacagaaaagttaaatgcaaaacctggtttcttttccacattggtcaacactgtagtcgagattctgggtgatacctttcctgaagtaagaaaagatccccaaagtgtcatggacaccatcaacgaagaagaagaacaatttctgaaaacgttgtctagaggtagaaatctccttaaccgaacaatcactaaattggacagtagcataaaggtggtaccaggagatgttgcttggcgattatatgatacctacggttttcctgtagatctgacaacactgatggcagaagaaaagggtcttactgttgatatggatacctatgaagaatcgaaaaagcaagcacaaatcgcatcacagggtaaaggcactggtgtagcagatactattaacttagacgtacacgcaatcacagaacttcaaaataaaggagtaccaccgacggatgatttagaaaagtactcatatgtttctacggaatccccagattcggattacactttcaaatcttgtgaagcgacagtaataggtctcagatacaataaagaattcgttgacgaggttcatactggacaagaatgtggagtactactggataaaaccaatttttatgctgaacaaggtggacagatttacgatactggatacatcgtaaaagttggagacgaaagtgtggaattctcagtgaaaaatgtgcaagtcagaggaggctacattattcatattggaaatttggaaggaactttaataaagggcgacaaagttagtctacatattgataacaacagaagacgattgatcatgagcaatcataccggtactcacgttttgaatatgccttgcgtaaagtactaggcaccgatgctgaccagagaggttcccttgtagctccagataagttacgttttgactttaccaataaaggggc

SEQ ID NO: 2870 - DNA, 768 bp, Diabrotica virgifera
  misc_feature (745)..(764): n is a, c, g, or t
  misc_feature (766)..(767): n is a, c, g, or t
caaaaatgtttgtagtcatatttttaatattctgcatagtcataattgattaattaattcttgctcgttcactaaatcaatcctcacatacagtgtatttagtgggtacttaacttaattattaggtactgaaatagtactacatactataaaagaatggcagattattttggagaaatgggatggacgcctcttgaagatggacaagcacctgattattttttgcatctagcccgtttgttaagagattttaacatgttcgaagagttaagcgtgttgaatggtaaaaagttagcacctccagcttcaaaggattttgtggcagccattccaaatgaaagtattgaaaccaatgatttacaatgcccagtttgtcttaaagaacatactaaaggagaaactgcaaagaaattgccttgtggtcacttatttcacacagagtgtataatgccttggttatcaaagacaaattcatgccccttatgcagatttgagttacctactgatgatgaagattatgaagcttggaggaaagagaagaaacgagcaaaggaacgagaagcagatattgagcacttacataattcaatgttttcttgaaatataatagaaacattaattctgtgtgtggcgtgtgatttacagcacaaataggttttaattgcattttattcgttagaaaaaatattttttttatttataagtgaattattgttataagaaatatatgttataattatttatnnnnnnnnnnnnnnnnnnnnanna

SEQ ID NO: 2871 - DNA, 1221 bp, Diabrotica virgifera
cccacgcgtccgtagcctttttgtaatatctcatactacacatttcaactgtcaaacctcgtcttttcaattatgtcaaaaaacgccttattttttactaacttgattggtctactaaggatttttattgggattgttagcctaaattttggtttctgttttgcttatgttttaataataacgaaaattatttttgatctagcttgattattatggagaaatcagtattggaacacctccacaaacattcaaagtcatttttgacaccggatctgccgatctttgggttccttcagcccaatgcgaaaacaacactagaacaccaaatggttgccaaaaccatactaaatatgatgctgacaaatcttcaacataccaggaaaatggccactccttctatattgaatacggatccggatctttgagtggtttcttatctgaagacagcgtaaatgttgctggagttgctgtggagaagcaaacatttgctgaagccacttacgagaccgctccagctttcgtggatagcacattcgacggtatcttgggattgggttatccagagctgtcatcacaaagtgttactccagttttcacaaacatgatcaaccaaggagttcttgacgcaccagtattttccttttatctgagccaaacagccaatggcgatcaaggagaactagtgattggtggatcagatccaagtaaatacagaggagacttcacctacacagaagtatcaaaaaaactgtattggcaaactaagctacaaggtgtttccgtagggaaacaaagtttatgtaggaatggatgtcgatctgtaatagatactggtacttctctcatctacggaccaaacgatgatgttgaagctatcaatgacgcaattggtgccttctatgactacgatcttggtatttacaccattgaatgcgatgccgatttgactaagcttcctaatgtaacatttactttcggaggcaagaaatttgacatttctccttcagcctacgtcatcagagattcaggtatttgcgtatcaagctttgtcgccggagactttttcctcgctggatttgaatggttggttggagattcattcctgaaaacagtctacagcgaattcgattttggcaacaaccgtattggatttgcagaattggcataaatagttgtaactttataattatttatttattaaatattgctttataaaatcaa

SEQ ID NO: 2872 - DNA, 1535 bp, Diabrotica virgifera
gattaattaattcttgctcgttcactaaatcaatcctcacatacagtgtatttagtgggtacttaacttaattattaggtactgaaatagtactacatactataaaagaatggcagattattttggagaaatgggatggacgcctcttgaagatggacaagcacctgattattttttgcatctagcccgtttgtatgaaaatttcacatgcccggtcgaccccacgcgtccggatgtacgcaaagattttagttcttttggtgatagctgctcttgctagcagtgaacttatcagaattcctttgaagaaggtacctgctaatggacaaaaaagattgcgtaatgtagccgctaaaggattacgcagtagatttggaggcaatggagtagtacctttagtcaacgaatatgaccttgattattatggagaaatcagtattggaacacctccacaaacattcaaagtcatttttgacaccggatctgccgatctttgggttccttcagcccaatgcgaaaacaacactagaacaccaaatggttgccaaaaccatactaaatatgatgctgacaaatcttcaacataccaggaaaatggccactccttctatattgaatacggatccggatctttgagtggtttcttatctgaagacagcgtaaatgttgctggagttgctgtggagaagcaaacatttgctgaagccacttacgagaccgctccagctttcgtggatagcacattcgacggtatcttgggattgggttatccagagctgtcatcacaaagtgttactccagttttcacaaacatgatcaaccaaggagttcttgacgcaccagtattttccttttatctgagccaaacagccaatggcgatcaaggagaactagtgattggtggatcagatccaagtaaatacagaggagacttcacctacacagaagtatcaaaaaaactgtattggcaaactaagctacaaggtgtttccgtagggaaacaaagtttatgtaggaatggatgtcgatctgtaatagatactggtacttctctcatctacggaccaaacgatgatgttgaagctatcaatgacgcaattggtgccttctatgactacgatcttggtatttacaccattgaatgcgatgccgatttgactaagcttcctaatgtaacatttactttcggaggcaagaaatttgacatttctccttcagcctacgtcatcagagattcaggtatttgcgtatcaagctttgtcgccggagactttttcctcccccgggttttttaaatgggtggggttgggaaattgttattcctgaaaaaagagctccattttgcgcacatctttattttaggcccacaattggcctattttgggaatgcggtacaaaaatttgattatactaaaaagattggttaaaattttttttttattttattattttttttttttttaaataaaattttttgtttttgtttttttaaaaaaaaaaaaaaaaaacaaaaaaaaaaaaagggaggggggggg

SEQ ID NO: 2873 - DNA, 1009 bp, Diabrotica virgifera
aacgtctataagtatatatggtctgtggataacaacaaaaaactttcatttgatttgatttttcatttgatttgttgtttgttaattaatttataaacaaatgtaattaaaaaaaaaattagtttcaaaaagttgaacagtgattgctggtgtaaatacaatatcatttgaaataaaaaggcaaaatgtcttcaatgcaaaaaacggatgatgtgttagaaaaagttacaaaatcattaaaattatggaaaaaattaatatcagatgtgtgcgaaaatgatgagaccaaacaaaaccaattgaacattttagaaactcatgtaaaagaatatagtgagttggaacataactttaatacaaccagtaaggcttttcagaacttggatgagaaattaaactcttcagaaaagatagaagatatagaaagtttgtatcaggattgcgtggataatgtaacaacagggtcatcaataaaccatcaaaaaagtcgtgtttggcagacaatctttaaaggtaatgctgacgtaagggaagttcataagaagagcaaaaaacttcaagatacacaatatgatactattgatgaatccctactttgttccaatgtgtttgttccacctttggatcctatcagtaacgaaagtaaaaaatccatataaaagtaagaaatgtggccacatatatgaatttgattctatagctagttacattagatcccaaggaaagaaagcaaaatgtccttatataggatgcaatagtgaacaattacgaatgacagacttagtaagagataatgaattacagagccaaatttcacaatatgaagaaacacatgttactgaggaagaagaaggagatagtgatgacgattaaaaattaatggtgtatatataatgcgtaatttgataggtattttttatataaatacattttttaccagcgttaacgacgtgtatttgtgatgggtagctctgttagacaaagacttagtataacacggatttaattc

SEQ ID NO: 2874 - DNA, 1296 bp, Diabrotica virgifera
caacactcaagctttttgggtccacttgctgtcgatgcagttcttaaaattgttgaacctggtagagaacaagcttgtaatttatctgatatcaaagttattaagcaacttggaggtacagtagaagataccgaattagtagaaggaatttgtttccctcaaagatctgcaaatgtctctggaccaaaaaggattgagaaagctaaaattggtttcatccagttctgtatttcacctccaaaaacagatatggaccacaatgtcattgtttctgattacgctgctatggatagagtattaaaagaagagagagcatatattttgaatattgtcaagcagataaagaaagctggatgtaatgtacttttggttcaaaaatcaattttgagggatgcagtttcagatcttgccttacactttttggataaaatcaagtgtatggttattaaggatattgaaagagaagatgtcgaatttgtatgtaaatctttaggatgccgccctattgcatctttggatcattttgttgctgaaaacttggttactgctgatttagttgaagaggttggattggcaggaaatagaatggtcaaaattacaggtgcacaaaatgcaggcaggacagtaactctgctggttagaggatccaacaaattagttcttgaagaggctgatagatctcttcatgatgctctctgtgtaattcgttgtcttgttcgcaagaaggcacttattgccggaggaggagcgcccgaggttgaggtggctcttaaactagcggctatggccaacaaactggaaggcattgatgccatttgcacacgcgcatatgcgaatgccttagagattataccatttaccttgtctgagaatgcaggattaaatcccatacagaccgttactgaactaagaaacagacacgccaaaggagagacatctgctggaataaacgttcgtaaaggagctattacagatattctcgaagaaaatgttgttcaaccacttttagttagcacttcagcattgagtttagctacagaaactgtgagatccatcttgaaaatcgatgatattgttaacatattcacataagatctgccacctcttagtgacctattttaactttcgaacacatctcagctttaattcgtttcatgtattacgtattttcataacggtatttaaaatcttcattttattagattactaaacgtttatttctaaaaaaaaaccacgcgtcccaatgtccaagctgtagaagaaggtgattggagaaaaactgctgttttgggagtc

SEQ ID NO: 2875 - DNA, 1156 bp, Diabrotica virgifera
cggacgcgtgggcggacgcgttgacttttgacagcaccaaaataatccaattttagggagtgaaattttcaagaatataatctgtaaacatcggcttcaggaatatcttttttaaataaaaaacaataataaaatcaaatatgactgcgcctacagccggtggtgatacaaatagaggaagaaccgttgcatataaggacaaaagtaaacccgctgatgtcaggaccagtaatattaacgccgcaaaagctgtttgcgatgctatccgtacaagtcttggccctagaggaatggataaaatgatccaggctggaaatggtgaagtgacaattaccaatgatggagctacaatcttgaaacaaataaacctcattcaccctgctgctaaaatgttggtagaattatcaagggcccaagacattgaagcaggagacggtaccacatctgttgttgtaattgcaggagctttgttggatgctgcggaaaagttattacaaaggggaattcaccctacagcaatatctgaatctttccaaagagcagcccagttggcagttgatattttgtcagacatttctactccaattgaaattactaatagagaattgttaattaaaagtgcatccacttccctaaactcaaaagttgtttcccaacactcaagctttttgggtccacttgctgtcgatgcagttcttaaaattgttgaacctggtagagaacaagcttgtaatttatctgatatcaaagttattaagcaacttggaggtacagtagaagataccgaattagtagaaggaatttgtttccctcaaagatctgcaaatgtctctggaccaaaaaggattgagaaagctaaaattggtttcatccagttctgtatttcacctccaaaaacagatatggaccacaatgtcattgtttctgattacgctgctatggatagagtattaaaagaagagagagcatatattttgaatattgtcaagcagataaagaaaacagaaagcagctggatgtaacggttactttttgatcaaaaatcaattttgggaaagggagtttcactttctttataacatcaatttttggataaaaacccaacggggatggttcttttagggaaatttgaaaagaaaaaaaaatgtcccaattt

SEQ ID NO: 2876 - DNA, 948 bp, Diabrotica virgifera
  misc_feature (829)..(829): n is a, c, g, or t
  misc_feature (904)..(904): n is a, c, g, or t
ggaaagaattagtcctcacatcttttgtatttaagttgagggaaaaaggtgatttttgatatccaaagagccccgctttgttaatcaatagtaggggataagatttcaatcatccataatattcgaaaatattcaaaatacacttttaaaaattttaagtttgtgagtattttgtaatggcgaccccatcaactggtgttgttgtgcctcgaaactttcgactacttgaagaactagaagccggtcaaaagggtgtttcagatggtactattagctggggcttagaaaatgatgatgatatgacacttacacattggatggggatgataatcgggccccctcgtacaccgtatgaaaataggatgtattctgttaaaattgaatgtggccaaaggtatcctgatgatgcacctactgcaaagtttatctctagaatcaatataaactgtataaacagtaacacaggggtggtcgataacagacaagtcccaatattggctaggtggcaaagggattacactattaaaacggttttgcaagaattacgaagaataatgacacttaaagagaacatgaagctaacacagcctcctgaaggcacttgcttctagcctttgaatcagcataacactcccccagtatcttctgttacaacttgtccattgagtgtcgatacctgcaccacgcaatcatgctgtcttctgtagcggattcaccttactcacaaactatctatggggtgtcttgaactggttcttggaagataacctgtctggtaatgaggacaaactggtgtatttaggttaaggtgtctaatgataagagtatnttttaatattactgctttgtacacttgtttaactctattagaggatgactcatgatcgaacttgtatttttgtangaaacaaaagtaatgttgatgtcaattataataaacatctatga

SEQ ID NO: 2877 - DNA, 842 bp, Diabrotica virgifera
gaatcgagtcagtgatatagcaccatccctatataaaaaatgcggattagttgtgtattattcattggtctagtcacgtttgccgccctctgttcagctcgaccagctgagaacgacgctgactacgatgaagaaccagcacctccaccaaaaaaaccagcgaggccattaaccagcagaaggaatccactaagcggtagaactaatggaaaagcggcaagtagcaccactacaactacgcaagcaccagtggaagaagaagaagctgcggaagaagaatatgatgaggagttaccgccagaacaagaaccaagttcgacgacggaagcccctaagaaaaattttcttaaaactggagtagttaggccatttagaagcaatgacgaacttctggcagctttaaaaaagagaagggagcaagtagtccataataagatcacaaaccctgtgcaatcgaattcagaagtacaaagtgcccccccagcagccgccgctgagaaagaatcttccaagaagagcagcacatcatctggtaggaggaatagattcaatgctaaagaaaaaagcccagaaccagcagcagaggaatctccagcaccagcagctacaccttctagaacaggaagaagatttggtggtagaagttaattaatttctcttttatagtcttagatccagccagtttctaaaagaaaaagaccgatattagatttggaataattaatatggaatacaccctgtattctttgatgtattcattaatttgtgaacataaaaagaattgagaaaagcgtctgattggttctgagtctattagtgtagaaataaaataaaaattgtta

SEQ ID NO: 2878 - DNA, 1413 bp, Diabrotica virgifera
  misc_feature (1362)..(1362): n is a, c, g, or t
  misc_feature (1371)..(1371): n is a, c, g, or t
cgtgtaacttcactggtgtttcgtttacaattaacaacaaataagtagtcaacataattgcatgaaaatgagtgacagcatgaatatcaagtcaaattcgtcccagaatgagcctgctatgaagggatggctatttaaatggacaaactatcttaaaggatatcagagaagatggtttgtactacaaagtggacatttgtcctattacaggaaccaagctgagatggctcacacttgtcgcggtagtatatcccttcatggtgccttgatatacacagtcgatgcttgcacttttgttatttcaaacggaggaactcagacatttcacataaaggctgcttcagaggtagaaagacaacaatgggttactgcattggaattagcaaaagccaaagctattagaagtatggaatctgaggaagacgaggaaatcgatgaatctggtgattttgaagactggtctggtgtagttagaaaattagaatcacaattgaatgatttacaaacgtgtggtgatgtattagctaagcattggaagcatttagcaaagtctttaggtgagatggagaccaattctgaccatgaattgttacaagggaaaaataaagaagtttgtgaaagagctacgttgttcaggattgcttctaatgcgatggttaactcatgtaatgattatttaaagttcgctcaaaaccatggtcataagctagtaagagccctgcaacacgaaaaggaacaaagaggtcgcttgcaagagatggtcgaaactcttgctcaacaacattctaaattagaacgggcagctaatgcacattcgcatctttcagcaattggtgcaaacgataatgaagatgaggatgataatgagttttatgatgcattagctgaggagggacattcttcaggacaggttacagatggagataaacattttcactttcgaataattcgaactcgctacaggacatagaagaaatagttcggatagttctagtgaaacggaggaaactcagacgaaacaagtgggtgtagtaacgggtaaacacaacaacgtaagacgaccagaaacacctagtgggttcatctggctaatggcatctccaaaatccaatggtgcgaaacgccagcggcgtactcgggtggcggacaaacctaattacccccttaatttgtggagcattatgaaaaattggataggaaaggatcttttccaagataccaatggctggttaattttaatgaaccactttctatgatgcagcgcatcacagaagaccttgaatatgctgatggtcttgatgtagctgcaaaatgtaccgatccttgggacaattagcatatatagctgcttttacaatttcnttctatgcngtcacaagcattagaactgggtaaaccatttaaatcattatt

SEQ ID NO: 2879 - DNA, 964 bp, Diabrotica virgifera
ggtacattaattgaccttgattattgtgatgaatagcatataaaaattcagtatggattttatttaacccatgcaagtgataacaattatagtttacaaattcaatatttaaataaatcgaaactaggtgaaatcaaatcctgtatattggacatatgacatcaatatcaataggaaataattatattgatattaagaaactgcgtctactcactttgaaatcggctgcccacatcaacgatttttaaaattccaatttttactttatgtttatacctatataattagaaaataacaataacatgaaaaaccatttgaaccgtaacaacaatctacaaaaaattggtgcaaacgataatgaagatgaggatgataatgagttttatgatgcgttagctgaggagggacattcttcaggacaggttacagatggagataaacattttacgttgaatattcgaactgctacaggacatagaagaaatagttcggatagctctagtgaaacggaggaaacccagacgaaacaagtggtcgtagtaacgggtaaacacaacaacgtaagacgaccagaaacacctagtggttcatctgctaatgcatctccaaaatccaatggtgcgaaacgtcagcggcgtactcgggtgccggacaaacctaattacccccttaatttgtggagcattatgaaaaattgcataggaaaggatctttccaagataccaatgcctgttaattttaatgaaccactttctatgatgcagcgcatcacagaagaccttgaatatgctgatgttcttgatgtagctgcaaaatgtaccgatccttgtgaacaattagcatatatagctgcttttacaatttcttcctatgcgtccacaagcattagaactggtaaaccatttaatccattattaggtgaaacatatgaattggataggactgatgatttgggttggcgtgt

SEQ ID NO: 2880 - DNA, 448 bp, Diabrotica virgifera
atttatacatccacatacttacagtttaaaatgattattatttaattacaacaatagtaaattagttaagaaatgtgttaccgccctgtatgctgttctccttgctccgttatggcttgttatccattatgttatccatgctgtcagccatgttgtccaccatcgtgtccacctaaagaagtccaaaatcgaatcaaactgttggcaccccctagtgagcccaggcctcctttaaaatgtaaacgcattcaaccttgttattattcaaaaccttcagatccaagatccaagactatcaaatttgatgaaaagatgcaaattacaactaactactgcaaagattaatttaatagaagattcccataccacttacttataatattgatgccaagttaggatttgtatcccatcgcatgaatatattatggtactctttctcaaaaccctc

SEQ ID NO: 2881 - DNA, 1215 bp, Diabrotica virgifera
gtgtgttgtgtgttccagttggattcctaggttaagatcgattaaaagagggcataacttttgaaattcaagtgtaaatatgttgtgaaacaacataaattcctctgtgagagactctgcctgaaatcaaccgaagatgtgtcattaaaagtattcgttaaaaaaagatgacgttggcgttagtctacaccagaaaaattacttacgtgtatatgcatagatgattaccagtgatgattccaccaaaggattggagaaaagctctaaaatcacaaccagcttatagaattgtaaataggacaatatgttgccagacgttctttgtgtattcagtgggactaacaggcataattttgttgtttttcttgtacacacattcttcaactggtaccagtagttcatattatagaagaagtaattataattatacctatccaataactaggcctataaagacgaaatccatgcacactttccgaataggtataatcgcagatttagatcaaagttcacatagtaaaaaagaaacagatacttggtattcctacttcaaaactggatatttgacgtacaatcctcaaacacatcacatagtagttaattgggatcaaaaagaagcagacatgctgaaaacgagttatgccctcaaaggtagaggattagagctgtcagaattggttacgttcgatggtaaattattaacgtttgatgatagaactggcctagtgtttgaattagtgaataacaaaataattccttggttaattcttatggatggtaatggaaaaactcaaaaaggtttcaaatcagaatgggctaccgttagggatgaagtgctttacgtagggtcaataggaaaagaatggacaagtgcagagggtgagtttgtaaataatgatccacaatatataaaaaccatcaccaaagaaggccatatcaaccatataaactgggttgaagaatataatagattaagaggtataatcggaataaagtggcctggttacatgatccatgaaagtggactgtggtcagctgtacataagagatggttttttctaccaagacggtgcagcaaagaaaggtataatgagagtttagatgaacatcgtggatgttcagtgcttattaccgctgacgcaaatgttaatgatgtgaatgtgatagaaattggtaatgccaaaccaactagaagtttttcaagctttaaatttg

SEQ ID NO: 2882 - DNA, 442 bp, Diabrotica virgifera
cccccttcgtccggaaacatttcaccacatcaacacgtgaattaatattcgaaaatggagtacgaaaatacacaacaaaatataaacttcgtaccgtgtgtaagatgggttaaacgaggagtggccaattcaagcccagtaaaattgcaactgtcgaaaaacgagctggctcaaattattaatgacaccaagattaaattacaagaatccaatgaaaatgaagatgagcctatggaagaaggtgaaacgtctcaaacagatgagtttgccttagaggattacgataaagaagacgaaaatgaggacactgcaaatgctttaggaattggatcattggcagaactggataatgatgctgcagacaatttttctgagtcagacgattctgaaaaagaagatgataaaatcaaaccatctgacaatctcatactagtatgacatg

SEQ ID NO: 2883 - DNA, 575 bp, Diabrotica virgifera
  misc_feature (507)..(507): n is a, c, g, or t
  misc_feature (544)..(544): n is a, c, g, or t
acccaccttcttttaaaatatataaataatctggtaaccagacatggacaagacgtggaggagaaatctcttacgatatgcagcggaacggactacatcaacataaactaccagcatatcgtatgcccgaacgcagaaaccgctaaggtatggttggatggactaagaaaaatcacccacaacgggaaagcaaataatttttgtcccatgacatgtttgaaaaaacattggatgagactaggattctctgtggatcacagaggccaaatcccggtaaaggtaatcgccaggactttcgcgtccggcaaaaccgagaagttggtctatcagattctgtccgaacttgaacttccgtctggaaaaaatgattccatcgaaccagaggctttcacctttgacaaattctactcgttgtaccacaagatctgtccaaggaatgatattgaggagttgttcaggagcataaccactgctaatgccgactacttgacattggaccagttcatncactttttgaacgagaagcagagagatccacgacttnaacgaatattataccctctctacgacgaaaa

SEQ ID NO: 2884 - DNA, 1075 bp, Diabrotica virgifera
gggccggccacgcgtccgattaagtcggagttaaacgaaccgacatacagttgagtcggcaaaccttaacccgtgcgtcaccatttagagcaggcaaaataagtcaatgatagtaaatttcaatttcggacttaccaccaacttgttccgataactttaagtgatgacgcacgggtgaggtttcgcggactcaactgtactcacaattcctttaaaatgctatgtatgatacaacttacatcgttgtaataatattgctatggttaccatttaaataattttgaacaattggtgaagggggacacatgcatttattataaaagcttttattgttataaaacttgataagtcagtgatttgttactaaatgaggcgacaatatggctgtataaaagcagaatctttgggtttttcgaatttacatttattgaattttactaatatcagagaatcactttgtatgcaatcagacaatcagtccatttcaaaatcgttttatgtatgaccgttgtttttaaaactgacatagaataagtaagtacttcttattctgtgtctatagagaaattttttgcaagtagttcaatgatttgttcacattacctgcattttaataacaaccaagatagtgtaccatattatatttttttggtctcctacacttttgtcaatatttttatagaactggtataaattacttgcaaaaattttattcaagactctgcttcattttacataaaggtattttggactaataatcattaattgcgactaaaaagttaggaatgcttttttgatcgtatgacacctgtgaaacaaataaacattcttcacaaagtattttttaccaaagacaaagactctttcccgcttcgggattggaagtaataatgactattttttttaagttatgacttcaagctagactattataagtgaatgatattaagatctgacttaagtcattaaggagttctgttttttctgatcgctgactctacttatgtatcttattgatcgtatatttatctctctgatcctttcagatgcgtttaacgtaaaatttagggtttat

SEQ ID NO: 2885 - DNA, 904 bp, Diabrotica virgifera
tttaataaaaaatttataaaaatataaatttaaattatttaaatttagtaatgttgccacaaaagaatccaagataagagctcgcgcagattgcagccaaagttggtgtaccaatcgaaaacgtaagcaatgtaatcatttggggaaaccactcatccacccaattccctgatgcttcccatgctgtcgttgttgttgacaacaaatcggtacccgctgtagaagctgtcaaggatggtgaatggctcagaaatgtattcgtttccaccgtacaaaagagaggtgctgccgtcattgctgcaagaaaaatgtcttccgctatgtctgctgccaaagcagcagctgaccatatgcgcgattggttcttaggcacacctgacaacaaattcgtgtctatgggagtattaagtgacggtagctatggcgcaccaaaggacgtcgtcttctccttccctgttaatattaaaaatggcaaatggcaaattgtccaaggtctccaaaacgacgacttcgccaaaggactgttggccgtcactggaaaggaactggaagaggagaaaaccgaagcgatcaccatcatcggagcatgactagctaacaaactttagaacgttaaacaaaaagaaataagtaattttgcctgaagtatacttgtatgcttgcaagtagtgagcacagaagtagataagcattatagataaaattcaattgaacatcaggcggggtcaatcgatcaacattacatatatacatattgtaaaaaaggtactattttattaaagaattctttttattctaaaagtaaaaaaaaaaaaaaaaaaaaaaaaaagaaaaaaaaaaaaacccggggggggggcccccccccaaattccccttaaggggggggttaaaaaaaaaagggggg

SEQ ID NO: 2886 - DNA, 1034 bp, Diabrotica virgifera
ggacgcactgctggaacaggtccggatgcccgggtgacccaaccatttaaaagtggaagtgatatccccggcgaggactatttcttaaattatattaatttacctcaatttatatctataaacatgccgcaagaaccaattcacgtagtcgtaactggagccgccggtcagatcgcatactccctactgtacatgatcgccaagggagatgtcttcggccccaaccaaaccttagtcctccgccttttggatatcccacccatgatgggcgtgttagagggagtcgtaatggaactcgccgattgcgcccttccacttttaagagaagtcattccaactgctgatccagctgtagcatttaaggacgtttcagctgccttccttgtaggagccatgcccaggaaagaaggcatggaacgtaaagatttactcgctgccaacgtcaaaatcttcaaagtacaaggtgaagctttagacaaacacgccaaaaaagatgtcaaagtattagtcgttggtaatcctgccaacaccaatgctctaatttgctcaaaatacgctccctccattccaaaagaaaatttcacagctatgaccagattggaccaaaacagagcacaagcgcagattgcagccaaagttggtgtaccaatcgaaaacgtaagcaatgtaatcatttggggaaaccactcatccacccaattccctgatgcttcccatgctgtcgttgttgttgacaacaaatcggtacccgctgtagaagctgtcaaggatggtgaatggctcagaaatgtattcgtttccaccgtacaaaagagaggtgctgccgtcattgctgcaagaaaaatgtcttccgctatgtctgctgccaaagcagcagctgaccatatgcgcgattggttcttatgcacacctgacaacaaaataatggatcaaaatcgattagacatcaggaggggtcaatcgatcaacattacatatatacatattgtaaaaaaggtactattttaactattttattaaagaattctttttgt

SEQ ID NO: 2887 - DNA, 1011 bp, Diabrotica virgifera
cgccgatctactaaagtttaaaaagtaattttttataaaaaagcattgaattcgttgttgtttagtttttagtatttagtggatcaaaatgagtgaaaaaatcgattgggcaaaatatgctgctgaaaatgaaaaaaagttacaggaaattgaaataacaaagaccaatggagatgaagcgaaaaaagaagatagcaaagaagaagatgacaaaattgatcctgcagaagctagtctgttagctaaaataattagaaaaggtttagtagaaaataaaaacgatatagaagttcaaagaaaagaccctcgttcaccattatactcagtaaaaacatttgaagcgctcaatctaaatccaaatctactcaaaggagtgtatgagatgggatttaatgctccttccaagattcaagagactgctttacctgcacttttggcagaccctccgcaaaatttgattgctcagtcccagtcaggaacaggtaaaacagctgcttttgttctcgcaatgctgaccagagttgatccctctaaaaagtacccacaagtgttgtgtttgtcaccaacctatgaattggcaattcagacgggagaggttgcagctcatatggcaaagttctgcccggaacttgagctgaaatatgcagtagctggtgaacaagcagcgcgagggagccagataactgagcacatacttattggaacaccaggaaaagttttagattgggctataaaatttaaagtatttgatctgaagaaaattcacgtatttgtattagatgaagccgatgtaatgatagctacgcaaggacaccaggatcagtgtattaggatacacaaggttttagatgccagtaaatgtcaaatgatgtttttttctgcctcttacacaacaaattacatggagcatgctgatgatatagattaagttaactataagtttttaataaagtaataataaattcagaagaaaattctgaaagtaaaatcatcaaaatctaacaaatgaga

SEQ ID NO: 2888 - DNA, 703 bp, Diabrotica virgifera
caaaagtctggtcaggattttctctattttttttttcatccgaggactgtagagactgttaaggagtatcagcactgcaatgaaaatactccatttgatgcatttccattgggccagagtttatggaagtcccatcaattctcagaagattttacagataaaattaggaactatgttgaagaatgtgataattttcagggtttccattttcttacagattgcaccaatgctttcgctggtttgtcgtcttcctgtttagaatacattagagatgaatacgatagaaaatcagtgttgatacttccaatgattccatcttactttcctgacaatgactttagttcagaagaagaaaagaatcagtcccttataaatgattctgttagggtattaaatatggcattcggatttaacgaatttagcgtttattcttcattaacagtgcctttaagtattggtagtaaaggatggagacaacctggacctccgcgaatttttcaaaatttggattataatcataaattggcctaccactctagtgcaatattagcagctgcattggacactgtaacattaaagcataggctgaaaaactcaccttttactctgaaagatttaagtgcagatttaactcagaacggaagaaatttgtggcggccagtgtacaaatgccgtttcgtatacacgaaaaaagtgacctact

SEQ ID NO: 2889 - DNA, 2321 bp, Diabrotica virgifera
gcaacttgaggaagaaagcgaagctcgtcttgaccttgaacgtcaattggtcaaatcccaaggtgaagttcaagtctacaaatccaaatatgaaaccgaagtcgttgctcgtgctgaagaagttgaagaaatccgtcgcaaattcaccatcagaatccaagaacaagaagaacacattgaagccctcttggtcaaggtcaacaacctcgagaagcaaaagtcccgcctccaatccgaagtcgaggttcttatcattgacttggagaaagcaaataacaccgctagagaacttcaaaaacgcgttgaacaactcgagagaatcaatattgacttgaagacccgtctcgatgaaacagttcaattgtacgagcaaagccaacgtgacctccgtaacaaggttactgaattgcaacgcgctgtacacgaattggacaaaactcgcgaactgaaggaccaacttgccagagaaaacaagaaattatgcgacgatctcagcgactccaagattaccattaccgagcttactcgtcgtctccatgaactcgacttggaagttcgccgtttggaaaatgaacgtgatgaacttactgcagcctacaaagaagctgaagccggacgtaaagctgaagaacaacgtgcccaacgccttgccgccgaacttggtcaattccgtcacgaagccgaaaaacgtcttcaagaaaaagacgaagaaattgaagctatccgcaaggcaaccagcatcgaaattgaacagctcaatgcccgcgtcgttgaagccgaaaccaggctcaagactgaggtcacccgcatcaagaagaagttgcagatccaaatcaccgagctcgagatgtccttggactccgccaacaaactcaacatcgacctccaaaagaccatcaagaaacaatccctgcaactcaccgaaatccaggctcactatgacgaaatccaacgtcaattgcaagttactcttgaccaactcagcgtatcacaaagaagggtacaggcacttaccgccgaatctgaagaaatcaggagcaattatgaaggtgctcttcgtggtaagaggcaagccgagcaaatgtacgaagaagctggcactcgcatcaacgagctcaccaccatcaacgtcaacctttcttcaatgaaggtcaagattgaacaagaactgtcctcagttcttgctgactacgatgaaatcaccaaggaactccgcatttctgatgaacgctaccaacgtgtacaggccgaactcaaacataccgtcgaaatcctgcatgaagaacaagagcgcgtggtcaagatcgaagctatcaagaagagtctggaaatcgaagtcaagaacctctcagtccgtttggaagaagtcgaagccaacgctatcgttggaggaaaacgtatcatcagcaaactcgaagctcgtatcagggattgcgaagctgaactcgatgaagaaaagagacgccacgccgaaaccatcaagatcttgcgcaagaaggaacgcactgttaaggaagtcatgatccaatgtgaagaggaccaaaagaacatcgctctattgcaagaaactttagacaaggctaattcgaagattactattttcaagagacaactacaagaagtcgagggtgtatctagccaaagcataactcgcgtacgtcgattccagagggaattggaagccgccgaagaccgtgccgaaaccgccgaaagcaatctgtccctcatccgagccaaacaccgcactttcgtcaccaccagcacagtacctggctcccaagtctacttggtacaagaacaacgagcatcttccgaaatctaatcatctcctattctagctactaataaactaccccatccggccgaataacaacatcaaagacacttatccatacagcagcgacatctgcgaaggaaaacttgagttggaagactcgtttctcttcgtcagtttcttgctgtgtgcaaacttgtctttgggctcgcgacatggtggaagacatcatcatacaagatcatttttttttgttcttcgtgcacataattaaataatatttaccactctctttgaaatattattattattattataacgaaacgtacatatttcattaaataaattaataaaatgagtaagcgatttatatttgtttgcaatcgcacgatgagtccatggtatggaaatttgtaggtttctaataaactgttatgttatgtaattgtacttatatcactgatgtgtgcttctattagaggtacaagggttattggaatgtaatttataagtttttgaatgtaccgtgtaagaataaattgcttat

SEQ ID NO: 2890 - DNA, 1897 bp, Diabrotica virgifera
cccttttcgtccgcgacgctcctataccgtcgactctgccaccactgtcaggcggcgcaggcacgcggatttcaatcttgaaattttcgacggtcagtgcaccaacgacacgactatacattcacaaaaaagcaaaaaaatctcttgaagatggcttcttcctctgtggcgaggacctccaaatactcgtaccgttccacaggagctgcaggaggcagtgctgacgtcagcatcgaatacagcgcggatctgacagcgctttctaggcttgaggataaaattcgcctacttcaggatgacctagaaattgaacgagaacttagatctagaatcgaaagagaaaaagccgaccttagtgtacaagtaatccaattatcagaacgtctagaagaagctgagggtggtgcagaaagtcagtttgaaattaacaaaaaacgtgacacagaattgctgaagcttcgcaaactattagaagatgtacacatagagtcagaagaaactgctctcatcctcaagaagaaacatcaagaaatcgttgtcgacttccaagaacagattgattccttagctaaagcaaaatcaagagccgaaaaagaaaagggcaaattccaagccgaaatctaccagctcatcgcccaggtcgaaagcgtaaccaaagaacgcttgatttccatcaaacaatgtgagaaactagaaatcaccgtcaacgagctcaacatcagaatcgaggagcttaaccgttccgtcgttgacatcacctcccacaagacccgtctctcccaagagaacatcgagctcatcaaggaagtccaagacctcaaggtcaatatcgaaaacgccatctacctcaagagccagctcgccggccaactagaggatgcccgccgccgtgctgaagacgatgaaagaagacgctcccttttggaggccaacctccaccaggtcgagatcgaacttgaatctgtccgtgtgcaacttgaggaagaaagcgaagctcgtcttgaccttgaacgtcaattggtcaaatcccaaggtgaggttcaagtctacaaatccaaatatgaaaccgaagtcgttgctcgtgctgaagaagttgaagaaatccgtcgcaaattcaccatcagaatccaagaacaagaagaacacattgaagccctcttggtcaaggtcaacaacctcgagaagcaaaagtcccgcctccaatccgaagtcgaggttcttatcattgacttggagaaagcaaataacaccgctagagaacttcaaaaacgcgttgaacaactcgagagaatcaatattgacttgaagacccgtctcgatgaaacagttcaattgtacgagcaaagccaacgtgacctccgtaacaaggttactgaattgcaacgcgctgtacacgaattggacaaaactcgcgaactgaaggaccaacttgccagagaaaacaagaaattatgcgacgatctcagcgactccaagattaccattaccgagcttactcgtcgtctccatgaactcgacttggaagttcgccgtttggaaaatgaacgtgatgaacttactgcagcctacaaagaagctgaagccggacgtaaagctgaagaacaacgtgcccaacgtcttgctgccgaacttggtcaattccgtcacgaagccgaaaaacgtcttcaagaaaaagacgaagaaattgaagctatccgcaaggcaaccagcatcgaaattgaacagctcaatgcccgcgtcgttgaagccgaaaccaggctcaagactgggggcccccccatcaacaagaaaaaaaaatgtggagagaaaaccccaaaaatccccccccagggggttgggaaaaggtttctcttttggggatactccccccccccccaaaaaaaaaaatatatcaaaa

SEQ ID NO: 2891 - DNA, 872 bp, Diabrotica virgifera
  misc_feature (798)..(799): n is a, c, g, or t
  misc_feature (807)..(807): n is a, c, g, or t
  misc_feature (819)..(819): n is a, c, g, or t
  misc_feature (822)..(822): n is a, c, g, or t
aacccggtcccggaatttcccccccgacgttcttgcaaactttcaagaagttcaagtgctcatttttacatttttgtgcccttaacaagtgcgaattatcgagttcagacgatttgaaaagtagaaaactgaaatcgaatataataattcaattttcacgctagagagtaaagagttcaagttcaaacgaaaatcaattacgaaaaaatacagaaacaatggcagctgtaataccagccattactaaaatttctcccagagtaataagaatattagggtgtaatcccggatttatgacattacagggaaccaacacgtacattgttggaacaggcaaaaggagaatattgatagacacaggagatgaaggaatacctcaatacatcaaccatttgaaatctgttttaacctatgaaggcatcgatttggctcatattttcataactcactggcatcatgaccatattggaggactcaatgacatattgacagaacttagagaaaaaacaaaacattgtcaagtttggaaatacccaagccttaaagatgacatcaacaagaacgaattgatagaatcatttaaagatggtcaagagtttgctgtagaaggagcaacacttagagtggttcatacacccggacatacagatgaccacatagtgctccatttactagaagacaatgtcatctttagtgcggactgtatcctgctagagggcacagctgtctttgaagacttgtatgattacatgcgttccctgcaggacattgctaacctacagcctgcaactatccttnnccgacatnggaatactatancanaccccgctgagaaatatccttctacatcaaacatagactcgaacgtgaat

SEQ ID NO: 2892 - DNA, 1753 bp, Diabrotica virgifera
caaaataattccttttttccaatttataaaattatctttccattttgtctatttttgtacatgtgtatcctattgtaaaggatgtttggtagccataatctttcaaatagttttctttaattgtatgataaattcttttaaataccaataaaaggaaatcccattttagatctttgtctcggtcgccatcaatggttatacattacgttttaccacgttttcttttgtttagatacttcttctccactcatcaaagctaagagtaaaattattgaataataacaataaagacctatgacacattaaatttgcatgtcaacaaaatattaaaaaggaatggtaataaatctgcctaacatacctaatataaacgcagcaaacattggaatttgcagatacatatacagtgaaaataatgatgatgatcataaaataaacaaaattacatcagatccataatgaaacgttccattccgctttttgtataagagaaggaacgtgcgatgctttctatgtgtcgtaggagaagacgtatgtaattaatttttattattaaaaactaaagaatctccaagtggaatcagcacgaaacaatgaaaatctattcataaaaactattcaagttatcctgtttctaagacacgtttcctgtcactgtcctgtcacatttgttaagaaggcaaacttaatttcattgtcatttagcagagactgaatgaattattttttcgtctatgtaaatcgcttcgtgaaagaaatcatgggacaacgaatccctataactaataccaatttaaatgtaatctcgctcacaattaactaaaacatgacatgaaccttcggtacaatccgtcaacaaaaggttaaaaatgttttggtcaacagttatttatgcaatttgtgtagtaaaagacttcttgattttgtttggtgtattcagttaacttccttttaaaggcaaattctaaacaatgtctgtgatagtagaataacgattattcttaaaagtcacaaagcatgcgttatttgatgagattgcaacaatctcaaattgaaagcagatagggtagtttgtaattatacaaaaagtgttgtgtattttgataattattgctttcattgtgccaaattgtaaaaattaacgaaatttttattggtatcgaaagaaggttgataacaagccgcagtaatttgtggatttgttttgaataattttatcatatttgagttttaatttggtcagggttatagtggatttgaaacgtgcaattaatacttattttgtatgtaatttaaataaaaaaaaaaatctgtacatattttattagccattcaacaattatttctttgccctaaattcttcttgttgacatttggttggaaatcaatagaaactctttcattttctgatgctatgggcaataaaaaaaaaaaaggggaaaaccccccgaaaaaggggagacccccccaattttttccctttccggaatttttaacccccctttttcaatttttgtttttgtttataaaaaagagaaaatttttttttttttttccaaaaaaaaactggcccccaaaaaaaaaaccacttatttttgtgggttaaaaaaaaaaaaaatttttctcgaatattttaggagaaaaattcacaaaaaatatataataaatatttttttttttttgggtgttttcctacaccacaaaaaaacaaataaaaggggggggaatatttttttttttttacacccccccc

SEQ ID NO: 2893 - DNA, 1397 bp, Diabrotica virgifera
gtccgattgatatttatgttgatatgtgatctgaaggaaccactacactgtaaagataccctagtaagagtggaatcagttcagtgagtcaaattcagttcagcgcagaagtcgattaacaaatttaagctcaaatgttttcactttggaaacaaagtttggtgtatttgatttacgctagtcatttgatggaaaacaggatttttttagtcactgttatcgttgaattcagaattcacattacagattttagaatctacgctgcaacaataatcgacgtacctttttgcgcatttaatcgttagttttagcttggaatgtattataggaatcgtttctgagctgagaatcaatgtcacgtaatcggatcacacaaaggaacataaaagttggatccaactctatacaaatgttttttagtaggagcgcttgtcagttatttttattctaggattcatttgtttccacaagttttgtccttagtccatgatatttagttcctttttactaatgtttcatgttcgtactaatgtgttttatacaaaccttcgtttttttgtctattattatttacgtttattgtatattctaattcattcattattaatattaagtattaaattgtcattatctaaaactgtttgattttattactttttaccgattgaaatgtacatatttctatttatttcggtattctatcaatttgtaaatcattagaattaagtttataactgcccatgacgcactaatgcgtcatctgagtatagaatgtgttaatggaaatctgtgtacatgaaaatttgttattgagaatgttttttcttgcgcacaacttctttttgatttttgccttaatgtcacattaagcaacttacatcacatctccgctcaaacagtgtcataattcaaaaagcaaagtatcgagaaaacgaaattttaaagttagctctaaaatttttccgaatttctttaaaaactattataattagaaaaataactatttttataccgttaccgagggtttttgaagcactaacaaaaataaggattaagtttacttgggtaaaatattttaaaaaaaattttttttttgagttggggcccctttaaaaaataaaaatacgaaaacattttacgcaaatattaagggattttattaaaaattgggttttaaaaggacaaaaaaataatttattatttatttgggtttaaaaaaaaaattatcctttttttaataaatttaaacttataaaaaaattgggggccaaaaattttaaaaaaggggtggccctttctttttttggtggggaatattttctcaaatatttttttttttttaaaaaaaaggaaaacacaaacacaaatattttttttgctgtttttctttttttttt

SEQ ID NO: 2894 - DNA, 2063 bp, Diabrotica virgifera
gaacgggccgggatttctcgggggacctgttcacatttagactgtcaacatggcgtcaattctaaagttttctcgatcttttgcaaaattacctaaatacgaaactgcattaaaagcctgtagacaaaatattattagaggagcagccacccagccagattcacaaactgttgttctaaatgtaccaccaacaaaagtcagcactttgaaaaatggtatcagagttgctactgaagattggggatcccagactgccacagtaggtatttggattgatgctggcagtaggtatgaggatgataaaaataatggagttgctcacttcatggaacacatggcatttaagggtaccagtaaaagaacccaaagtcagttagaaattgaaattgaagacctaggtgcccaattgaatgcctacacaagcagagagcagacagtatattattccaaatgtttagccaaagatgtaccaaaggccatagaaatcttggctgatatcatccagaatgccaaattgggagaggctgaaatcgaacgagaaagaggtgtaatccttagggaaatgcaagaagtcgaatctaatttacaagaagttgtatttgatcatttacatgctattgcttaccaaggaacacctttagctaatactatcttaggtcccactgccaacattaggtcaatcaactccacagaccttagaaattaccttgacaaccactacaaatctagcagaattgttgttgctggagcaggtggaattgaacaccaagatttagtgaaactcgctgagagccatctgggttccttaaacaatacatatccaggaaaagttccagtaattgctccatgtcgtttcactggatcagaaattagagtcagagatgattccctgcctttggcacacattgcccttgctgttgaaggggctggttggtccgaccctgataccctcacattgatggttgcttctactttgttgggtgcttgggacaggtcccaagcctccgccaaacagaatgctaccaacttagctagagctagtggggaaggtgacttgtgtcattcctaccaaagcttcaatacctgctataaggatactggtttgtggggagtgtatttcgtctcagatcctcttaagattgaggatatggtctttaacattcaacaagaattcatgagactctgcacttccgtaactgaaggtgaagttgagcgtgctaaagctcttcttactgccaacactcttcttcaacttgacactactagtgcagtatgtgaggatattggtcgtcaattactctgctatggcaggagactcccaccccatgaattggctcaccgaatcaacagcatcaccgccaaaaacgtgaaagatgtatgctacaagtatttatacgacagatgtccagctgttgcaggtgtaggaccagtagaacagttacccgactacaacatcgtcaggtcacaaatgtactggcttagagtttaagagggttcagcactaaaaacaggaatgatggatgattgtaaagaattgtttttattaatttctcctgcttatcgaggcttttggctctgcgtatggttactagtaaaatatgaaaacatttctgtaaatattttgttttatgacgtaaaagataagggaaaagtttgaaaggctgtaaattgtaaaccaaataacagaaaattaagttgtttgataatgtagtgacaaaaaattgatgggtgcatattgagaaattaacaattccttttgtatactagtattcatcgtttttgttaataaactcttagcgacattttttcccagatattttttaattcctgtacgatccacaccttgtaatatattaatttaatttataaaatacgttgtttaaatgtaagtactctacgtcgtttttattaaaataaagaattaaagagaaaaaaaaaaaaaaaaaaaaaaaaaaaaaaaaaaaaaaaaaaaaaaaaaaaaaaaaaaaaaaaaaaaaaaaaaaaaaatctttgttttaaatcggggggggcccctttaaaagatccaaggttaacgaccgggg

SEQ ID NO: 2895 - DNA, 1159 bp, Diabrotica virgifera
atttttaagtaaaaatcatacaacatttttttaataggtacttagtgtaagtcgtacgcatacctcacgatagaaaatgctcaagaaaattttagttttgtgtttggtttgcaatgcctgtatggcatacacagcaactatatctcaagcagctgttagcaataataacaacaatataggaactatatctgcctttttgaaggaaatacttaaaattacgggcatagtgactgcaaataatgcgtccattttacagaatgcaacagtacacgttgccacgatatttagtaacgtacttccaccgttaccgcccggtttgccaccattaaacctagatgaagttattctctcagtttttaaatggttccaggatattttaatatggtacgccactgtaataaagaaattagaagactctttgaaacttccatcgtcacagagcttgccaaatgttcctggtaatttcacaattgatgaaacaggaaaatctataacagactgggcaactgttaatcaaaaaagtatacaggcggcaattgatgaagcgcttaaaggagtagaaccttttcctccttatccagatatatttccaaaaattgccaagcaatacgtagattaccttcaagtcatcccagattcaataagagaagtcatcaagaatacagtaaaatcaattggggaagaaatcaacaaaatcaagatatgattaaagacgccgttaaagcagctatcccacaagcgctgaacattcctaaaatacaactatttcccaatacgttaccaaaactaatttggttttaggatataaacacaaatcatacgtatatagtaataatgctaattattctgccgtttgtaagcttttaggaacgtacattcgctcactttctgcgtgcgcatgtcgatagtgcttttgattatatacattattgcgagtagcgtatctggatatctctgatgctacctactcttattactaagcttcttcgtaccattagggattgaattactaccagaatactgcacctcctagatcgccctggcgattaaatatacatttaacgagagaggttcattagccgaagaagaattgtatccttttatctgcgacgaagattttatataatagggatgctgatgtgaacagcctatgtactga

SEQ ID NO: 2896 - DNA, 919 bp, Diabrotica virgifera
gccaatggtgaatcacgggtccgaaattgcgactatttatttacaaaaataacaatgaattttctgagacaaaagttttctgacgttgtaatcccttactttagtaagagaatagaaaccaacaaagaacaaaaagtcggaaagtatggacagtattttgagaagatctacgaagttcttagctgggaagatactcgctacagtttggtagttttcgttgtttttaattatttattttggttaatggtccaatggcagatcaaaatcgttggtctcatattctttatattgttaattctctttttgttcgacacatttttcccacatacgaggcaaatagaacaaccgataaagtcagctgatatggtggataatacgtatatagtgataatggacatattctacggcttgaaagcttttaggaacgaaaattcgctcactttctgcgtgggcatgtcgatagtgtttttgattataaacattattgcgagaagcgtatctggatatctaatatgctacctactcttattactaagtttcttcgtaccattaggcattaaattactaccagaagaagtaacctcgaaaatagccaacggaattaaatatacatttaacgtaaaaggtacattagccgaagaagaattggttccttttatctgcgacaaagattttaataatagggatgctgatttggacagtctatgtactggatagaactgcagattcagtttcaaattcgcttatcagtggaataagcacgatgccttcatttctcgacatggcagaaggcgatcgagatatagaagaagacgatctcataccaccactaactccaagtgatatttctagtgattcagacctagaccataaagaaatgagtatcgattcctctcattttcacggagatagctcttca

SEQ ID NO: 2897 - DNA, 705 bp, Diabrotica virgifera
  misc_feature (495)..(495): n is a, c, g, or t
  misc_feature (499)..(499): n is a, c, g, or t
aaatagattccatgataaacaaaaagaatgtaattttatgagtcatttaaaaaaatttaccatgggtactatcaaaaatgtgatagttgtatttttaactgtacaaatattcattgtaagatgtagcgacattacaaaacttgcttttggacaatttactcatggacttccagcagcatttggagactttaactctgatgaacttacggatgtgtttgtgttaactaatagggaacaaacactccaaattcttttagcttatgcagaagagccattgcttcgaccagcacctacacttaattgcacatttaaaaaccacaagattaccagtgttgtaccaggtgattttgatggagatgccttgatggatgtgttaataactactattaaagcagatacctcgattaacaatgcaaggacaagtatttatattctatggggaggtaatactaccttcaattgtacagagattgaagggccccattgattgaaatngtangtcaaccatggcaattgattataatcaagatatgatcattgatttgtttggagaagacatttgagaaaaaaagagccttttggtttttggtaaaaacagaactgagcctaaagaaagtggagatgcatcaccacaataaagaaccaaatggcgtactcatgaagcctcatgctcatgcatttttagatcttaatgatgactatatg

SEQ ID NO: 2898 - DNA, 473 bp, Diabrotica virgifera
ccctactcacgcgctccgcccacgcgtccggtttcagaaatagactatgacaataaatgtcagattcaacaaacttgttttgttacctagcaacgatctcacaggttacttaaaataattcatcttatcacataatgaaaatggatacagatatttgaaacgaaattattattggtagattgtgagtattagaaatccataaactactaaccgattgtgagtaaaatagtatacaaacctcgcgggaactcattctagcctcgcgtctgtagtttacctcggtgcttcgcacctcggtaaactaaccttgccgctcggctgaaattatattattttccgggtaggtaggtaatatactaataacttccttcctggctcagataattttcgcaatttatagattcgcaatagatttattatacccattataaaatttaaaagaccaaatttcagtatttaaaacgtaagtatat

SEQ ID NO: 2899 - DNA, 1316 bp, Diabrotica virgifera
cacgcggaactgaagctggagaaggacgctgtcggttttcttttctgtgcatgtttcaccatttttaataatttaaaaacccgctattcgtaattttgttggttgtctttacggattacttacaattttggaaataaaatgactcccggccgatcatcaacgactacaaaagtgtttgtaggaagtttgcctccagacgctaccccagaggatttgaagaaacttttcgagccctacgggaacattgcagaatgcgacatcgcgaacaaatgtggattcctccacttagaggatggcgaattggcaatgaaggccattgacgagctaaatggtatggaattcatgggttccaaaatttcagtggaaaaggggcgagttaagccgcgaaggagtggcggtggacccagaggtggaagagaacgaggaggcccgtattcaagaggaggaggtgacttcagaggcagaaatggaggttttggtgggggacgtgatggcggaccatacagaggtggtggtggctttgacaggagtggtagaggtggctacggaggtggagatagaggttatgatgatagacgtggtggcagaccagcatatgatgatagaagtactggaggatttgatggttatgatgatagacgcggaggatatgacagggatccttatgctgctggtggttatggcggtggctacgaaagacaaggaggctatgacagcagaggaggttatgaagacagacgtggggcagctggtgcatacgatcaaagagcagctgcaccagatggtctctacagtcgcagagatatggcacctaaacagagttatggtggatccaacggatacggcgcttctgccggctacggtcgcgacgccggtggctacggcgccgcctatggagatcgcgcagacgccgatccgtacgctgcagctgatccatacagaggggcttcagccggtggtggctatcaggatagaggtgatagaggatacggtgggcgacctgctgagggttatggaaactcatacgctgctgcatctggcggagctaccgctgcaagaagtggctacgactcggcatatcctcctctaccacagcaaagaggcatgtactaaacacgcattgtcgaatactcgcttccacatgcgcccagaatcgtttgacggacaattaagagaaaaaaatcaaaactcgcagacataatagcggaagcccctattctggataatgtaagattgtttaattttagcgcatcaaacctaagtttatgtcatgtagtgtttagatatcttcattttgataatataatgttttaagg

SEQ ID NO: 2900 - DNA, 1550 bp, Diabrotica virgifera
ggataatgttaagaaatttaaatgtcaacaccatggagcgcccatataaaaaatttcaggggggggcagacctgaagattttgcacattacattttgtacactatggataacaatatatagtttgaagcacccgaaaagctaggggagctacggccccccctgctcttgggtatgggcgcctatggtcaacaccaaaaataacggccaataaaaggcgaaaaaaatggcagctttgataaagtggtttcgtgctttcttctttgaacgacaacggttcctttccgtttaagacctgtcgtttacttattgcgaggtggttttgctttcaatcatagtaaattttccggggataaataataagctagttttcaccacttgtggacgcttctctattccctctagagaggttcagtgtctgaaaagtttgaaatttgaagtatcagttacgataagatacctatgtagaaacctcatttttgaagatagctttgaagaatcaaaaatttaattgcaataaatattataatttttctacaagaaaaaaaaacaatagaaagagtataacatactagttattacgccatatagactttgttatccaactttgctgatatcattaccgtatctaataaaaaaatctatttttactacttaatatcacatttcctgatgcaatatccgagaaacgaaaaattacccaagataataaattgattttgctctacttaagaacatagtggctgttttaaaaatatgatgttaatatttttggaaattgtgtccaccttagtatataattaatactacatgtaccaaatgatggccacagactatttttcgttttctgtctgtcctaacgtccatctactaaacgtgaaagagtttggtagatggcggtaaaaatgccatgaacttatttctgtagaaaatgaggctattgaatatgttgtgaggaaataggcaagtgtatgattgcttacgattgccagacaaataaggaagactaatctagaattcttttcaaaatagaaaaaaagactaatcatttttaactgctacaaaaatatcattttgcatagtataaaaatataaagacgattttaaatgaaaattaagattatattgaattgattcaaaacagaatatttcgatgaatttacacttgaataaaaaagttttttattggaaaaataatctgtgaccttataatataccagtaaatcatcaatgtgaatatattttcatgtaaacgtgatatttagtttctaatgtttagctgtcttataagagaaagatctatcggtttttcgagagaataatagaaaaactgcacagaaatgtacagaaaaaggttgtgtaggaaagttttaaaaaagttttctcggaaagaaagatttgttctttatcgggcggtttagtggtattcaattgttaaatttttatttatatctatctctagtggtggttaagtaatcatagacgtttttgatcatttgtacttttgcctaaatagatttgtttttaaaattaaaaaaaacccacgcgtccg

SEQ ID NO: 2901 - DNA, 3338 bp, Diabrotica virgifera
gtcgcggagtccacggcacgttgcgtgactttgaaccgcgtaacccatatataaatttattttgcaacttatcctgtcagttgtgtgctaggtcttgatttgtcaagccctaaattaccgggagaacaagtcataacagtgtttacattaccccatagtgcactttgcaagtttggagtaacttgtaaactgttagtgaaaaccaaagagactcttggacttaattttcttgtgatttttctgtgaatttataacagataacaatggcaccaaacacgtcaatgcccaccggtgttcttcacgaacacgatgacgaagtccaagcaaaaatgattcccgcggaaattgtaaaaccaagcgagcgcaaacttgaactggtttggcgcaacatcattctttttgcttatcttcacatggtagcgctgtatggattttatctgatgatagcacaggcgagagtatttacttcgatattggctgtagtgttatatatttgcggtggtctgggaataacagctggtgctcacagactgtgggctcaccgctcctatcaagcaaaatggccactgaaaattctccttaccatatttaataccttagcatttgagaactcagtaattgaatggtccagagaccacagagtacatcacaaattcagtgaaaccgacgcagatccgcacaacgccaagagaggattcttcttcgctcacgttggttggctactctgtcgcaaacatcccgaagtcaagagcaaaggcaaaggaatcgacatgtccgatctggaacaagaccccattttggctttccaggacagacactatctgatgctcatgcctataacctgcttcgtgattcccaccatcataccaatgtacttctggaacgaaactttcttcaatgctttctgtgtcaatatcttcagatatgtattcaccctgaacgctacctggttagttaattctgctgcacacatgtggggtgacaaaccttatgataaattcattaacccttccgaaaacgtctctgtttcggtcttcgccttaggtgaaggctggcacaactaccaccacaccttcccatgggactacaaaacttccgaattaggcaaatacagtaccaatttttcatcagccttcattgacttcttcgccaagatcggctgggcttacgatctcagaactgtctccattgacatgatcaagaaaagggtacaacgtaccggagatggaacccacgaaatctggggatggggagacaaagaccaacgtaaagaagactatgacgacgccacggtcttgtacaaaaaagattattaatacgaatgctagtgaatgatagtgaaacaatatatagtagtcgtgaatgtagtaaacactgaaaatgttactaaaatttttgagttgcgtccggatgttacttgtacaatttggaatttttactaattttattaatagtttagcatttaaaaacttttgatagaacatccggtaacgctgagacatgaatctcagaacacaaaaattgtaagtaatatatgtgtagttacatagaaccttgatattttcatgttaaaatttgaaataaatatatcttatttatgtaaagactttaacgactacaaattgtgtgtatctgtgacaaaaccctaagttatattgaagagactgataaaaaaatcgtaagtgacttgctctgaacgagtggtaaaactaaatggtaacttatccagccatgtatgtttgaactgtttcatcgtctgccggcagaccagtgatttgatttagaacacgaattttggtctttgtatacctaaatcatttagatttgccacttaaatttttaaaaattgatgtgaatcaaaataaataatcaatttattactgttgggtacaaaacacacttagttttgcgtacgcatcttatacaatactttcatgagatttttacactgtttaaatattatagaccttatcttgaaatttggaactccatatgataagttggtcttcttctctcttactgttcgttaaaaatcagttttgctccctaacttttaatatgtctttaatctaaaagtggcaggtagattttttgctttttgttaatttttagcacaggttcaagacactctgaggaatttacgtaggaaagaagaagttttctgagctaaaccacctgtataacttcacataatggataatgttaaaatttaaatgtcaacaccatgggcgcccatataaaaaatttcagggggggggcagacgtgaagattttgcacattacattttgtacactatggataacaatatatagtttgaagcacccgaaaagctaggggggctacggccccccctgctcttgggtatgggcgcctatggtcaacaccaaaaataacggccaataaaaggcgaaaaaaatggcagctttgataaagtggtttcgtgctttcttctttgaacgacaacggttcctttccgtttaagacctgtcgtttacttattgcgaggtggttttgctttcaatcatagtaaattttccggggataaataataagctagttttcaccacttgtggacgcttctctattccctctagagaggttcagtgtctgaaaagtttgaaatttgaagtatcagttacgataagatacctatggagaaacctcatttttgaagatagctttgaataattaaaaatttaattgctatacatattataatatttataatagaaaaaaaaataatacgttaaagtatcataagactatttatttttttctttctacaattaaaaaaaaaaaaaaaaaaaaattatatttccccatttttttaaaaaaaaaataaaaaaaaaaatttttttttttttattgaaaaataaatatggtagataagttttttgtaatgaaatgttattcgtatgtaaatataactaatttaaaaggaaataaagaaactttatttattaacaatatatatataataaaatatttttatattattaatatgaaatatttttagggatgagcttaaatataaaattttattaaaattcaatttttaaataaaaatgaggattaaaaattttcatattataaaatatgctattatttatttttatatattataatttttattatttataaatcttttattataatatagagttaaattatttttaattagaaatgctgatgatttgagtatgtagagaattggaatttagttacaatatataggtcgaataaaggaattcagtcaactttttttcccctgtttattacaaacatgcctcttcgtatgaagtataaagtatcgcctggccactgattaatttgaatg

SEQ ID NO: 2902 - DNA, 934 bp, Diabrotica virgifera
ccctctacgcgtccgattttattatttaatttttattatatactttgaattcgttaataactgataaaagcatgggtttggcactgaggcactttggcgacagtctattgttccttgtttgttttggagaatcgactgttctaactggcatagagggactctactcggttcatgctaaatgcaggacagattaaaacggcgagcacttgctggttgtgtggaaaacgtatataaatataaattttcagatgtatcggaaggcattaaatgatttgcaatctattttagtctctcctgcatcgttaatatcgttcctcatggacagagtaagttttattgtatgtataatataattatatattttattcttggtaatgcatttttgcattgtgatgattgtattttagcagtaatttatggagttcaaagcatatacttctgttttccggcacagttagtaacgttaactaataaagttaaaatagcgatattgcttgaagtaaagtagttcccattttggtctttttttatatcttcttttattaagcaaagcaatagtaatgtgtaggtaacaacgggacaaaataggagctacttatttcacctttttttttatattgtcatgtagtttattttttgaaagaggatcgcaggcttccctggaggagtacagctaggacattcatttgcaatcatagaatcatatatgacgataattattatattaatttaattctggttttacatccatttttgcttaagctttttggtattttgtccctctccgatacattaaaactaagaaactttctgttttattattttttcgctttttctgtgaagtagttaatctttctatatttgccaattaaatgcctaaataagtaacccctttttctggattttatacaaacaccacaagcctccctattgt

SEQ ID NO: 2903 - DNA, 932 bp, Diabrotica virgifera
  misc_feature (818)..(818): n is a, c, g, or t
  misc_feature (904)..(904): n is a, c, g, or t
gtgagaagtggaagagggaaaatgggttgctgcgctaaagttggagctgttgttgcagtgcttttagctgttttagttgtctatagtacaaaatctttatttcaaacacccaaggtgccagatttgggcgaaaaatggtggaaagtggccaagccggcaaaagtggatactagtatcaaaccgttcaaaattcaaatttcagatgaaattttaaaagacttgaaggacagactagatcgtagtcttccatttcaaccacccctagatggcgtgaaacaacattacggaatgaacactaatctcctgaatactatagtggactattggaagaacaaatatgactggagacaaagggaaaagtttttcaaccagtatccacagtttactaccaatatccaaggacttaacatccatttccttcatgtcaagcctactgagaccaaaggactgaaggttttcccgatgttgatgttgcacggatggccaggctctgttagagaattttatgaaatgatcccacttttgaccaaaccgcagaagggaagagattttgtatttgaactgattattccaagtttgccaggttatggattttctgaaggtgctgaagtatctggacttggtgcaccccacgtagccgtcattatgaagaaccttatgacccgattgggattccagaagtactaccttcagggaggtgattggggtggcataatagtagccaacttagcatcattattcccagaaaaagtgctgggagtccattccaatatgtgctttgccaatagtcctctttctcatctaaaattagcatttgngtagtttaatgccatctttgattgttgaagccgacaagcaacatctcgtttatcccagaaatgaaatttttggattcttctactgnaaaagtggtatatgcatcttcaggcgac

SEQ ID NO: 2904 - DNA, 1073 bp, Diabrotica virgifera
cgcgggtcaacacacgcgtctacagacacgtgcagtattctcgcttgtttgtttgttgtgtgtgagaagtgagcgaagaaacatggggtgttgcgctaaagttggggctcttgtggcagtccttttagctattttaattgtatattgttcacaatcgttgtttgaaactccagaaagaccagatttgggcgaaaaatggtggaaagtggtaaagccggcaaaagtagatactagtgtcaagccgttcaaaattcaaatttcagatgaaattttaaaagacttgaaagacagactggatcgtactcttccattccaaccaccactagatggcgtgaaacaacattatggaatgaacactaatcttctgaaaactatagtggactattggaagaacaaatacgattggagacaacgggagaagtttttcaaccagtatccacagttcactaccaatatccaaggacttaacatccatttccttcatgtcaaacctgctgagaccaaaggactgaaggttttcccgatgctgatgttgcacggatggccaggatcgattagagagttctatgaaattatcccaattttgaccaaaccgcagaagggaagagattttgtatttgaattgattattccaagtttaccaggttatggattttctgaagctgccgaagtaactggactcaatccagcccaaatatccgtcattatgaagaacctgatggctcgattgggattccagaagtactaccttcagggaggtgattggggttccgcaatagtagccaacttagcatcattattcccagaaaaagtgctgggagtccattccaatatgtgtatggtcaatagtatgctttctaatctaaaattagcattgggtagttttatgccatccttgattgttgatgctgacaagcaacatctcctttatcccagaatgaaacattttggattccttatattggaaagtggttatatgcatcttcagggtagtaaaccagataccgttggtgtcgctctacgtgatagccctgtaggtcttgcagcttacatcatagagaagtttcacacat

SEQ ID NO: 2905 - DNA, 683 bp, Diabrotica virgifera
ctcgcaggtcgatacaaccggacacgttgagctgtttttgtgttgattgagtgctttatttgcaagtttcagaagttgtctttagaagctaattaccacaatgaattttgaagaaatggcagtcattgaagaacacagtgtttgcgaagggcctgcccgtaaggaatcagggaagcggggacgaaagccaggcaggaaatcggctgaaaaagtggacatgaaagccaaattggaacgtagtagacaaagtgctagagaatgccgagctcgtaagaagttgcgctatcaatatttagaggaacttgtagccgatagagagaaggcagttatcgcactaagaaaagaatatgagcagtacattttttgggcaaaggaaattgatgccggcagaattccagaaggtattcacgaagcacttgaggaactcagcttaaatcaagaacaaaagtgaagtgaatatcggattgtgataattgggaaactttttagtttggaaagcgttttctttattggaaagccatgtataagttttgtatttattgtttttattggattacgtgaaaaatatattttacttgtatttttaaaaaaaaaaaaaacagggcgaaggtcgcccataccagtgtcccacgatattttcccccaaactggcggatgaatattcagaaatcacctctctgtcc

SEQ ID NO: 2906 - DNA, 1332 bp, Diabrotica virgifera
aagcaatatggctaatcaaaacacccccgaatatttagagaaaattaaaacaagactttttgaaaatttgagaatgttacctcatgcccctggtgtacaagtacaggctattccagaagatgcaattaacgaagaatctgacaatgaggataaagttgataaagatgaacggttgccacagaaagatttagataaaagaattgttcctgaaaacgaattttctgacagtgaagatgagggagaaggagatagacgagacaatagaagttacaaaggtagaaaacgtccacggttagataaaggaggagaaaacaaagaagaggataagattaaagatgaaatgaaagcagaaaaaggtgaagaaggaattatgaagtccagtcctgatgacacaaaaaagcttttgggaccaactccatgacatcgtactaatttaatcatataattccagtacattattggagtttaaaacatttttatagtaacttctaactgtgtacagtttgtatttgatgtttatacagtatgtgacttttgtatatacttttcttagtgacaaacaatatttttttaagtagacatcaatagttcattacaatgtttgctgtcgcgccattttaaaagattaagtctgtttacaaggtttgtttgttgggcatgtctgtcacagatctacatgtgcacattgttttccgagttaaagagtatgaaaatgtaaaagataacaacattttgaaacgaattcctgatatgctcaagaagcataacagtggaatatgggaatggcagctccagttggactactctcaaagatataacgaacagttgcctgaggattggctgaaaattccccctcatttccaagcaagaagtcaaccttggaagaactgactgccaaataaggaaagagcaaacgtctatttttagcgaacgataacgacattttgaaacgaattcctgatatgctcaagaatgctcaatgtattcttttttgtactttttgataaatataaactgaatttttcctctgacatgtatattgtctaaataaaagcgtagagtgaaaaatgctttacatttttagtaattttatttttgttattctattagttttttaagagtttagagttttagagtaactactttaagagtttggctatgtcaagtgatttgctgtagttgacttcgttgttggtaaattttgaacattttcctatgggatatgtctggcatttgttttcatgcactaaatcagttttcttcttttcagttctgggtaataaattatcatacgcttttttccaatgtatgtcaatcaactttcctgacaaa

SEQ ID NO: 2907 - DNA, 926 bp, Diabrotica virgifera
  misc_feature (896)..(896): n is a, c, g, or t
atgtgcttttgttagtatggaagtgaatggtagttttagtttattgtgcttatggtttagttttataggattagtctccgcaacattagaaattaatagtatcgatacaaattccattatcagaaaaacacggcaaagcagcttgaagtgcactctgccaccacagatagaaaatggaaaatggttaataactgaagcagatgttcagccaggtgatcaaatagaagttaacacaatagtaagattagaatgtaatgaaggatatcagttgtacccttacaacacactcatggcttgtgatagcaattgggatgaagaagattttccagtgtgtagaaaaaaatgtccttcgttttattcaacggcaactacaaagctgatatgcaaagataaagatgaaaacactatcacttgcgacaaagcgactgacgggacgtacttaacctatagttgcgtcgctttctatgaagtcccgccaggtgggaaaaacgttctttattgtaacgatggcatttgggattttcccaaacctctgtgtaaaccaatttgtggaaagaaagttactacggatacaacagaacttacttggggtggcactgatgttaaaggatatgaatatccatgggtgattgcgatgtttaagaaattagcaggaaaatacgaaaatgtctgtggcggaacgttggtcagccgtagagttgttgtaaccgctgcgcattgtgttactgataattatggcaatgctcttggtagagaaaactttcaggtggcagctggaaaactttacaacgccttcggagacccacgagataaacatgctcaatatagaaagatatcacaggtcgttgtgcatccaggatatagaggagtcagtcagcgatatgttgctgacttgnctttacttattacacaagaactattcaaac

SEQ ID NO: 2908 - DNA, 628 bp, Diabrotica virgifera
ctgtttacattaattcttctagtgaaaatgttattttaatctatgtacaaaacaaaactacaaataaacgcaactaaaattatctaaaacacattaagaactgattgaataacatttatgtttgtctcccggctgccataatatagcagccgggattgatttaattttgacagcatgttggaatgccctatccctatattatattgtagataatcgcttatcggctaatatttgcttaaacaggtctaggaaggatgtggatatattcttgaaataacgaagtgacataatagttaaagttggatttgaaacgcatacgaaaatattgttttcctgattaaagatatacctaatacaggaacaactaacggtagcttgtatgttagtggatataagcctgaatcccgcgtaccagagagggtttgttaatagcgaactgaaaatttgttgaaagctgaacggtgtctggtcggacaagctttgatgtatggaaatactggaacggggcaagttttaattgtggaaagttgattttaatgatagaacttgtcattctgataagtttattattgtgaaaattagaacgtttgtttttaaggttatttcaatacaaacttgtatatccatg

SEQ ID NO: 2909 - DNA, 1364 bp, Diabrotica virgifera
attactacaggttcggctgtatctcgcaatatgtgaacaagttcagtcaaactttcgatgaaaggcaccaatcatacgggtttcacgaaccgtcagaaacaagccggcttaaatcaaggaaacggtttatgagaaacatctgtgtcgaaccacccgaactgttccccctacacccataaccatctaatgggatgaacctggactggagaacctggtggacactcaaccgcataagcaccggcgttgctcctgtaaaagagaacctcattaaatggggtataaagacaaataacgacacactttgttaatgtgcggaaatacagaatgtggagcacctgagattatgcagattttgcccatcacagtgcaccctcgataagctgtagtcggatcctcctcctcctcagtcgtttcctcattgctgagtgtcgtgattccctataatactagcaaccatctctttccatcggcttctgtcctgagcttccctcatggattcagagaatgtttttccactggctttctgtacttgatccgtccatcgagtaggtgagtgacgcgcccttcaacgtttcccgaaattataagtctctcaagattattatcacttcttcttgcaatatggccgaaaaattttaagacgatggagaggcaaatagaggaaagtcgagtctgaatattaagctcttggaggattgagtggtttgttctgtgttccgtccatgagatccgaattattcttctccagcagcacatttcaaaggcgtcaatcgtttttctgtcgtccgatttcattgttcatatttcgaatctgtaattaaatatgggaaaaattaaggctcgtactaatcttattttggtgttcttcgacaagaagtgatctttccagattttcgacaatcgactcatagcgtttttggccatgcctattctcctacgtatttctgtttcacaagatcctgtattactgatgtaggataagacaaattggtaaaaatttggtttatttaatttttgtaaaattaggaaaagtgttgttgattcaaggagtttaagacaatacaactttgaggaaaacttagtaagtttctaaatacttctgaacacggtaccttctgaatacttaaaaaatcatcttgtttgcatttggctacaaccctagatatgcacaactaaagtcctgcgcccacgacggaagtgttttaaaactacggtctgaaaccgattgcactcgcaactggttttcaactagttttcaaccgttatttgaaagcagttgcgtcgtgggggctggacctaactgcgcattatttttactatcccagtctgcacgtatatttttattttgtaattaagcttgtgta

SEQ ID NO: 2910 - DNA, 810 bp, Diabrotica virgifera
acccacgcgtccgcccacgcgtccgtttattaccactaatttgttgtccgtgcgttgtccctatatgttttaaaatgcaaaaaattgctttttttatttttatgggttttatgcatcatgcttacataatggcgccatggtactctaaagatacggttgaatgtgtaacgccaaagattaagactgtaataaaagagcaaatagaatgtgaccaaaactacactccaccatttgatacgatgaagattacacatagaaaaaaccaaataagacccttctattttgttaccgatcgttgttcttttagacctggaatagatgtctgccttgaaaggtcaatgaatcttgtttcagattgtttcaattccagcaatttggagggattggcaacttggaaaaagatagataacgaagtaaccgagtatgtctgtaaaaataattcagaagtaggatatgacctctttgaaaattcaactgctaagtgctatatagaacaaataacgtacgcattggatcgttgtgtgcctcttctaaagctaaatactactatatacgatatacagggccttactcaaagttgcaagaattctgaagagttttccacctgtttcataaaggacttgagaaaagcatgttctgaaaaagtaattgaaatggcatccaccttaatcaagatcgtggagtcacatttatgtcctaagaaagatgacaaattggtttaaaggagcgggttgcgaatttgggttttattagataatgtagtagaattgttgcgaatacttgaataaaatatatcgatatttaagaaaa

SEQ ID NO: 2911 - DNA, 2972 bp, Diabrotica virgifera
ggctccttgtcaatctcacgagaaacaaacgaaaaccgagcgcatcatcagcttatcaaacaattgaagttaactcctaattcatacaacctcgtcttaagtacacacacataccagcgcgctgtattaaaaatcatgtgacagacggcaactatatcgctcattacaacagctgccttcaaaggtgtggtgatttaaaaaaacagtgctccaattttttagtgttaaggactgtcaaataaaacctcctcaagatggggagtatgtttagaagtgaggaaatggtcctcgcccaactgttcgtccaaccagaggcttcgtactacgctatttccgaattgggtgaaactggatgtgtacagtttagagatttaaatgaagaagtgaacgctttccaaagaaagttcgtcaacgaagtgagaagatgcgatgaaatggaaagaaagttaagatacattgaagcagaagtgagaaaagatgacgtcaatattcccgatgtcagcgaattaccaaaagcacccaatccccgtgaaattatagacttagaggctcaccttgaaaagaccgaaggtgatatcaaagagctctcagaaagtgcagttaacctcaagtccaactacctagaactaaccgagctcaaacacgttctggagaaaacacaagcgttcttcaacgagcaagacgaagcaaacggactctcggactcagtccacaaatcacttatacctgctgaagatcacaatgcttccattagaggccgtctaggtttcgtagctggagtaatcaatagagaaagagttcctgcttttgagagaatgttgtggcgtatttccagaggaaatgttttcctgaggcaagccgaaattgagacacctatggaagatcccgcaacggggattgcatacaacaagaccgtcttcgcagccttctttcaaggagaacagttaaaaacaagaataaagaaagtatgtgctggcttccatgcttctctctatccttgtccaaacacgatcactgaaagaaacgatatgcttaaaggtgttcgcactcgtcttgaggatcttaacctggtgttaaatcaaacaagagatcatcgtcaacgagtactggtcagcgttgccaaagaattacagaactggagtataatggtaagcaaaatgaaggctatataccacactttgaacttcttcaacatggatgtcaccaagaaatgtttaataggcgaatgttgggtaccaagcaacgatattcctgttgtccagaaggctttagccgatggatctagtgcttccggaagctcaatcccatcgtttctcaatgttatcaacactcacgaagcacccccaactttcaacagaactaacaaatttaccagaggcttccaaaacttgatagatgcctatggtgtggcctcctacagagaagtcaatccagccttatacacaattatcactttccctttcttattcgccgtgatgtttggagattgcggccacgccatgatcatgtttctatttggcttgtacttggtgttatcagaaaagaagatcaacgctatgaaaaataaaagcgaaatatttgtgatatttttcggaggaagatacatcatactgctcatgggtatattctccttctacacaggctttgtttataatgatatattttccaaatcgatgaatatatttggttcgaggtggtatgtgaatattaccaatgcaagcactcaaatacacgaagaaatggacttgttacctaagatgaactatatgggcacgccatattatattgggcttgatcccgtttggcagtcggcaaaaaataaaatcatcttcttgaattccttaaaaatgaaaatgtccatcatcttgggaatagtgcacatgttgttcggagtaatctgcagcacattcaactttgtacattttaaaaaatactacagcatcgtgtttgagttcttacctcaagtactgttgttattattcctcttcatgtacatggttataatgatgttcatgaaatgggtattgtattccggagaaaacgatggatgggataagaatgtaaccgctaaggacggttcatcgtgtgccccgtctgtactgatttacttcatcaacatgatgttgatgtcgccaagcactgctaataagggctgcgatatatacatgtacgattaccaacgtgaaattcaaatgggtttagttttttgtgcattgatttgcatccccttcatgttgctcggaaaaccattatatataatgcgtcaacgtaagaaccaagcgaaaaatggaagcgtacaactggtcagtaataataaaacaaacggtgacgtaaaccttggaatggaactggaagagatcgaaaacaaccttcaagatgtggccgaggtggctgctcaagctcatcatgaaaaagaagaagaggaggaacctatgagtgaaattttcattcactcagctatccatactattgaatacacacttagtacaatttctcataccgcttcgtatttgcgtttgtgggcgttgtcccttgcacatgcgcaattatcggaagtattatggactatgttattctcaaagatagctttgagaagagaaggattcataggagtgccgatgatcttcattctattttccgcatgggccttcttcactgtcgccatcttggtactcatggaaggtttatcggccttcttgcatacactccgtttgcattgggtagagttcatgagcaagttctactcaggcgtggggtacatttttgaaccattcagttttaagaggatactggaacaagaggcaggagaagaggattgaagcgatagctagtgttttgttttagacaagtttaaataaaaaatataatgtagcgttataaataaaactaatttttgattttcgttgttcaataataaaaaaaaaacaatctagtttttaatttgtttccaaattaaatactttttattcccc

SEQ ID NO: 2912 - DNA, 910 bp, Diabrotica virgifera
  misc_feature (832)..(832): n is a, c, g, or t
  misc_feature (866)..(866): n is a, c, g, or t
tgcacttctctaggcaaacctgaggctgtcaaacctgagactgcttggtgacaggttaggttaggttatgtaatgtaacctaactgcttggtgtcaggtaacctgagaccgtttggtgtcaggtttgtcgcttatcattgttgtattttatgttcgtggtgaagtgcttgaaatatttgaaatattagcaacgttcactgatttttttgaattttcagaaaaaggtttctactgtaccttgacgccatttttgttatgagatataaacaaaaattttaaattactgatcaaaattgtttatcaggtataaggtatgagtagattgatctttgaataaatcgtctcacttctcatctttcttactaaacctataactcggtcctgtataatatgtttgcatacagtattattagtacagtaagtacttaattatgctgtcaaatgtgtcaaggtcagtcaagttatattgaaaggtgacatggagccaacgaagaaaacacgaaaatggcaggtcagacaaaaatcaaatactataatagggctatttatctccgccatttttctcgtacacttgacacttgacatatgacgtttatatattgtccgtcatatgtcaagaggacgagaaaaatggcgacgatgaataactaataaaaatgcatcaagattatgacacacgcctggaaaacctggaaaaaattatccgagataaacggatatagaaaacagaacagtaaatgaaagaatatttgaaccaatggaaataattaaaagcaagcagacgaaatcattgacagagaatgtaactgcatccagaggaaaacgtgatganacaatcaaaccccatcacaggagagaaccagaanagaggagtcatcagctgaaaggaggtgatttagatatcacttca

SEQ ID NO: 2913 - DNA, 1002 bp, Diabrotica virgifera
ccctccacgcgtccgctgtcaattcagattcagtcagttaatttagaactgaaaatttatattcgcagcgcgaaaaataagtaatttacaaagtagtcgtcaagtgaaaaatgtctctgataccgctaccatatttttttggcgatggaccctacagcagaccatcaaggctatttgatcaacattttggtcaagttttggaaccggaagatttgctacaacctatctcaagacagttcctcagatgtcctgccggctatctcagaaactggcagtctgcgtcgtctggaaatgattccggctctacaatagatttaggaaaagaccagttctcagccaacttggatgttcagcagtttaaacccgatgaaatatctgtgaaagttaccggagaccgggaggtgaccattgaaggaaaacatgaagaaaaggaggacgagcatgggcatgtctacagacacttcaagaggagatatgttttgcctaaaggttatgatatggacaagatagtgtcaaagctgtctacagatggtgtcctttccatccatgctcctaagatagctgctggagaaatcgaacacaagaaaattgccattgaacacacaggcaaacctgctaaatccctagagggagcaaaaggagctggtgagaagtaaaattaaaatcttcgacataactatgtgtattcaaatattcggggactatatgttatttcattgctttgtagttcataatagttttgcatagattctatagacactatttagtgtaaattcatcttggtattaacagatcttttagtttgtattattttgagactgagttcatctaatgttaaaacttttctgtattttaatataaagtaatagcaatcgaaaaaaaaaaaaaaaaggaaaccgcacgaaggaaacaaaataaaaaaaaaaaaaaaaaaatgggggggccccctcaaaggaccaaagtttagttaccagggccttgaaaggggggggcccctccaaa

SEQ ID NO: 2914 - DNA, 890 bp, Diabrotica virgifera
accacgcgtccgcccacgcgtccgattttagtatatgtttaattaaatttttaaaaattaacttcacatattagtcaaaattgtaattattaactttagttaaattgaacttaataagttaaagttaagtaaagttaataagttcaagttaactttaaccttaatttattaaattcatatgaacttctggattctaatccctcagattagtttttggtttcacttgttattattactattataaaccacgagttaggaaaaggatctgtgtatccactcgtaggtttatttattcaataaggcttgtgcctgtcccactcacagtgaggtatttatatgttatatatagtatcaggtagtatttaattaaggtgtacgtattataaacgtacaattattatttggtgagggttctactaacctagttgtaagttgtacttcctgtattagaggtacccgtagtcagtttttctaaccttataaagagtattcttagatcatagttgtatgatgattttgtaattgactttcactagtatcactttttcctgtcatgttagagttacacactagttacttgtcctaactcagagattgttaaaaagatctagtagttacattcaataaatatacatttattgtgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggaaaaaaaaaaaagggggggggccccttaaagagatcaaattttaaaaaaggggggtggggaagcaaaaatttttttaaaggggccccaaaattcattttcgggggggggttttt

SEQ ID NO: 2915 - DNA, 1852 bp, Diabrotica virgifera
  misc_feature (1725)..(1725): n is a, c, g, or t
  misc_feature (1742)..(1743): n is a, c, g, or t
  misc_feature (1745)..(1745): n is a, c, g, or t
  misc_feature (1747)..(1748): n is a, c, g, or t
  misc_feature (1750)..(1756): n is a, c, g, or t
  misc_feature (1758)..(1758): n is a, c, g, or t
  misc_feature (1762)..(1762): n is a, c, g, or t
  misc_feature (1776)..(1782): n is a, c, g, or t
gacacgggcccgaatatccccggccgctctctacgatcaacgcatcgaagagagcgttctgtgttttctagtaatagttatttaatacattttataaatcaaaatgagggaaatcgttcacatccaagctggacaatgcggtaaccaaattggagccaaattctgggaaatcatctctgatgaacacggaatcgaccccaccggagcctaccatggagactctgacctccaacttgaaagaatcaatgtctactacaacgaggcctccggcggaaaatacgtaccccgcgccatcctcgtcgacttggaacccggtaccatggattcagtaaggtcgggtcccttcggacaaatcttcagaccagacaacttcgtgtttggacagtctggagctggaaacaactgggccaagggacattacacagaaggtgctgaattagttgattcagtattagatgttgtaaggaaagaagctgaatcatgtgattgtttacaaggattccaactcacacactcacttggaggtggtactggatcaggtatgggtaccctccttatctcaaaaatccgtgaagaatacccagacagaattatgaacacatactcagtagtcccctcacccaaagtatcagataccgtagtagaaccatacaatgccacactttcagtacatcaattggtagaaaacacagatgaaacatactgtattgataatgaagctctctatgacatttgcttcagaactttgaaactcacaacacccacatatggagacttaaaccatttggtatccctcacaatgtccggtgtaaccacctgtcttaggttcccaggtcagttgaatgctgatcttagaaaattggctgtcaacatggttcccttcccccgtctccacttcttcatgcccggattcgctccactcacctcaagaggcagccaacaatacagagcgttgacagttccagagctcacacagcaaatgtttgatgccaagaacatgatggcggcttgtgatcccagacacggaaggtaccttacagtagctgcagtattcagaggtaggatgtcaatgaaagaagttgacgaacagatgctcaacatccagaacaagaacagcagctacttcgtcgaatggatccccaacaacgttaaaacagccgtttgtgatatcccaccaagaggtctcaagatgtctgccactttcatcggcaactcaaccgccatccaagaattgttcaaacgtatctccgaacaatttacagctatgttcaggaggaaagctttcttgcattggtacaccggagaaggtatggatgaaatggaattcacggaagcagaatccaacatgaacgacttggtatcagaataccaacagtaccaagaagccacagctgacgaagatgccgaattcgacgaagaccaggaagccgaagtcgacgagaactaaatttcatacgttaattttggatctgaaatcaaagctttataacttttatatttgtctcctctccttttattttttatttaagcatgttttttgtacagtctctacattcccgtttgtaaatttcgaatacactacttaaattattccaagactgactttttgttgcttgtgtttctggaatttcaggaagtgtttagatatttaacatgttttgcgaactgtttttttatgaataggcattaaaactgctgccattacttatactcagaggcaagtgnaaaaaagaagaaatttnntntnncnnnnnnnanaaanaaaaaaaaaaaaannnnnnnaaaaaggggggggggggcgcccccccccccccccccctgggggggggtttaaaacccccccccggggggt

SEQ ID NO: 2916 - DNA, 1230 bp, Diabrotica virgifera
tgattcctttaaaaaaaaaacattttgtgttccctttttaaaataaaaataccccggatgttttttgggccaaatacaaaaggggggggggggttgttttaaaatttttttaaaatttggaaattaaattgtgtttttggttttttaatttttttaaaaaagtttaaaacatattaaataaaaattttccccaaattccttttggaaggaaaggaaaattcaatttttttttgaatgggccgtagggaaaacaaaaatttaaataggggattaaggttttttcttttgtacagttaagtatgataagggaagtggttaaggtgtttggccaatgagaccgggttagggaaacaattgtatttaggaaatttaaaaggaatgtaatctcctttaaaaccggatgggcatgtaattagtttagggaaattagaatggtaggaaaaagtgggttttggatctgacattgacaatttggaatttaattctttggaatcgttgtcagtggactttcataattttttacataatttaattttacggtagaataattttttcaacgttactgtttagtgctggcctttaaacgaatgtgattctagatgatagttgttaaatgatcgtcaagtcgaatagtggtgatctctgagagtctcctgaagtagtaaggcagataaatgaatagctgtgagtttgttgaaataagtgtcctgacggaggctcatcacgtaaagcattgtaagttatattgttctacttatattccaagagtcaccgttgcatgccggaacgagaaatagattcagtttattgagaggagaaaaggctagcatggttttttgaacgatacgtgcatctgaagggggtcattgatgacaataggcttgcaatagtttgttgcgagattgctgactacatagggggctgctaagagtaaattgtaggcgaccagagacaagaatttggacaactcatcatccgagagacagttttattttttttgtagaattattcataacgcaaatttcaataagtactttagatagtggtaggagtatttcaataatcagaataggagatattatttttagaggatattttgagggtgaatttatttcaatagatgtttttgtaccatatatgtgttttattccgttagtctttgaccttatttatcatatgtaaagcaaaggagatattgaagcacgagaatataaaaccctgagattagag

SEQ ID NO: 2917 - DNA, 920 bp, Diabrotica virgifera
aaggggatccgaatcccaccgacttcgtaatcttcacttcggtaggtcaaaaacgacatcactctcgactcaaaaaacgtttctttttaaaaagactctcacgaacttcacaggcgtcacatccgcaataaagaagaaatctagtcaataaaaaataacatcactttttaaaaatataattttaaacaaaatttaaataggtataaataatacaaagtttttcgatcaatatattcggctctctttcgcactcgttaaattagtaatttcgctcattcgagaaatcatctttttacgtcaaaataagacatctttttatcgacatagatatttgtcgcaataatctaatattaagtaactcaattttcgggatggtgaagggtctggtgaagggagctttgtacatctgtgatatacagggtaactcaaaaatcggagtgagggaagcagtgcaatagataaaagtaatagaaattgtctagacagccagagactttgtgcattaggtgttttttttaataattatattgttacaataatatgaaattttttaaaattttactaataaaactttaaaatatatttatattcacattcgtacccaggtaaccaaataacatttacaaaacgttgaaaagacgtcataattatcaccaaaccacttcagtttatcacgttttttcgacgtcgaaagtcacgtgaatatctcccaccataactgacgtcatttttatcacgttttaaatacgtgatatcaaaaacgtagttttatgtcgtttttttagattatttttcattttatggttttaaaactacacaataataattattcgtatgggcattattgttatttgcatttttcatttaactattttaaatttagcttataaggcttaaagtaaaaccaaatggaaaaactt

SEQ ID NO: 2918 - DNA, 1171 bp, Diabrotica virgifera
cagtagcaaagatcaaataaataataattattaattttgtgttatcagcattagagaaactatacagtttagttcttagaagaacaccaatgcagttagtttaagttgacataattatggggtcctttactattgtgttattgttttgttttattgcctcatcagtgaatggcaaagatcaaactccaacttggaagcaaacctacagcgtcacaggactcttatccattccatatgctgagattcaagaaccattctctgcttggtatgatgaaccatcaaaacgatcgcgaatcgattattatggagatatggtcaagacatatcaactgggcacaccaggttatggtgtaagtttaaaagttactccagttacaacagaaactgaagaaaatgttagaagttgccttatggttaatggcacggaagaaattagcattactccgcaagccattttgcccgatttgactggatttaaatctgatggaaaagaagtagtaaatggatttgaaactgaaaaatggaccttagttaatatagttggacacaaagtaaatagatattccatgtggatcaaagatggaggaataccagtgagatatgaaatgaaaggatttaattctttattgggtagccactacgatcactattatctggactattatacttacgacccaagtcccatttcagatgatacatttagagttcctgccgatctagaatgcagcgccttccctgggcctggagacaaacatatttatacttttaacccaatggctgagtttatcagaccagaaaagaccggccatcttgatttcgaatttaataagtttgttaataagcatagaaggcagtacgctgataaaaacgaacatgaaaaccgcaaatacatattcagccaaaatatcagatttatacacgccgtaaatcgacaaaacaaaggttatactttaactgttaaccacttagctgataaaaccgacttggaactaaaagcactgcgtggaaagaaatataccggtgtatacaatggtggagcgccattcccctacaagaaaaacgaaatggacaatcttccagactcgtatgattggagaatatttggtgcagtttcaccagtaaaagatcaatctgtctgtggatcgggttggtcttttggtacagttggagc

SEQ ID NO: 2919 - DNA, 1174 bp, Diabrotica virgifera
gtagtttacgtttaacaaaaggtaaagtaaacaacaaaatgggcaaaatggctaacaataggaaaactccagtaatggcacttcaggaactagcagtaaaaaaaggttttccggttcctcaatacgaaatagttgatagtattttaggtactcataacgatcgatttgattgtcgagtaaaagcatgtggaatggaagcagagggaaccggcacttcgaaacaaatcagcaaacacgaggctgcatataaactcttaaaattactcgaagagggtggtatttatgacccaaaggaactaccggttcaagaatttcaagtcgaagttgctggtttagaaaatggtagttcggtagaggcacctgttaactggataggtccattgatcgaaatgtgtgctaaaactaaaattgaagatcctatgttcaaagaaatatcagctgttggattatcacattctagggaatttacctatgaatgtcgcattggttctttgaaaacacttgctgttggcagaacaataaagatggctaaacacttagctgcaaaagaaatgttagaaaagttaaaagataacgatattctatcgattttaatattagaaaaccctaagaaggatcaccaacaacgctacaataagttaatgacatcagttgtacgtaataaaatggccaaattgaaggattttataacagtttttcatgacctgatggaaaaatatgagaaaaacagtgacgttttcattaatgatttgcgtgaacgtacagaagaatctcttgttagaattttaaagcagcttaagctaaaacatgacattttggtcgtaaaagacgaatctccagttattatagttttacatgtcaattgcaatgtaccctatgctgtaatgggtatgggtgccacagtagaacaagcaaaagaggaggcactagacgagacattcttgctgctggatggcttgattcagaatagtattcagagggtttaaaaatcagaatagttaagtttaatggactgtttatgggaatggaaattttttgttaaatttaaaaatttgtttttttattttttttaaaaattttaaacagggagggacaaataaaaagatttattttatttttttaaaaaataaaaaaaaaagggaaaaaaaaggggggggcctaaaacttataatat

SEQ ID NO: 2920 - DNA, 839 bp, Diabrotica virgifera
cccacgcgtccgaagttggaaaattttcaacaccagtgaattcaaaatatctaacaaaaatgtctctggaacgtcaagtccgtaacaaactcgccgctaaacgcgatccccaacaagacaaagaagctcaagcatggatcgagactatccttggcgccaaattccctccaggtgaagcctacgaagatgttattcgtgacggaactgtcctctgccaactcatcaacaaattggctccaggatcagtcgccaaaatcaacacatctggtggacaattcaaaatgatggaaaacatcaacaacttccaagccgcaatcaaagcatacggtgtagctgacattgatgttttccaaaccgtcgacctctgggaaaagaaagacatcgcccaagtaaccaataccctctttgctattggcagacagacctacaagcaccctgaatggaaaggaccttaccttggacccaaacccgctgacgaaaacaagagagaattcactgaagaacaacttaaagctggtgagactatgattgggctccaagctggtcaaaacaaaggagcttcccaagccggacagaacatgggtgctggtcgcaaaattatccttggaaagtaatttatttatttttttaacttttacactattttttaatttgtatacgtaacttttattttttaatttattataacaataaagtttatttttaacagttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggg

SEQ ID NO: 2921 - DNA, 1195 bp, Diabrotica virgifera
gattggaagcatattggaagttagaaggaagaaaagcagtgtgaaaaattcataaaaatttagataatttaagcttttattaatcaaaaatgaattcactcatgaattatggtaatggtagtgatgatgatctggatgatgttgccgatgaagcctctgtggatccctacggtggcagcgccagaaacttcaggaagcccacaagtgcccagcaaaccgatgataccaactatgacgaagtccagatgagctgcagcgaggactctgatgctgaaatgagatcgtcgtccaagtatagagaccgagatagggacgataaacgctccagtcccagaggaagcagagactcgagagataaagataggagagatgataggtcagaaagggatagatacagcggaagagataggaacgacgatcgatccagcaggtacagagatgacgatagatcgagatatcgtgatgacaaagatgatgatagatcgagacatcgtgatgacaaagatgatgatagatcgagacatcgcgatgacaaagatgttgatagatcgagacatcgcgatgacaaagatgatgataaatcgagacatcgtgatgacaaagacgacgatagatcgagacatcgtgatgacaaggatgatagaagaagtaaagatgacgatagagggagagatagatctagaagtcgagatgatgacagatcgagagataggagggatgatcgaagagatagacatagtcgagatgatagatacagatcagacagagatagaagaagaagcaggtctagagatagagatagaaggcgtagcagatctccgagacgttcaagatcgagagaaagacctggcagaggaggtttccaaaggagatttgatagaggaggcagaataaacaaaccaggatttgatccgaaaaccgctactcaaactcctcaagaaggcgacagtacccaaaacaaagatagatttttcatgcctggtattaccgggcgttttagagaccagatcgaaaaacgtaaaatgttatggcaaaagaaagatccggaaccagaacaggctggacccgcagtgcctatccacaatccaaagctccaagcgaacgccccaaggtctactaagttgtgggaggcgaccacttttgcacaggacacagacgggaaagtagccaataaatttaagagattgatgggcat

SEQ ID NO: 2922 - DNA, 2122 bp, Diabrotica virgifera
acggtattttccaaaattcgagaaaagtttatttagtgttattataataagggaaaacagtaaaaatgagtagatttttcgctggatccgattcagattcggatagctcatccgaagaagagattatccaacgtccccaagtaccagcttatactttcagtgacgatgaggaggaggtaaaacgtgtagtaagatcagcgaaagaaaagcgctatgaagaacttacaaatactattaaacaaatcagaaattttaagaaaattaaggatatgtctagcatgttgaatagttttgaggaattacaaaaggcataccaaaaagctgctcctgttattgtcaaagaagaaaatggccagactccaagattttttattaggtgtttggccgaaatggaagactttattaatgaaatgtgggaagatagagatgggaggaaaaacatgagcaaaaacaatagcaaatcactcacatctatgagacagaagttgagaaaatatttgaaagattttgaagatgacttggctaaatttaaggaaaacccagaacagcctgatgatgaggaagaggaggaaaagcctgaagtagctgaggattccgagaacgaagctccatccaaaaacgcgtttctcaaagctccacccaaacaagttgtagacgacaaagatgaatcgtcagactcggatgactggccatctgactctgaatctagtctgtcatcatctgatgacgacgaaggcaaataccagagcataagggagcgtttcttgaagagaactgggcccgctcacgaagaagatgaagaaagggaaaggagaaaggaggagaaaaggaaggagagaaaggagaaaggtaggaagttgaaaaaggatgaggaggaggatggtgaaggcaagtgggagactgttaatcgaggtttcgccatccctagtgaaaaacctaaaatgttcgccaaggacgccgaaatcgatctaaaccttgtaatcaagaaactcagcgaaatcatggcagctagaggcaaaaagcgcacagatagacgcgaacaaatagaactcctgcacgaactccaaaatgtttctgagcaacaccaattgggagcggctattttcattaaaattaaactcgccatcatatctgccattttcgattacaaccccaaagtttctgacgcaatgaagccggagtattggctgaaattgttggagaggatgagcgaaatgttgggcatgttgttgaatactaccaatctagtagtttctgatggaattactgaagaaatggaaaatcttgaagaacccccgtatcgcattaggggctgtatactaacatcagtggaaagactggatgacgagtttactaaactactcaaagagtgtgatcctcacagtaacgagtatgtagaacggttaaaggatgaatgtaaggtttctagtatcatcgataaaacaatgaaatacttggaaaggagtaacgtatcttccgaactatgtaggatatatttacgaaaaatcgagcatttgtattacaaattcgatcctagagtattacagcaaaaagctgatcctctcgtagtacccaaagacgagatgaactccgtgcaagaaatggagaaactatgcaaatttatctacgcaaaagatagtactgacagattgagaactagagctattttgtcccatatatatcatcacgctctgcatgacaactggttccaagcaagggatttggtattgatgtcacatctacaagaaacgattcagcattctgatcccagcacacaaattttgtataaccggacaatggcgcatttgggattgtgtgcatttagacacgctaacattaaggatgcccataactgtttagttgatttgatgatgactggaaaaccaaaggagttactggcacaaggtttgcttccacaaagacaacacgaacgcagcaaagaacaggagaaaatcgagaaacagcgtcaaatgcccttccacatgcacatcaatctcgaactctagaatgtgtgtatttagtctccgccatgttgatcgaatcccgtatatggctgcgcatgaattcgacgcagacgcaggatgatttctaagacttctatcaagcagtgcgttcttccgac

SEQ ID NO: 2923 - DNA, 992 bp, Diabrotica virgifera
ccctcccccaaagccctattgtggcaatgtgacagaggtaatgtgtaacgtgttacttttttaagtttgatttacatattgtactaattttaaagttctaaaatacaaagaatggcagaaaaaactataaaagacaaaacaataacatcattatatgcagagttaaataaatttaatcaaaatggggaatacgaaaggtctttgaaaacatcaaataaaattctgggtgtggctccacatgaatttttagctttccagtgtaaaatggtgtgtcttattcacctatcacgttttgaggaagccatttctttgatgaacaaaaatccacaatttttacaggaagtaatatttgaaaaagcttatagttactatcgtgttaataaaccagaagaagctttaaaaacaattgaattaagtgagaatgaactggatttccgttgcaaggaattgaaagctcagattttgtacagacttgaacaatatgataattctgtctctatatacagagacatcattaaaaatatgcatgatgatgattatgatgatgaacggtacaccaatttgagtgctgcaatggttcatctgaagaatgaaaatgcgatggatacaattaacgaatttgttgagaacacttatgaacagtgttataacaaagcatgtttattaattgaatatgaaaactatttagaggctgaaaagaaactcaagcagtgtgaaaagatgtgtagagagatgttggaggaagatgaaactaccgaagaggaaattgacattgaattggcgcttatcagaatacagttagcctatgtttaccaaaaaccaggaagaactaaggaaagccaactgctttatactggaaatttaaaattaaaacttgatgatattgcattaatggctgtagctagtaataatattgcttgtatcaacaaagaacaaaaattattttgatttcaaaaaagaaaaatgaaagtggctcctcaatgatggattgg

SEQ ID NO: 2924 - DNA, 1047 bp, Diabrotica virgifera
cccttcagtccggtcatgactattcatgacatcattactcataaatacatcgataatttttccagaatttttacaataaataaaaaattaactagtgattttgtgcggcaataaaaaaatatcgccaaaatgtcgttaaatacggcacatttaaacggaggagtgctaatccataatggagaacagattttattatattcagacggtgtaggcatagaatggagtggtcaacaaggaaatgccttctatggagtcaagaagggctctatttatctaacaacacacagagtcattttccttaacaaatctagtgcggatgagatgctcagtttcagctttccctttgtaacactcagtgaggtcgagatagaacaaccagtttttggagccaattacataaagggaaaggttcgagcgcagccaaatggcaattggatcggtgaggccaagtttaagatgaccttcaagcatggaggggccattgagtttggacaggctctgcttagggcagcacattttgcctccagaggtggtggttacgatgcccctcctccatatgttcctcctcagacccagtggtatgcagctccacctccatcctacgctgctgcatcacaaggctattatggttggatgcctcccaccaatgtattcccacaacatccacctactgatggtgtcttcatgactgatgctcccccaccatacccgggaatagtacccggctaccaacccaatggctatggacctccacaaggcccccctggttattcccaaggaccaccaatgtatcctggaccagctagttatggcggtcagagttctgctggggcagctggttttcacaaccaccacaatttgctagtgccgcagatgccaaagctcatgaagctgctcaatcggcctacaataatcaaaatagtagaccaccacaggggtatgctcctcctcccccaccctatttttgaaatccacccacctacagccaagctaccctacagaaggatcagtaagcacttgcaggcgtactggaagtgagcacagaat

SEQ ID NO: 2925 - DNA, 915 bp, Diabrotica virgifera
  misc_feature (831)..(831): n is a, c, g, or t
ctgaactaactaactacaaacatcagtccgtcattatgtggtttcaagaagttgacggctagaacccatttaaaaagtgatttattgacataaggtctgataaggtaatttcccatacattaactgaacaggccattaacatctggtgttttaaaagctgaaaagtcattttacctgaatacacactgatatatttcgtttcttaacttaacaggcccttctatgcatatggtttgtatattaaatgtgaattataaatgggacgtattatttcattttgaaaaagttattaaaaattaaaattagcaaaatagtaattgtagcgtgtcgccacaccttgtaacatctcatacccttccttgtaatgatttgtatattcattttattccgaagacaaattatctaccctgtatacgagttgaaatttttggactactttctagatatacatattttttattttgcagtattttttacttttgtacattcgatcttttatcgtaacttaatcattgttataattaggcattggctctggaagttatatttatattctacaacaaaaatttgtgtacttgactactctctggacattacaaaaattttggagagtgtgttttaaatattcatatttttaccattggctaatcatttcatttgactcattgccacatacaaagtcatgtaaagtaaaatatatacatattttgtgaaaataaaacggaagcataaaactttttgtttatgtttccttagtataaaaacttttttttatttttatattatgatatgccaaccacagtgaattttcctgcagggattcttatatantttttattgatgctgtcattatattttataatatcgtaattatcaaccagtactggccaagttctattttcatttaacttttac

SEQ ID NO: 2926 - DNA, 1323 bp, Diabrotica virgifera
  misc_feature (774)..(774): n is a, c, g, or t
aaagacttaagattaaaattaggttaaatatttcaacaacattaaaaaataacagaaatgaaaataaataaacgtggacatgtttaaatgatacagtgaagaataatatatagttttagttaatctatttataattttgagtcagaggaaatagaaacaaaaaagttttatttaattttgcattttcaacttactatggaagcaatatttcacgaaaagcaagagggttctctatgtgctcaacactgcttgaattcattattacaaggatcatattttacagctgtagatctaagtactttagccgaaaagttagatgatgaggaaagacaacggatggcagaatgtggcgaagaaagcgaagaatatcacaaatttcttcagcagccttcaggaaacatggatgatagtggatacttttctgtacaagtaattagtagtgcccttcaagtatggaatttagaattagtgccttactctagtacagaccaaagactcaatagtgatccaagcaaaatgacagctttcatatgtaacttcagagatcattggtttactatacgaaaaattagtaattattggtttaatcttaactctcttctctccagaccagaaccgatttctgatacttatcttgctttgtttctagcccaattaaagaatgatagttattctatatttgctgtacttggagaactgccacaatgcactgccgaagaagcattaaaaaataaatcacttgtaaatgatcctccaccaagacctccgttaagnatatttcttcagttgaaagtgatcccgacctgagagcagcgctggaattaagcattgctgatgaaatgaattttatttcccagtctcaagaatctgaggataatgacctgccagaagctttaaaggtaagtaatgcaagggttttccgacaacttcccgaagaggacgatgaagaaacgctactaagaaaagcatttaatatgaagttacagggtttagttttgggttattttattggggacgatatggttttgaaaaaaaaaaaaaaaaaaaatttttgttggaaaaggtaactttggaatcctttaaatttatttttttttcccttccccaaacacaacataacaacaaaaaagaaaaaaaaaaaaagaaaaaaaaaaaaaaaaaaaaaaaaaaaaaaaaaaaaaaaaaaaaaaaaaattaaaaaaaaaaaaaaaaaaggggggggggggggcgcctagggaaggagaaaaaaagaatttttaacaatacagggggggggcggggggggggggcggcgggatgatgttttctttttttttttttttt

SEQ ID NO: 2927 - DNA, 1065 bp, Diabrotica virgifera
  misc_feature (852)..(852): n is a, c, g, or t
  misc_feature (883)..(883): n is a, c, g, or t
  misc_feature (905)..(905): n is a, c, g, or t
  misc_feature (915)..(915): n is a, c, g, or t
  misc_feature (951)..(951): n is a, c, g, or t
  misc_feature (956)..(957): n is a, c, g, or t
  misc_feature (960)..(961): n is a, c, g, or t
caagcctctagagtgagtcgttgtaagcgtgaaaaatccaatttttgcgcgcacacaagttgtttttttggttatctgtgaatgtccccactgacacagtttttcatgaacacgggcacaaattctactatatcctaaagaagccatcgttaagactgctgcgagaccgcaatcaccgactaagaagcgtggcggagcacctcacaagcgcctttccacgaacaaacacgacgtcgccgtagtcccactacctcgagcgccttttaccattaccataccaatcacgatttctacgttttctaacctgcaagataatgtctgctactattttgacgcgaattaatttagcagttcaaaatttgaagcatcatgtacttaatacttttggaagaggttttccaccagatgcactttgcctagcaggaatagaattaaacaaaagtcctcagaatttgcccaaattttctattaaagatataataggcgagggatttttatgggcagttcctaaacataggcggtcagtagaaaaacgatggaaaagaaaatttggtgatccctattatgtcttgaaaattttattgcctagaaaggatttaaggacctgtaatgtttgtggtgatgaccacgaggctggtgttttatgtccaacatgctacaagaaagttattgatgaaacaaaggcaatgcaagagcagattcaaaacgaattaaaattggaacctgtggaaaaagagattgttgttttatatgaaggcgaaaaaaatgacaaaccagcggaattctttgagggaaaaaggatagtagaaatgaataaaccaaggccgcaatggtttagcaaaaacttgctgncagaaacaacacagaagaatgctaccactanagaagtgaagccgtctgatctnaggtaatttnaatgtagtagtttgtagatatcaaatgtattataanagtgnntannaactttgaagaatattgtatattttcatatttacatatagattttatacttacaaaaaaaaaaaaaaaagggggggggggcgcccttttttttttttttttttt

SEQ ID NO: 2928 - DNA, 1136 bp, Diabrotica virgifera
caagcctctaaatagagtcctattaattttttgtgtaaaagtaattcatttattttcttccattttcagcagttttttgtgctatttttgtactaatagtgatatctaataaacattaacaatgtccgcacaagacaacgtgaccacccctgaggaattcgtagaacacgaaaatgaaagcagttacaagcctccaccagagaagaccatcgaagaaattctacagatcgatcaggaggatgaaagtttgaggaaatacaaagaggccttactcggtcaagcacaaactggacctgttgtagtggaaccagacaacccaaagaaagttatagtgaaaagactggtactagtagcagccgatagaccagaattggctctagatctcaccggcgatttgtcaaagctcaaaaaagaaacgttcaccatcaaagaaggcgtttcgtacaaaatcaggattgaatttctggtccaaagagaaatcgtacatggattgaagtatgtgcagaagacgagtaaaatgggcattacagtcgataaaatgacacacatggttggatccttcgcgcccaagactgaaatacaatcctacaccactgctgccgaggatgcaccctctggaatggtcgcaagaggaacgtacacagtccactcgttgttcacagacgacgacaagaacgagcatttgaaatgggagtggactttcgagataaaaaaagactggaaagattaagtttcctctgggtaagcagtcagtcagggtattttttaaatcctaagccttttacccgcaacaaatactattttatataagtataacctttttgaaagaaatttaccaaaaaaacctttttgaactttttgctgatgtattattaaaaatgagtcagtattttgccttaactgtaaattgtgtatgaatataatccggtctgtctatccaacaaggtaatccaaaatagtcctttatatattttaaagttttatttttatttttattttttatagaaaaggttcttgtttactttttttctttggtttatttgggaaaatcggaaaaaggggttaatagggccttaaccccttggggactttttgaaaaattccctccaggggttttttaaaaaaaaagggtatat

SEQ ID NO: 2929 - DNA, 554 bp, Diabrotica virgifera
agcccacgcgtccgcccacgcgtccgaaatgaagtatctgtatttgttttttattgcttatatcttcgcctacgtttctggatctcagcttaaaaatcaacaacatgtttgtaactgccaaaagactttagaaaccatttatgctgatgtcctccagcaagagaaagctttaaatcaaacccttattgatatttctgttcttgaaatagagcttagacaactcgatgatcttcttgaaggacaagaagataagctaatagacatctcggctgaattagcagcactaactgtaactaagaactacattaatcgtttacttgccgatggaagccaagccctccaatgcatcatagacaatctcaaagaagtttgccatgatctacacgatgacgtcgataatgatgtcgatcaacaacaatctcaaattataaatattctaagtgttgttatgaaagttgaagattgtaagaatggaaactcatgtcctgctgctccccaataaaatgaactgtaaaccaatcatgctcgcttaacacaatttcttttgtaaaaac

SEQ ID NO: 2930 - DNA, 1455 bp, Diabrotica virgifera
agcttttattaaccgttggttgacgcattgatcaatgatctttctttattcattattcatttgatcacacaattccaatacttaatacttttgcctttcaatcaacttgaaactgaagtgccgttatcacgtaatcacgtttattgaaacacaaagggaattattttctttctttaaataaaatagaaataaacctgtgtggtagtttgatctctcttggtaaatagtcgctatttgtaacgttgataagataactctgtaagtgggaggtttaaattaaattacaaaatataaacgttaatcaacaatttaaatagtactctcagggtgattgctagtgtacttgaaatatggctcttccaggacccttggataaattattcaaatatctcgatgaaaacaaagcaaaatatatagaaaacttaagacaagtcgttgctatccagtcagtatcagcatggccagaaaaaagaggtgaaataaccaagcaaatgaaatgggcgctggaacgtttacaagctttgggagcgtcagcagaattaagagatcttggaacccaaactctacctaacggacaaactatacctttacctcctgtcttattcggttcattgggcaacgatccaaaaaagaagactgttttaatttatgggcatttagatgttcaaccagctcacaagagcgatggttgggactcagaaccttttgagttgacagaaagagatgggaaactgtacggaagaggggcttcagatgataaaggacccgttttgtcttggttgcatgctattgaaggattccaggcaattggcgaagaagtacccgtcaacttaaaaatggtattcgaaggaatggaagaaagcggaagtgaaggtttggacgagttgttacatgccgagaaaaataaatttctggctggaacggattatgtatgtatttcagacaattactggctgggaaccaccaaaccttgcattacctatggtctccgaggaatctcttatttcttcttagaggttgaatgtgctgataaagatttgcatagtggagtttacggcggtacagtccatgaggcgatgtcagacctaatgtacctaatgaatcaacttgttgataaagacggaaaaatcttaatcgacggtatatacgacgatgtagctccagtaaccgataacgaacatggcatttataaagcaatcgaattcgacgtcgacgaataccgccaaaacgtcggtacttccaaacttctccataatgaagtcaaagaaaaaattctaatgcaccgttggagattccccagtctctcactgcacggaatagaaggagcatttagcgaacccggatctaagactgtaatacctaggaaaagtatcgggaagttttctataaggattgtacctaaccaatcgctgaaacagactgagacacttgtaatagaatacattaataaacttt

SEQ ID NO: 2931 - DNA, 965 bp, Diabrotica virgifera
  misc_feature (930)..(931): n is a, c, g, or t
cgggtcgacgcacgcgacaagttcatcaagttcttgttttgtctcgaggagttgattcgttttgttggcagtacattttataattattggagtcggaatatttaattaatgtgattagaaagtgtatagttttagaactagccatcacttacttaaatttctttaatagactcattgttttaatatagtttggtcagttagttaataaagtgtaattaaaaatgagtgaccccacaaatcctactggactacctagaagtttaaattatgaagcattaaaggctcatataatatcgcacaaaataaattgcggcctatggttaattagggtcataggcattctctgctccatagcttacttcattccaatttttggaaatccttacaactactattacaaagtactcctagcaaatgcagctatcagcgcattgagattacatcaaaggataggcagagtgcaattcacgagacaatttgctgcagaattactttcagaagatagttgtcactatcttttctattcgttgatatttttatacgtatcgccagtatcattggtactcgtaccaattatcctcttctgcgtactccattcagctagttattcactcacattgttagatacattaggtcaaaattcatggtggggcgcaagattactgatttctctagtagaattccagtcccttaacattctcaaagcagttgcatttacagaaatctttttgatgccttacacagtcctattaatattgctgggtagagccagtttgttgacaccgttcatatactaccacttcttgacgcagagatacacctcgagaagaaacccctacacaagaaacatgttcagagaactgcgtgttctgttcgagaacaccgcagccaagcccagcatgccttcgtttgttaagcaattccttctgnntaattgtcacttcacccacaaacttgctccagta

SEQ ID NO: 2932 - DNA, 1865 bp, Diabrotica virgifera
ccccccggcggggtctggaccccccttcgctccaggattcggagaacatatttaaaataaactcgtgtacaaaatctggaagcaaagaaatagcgagcggccgttccaaagaacttagagacgatgggttcgttaactttatcagtgatctttttatcgttagcggctttttcggtcgctgaaaatattgttgtgtgcaattatgagtcaaagtcccatttaagagatggagaaggaaaattcgatgtttctaatttaaacgaagctttgcgctattgcacccatttattatatggctacgctgcaattgacgacaacacatacaagttagttccaatgaatgaacaatatgatgtgattaaagaaaattataaacatataaccgatttgaagaagacccaccccaaacttaaggtgttactttctgtgggaggaaacgaagatgtcagtggctcaggtgacgagaaaaatgaaaaatatagaaaaattttggaatctaccgctcaccggttaagctttgtcaactctgcatacactttattaaaagcttatggttttgatggacttgatttggcttgggaattccccgaaaccaaacccaaaaagataaaatctggattgaaaaaactgtggagttccatcaaaacaacagttgccggtgaacatgttgttgacgagaatgctcagcagcatagagaacaattcgtagcattagttaaagaacttaaaaatgctcttaaagcagacaacatgcaactgtctctgacagttttgcccaacattaacagcacagtgtattatgatcccagaaatctggccccttatttggacttcattgttcttcatgcatttgacttctacacacctttacgtaacgaagaactggctgatttccctgcacctttgtacgaattaatcgaccgtagaggtgatgagaacattgatgcttgggtaaaatactggttatcaaacggaacaccagcaaagaaacttcttcttggcattcccacttacggtagaacttggcatctaaaaggcgaggcaaaagtagaccaattcccaataaccgatttgaatggaccaggtgatgcaggaccacttaccaaagaagcaggtcttctcagttatccagaaatctgtaataaagttactccacgaacaagcactccaggaggtttaaccaagattcctgacggaactaagcgcagaggagtttacgcataccgttatcctgacaaggacgacaagggaggaatctgggtaggatatgaagacacagaaacagcatctaccaaagcacagtatgccaaagctaaaggtcttggaggtattgctattgatgatctaacacttgatgacttcaaaggagtctgcggacacagtaataacaagtttgccatattaaaagctgcagtagctgcattgtaataaaattttaatttgtaattaaagttatagtttgtaatcgtccactaataatagtgtagatatccatgacgtccaacacgtctgttaactaaagacatcacactacttagcagcaccataaagtattatatagagatcttcttcaaatcggttatatgtttataattttctttaatcacatcatattgttcattcattggaactaacttgtatgtgttgtcgtcaattgcagcgtagccatataataaatgggtgcaatagcgcaaagcttcgtttaaattagaaacatcgaattttccttctccatctcttaaatgggcctttgactcgtagttacacacaacaatattttcagcgaccgaaaaagccgctaacgataaaaagatcactgataaagttaacgaacccatcgcctctaagttcttcggacgcgtggg

SEQ ID NO: 2933 - DNA, 883 bp, Diabrotica virgifera
  misc_feature (770)..(770): n is a, c, g, or t
  misc_feature (781)..(781): n is a, c, g, or t
attaacctcaatttgatgtaaacaaagtctttgagaaaataaacagcttgagttgtaaaactaaatccgttgtttatatcaactaaatattcgttgattatattaaaatagtatttcaaaagttgatacattccagttcaactctactctttattacgaaatgatagaaatgaggttctttaacaatccttttgaagattatacaccagaagggctacaagaaagtaaaaacaaagtgagtcaaagcataaacgtaaaatggaagtcaactatggaaaacttacagaccttggatttcagtgactatactgtttatacaggtacttccggcgtggctctacttaaattattacaagatcctgacgacttccagaatttaaaggaggttttaaaactgctttcgcttcacaaactgaaaggaagaaggcacactttcctgtgcggtgatgcaggaccacttgcaataggaatagtggtacatagcaaattgggaaatcacgatgaagtttcacaactaatatcaaaattaactttgctgaataaagatgttttggatattcattccgatatagccaatgaatatatgtacggtagaattggatatctatacgcaatactgtatgtcaacaaaaacatttcacctcctccttttgatgataactatattagccagattatagagaccattttagtaatcggtcgtaatatctcaaaggcaggtagatttaagtgtcctataatgtatgactggcacgacagttactacatgngagctgcacancgacttgctggtattttatatctgttgctgcaagcaagagcatatcttactgaagacgaattgaatatgtggtcaaacctaccatttgatatttactgactc

SEQ ID NO: 2934 - DNA, 989 bp, Diabrotica virgifera
ccacgcaaaatggcaaaatttactctctttcttttggcagctgtctttgtagctgttttagctaccaaagaagtcagctcaagtgatgttaaagttgttgatgatccagacgatgaaccaactactacaactactgctcccgctacgtgtgactgtgaacaatgtaacactcattgcacagaggaaagcaaattagacccacccaaaaactacgctggaggagtctgtgtagataataaatgttattgtgtcgaaattgtttaaattatattcctttatattatcaataaatgtttttaaatgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatttaaaaaaaaaaaaggggggggccccttaaaaaaaaccaattttataaaccgggggggggggaccaaaatttttttttaaggggccccaaaatttattttcgggggccctttttttaaaacggggggggggaaaaacccgggggttcccccattttttccctttggcaaacccccccctttcccccgtgggggaaaaaaaaaaaaggcccccccccaccccctctcccaaaaattgcccaccttgaaggggaaaggggccccccccttaaacgggcttttaaagcgggggggggggggggtttcctcaaggggtgctttatattttggagaggcccttaagccccctcttttttttttttttcctgtttttttttcccaaatgttggggggtttcccccgaaaattttaaaaaagggggccttctttttgggctcgttttttgggtttttcccccccccccccccccaaaaaatttttttgggggggggggtcaccattggggggccctttccccccttaaaaaagtttttttttccccttttaaaattgggagaaccaacatttttaaaataggggattttttttttt

SEQ ID NO: 2935 - DNA, 1220 bp, Diabrotica virgifera
cagctgactttttactttttgttccagtcctatattcaacacactttggatattaaatattttattctaaatctcaagaatggcttcaaaagacagattgatgatttttccatctagaggagcccaaatgatgatgaaatccaggctaaagggagcccaaaagggacatagtttattaaagaagaaagctgatgctttacaaatgagatttagaatgattttgaacaaaattattgagaccaaaactctcatgggtgaagtaatgaaagaagctgccttttctttagctgaagcaaagtttgcaactggtgacttcaatcaagttgttcttcaaaatgtcaccaaggctcaaataaaaataagaactaagaaagacaacgttgctggtgttactttaccagtgtttgaatgctaccaagatggtacagatacatatgagttggctggtttggctaggggaggtcaacaattgacaaaactcaagaagaattatcaaagtgctgttaaactgttggttgaattagcctctttgcaaacttcttttgtaactcttgatgatgtaatcaaaataacaaacagaagagtcaatgccattgaacatgttatcattccaagaatagagcgtactttggcttacatcatatccgaactggacgagttagaaagagaggagttctatagattaaagaagatccaggacaaaaagaagatcagcagagcaaaggccgagaaacaaaaacaagctcttctccaagctgggctacttaaagagtcccaggcaaacatgcttttggatgagggcgatgaagatctacttttctagaacatcaaacagcctgaagtgtggttctgtacatatgaataaatatataacgctaacttgtttttagacggtaactgtttatttttcgcattaattaatacatttttaagatatatctttatttttaactggtttttattcttatgccttgcaatagtaaaagatatacgaacccggatatttcctatataaataacttcctactttttattaactccagtttttaggattttaatacaatattcaacacatcgtgcaatagaatttgaagtgaatattacttgcgaaaataaaaaggtacaaatatttttcttaatattgaacgtatattccagaatagtattataaaaggtttgattgaaattcttgtacgtgacactatgaacttgtagatttt

SEQ ID NO: 2936 - DNA, 908 bp, Diabrotica virgifera
aacaattgttataaattattataaaaatgccacctttagttgatagaagtccggaaaatgttataattgacgaggataagaaaaatctctggtcacaaattctgcacgatgtgcaaaagaacggaaatccgaaattgtcaccacataaacaaattttggttttgggtgacaatgagtcaggcaagaccactatggtagctaaacttcaaggtattgaaaattccagcaaaggttctggcttggagtacggttatatcgatgtaagggatgattacagagatgatcacaccaggttgagtgtttgggttttagatggtgatccagctcacgaagatctccttaggtttgctctaaacgaagaaagttttcaggaaacgttggttattttaacagtagccatgaccactccttggggaatactggaacagctacaacattgggcatccgttttggctgatcatctcgataagctaaaattagatatagatctgagacaagctaggaaacaactgatgattaagatgtggctggattacattgaacctggagatgaattggaccctgcttctcccatgaagagaagttccagaaatttgggagacgatgatgagggttacgatggaactatgctaccagaaggaacattatcaaataatttaggtctggatattgtggtggttgtcacaaaaactgattatattcaaaatcttgaaaaagagcaagattatcgagatgaacatctagactttatgcaacaatggattagaaggttctgccttcagtatggagcagcacttttttatacaagtgcaaaagaagataaaattgtgatttgttgtacaagtacttaactcatcgcatctataacttccccttcacactccagctcttgtggtagaaaagatgct

SEQ ID NO: 2937 - DNA, 1439 bp, Diabrotica virgifera
  misc_feature (1286)..(1286): n is a, c, g, or t
  misc_feature (1358)..(1358): n is a, c, g, or t
  misc_feature (1423)..(1423): n is a, c, g, or t
cggaatttccctgggtacgacccattgcgtccggctctagttactctatttttggattcctgtaagaatctaccacaagctcgaatgtcaacgaagccagatccatacgcaactgtaagagtaggaaacgattcccagcaaacaaaggttttaatgaggacagtcaaccctgtatgggagcaaggtttcactctttttggttaccaatccagaaaacgatacactatttctaagcataatggatcacaaaacatcctccgaaataggacagcttcactttaagatcaaaacattggctactaaacctaatatggtaatgagcaaagaaccattttcgctgataaggtctggacctgagagtaaagttatctggtcaatgcatcttaggatcctaaaacaaggcgaagctacagatgacgcacaacttgataatacagataagtttaaaagaagtatctccaacatttcgaaatcttcaatagaaagctcaaatgcggttttgccgcaatctaaagaaaatctggatgaagttgagccagttttagatcaggatcaagaagcaccagttgaagaaattttagaagattcttcgttatctgctcttggtggtgcgcaaccactagatggcaacgagcttctatatcatcgaacaccaagtgtaacatcttccgctggtgatgctggtcttggccgaattcaacttacacttcgctacagtgtccaaagacaacgacttattgttgtggtccataaaatcatgaatattcctcttaaagatccatcgagtatacccgatccatatgtcaaattgtatttgttgccagagagagctcgtgacacaaagagaaaaactcaggtaatcaaagacaacgtaaatcctatctttgatgaaagtttcgaatatgtgattaaccaaggagaagtagggtcaaaacagctagaagttacagcctgcacacaaaaacaattgatttactctagcagcaacgttttaggacagattatcatagatcttggaaagttaaatctgactcaacccttcacttcttggttcgatctacagcatggataacatggagattaatcttgtgataacttttaagcctttttatttttaatttaagtgtctatctcatcaactatttttatttttatatttcctattaaatttctgtttaaaaaagatataaataatacgttttatatttgactgtttttagtagtcactagaaatatctagagcaaaaattttatcgatcaacttaattcttattttattaacttanattatatatttattttacttaactgtgctccccaacgtggcattgtcagacaatactcaaaagggagtcaanctgctaattacacaaatttaatcaaatgttgttctaattctgtgtctgacctcttttactactanttctaaagaaaatgct

SEQ ID NO: 2938 - DNA, 1031 bp, Diabrotica virgifera
cccacgcgtccgcccacgcgtcgacccacgcgtccggattacggtttatcccaataacaagttccgctggtgatgctggtcttggccgaattcaacttacacttcgctacagtgtccaaagacaacgacttattgttgtggtccataaaatcatgaatattcctcttaaagatccatcgagtatacccgatccatatgtcaaattgtatttgttgccagagagagctcgtgacacaaagagaaaaactcaggtaatcaaagacaacgtaaatcctatctttgatgaaagtttcgaatatgtgattaaccaaggagaagtagggtcaaaacagctagaagttacagcctgcacacaaaaacaattgatttactctagcagcaacgttttaggacagattatcatagatcttggaaagttaaatctaactcaacccttcacttcttggttcgatctacagcatggataacatggagattaatcttgtgataacttttaagccgttttatgtttaattatatagtttttcttaagtgttgtgcacctatttaggtttatttttaatttaagtgtctatctcatcaactatttttatttttatatttcctattaaatttctgtttaaaaaagatataaataatacgttttatatttgactgtttttagtagtcactagaaatatctagaacttaattcttattttattaacttaaattgtatatttattttacttaactgtgctccaaacgttggcattgtcagacaatactcaaaaggagttcaaactgtaattacacaaatttaatcaaatgttgttctaattctgtgtctgacctcctttaactactatttctaaagaagatgccgtattttatacagctttactatttgtagcataacttaattaataaaaattatgtacttacattttaaaaaaatgttatatattacaaagttttcctgaagtctattttcataaattttatttgttaaaaccttttttatgggaaatataacccttgaaagttgtttt

SEQ ID NO: 2939 - DNA, 1776 bp, Diabrotica virgifera
aataattcgtattaatgcacacgattttggggctaagtttgtccattgaaagatttgcatattaagcatgtattaatgttaaacaagagattcggtgttaaaattgatattttttaccaagctgtattttggtattatttttgcaaccagggtgtgtttactgcaagctgaacacagaataatcagtgattgtatgtcagttttgagtacatgttcaatttgcatgtatttaatttctatcaaaaactagactataagctacatcccaaaaaaaattttttttacgttttttcaatatttgtatgacgtgaacaaaagtttaaatgttaatgtgaatttgtatctgacagagtacgaatcagttatatgtataaatgttatgtggtgttcatgactatttggtagtattcaaaattttaataattttatttttgtctggactgtaaacttatagaaccaatacagttgaacccgcttattagaataccggttatagaaatattccggtttaagcaatagaaatttgaggttccaaaacagttttactagccactaatgatcggttattagaaaataccggttataggaatactttcgcttggcatgaaggctattccaataagcgggttcgattgtatcactaggaagcacccgtaaagtgcctgtgaatgacatctcaaaaacatctgcagaaagtattggaaatgtttttatagatagcggtacatactactaatttcagtgtgtgaatcaaatggtatgtcatggtggcgtaggaaccatttgacaccgtgacaatattgttaaattgacaaatggatgaaaacgaaatttttaacgcttgttgtaatgcttttcatctacttttctgctttctgtccgtcaaggtgcaattttcgtaatcaaaatatctacctacctagtagtgatagagagtgacaaaagtcatcaaatgagatgatgtataattatataaagcatacatagtttttgtgtaatatttcatctagtgtgcgctgcagttcttgaacaaatagccgacaaattattttcaaaaccttaactttaaaatcatcatctcatgtaatttgttggggtgccctatcctttctagacgttggcagtcatcagcgcaatacagactttgttccactgaaataattcagctggttttgtttcaaactaccttcgcaagtttggattcttcttccgggacctctcttgtcgtcagtccttcattggataacctataatatcgtgtaatttagaatatcaaaaaaaatattgatgttagtcgaaagtttgtctgaatttttcataattaccattttcgatagtgacagatgaaaacttgaatgtatcatttgtaaaagcaatgatgctatgtcctatgtctagataattcttcactgtgatggtaaccgcagtagacacatcataagacagtcgtcttggtacgctccttgaataaggctatttatcgcttctcatttgtttcgggcacttgtcatgggtcatatagtattatatgacatatgccaggtgcctgaaacagattagaagcgattaaatagctctatcgctacatacaaggacatttaataaaataaaccagtttgctaagaaaccctaacttaattgacatatttatcagctcaggcaaataaaagatattaactatagtcggttctctaaactcatacacggctggctagtgattttagtaagtaattttgccaattttgcaaaattgacgaaaaaaaataattactaaat

SEQ ID NO: 2940 - DNA, 1553 bp, Diabrotica virgifera
cggttaggtcgcataggaaaaagtttgtgtgacaattctcatattttatttagtcttagtcctagtcctagacttcaaatcttaagaaaaatgtcttattccatagtagagagaggatctccgttctcacccgattatagggtttatatcgaaaatcaaaatggtccaatctcacctcttcatgacattcctttgttagtggatggaaaccctaaggttttcaatatggttgtagaagttcccaggtggacaaatgcaaaaatggagataacgatgaaagaaattcttaacccaatcaaacaagatatcaaaaaaggcaaacctagattcgtttcaaattgtttcccccaccatggatatatctggaactacggtgctctaccccaaacttgggaaaatcccgaacatcttgatgatggcacaggttgcaaaggtgacaacgatcccattgatgtcatagaaattggatacagagttgcaaaacgtggggaaatcttaaatgtaaagattttaggaactctggctttaattgatgaaggtgaaactgattggaaactcattgccattgatgtaaacgatccattggcagatcaaatcaatgatattccagacgtagaaaaacatttcccaggtcttctgaaggcttctgtggaatggttcaaaatatacaagattccagatggcaagccagaaaatcaatttgcatttaacggagaagctaaaccagctgcatttgcgcttaagattgtagatgaggtacataaattctggaaaggccttgttgcaaaagaagtcgacgctaaaggaatttcatgtgtaaatacaacactagaaggaaactcgtttaatattagctacaatgacgccaaagaagttattgaaaagactccagaatatggcccagcacaacctactgacccaattgtcgacaaatggcactatattcatctaaagtaaacaaatggaacacaactgaacaatgttgcatttaggttatggatggagataggcacacaactttcctatgttttattaaataaatagataaaagaaaaaaaaaaaaaaaagaccggacgcgtgggttaaaataataaaatattttttagtaaaagtaaagaaaaattttatttaatgatagttaattagtattgtgagagatattttatttttatattattttttgtaccttgtgtatcagggattattaattaataatatatatttattattttccaatttaattcagctaaaaaattaaaatttttagataaaaagaaatataataaataatttttttgtaacgaaatgttattcgttttaaatatatctaattttttaagaaataaattaggtttatttattaacaatatatttataattaaatattttaatattattaatattaaatatttttaaggatgatgtaaaaaaaaacaattttattataattaaatttttacataaaaactaggattaaaaaatctcatatttaaaaagatgtcattaattattttgaataattatcatcatgatttgttatacatatttgatta

SEQ ID NO: 2941 - DNA, 927 bp, Diabrotica virgifera
gataaaaataccgaatacaaagataaaatgtgtacggttaataatgataaaggtgaaatagagatttatagattaccagtaaatgctgaagaatatgttattcatgactggacaattaaatacacgaagtctcatatacttcactcaatttgtgcaaatgctgaaacttgtagctctaaacctgaagaacgatgtctcttatgcgtgtacaacaatgaactagagctaccccatttacctgaaatggtgtttccgaataataagttaaatcttagccataagtcaggattttcagtagaattcaatgccttggatgctttaaagactgtcagtaatggaaaacagtcaataaaagttgctcattctgatgtatggaaagattcaagggcgccagaaaatttagaagaaaaaatcaaaccttttgactggacgtttagctcagattatagggggtatatgtccggggaatcatcattagaagaaacagaagaacgaattaatatcgagaaattaaaagaaaaagagaaaattttgttttatcaagaattaatgttgtatgaagatgaattacatgataatggaatttcttcatgcacaattaaaatcagggtgatgcccagttcgttttttgttctgttacgatttttcttgagggtcgataatgttatggtcaggatcaacgatactagagtgtttcatgacttctcaaccaactatttacttagagagtatacgaataaggaatgtggggtaaaggatttgaatttaccattaacagtgtttggagatccaaacgcactatcgccacatatgccgttacgaacatccatttttgaaaaaataacaattccttctgtacaatcataaataacgtagaatattttagtgattccttatttattttactaaataaatacttttacttgt

SEQ ID NO: 2942 - DNA, 1059 bp, Diabrotica virgifera
  misc_feature (882)..(882): n is a, c, g, or t
  misc_feature (959)..(959): n is a, c, g, or t
  misc_feature (1005)..(1005): n is a, c, g, or t
acatagtaaatattggtggaaagcattaattcagtctagcttacaaaagataaaagaacaatattaatgttccaaaaatgcctggaccagtcagacctaggggctcaaataccggcagtagggctcaatcggtagccccaatgtccgagaggcaacagatggcgctgctgatgcagatgacttcaggcaatgagttggggtcaagaagtcccagttcgagttcttcacgaacgagagaaaggaacgaaagaggtgaaactccattgcatttagcagctattaagggtgatgttgatcaagtttgcaaattgcttgcacaacacactgatcctaatgtagctgattttgctggttggactcccctgcacgaagcctgcaaccatggttggtacgaagtggcctttcgtcttgtccaatcgggtgccaacgtaaacgcgcgcggtttggacaatgacactcctctccatgacgcagctgtcaacggacacctcaaactcgtcaagctgttggtggaaaagggtgcggatatatatgcaaaaaattctaaagggaagactccactagacgtggctcccgcctccgttaagccttatcttctaaattccgctttgcctttaccagattctacatcgaattctagagtagtttctcgcgcatcgagggatgacaaaaaaatcacctcaagctgcgacccatctacctcaacggcctccaccgcgagtggtggcagcaacgctgccggcggaaatagtggtgctgccgcctcaacatcgggtaaagcccaaaagaacgaaccgatggaagtgaagacttccacggcgtctggtactttctcagcgacggctgggacatcgtcgagaaatacctccggaacggcaaggngtgcttcgggaacgacgaccggcgatgacgtctacgagttcaaatcagcttaaggagggtgacacatcaagtgctgnaagaaacaaggatctggatctggaagtaccgaaatggaacagacgnaactgatcctcttagtgtaacgcgcccgactacacaggcttccgaagaatcatc

SEQ ID NO: 2943 - DNA, 1081 bp, Diabrotica virgifera
cccccagcggggtccggaccccttctgcgtcccgaatcaaaagaagggaaatcgaatatgaagctatcgtcaaaaagtacaaagatgagttggcagctacaggttagaattttgaagtgttcgaaaacttcagttctatttttcagttttattccatttggtctcgattctctgggatattattccccttcatctgaatgttagcagtgttctctatatgccaagcatcattggtggacaaagaagagatcagaaacagtaagattttaaatattgccaacatatattacgtgttttgtagaattgctgcaaggtattacatagattatccaaatagatgaacaactaatctaaagggctccaaatattcagcaatgctcaaaaagtacaatggaggattataagctacaggttaggattttgaagtacatattccaaaatagcaattgtatttttcagttatttttctgtggatatcaattttatggaattttactcccctttatcaagatggcagtgtttttttgtaactaaaagaagatatccatggataacgaagaagttgaaaaacagtaagatattaagtattgcaaacattggctaatgttttttagaatgattttgaaaatgttgtatggattattcaagttcacgaactaatcaaaagaagggaaaccaaatatgaagctatcctaaaaaaagtacaaaggagagttggcagctacaggttagaattttgaagtacttgaaaacgtcagttccatttttcagttttattccatttggtctcgattctctgggatattattcctcttcatctgaatggtagtagtgttctctatatggcaagcctcattggtggatacagaagagattaagaaacagtaagattttaaatattgcaaacattggctaatgttttttagaatgtatttgaaaatgttatatggattatctaagttagtgaactaatcaaaaaaaaggaaaccaaatatgaagctatccttcgagaagaacaaaggagagtttgcagctacaggttagaattttgaagtattcgaaaacatcagttctatttttc

SEQ ID NO: 2944 - DNA, 1826 bp, Diabrotica virgifera
cccggacgtccgcaagtgccttaaggtaacagatcgagaatgaaagcgtttttggtacttggatttgtggctttagccgtcgccacgagcccaccagctcccactagcggcgagaagaaggataatgccaagcctgttgtagcagaaaaatccaaacgtcacttgggaggtggattctaccaacaatccttcaacagtattccacaaacttactcatcttcatggagcagtggtccagtagtccatggatacggctacaaatacaactataactcaggaccagttggtcagtattctgcatcatcatattcctcacctttaagttactctgccggtggattatctgctggaggtttatctggaggccaatactcatctggactttattctgctggattagccggaggttattcttctggtctttcttctggaaatctcctttctggtggtctttcctcaggcgctgtatctgaaggtttttcgtcaggatacggctctgaaggtttatcaggtttatctgcttctgctggtttgggtagtggtggtttaggtggatcttatggatcttacggatcctatggatcatcatatggaggccaatctggtcttctttcaggtggttcctctgatgtttactcttctggactttctggtctttcctctggaggtttgggtcaaggatattcttcctacagttatggtgtaaaatctggtctggaaaaagtcgtctcaagcgaagaagttgcacgtcataccgtccacaatgtaatcaacaaagttcaagtaccagtaccagtaccccaaccttacccagtaaccaaaactgtccaagtaccacgaccataccctgttaatgttgacaaaccagtacctgttcaagtaagagttaacgtaccagtaccagttgaaaagccctacccagtacaagttccttatcaagtaccttaccaagttaaagtaaaagtaccatacacagttgaaaaaccatacccagtacatgtcactagaactgttaccgttccagtagaaaaaccagtatatgtaaaagttccagaagtagtcaggatcccagttccacaaccctaccccgtaccagttcaacgcagagttgctattaaagtcccacacccagttgtagttaaggtaccagaagttgtcaacgtacaccatgccatccaaactgttaaacaacccgtagaatttgtccaacaaagagtctcagctccaattgtctcacacacatcttcaggtgtagttggcggacaatcaggtttttcatcaggagcattctcttctggtctttccacctcatctggtttttcatctggtgctgatgttgtttcctcctctggtttagaagcatcctcaggtcttttggctggaggtcaaggtttcaacactgatatttctcaaggatactcttcttccggtatcatttcatccggtatccaatctggtggtcaagaacttatttctggtcaatcaggattctctggattggaatcggcaggtcttcaatcaggattacaatcatctggtttccagacagaattccaatctggtggaatccaatctgctggagccgattttagttcatcaagttcattgtccggtacatcccaaggtgttgctagtgaataccttcccccatgcccattgagccacggacacaacatctcagcacgtaaagcagaagaaaagaaggttgatgaaaacaaacattaaattgttattgttgtctataatatagtatataaaatgttgatattcgacacgatttgtacatgaacatttcctccttctgttaataaatctttaaacaaaag

SEQ ID NO: 2945 - DNA, 910 bp, Diabrotica virgifera
cggttgcgcggttcggcagttattcgtccgatttttgttgacgtaaaacaagaagtttattgtttatcaaaatatttattaccgaattttcaataaaatgtcggtcatagacagggtgagaattctagtattaggcgattccggagttggcaaaacatctttcgttcatttggcagctcataatgaaccccttcgatcacctagttggactgtaggctgttcagtagatgtgaagttacatgaatataaagagggcatgaaggaccaaaagacgttttttgttgaattttgggacataggtggtagccattcacacagaaacgcacggcctgtattttacaatccttttcatggtgccatactagtgcatgatttaacaaaccgaaaatctgaaaagaatttacacaaatgggttagagaaattagtgtaaataggagagaaagaaaagattctaatagtgcaacaaatcctgttttgccagggttattaggcgacgatttcgaccaagagagttttataggaaatatgtcaataccttatattgtaataggaaccaaattggatcagcttgatgatcgcaaaactcgtatcgaacacatggccagccatttaggatgtgatgaaattttaatggactgtagacagaccagatatttagcagcaggtacttctaatgctgtcaaactatcaagattttatgataaggccatcgaaatgagatctaagagccataaagattcattcacagaaagatttggagatcctatttcaccaattttatctacaaaattttattccccccatcaagactagattatagtgaaatatttaaaatacgggaagtagtttactacagaaattaaaaatacataggtatatggttttgggaaaactggcccagttaataaa

SEQ ID NO: 2946 - DNA, 942 bp, Diabrotica virgifera
  misc_feature (802)..(802): n is a, c, g, or t
  misc_feature (826)..(826): n is a, c, g, or t
  misc_feature (835)..(835): n is a, c, g, or t
  misc_feature (841)..(841): n is a, c, g, or t
attttaattacttttgtaaagaagtaataacgttgtgcttctatagaaaatgagggattatttaaatattggaacgattttgatagacaaaaaacgatagaacaaagtaatagtataatattcaatgagcatgcaatagccattacatgcgagtggaatactatactttttctacgacctttttttctattattagtagaaaaaatattgtattttaaaactcatcgttcgtttattgataaatataactaaactaaagtaattttttactagccgacctattaataagaaaatcactttacttaacatttttttgtattgcatagtctaagtgagaatccattgttttaagttacctatataaaaatcatatgttatatattaattatcaactactcttcattaaaattaaaatttacaaaaacaaataatgttcgccaatagtacgcggctgaatagttggttgcctactattaggaggcgtcgaccgtgaagattattcttataaagacatccgtgaggatcaaatttaaagaatggaacgtaatagaacgcaagctcatgtaacgtaatgacagtctgtttcaaccttaatatctgtcacataggtcactaggctatatgattgattaaacccgtgagtaatgaaatattcctcacaggtaaagtaattggtgttattatctattcaaaaatagtgaataatgagcatgttattaaatggtcgtagaaaaaaataatataattcaaaacagtcatgacgttcaatcgatttatttgattgattatcgtatgttcgttnaaaatgttcaagttccacatgttntaataattntctcanaatttctgcaataaagtaaaatattagatctggatgcacagaaatcagtattaacacaaaaaaagtacgtccgttgacgaaaaaaaaaagtattcacctga

SEQ ID NO: 2947 - DNA, 1137 bp, Diabrotica virgifera
aaaaaaacaaccaagagagggggccctttagtaccagaaattgctaggatatacaaaaccgatcgggaaaaatacaacgagttggcgcgcgagtggactcgcaaatacgctatgtgatggccaggcccccccgaccctcatttcacatattagaagaaaaacaaaaacaatttatttaataatacataaaaaatcaacaaacacatcggaggggatcggccagcctgtcattttcacaaacaaaattctactgtacatttgctttttgaggttttggattccgccacaataccatcatggggcttttatgtaacttttcgattcccaaatgacatgttgtggtgatactagcgtccaaactttggaggaaggaaaaatgtttatataaaataagtactattttttcgtctctacccaagttatctggctgccattgcctcactcgctcccaactgatactatatttaatattagataaattaatacgtaggatttttgtggttcaactaggtgtactataataataaatatatattttttccatactttccatgctctttcaacaattttcattctaagagaaagcaatatgagagtttgtactcacataaaatctgtagataatttgtaagtaatcagtgtgtctttaagtacaaactcttctaagatctcaaaggaatattcgactaatggaaaatgttaaagatttataatatatacataagttttttttaaaccagactgcagtttcatattgaaatgttgggtactaaattaaaaaacgatttctaacaataccttaatataaaaatcgtttaaattctttagaacctgcgaattagaaaaagaacaatgtagatatttgtaaattttttaaattagaatatttttttatttgttaaagcaattttggaagaattataaatcttaaaacatttttctaatagtaaaactggatgtgccgtgatgtatattgtttaccttctaaacagtgttcattattttactgagacggctggctaatgtaactttcaaggcttttagaaaaggaatctaccgtaaatgaaggcgtactttacaacaatgtttgataaaaattgaaattaattgtaaactttttatttatttactgaatat

SEQ ID NO: 2948 - DNA, 1535 bp, Diabrotica virgifera
taccggtcaagacatgcgtcggaagtgatcagtcataaattctggaacattaccattttaaagtgcatatttgagtgaagacagggtgttaagaagcattttagtttttcttgtatttatttccgtcaatttaactggtaataaaagtggttctgggtggatgatcacgaaaccatatttatttgatttacgtcgtgtctgtgagttttgaaggaggccatctttgcaatctctattagaggtcttcagcttgcgctttcattgtctggtgaaaaaccagtatttattacacacacatttcaccaaatggctttaaaacgaattaataaggaattacaagacctcggcagagaccctccagcacaatgttcagcaggtcctgtaggagacgatttatttcattggcaagccacaattatgggaccaccagatagtccataccaaggcggcgtatttttcctaacaatacattttccaacagattaccctttcaaacctccaaaagtggcattcacaacaagaatctatcatcctaacattaatagtaatggtagtatttgccttgatatattacgttctcaatggtctccagctctaactatttctaaagttttgttatcaatctgctcactactgtgtgatccaaacccagatgaccctttagtaccagaaattgctaggatatacaaaaccgatcgggaaaaatacaacgagttggcgcgcgagtggactcgcaaatacgctatgtgatggccaggcccccccgaccctcatttcacatattagaagaaaaacaaaaacaatttatttaataatacataaaaaatcaacaaacacatcggaggggatcggccagcctgtcattttcacaaacaaaattctactgtacatttgctttttgaggttttggattccgccacaataccatcatggggcttttatgtaacttttcgattcccaaatgacatgttgtggtgatactagcgtccaaactttggaggaaggaaaaatgtttatataaaataagtactattttttcgtctctacccaagttatctggctgccattgcctcactcgctccccactgatactatatttaatattagataaattaatacgtaggatttttggggggtcacctaggggtactataataattaaaatatattttttccatactttccatgctctttcaccaaatttttttttcaagaaaaaaaaaaaaagaaaagttgggatcaccccaaaaaaccgggaaaacaattttttaagaaaaacagggggggcttttaagaacaaaattcttttttaaaattcttcaaaggaaaaattttgaactaatggggaaaaaggttaaaaaattttttaaatatatttactataaggttttttttttttaaaaacaaacatcgcggggtttcctatttttgaaaagggggggggggaggtaaaaataaaaaaaaaaaaaatttttcttaaaacaaaaacccttctaaatataaaaaaaaaaaatccgtttataaaaatttttttt

SEQ ID NO: 2949 - DNA, 1106 bp, Diabrotica virgifera
  misc_feature (983)..(983): n is a, c, g, or t
  misc_feature (989)..(989): n is a, c, g, or t
  misc_feature (1036)..(1036): n is a, c, g, or t
  misc_feature (1046)..(1047): n is a, c, g, or t
  misc_feature (1060)..(1060): n is a, c, g, or t
  misc_feature (1094)..(1094): n is a, c, g, or t
tacttgttacttttctacttttaaaaaccaaccaaaagaagacttcctaaacatgtcgaaagtgagtaataataggaaaagaaaacatcagtctaaagaaggagaggagcccgaagtcaatcgccccaaagcaaaatttcggtcgcgcgatgagcaggcagaagaagagcaattgtcccaaattctatttggaggggccacgagttttctgcagtgtctagaggaggccgaacctgagccagggcctcctcgatcgaacgcagattcaggtgttggcgaaactgacaccgatgacgaagaaaaagaacgaaaacctgcatggactgatgaagatgatgatggtatagacgtggggcaggcactagacagccaaaggcgcaagttaccttcaggaggcattaacgacagaagtaacaaatattccaacttacttaaacataagttccaatctgctgttggtactccaaagtgggcgtctttgaataagcgtaaacgaacagaatcagactctgacgaagaaatcttaaggagttgtggttttattaaaactactaaagctcagttacctactagtatactagaatttaagaaagttaaagatttgaactgtgagacgtactcagaagggccttacatcaactcgatagaattccatccaacatccagtgtagctttagtagcaggtaacggaggaatagctactttatatgcagtagatggcaaaagaaacaacaaactacatagtgtgaaattccaaaattatccgatagtttgcgcaaaatttttgcagaacggaaacgaagccattttaggatctaggcagtcacatatattcagttatgacttgttagcaacaaaacctacaagatacacactaccacagggcttgacgcagtgtaagaactttgtggtttcgccagattcacagtttattgctatagctggaaaatggggagaggtgcatctgttatcggccacttccnaagaanaagtagctttattgaaagcagaaactgaggtcactgcttttacatancatccatcanngaatctcttattnggtcatagcaacacagacgaaataacagtatggngacatgaaatga

SEQ ID NO: 2950 - DNA, 1468 bp, Diabrotica virgifera
  misc_feature (1419)..(1419): n is a, c, g, or t
  misc_feature (1426)..(1426): n is a, c, g, or t
caaccagagggggcagtacaagcacaatcagaataactccaactcacaatttaaccaatcgaacaaggacctagctccgcgtttcaagaagagcaatttgatagtcggcaaagaggagatggcagatgttgaattgagaccaaactcgatgttgataacgaaggcttcttcgttgaaaagtaacaacatgatgaacaataacaagacaatggaacctaactttgcaccttctacaatcaaacaacccccgtcgacgttgctcaaagaccctctacctattaagcaggtgccagctgagaaacctaaacaatccaaaaaagacaaaggcccaaacaaagaggaagttcttaagaaatttaatactttaatagaagaattttggaaaggcgaagtagatcttaagcaagcgattaattcttacaaagagcacaaagttcccgataagtttgccaaagagatggtactgagcggtttgtctaatgctttagagaaatctgatgtcgaacaagaaaaattgatcagatttttgagcaacctcaaagaagacaacctgatcagcggcaatactgtccaggacgcgtttaagtcactctgtaatgtattggaagagagagaaaatgagattaacaaagtaacaaccgcagcttcggttctgtttgctacagcgatttgcgaacatctcgtacccctttccgacgttgccaatttgactgagaacggagcacaccacccactgttcctgttagtattgcagaatatacacaagaagaggggaaaaagcgaattatcggaaatgttcggaaagagtaagatcaacttgatgagccaactgccagattgtgataagactaaagaacggttgtcagaaattctagaagaaagagatctaacgttcctatatccattgctacgtatacaagctgatcttgctcgtcaacttcaagccgatcccaatccacaagcgttttacaagtggatcaaagaaaatctagaaccttcaaattttaacgatcccggattcataaacgctcttatgactgttttgttgaaatatattacacaggaaccatctgcttgtggcgatgaaaaagcaattatagaaaaggaaaatggcctcttgaagcgataccaaccgatattgcatgcttttctgcgcgacaaatccagtttgcagttggtggcactctattcgctccagatgcatttccattcgctgggattcccgcgcggtcagctcttgaggtggttcaatgcgctctacgacatggagattgtcgatgaagaagcgttcttgaattggaaggaggatgtaactgatgcatatccaggcaagggcaacgctctgtttcaggttaaccagtggttgacatggttacaggaagcagaatcagaagaggaagaaggagatgatttgactangaattanaaaaaaataaaaaatataagtggcgtgatttcacataatagt

SEQ ID NO: 2951 - DNA, 966 bp, Diabrotica virgifera
ctgcaaacaaactattcattatgtctgccgaacaatctcaccaaacaaccatgattcaactcggaggcaccacagtaggaatgacgcttcaacgtacgagtgaagtccacgtcaccaccgtaactaccacccagatagtcaacaaccagactggcgcaaacatgaatagtaccgtggtactcaccagccagcacgccagcgaggtacttagcaaagtcgaaaatgtacatctgcctggtcactcatcgatgcttgttatgagtcagcctcccaagcaaggtggagagaaggactacttccttgtttccaatcatggagatgtaaaacttgatgcagaggttatacatatggaaatgatggtacatcttggaccaagtcatcttgtaactattctacctggccagagccacacattcgatcttagtggtgtccacttccgcaatgctcttctcaaagttacaaatcatgaagaaggacaagctgtattttccgctgaaggtggtaatgtactaaaagacttcgaacagaatgtacaaaaactcgataatgaagtccaggttctacaaaaagttgaaaacttccatttggctggtcattcttcagtgctcgtcatgactcaacctcctaaacaggaaacgggagaaacaaaagatcaattccaagttacaaataatgggactgttaaaatcgaagcagaggttactcatgttgaaaggatggtacaccttggaccacgtcatctagtaactcttttgcctggccagagccacactttcgatcttagtggagctcactttaagatggctgtcttagaggtgagaaatcatgaggatggagaggctgtattctctgctgaaggtggaaatgttgttcaaaatatgggagggatttgtacaaaaataactttcactgagcagggttcccagagagtcgaaaacgtacgtctcgctggtcgttcctctatga

SEQ ID NO: 2952 - DNA, 3577 bp, Diabrotica virgifera
aggtggaaaagttcttcccgaaatggagaaaagcgtacaaaaagtagttccaagtgagcaagttcaacagaaagtcgaaaatgtacatctagctggtcattcctcaatgcttgttatgagtcagcctcccaaacaaggtgaagaagaaaggaaagatcatttccttgtttctaacaaaggaactgttaaaattgatgctgaggttatccatgtcgtaaggatggtacatcttggaccaagtcatcgtgtaactattctgcctggtgagagccatacatttgatcttagtgatgcacacttccacaatgctcttcttaaagttacaaataatgaacaaggacaagctgtattttcagctgaaggtggtaatgttctagaagatttcgaacagaccgtacaaaaattcgaatatgaagtccaggttatgcaaaaagttgaaaacttacatctagctggtcactcttcgatgttggttatgactagttccaaacaggagggtgcacaagaaagacacttcaaagttactaataatggaaatgttaaaattgatgcagaggttactcatgctgaaaggatggcacaccttggaccacgtcatctcgtaacccttttgcctggccagagccacactttcgatcttagtgaaactcactttaagatggctatcttagaggtgagaaatcatgaggatggagaagcggtattctctgctgaaggtggaaatgttgtgcaccaaatggaggaaagcgtaaaaccagaagaagttccaaatgagcatgtagaacacaaagtggaaaactttcatctagctggtcattcgtcggtcatggttatgactcaaccccccaaacaacaaggtgaagaagagagaaaggatcaatttatggtttccaataacggaaatgtcaaaattgatgctgaagtcacccatatcgaaagaatgatccatttaggaccaagccatcaaaaaactctcttgcctggcgagagtcatacttttgatctcagcggtgctcacttcagattagctgttcttaaaattacaaatcatgaagatggggaagccgttttttctgccgagggcggtaatgttctgaacggttttgagaacaacgtacagaaagttgaacatgaaacagaagttgtacataaggttgagaacttccacctcccagctgactcctcagtgctcgttatgactcaacctcccaaacaaggaaatgcagagagaaaggattatttccttgtaagcaacaatggaaaggtcaagatcgaagctgaggttactcacgttcaaagaattctacaccttgaaccacgtcatgtggtaactcttttgcctggccagggccacactttcgatctcagtggaattcactttaatatggctgtcttaaaggtgagaaattatgaggatgcggaagcagtcttttcagcagaaggtggcaacgttcttcctaatttagaaaaaaatgtacaaaaattagaacacgttgaacacaaagtccagaacgttcgtctaccagctcactcagccgtgcttgttctagctcaaccagaaaaagagaacgatgaccataggaaggattatttccgtgttagcaacaacggaaatgtcaagattgatgctgaggttgtccaaaacgatcttcaaccaccacataccaaaagccttctacctggcgagagccacacctttgacctgagcggtaatcagttccacttagctcatctgaaagtatccaaccttgaagatgaagaagctgcattctccgccgaaggaggaaacgttcttcacgatttcctaaataacatccagaaggtagtatccgagaagccccaacataaactcgatcatttccttttgcctcctagaagaactgttttggcattatctcagaccggtgttcaaggtgaagaaaacaataagtacacaattaccaaccatggacccgctgatctttttgctgaagttgttcacatgaatcacatctacgatgctcctcattggtacgtcgtcaggccagaagaaaccactgaaattccaataaacgagcatcttcaacgcaatattttacgattgaccaataacagttacaaagacgaagtagtcgtcagtgctgaaggtggtcacgttcttcaaggtattgagcaaaacattgaacaactttcaatgacagatagcacaggaactgtattaactaaagtagagaacttctcgttgcctccaagaacccacatcgttgctttgagtcaaaatgttgaaggaagcaacgaacatcctggaaggtttactgtaactaaccatggtaaagctccttttgatattgagttgaaacgtacatcacctgttcaaacacttgaccttcatctcagaacagttcagcctaatgcaactgaatattttgaactcaccgcccaattccaaaataccgtgttggaagttatcaataccagccatactgaaaccgcagtatttacagccgaaggaggggatgttatgcatgatctccaagatgaaattaaaaaactcgacgttcaagaacaaagtacactggacaaaattatagattccttagcaaaccttcgactaaatgcacgctcacgagttttggctttggtatatgatcccaaagatataacatcagcaggagaaaaaggttttactattactaaccacggacaatacgacatagaagccgaggttgtttataccgacagagatgaccgtgacaaagatcaacttaaagtcatcaaaccaaatgaaactgtattgattgagcacgttaaagatgctggaaaggcagtattaaacatcttaaacagaagttacaaggaattgggaaatattactgtcaagggaggcagagtaattcacgaacttgaacgaaaagtaaagaaactggcatctgacaacgaagtagtcctagaattagatcgtttccacttggcacctaactcttcggtggttgttatgcaccaaattggtaaatacaaacgaagattcgaaaactttggtctaacacttagatctaaacttggcggccttcaaaaatccatccaaggggtatatcataaacttgaaggagaaggtgagcaacctcaaggagagaatcaggaacaggaaggtgaacatcaacaagatgaacaccacaaatttgtgggagtacaggataaacaaattcaacgtagacaagttcttcacgatagatataccatcactaactgtggatacaacccaattactgttcagatcgttcacctaacaaaagaagacgccgatgatgaagtgcttcgtagccaggtcgtcaaacctaatgaaactcaggagctccttcttgaaggcatagaatcgtcttcgctgaaggttatcaatgaaagttcaaaggacattgctattttctctgcagaaggaggagaggtcattcccggagttgaacatttgattagacaactgcagagaggagaatgtatgaaaaatgttttgtggcgttccagacgtgaacgaagagtttaaataatgtgtacaataatttgattaaagttttttttataagtaaataaatactctacagac

SEQ ID NO: 2953 - DNA, 1332 bp, Diabrotica virgifera
ccccacgcgtccgattctgttcaactgaaaccatgttattgagttttacaacattttcatctaaagttaaatgtcaagtgtcgagtataggtggtcaaaacactttaaaaaacagtctaccgtcttgattaagtgctaaattagttgttttatttagtaaatttaagaataagtttatttaattttgtgaccatgccgaaaggaaaacgaaagggaaggtctgatcgcgggcgaaacgacggctccctaaattcatccgacgatgaatcttttatggacaacgcaagtgttgtcagtaactattccgaaaacaaaagcggagaagagtgcgaggacgctgatcttctcgcacaggaacaactggaagaaaaattagtagaaatcctcgatggactcacccagaaatcatcccagggcagaatcaattgcttcgatacgctaaccaaaggttttgtcaagaaatgtatgcctggatttatcagagatcgtcagttcacaatctgtgacagcatagaaaggagtttgaaaaaaggaggaggtcccgaaaaaatagctgctgccgagttagccaccgttatttgtgtccagctcggaggcgaagatgcaaccgaagacatttgcaggctgctgaaaccgatcttgcttagtttgatttgcgacaactcggttgctgcacctgttagagcaaaatgctgcactgctttaggaaacatcatattcttatcaggaggcgaaataggagacgttcttctcctgatgcaacaattggaggctatctattccgccagttacttaaaaggcgatggaaccgttccgaccatcagtccagatctaggagtacttcacgcggctgccatccaatcttggaatttacttttcacgttactctctccgggaaatattggaaccatgattaacaattctaaagctttaccctcactcgaaaaactctcagaactgttggaatcggcacatttagacgtcagaatggccgcaggcgaatctttagcactaatatacgaattaggtagagaagaaagtgaggacttcgaagaagagtttgcactagatgtcacagaaactttaaaacagttagctacagattctcataaatacagagcgaagaaagacaggaaacaacagagggccacgtttagggatatactacaatttatagagagtgacatagtacctgaattgcagattaaatttggaaaggaaacgttggtgcttgattcgtggataagaaggaagcaatacgagatgttgtgcaatatcttaggaccaagtataaatgtgcatttgaccgaaaatgatctgcttagggatatt

SEQ ID NO: 2954 - DNA, 1484 bp, Diabrotica virgifera
aaggttatgtcttttcggatgcgtgggcgttttcgtttcgatttcgggttttcgttatattttacttaaactgtgatctaccattaccagctttaatacgtattaaaacgatggagtacattcaagaaccagtctcaagtgaaccattaaaaacaacaatattatgttgtgaatgtggtatagctatagaacccaaccctgctaatatgtgcgtggggtgtcttcgatcacaagtggacataacagaaggaatccctaaacaagctactttgcatttctgcagaggatgtgaaagatattttcaaccacctggggaatgggtcaaatgtacattagagtctagagaactcttaacattgtgtcttaaaaaacttaagggcttaaatagagttaagcttatagatgcttcttttgtttggactgaacctcactcaaaaagaatcaagataaagcttactgttcatggagaagttgcaggtggtgcaatattgcaacaagtatttgtagttgaatatacagtggcacatcaaatgtgcgatgaatgccatagatcagaagctcaagacttttggagagcctcggttcaagttagacaaaaatcggaaaacaagaaaactttttactatttagaacagcttatattaaaacacaaggcacatgaaaatacattaggaattaagcctattcatggtggcttggatttcttctacacaacagagggccatgcaagaaagatggttgatttcttgtcagctgttcttccatgtaaataccaacattcaaagaaattaatttctcatgatattcacagcaacatttacaattataagtttacctattcagtggatattgttcctgtatcaaaagatagcattatttgtttaccaaaaaaattaactcaacaactgggaggaatttcaccaatttgtttaatctacagggttacaaattcagttcatcttatagatccttctacagctcaaattgcagaaataagtgctacagtattttaccgttatccatttggagccatttgtaatccaaagcagttagtagaatatattgtaatggacatagaacccatcatggataaagataggaagatattccctggacaaggagctatttcccacagacatgttctggctgatatttgggtagttaaagcatctgaattgggtgtaaatgataatactattcatactagaactcacttgggtcatgtcttaaaacctggagattccgttttagggtacaatatagaagacagtaacataaatgacacaaacttcgacaaacttgatagaaattcagttccagatgttattttagtaaagaaacactatggagacagggcatttagaagaagacagaggatttggaaacttcaaaagacttgctgaaggtgatactgcttttgatcctgatgcaaatgactaccaccaagtcttggatgatctggaagaaaatccccaactgggacc

SEQ ID NO: 2955 - DNA, 1622 bp, Diabrotica virgifera
gtcaattgaatcaactagacggtgatgtgttcagtaattgaatgtaaaatttaaaataatgttgaaattaatcaccttcatattcataatagtgaccgtcaatgcagcagaaagaatcaacaataatttaatttataaaaatgtggatagaaccatagatttaacgtcacagttagtaaaaatcaccagcaccataactcttgaaaatgccggcgcagaccctatcaagaattttctactggcggagcaaccaaatttagttgggcagatagcatttaaaggtgccaaagactctgccaagcaagatttaaacgtcttaacagcccaagtagaaaaccagagtgataagagattccacaaagttatcttgaggcagaatttggaaccgggccgtactgcaacagtggtggttgaagaaatactcattaaaagtttaattccatatccaaatagtatttcccagaaagagaagcagttagtgaggtattttggtaatcattatatttatacaccatacacagtggttaaacaaaaaactgatgttacattaagctctagaagtattgaaaattattctaaattgaaaccagttactcagacagatagtacagtacattatggaccatatggagaaattgcaccttttgctgtggatgaactgatagttcattacgaaaacaatgctccatttttgacagttgtccatctagatagaacaattgaaatatctcactggggtaacattgcagtggaagagcaaattgaaattaaacacacaggagctacattaaaggggccattttcgagatatgattaccaaagagacactagtagtacacatcacagtattaaatcatacactactgttttaccagccactgctcatagcatttattacagagacagcaatggcaacatttctacttcagctgtaaaacaccgtaaggattggatagaacttgaactgagaccaagattcccactttttggaggttggcaaagttcttatactcttggctacagtgttcccagttaccagtaccttttcaaggctgaaaatggagataatgtattagctatgaggctcattgaccatgtttttgacgatatgtatgttgaagaagttgttactaacgtagttcttcctgttggagtcactgatatcaaaattcgaccaccctatgatgttgagagactatcagatgatgttacttacaaatatttggataaccttgggcgtaaagttataagactgaaaaagagggacctgatcgaacaacacattcaagatttggaaattacgtataaatggcaaccacgattgttgttacatgagcctttgctgttatcgttggcactctttattttgttcgtagctgtaattatttgggtccgattggacttttcacttgcagtgcctgagcacagcaaaagagaataactttttgtacatctatattaacattttttgttaaataaattataagattgtattttgtattattttttacagttagttggaaaataaactctgatgaatcgaccgaaagaaaaaaaaaaaaaaaaaaaaaaaaaaaagggaaaaaaaaaaaaatggggcggccgcctctaaaagaatccaa

SEQ ID NO: 2956 - DNA, 1248 bp, Diabrotica virgifera
atttcaggtgtagttccgatttactctattaactgcgtataccccgtttttaatttgacttattctgtatagcagataacgaggttaagcgttcgctagtgacgaacgaacattttgaaactgatcattaaaattatcatggcccgaaacaagagctatattgcctaccgaatttgttcgtttttataaaatcgtggaaaagtaacgagtacaaaaaaacactgaacgattttgtaatttcgagtggaaatagcaaagctctgttttaatataaataatatttatatataaatatatatagacaacaaataactgaatgccttttatcaaataatgtagacgtatacacttttacaaaaaatattagctattattttggaagcattatgttaatacacccgttacataatatctcccattatcttttttaaacattcctgtaacaaagcgattatacagactgtttagatttaaattagatatacatcctataaatggcaacactgagcgcttcaggagacgtaaacattagcagatgtattagttgctaacggcgtggattattaatttcaccagcaaaacagatggctatttcgtttagtttttaataatcttggacaatcattatttgcattttcgcttgaattattcattaatttaattaataggattatttttttactaataactatgtattcagtgaatacaataatttatatactatgcaatacaaactaataatcgagaaaatagaaaaattgatagtgattttaataacatactgttactatcggaacgagtagataaattttgaggatctttaacaatcaaaatacctggtacaattatagtatacagcaatgctgccgattttagcgcttacttcagtgtcttatatctaatctaaaactaaacggtctgtacataataagtaacttatcgagaggtatcgcagatgatgtaaactacaggcgtgattagaaaaagtatttgggagttgttagggatgggaaggtgtaaatatagtgaggtgttaattttaaaacggattttgaatatctgatgtgtaggtcttaacgtttcttttcatttatatgcatattctcacgcttttaaccggactctttggaagatattcaatatcctacacattatttaatgtaaaaaatatcatttgtagatgagttttgaggttttgtaggatattttcatatatataaatatttcacggtcataaatctacaaaag

SEQ ID NO: 2957 - DNA, 1057 bp, Diabrotica virgifera
  misc_feature (819)..(819): n is a, c, g, or t
  misc_feature (952)..(952): n is a, c, g, or t
  misc_feature (1025)..(1025): n is a, c, g, or t
  misc_feature (1042)..(1042): n is a, c, g, or t
gttcgtgtgttgcaaaacgttatagtttgccaaaaataaggttatgcgttatgtgtgaacctaacaacattgaatattggtgttaagttgaagtgcatacaaaatggacactaatttacggaacgttttcctattgggattcggctttttgttactaatgactggcacgtttaccttatttaatattcaaaaaacgatagttgacagtatacaaaaagaggattcatcttttactgaaaatggatattatagccttgctttaaataatgcattttatgctttatttaattggataacaccttcagtgatacatctcattggttctaaatattccatgtgtttgggagtcatctttaatattatgtttatactacagttcctgattccgaaggtatggctgttgtatacaatatcagccttaataggattgggaacttcgttactgtggataggtgaagggaactacatcaccctaaattcaactgaagagacaatctccaggaattcaggaatatttacctttctctcaaattttagtatgatttttggaaatattttagttatgtttgcgttcagcggcaaggaagtaatcaatgaagcaacaaggacctatgtgatactatctcttgcaggtgtttgtagtgcaggtcttataattttttgtttactttcacaacctgcccgaaaaaaagatcctcatgaagaagttgttaaagtagaagggcctgtcgaggcttttgtaagtgctaccaagttatttattacaagggaagaagttgctacttagtttcagttttctctactccgggctggaattgngattttttagtggagtggatagttcttgcgttggtttacaaagaaatttgacgatcgcaaacaattggtaggaatatccggattcttataggtgttggtggagtggtcggcgcgtggagttcttagttatttnggacaaagttgtaaatttaggtagaagtatttagcatagtagcttgtagtatacacactctttgctttgcttntatatttattaatcttncgaatagctcaactt

SEQ ID NO: 2958 - DNA, 972 bp, Diabrotica virgifera
atcaccaaagagaacgtcataacgttctctttggtcaccaagacactgctgataattctaccttgtgaagaggtggacaaattcacatacttaggctccctgatgaccaaggagaacgttatgacgcaagaaatcaagcgaaggataatcctagcaaacaaatgctattttggactgagtagacataatatgagaagtagaaacttaagccaaaaaacaaaaattaccatatacaaaacccttatacaactagtgttgacatatggatcggagacatggaccttctccaaggcagataaaaaccttctgcttatatttgaacgaaggatcctgagaggaatattcggtggcatctgtgaaaatggtatttggaggaggagatacaactacgaggtataccacagatataaacatatatttggtggtaaagacgtagtatctcctataagaataggaagactaagatgagcaggacatctagcaagatcacagcataacaaccctcctagaagaatccttatgtcacaacctgtgggaagtagaaataggggtaggccaaaacttagatggaacatagtaatccgtctaattacagaggccttagtgttaacagtactattagtagactatttagcagaataataaagaacagattagacgtagagacaagagggagaataagtgaagatcaaagtggttttactgcgggacgctcatgtgtggacaaccttttcgtcatccaacaacttatagagaaaaggacgagcgtaaatgaagaaactcacattgccttcatagacttggaaaaggcatatgactccgtccctagaaaacagttgtggcatgccccttgtgaaatgaaagttagtccggctattatacatattatcaaatcattgtacagcgataatgtgggatatgtcaagattgcacaccactatctgaaggataaaaatagaaaaggactgaagc

SEQ ID NO: 2959 - DNA, 2038 bp, Diabrotica virgifera
  misc_feature (1995)..(1995): n is a, c, g, or t
  misc_feature (2020)..(2021): n is a, c, g, or t
gtcgtgttcacttttactgaatttttacctgcccttttggtattttaccgttgtggtgtttgagatttactcaagtttttgttacgaagatcgaagatacgaaaatgtcgactattattgactattcctacttcattaactcgaaatcggctagaagaagaccggctttgacaagagaaataactaaacggcaatatggtggccccaaggaacaaatatcactcgccgaaggagttccaaatgaaatcacttttccgtttgagtctattactgtaaacctaaaagatggatcgaagtttgacattgtcggccaagaattagcttccgctctgcaatacattccaacccaaggctatccagcgttggtgaaatcggtcaagacctttacgcaagatgtacataaccctcctggttggcaaaaatatgaaactctgataactaacggatcccaagatggaatgagtcgtgttctggagatggttttggaggaaaatgatagtatgctggtgcaaaatccttattatgctggaacggaggccatcattaaacctctgaatgttaacgttattggaattgacgaagatgaatttggaatcgttccgcaaaaactcatcgatgccttggaaaactgcaaaaagtacacagaagaagggggagggaaaatgccaaaaattatctatttaaacccaacagcatcaaacccatctggaagaacaataccgacagaaagaaaaaaagaaatataccgaatttgctgcaaatacaacattcttattctcgaagacgatgcttactacttcttacatttcctggatgagcaacctgtctcatttttaagccttgatactgaaggaagagttatccgactagattccatgtcaaaagtccttagctccggactcagactgggttgggtcactggaccaaagaggttgatccaaaatatagagatacacatttcaagctgcatccttcactccagtgtgctttcacaggtcattcttcaaaacctgttcgaaaaatggggcaacagtggtcttcttgcttacttttcaagagttgcttcattctacagagtaaggcgtgactacactgtctcatgcatggagaaacatctcaaaggactctgcgaatgggaactaccatcaggcggcatgttcatctggttcaaggtacttggtgtatctgatgtctacgatatgttgttaaccagaggcctaaagaaacacatcaccttcattcccggacaaaactacatggcggatcctacagcagcctgcagctacgtcagagcttcatacagtaaagttggtttgaagcaaatcgacaaggccatgcagattttggctgagttgataagggaggaacacttgttattgcgcaggaaattggatagtttagatgacgaaatgataataagataggttttgtaagaacgtagcgcagaaatgaaaaaacgaaaatttgatggaacggtattccttcaaatttgcttactggaagctcaaaccaagtttctagtgctgatctgttgacatcttatccattaaagagggaagcttataattctgaccataaccgatatggtttgtatatacagttatattgaatttaactaaaaattactcagaattcaagtattatgtagtacattgccgaacttgaagagttatggcgaaatattgtactacactacattacttatagagagttaaagtagggtaaatatgtaaactgtcttggactctatgagtctcaaaattttgaaattacgtatatctttattaaatgtgagtaaatcttaaattacgtgaaactgttatcagttctatctatcagaaattctatcaaagattcggcgaaaagcgttgtacctattatctgcgtagctactttaagtagatacttacgattaagcaatacgtagttattagaatacatgtttacatttatattttttatctaactttaactctctaatctacagaaacctanaatgaaacaggtgaattgttttacnnaatgaaaatatctattt

SEQ ID NO: 2960 - DNA, 1129 bp, Diabrotica virgifera
cttattattctgaccataaccgatatggtttgtatatacagttatattgaatttaactaaaaattactcagaattcaagtattatgtagtacattgccgaacttgaagagttatggcgaaatattgtactgcactacattacttatagagagttaaagtagggtaaatatgtaaactgtcttggactctatgagtctcaaaattttgaaattacgtatatctttattaaatgtgagtaaatcttaaattacgtgaaactgttagacattttacacgataaataagtgaataaatgtttttatatgttttattttaaacatgtgtaaaaattaatttcgatacctttgttgacaataaataaaacagaaaaatgatcaataagaaccaaattcttagtcaacttacctttaattgagaggcaaaaacagataaaatggtatacttaatggtgaaaataaatcagatagtaaagcttttaaggagataataacaagcaaagtatctcaaaaaagatatgttcgatgcaaagcatctaagttctcttttggcagcgacttatgacataccgatgtccagtgctagaagatcgatgatgaaatatgcttgtaccactggtgtaaacttgttttaagtactctttcttcctagttggtcgttcgatccggaaatagtgccgccatgaattttcaatgatttctcttaaactgcccccatctttttctccatcctctggaactctgaagcaaaggtttagcggagctcgacctcttttgtaatatggtccacctaccttgttggtgatcaacccggggctctcgctccttgcaccattccctgcaatgccagcttgacagccaccacatgaccagaggaagccgaggtcttttaggtcacaatgtttcgaagcctacgtgtcatgtgcagctgactaagaatatactcggtgattcttcttgcggtccaggatattgacaacattctttgacagcaaaacagttcaaatgcgtctatagtgcgtttatcaacttcctcaaaagaccagcattcagattcatatagaaacatcgagaacaccattgtgtttgcaagccttatttctgtatccatggtgatgtgatttttccatcta

SEQ ID NO: 2961 - DNA, 926 bp, Diabrotica virgifera
tttgaagcgacaagaacgcctttttaggacatctcatgccgaattcggcaccccaaagactacaccattcagaagatcagcttgaatttttggctcgtaacagtttctgacccactgcccaataaaatcaaatgctaatacagagaagtcaagtcagaaatcatcaaaactaaccacgtgctcaaactacaacccacttgcgatgcccttattggtagtacaagagtacactcccagaaattgattgacgcttacgacaatgttacgtactaaagtcatccagttcaaataccattcagttgttgcaatcacttctcagacaaaatctttccaagacaaagacccagtatccacctaagcgactccatagacgaagaagagcaaatcgcactgaataccaataaacagacactctggaagttgctgccacgcgtcaacttccttctaacaaggggagctgttatatccgtttttaccaactaaccttaataatgaagtacctacttatttcccatcaggatatatcaggtgtcagccatctgaatcgacgcatccagtttcaatgccaatgtcagcgagaactactacgtccaggctttctcacaacctcagcattttgtaaatcatataaaaccatttgccggtgtttaatatttgttcgtaataatttagatttagtacatgtaactttaattcttgtattttcaaaataaaatattttttaaaaagtcaaaaaagttttaagtgatataaaatatatacatatacatacatatatacatatacatatatatacatacacacatatatatatgaaagaacggcgattgcactccaccacacttcgaccaccgtactgtgttatagtggtttgaagtttcagcaattcggtcatgtgaaataaaagtctacccgtttcctcccct

SEQ ID NO: 2962 - DNA, 910 bp, Diabrotica virgifera
gttctccttgtcatggtcaacgtttccgcaccataagtcaacactggcaaaacacactgattaaaggtttttcttttaaggcatattggtatgtcacagtggcggctcgtaccactttaagaaggtagtgccacaactcgggcagccgccaaaatttttagtgacggattcacgatattgtcaaaaaaaggtatactgacaacaaaaactaaaaaaaatatgcgcggatacttttatctatatcttaagtttattgatctgaggtgccaagcaattgtccaacattgatcaaaatagttccgtaaattaattaataataaaaacctcttaacctaccaccagcatttactgctgatagtgcttgaaaattgttattacgatttagtctctatttaccaatttataaaaataatactatttcattattcacacacatgcacaaatttttgtaatgtcacttttaaagtttacgatatatgaagttcattcttctattttttggttgcaaagttttcaatgactttataattaaaattatcaatacaatttacaaaatgcttttctgcagatagcatacctaaagcactaggtttcgatgtaaacatcgaaaaacagcgttctgcttcagatgttgatataggaatggtaactaaaatacttaaaagtttaatagtttcttcaaatgtgctttttaaaccttccctctacaataaaaccgatagcgaaacagccccagaggtagtacttaattcgtctcgctaatacagtacctacttctaattcagttttaaaccgagttttgcataaaaattaaaattgatcgccgtggttcattaagaaatgagtcgggcaaactgatccttttacccagtaaactcctcggacataaataaattggaagcaactaaat

SEQ ID NO: 2963 - DNA, 1478 bp, Diabrotica virgifera
cggacgcgtgggatcgcgagcggccccctttttttttttttttcattaaaacatttaatttaaaaataatatgtacaatttactttataaacatctaatcctaaatcaaataaatttttcacaaacacaaatttcaatttaggaacgttacataaaatattaaaatattgcatatttttaacataagacaaaatacattacacttaacattaaagaagtagaaaaatatggctcaatgtaaaatagtacgtagaaacatctactgatacacaaaatggtaagtatcgcagaaatggaaaaagtggtaatatacaaatattgtataagtagcacttagtaagtagtttattaaagtagcggcagttaggtttaatgtggtggaatgttgaaaatgacattttttgttttaaattgattttttatgattactactggcctctctccaaccctctagggatgggccaactgtccccagaaaaggttgttgtggggtggtctaacgatagtttttggaaagtgtgcacgcgacaaatgcgtaataggtaatttacatgatactttacttttactttaatagatatgttagtacccgctctgtggctcagtggtaagaacgcctactcattaaaaataattgggtttttgtaaatattaatctaatttcaatgtgaaacatgaccacaaacaaaacaaaaataataatttaccaacatattgggttgttttgatttctgatatgtcaaaaataaaactgttttaggcgtaaaacaacagcttacgccaagctgcaaaaagtgcagcggctagcttgtctgagaatcataggggcaatgtcaatatgccccattgcagctctagaggcgatgctgaatattcctcccttgcagttctgcataaggagggaggcagtaaccaccgccttaaagcggcgacagcagtggcggctcgtaccactttaagaaggtagtgccacatctcgagcagccgccaaaatttttagtgacggattcacgatattgtcaaaaaaaggtatattgacaacaaaaactaaaaaaaatatgcgcggatacttttatctatatcttaagtttattgatctgaggtgccaagcaattgtccaacactgatcaaaacagttccgtaaattaattaataataaaaacctcttaacctaccaccagcatttactgctgatagtgcttgaaaattgttattacgatttagtctctatttaccaatttataaaaataatactatttcattattcacacacatgcacaaatttttgtaatgtcacttttaaagtttacgatatatgaagttcattcttctattttttggttgcaaagttttcaatgactttataattaaaattatcaatacaatttacaaaatgcttttctgcagatagcatacataaagcactaggtttaaatgtaaacatcgaaaaacagcgttctgcttcagatcggacgaaa

SEQ ID NO: 2964 - DNA, 1241 bp, Diabrotica virgifera
  misc_feature (1221)..(1221): n is a, c, g, or t
aaatcttaggtatagtactgcgattgctggcagtcgcgtactgtgtagaatcatttgttatttcagatgattataccgtaactgtgaaaaccaataatggaaaaataaaaggtggctttggagctagatcacatgcaaataaagatgaaattctatattggtttagaagtattccatttgccgaacctccagttggagatttaagatttgctgcacctgtaccaaaagccaattggtcaggagttttagatgtacgacataaagctcaggaatgtattcaaggttcacctgtagctggcaatgaagattgcttgtatctaaaaatatatagccgtcacagaccaagcaaattgcacaaactcccagtagtagtatggatttatggaggggctttctttgaaggctctgcagactttgacgatcaccgacctgatttccttcttcatgaagatgtaatcgtcgcagctgttcaatatagacttggatatttgggtttcatgtcgcttggagatactgtagctccaggaaataatggaattaaggaccagatattagggcttaagtggattaaggaaaatattaggaactttggaggagatcccaataaaatcaccatttggggtcaaagcgctggagccgcttctgtggcttatttactacaggcaaaacaaacaagaggcctctttagtaaagcaattctcaactctggatctagtttgagcccttggtctttggcaaaagatcttcccgcttccaccaaggaagtggcgaaaaaattaaaagtaaatacgggaacatcttctacgaatattctagaatcattaagaaagatcgatgtcaaagaattgcaagaagctgcgtcttctgtaatgaagcagaacatgctcttacgtaatcctctgcaaggtttggtttttaccccggttatagaaccaaatcacgacgatgctgtaataactgaatattctcacgaactactgaaacaagggaaatttcaccatgtacccatcctagcaggatatacatcattggaaggatatttcaatcaattaacagcaatctttagactatgggtagcgaaattcgatttatatcatccacaacttgtacctaatgatatgaacctcctaccaattataaaaagtattatagccgaaagtattaagagtaaatattttggtttactaccagttgctttgagtacagaagaactcatgaggntcatcgcagacacccatttg

SEQ ID NO: 2965 - DNA, 1761 bp, Diabrotica virgifera
tattcaatgactccaaaaatgttaaaaatcttaggtattgtactgctattgctggcaggcgcgtactgtgtagaatcatctgttatttcagaagatgataataccgtaatagtgaacaccactaatggaccagtaatgggtggttttggagctagatcacatgcaaatagatcccaaattctatactggtttagaagtattccatatgccgtacctccagttggagatttaagatttgctgcacctgtacctataaccaattggtcaggagttttagatgtacgatatagtccttcggaatgtattcaaggttcttcacctgtagccggtagtgaagattgcttgtatgtaaaaatatacagccctcacgaaccaaacaaagacctcaatcttccagtagttgtatggatttacggaggagccttcttcgaaggctctgcagattttgacgatcaccgacctgatttcattctttatgaaaatgtaatcgtggcagctattcagtatagacttggatatttgggtttcatgtcgcttggagatactgtagctccaggaaataatggaattaaggaccagatactagggcttaaatggattaaggaaaacattaggaactttggaggagatcccgaccaaataaccgtttggggccaaagcgccggagccgcttctgtggcttatttactgcagactaaccaaacaaaaggcctgtttagtaaagcaattcttaactctggatctagtttaagcccttggtcgttggcaaaaggtcttccagaggccactaggcaagtggcgatacagttaaacatatttgctttaacatcttcagctattctaagagaattaagaaaagtcgatgtcacaaaattgcaagatgcagtgaattctgtaaatcagcagctgacgatcttacgtaatccattggaaggtttggtttttgccccggtaatggaaccagatcacgacggtgctgtaataactgaatattcttacggactactaacagaagggaaatttcaccatgtgcccattttagcaggatataattcattggaaggatatttcgatgaattagaagcactctttagactatggatagcgaaatatgatttatatcatgcacaacttgttcctaatgatatgaacctgcttccaattacagaaactattatagcagaaagtattaagtatacatattttgatatatatccagtttctttaagtacagaaaaactcatgaggtatatcgcagacacccaatttgaaaaaccaattcatgaagctattagactttattccgcttacacaaaagtgtatgcttatcatttttcctatgaaggaccactatggggtcgcatagatcgcgaatttcacggtgttggtcatagtgaagatttgggctacttatttgactataatataacaggaagtaacgaagattacttgacaagagaacgaatggtgaggctatggacgaactttattaaaaatggcgacccaaccccaaagcctgaattattattacagaacgtcacctggccagcaaattctgttgtcataaagcctgaaaacttgaaattttttgaaattaacaaagatctaaaagtggtaggtcttccaaatgctgacaagattttactttgggacagtttgtatatggaatatggaagacctccatttactacttattgatatatattggcacttactgctgttgattttatgttatttaagttaaaataaagttactacaca

SEQ ID NO: 2966 - DNA, 2869 bp, Diabrotica virgifera
gggttggtttgtcctgtttctgtttatttaaatggaatggtttgttgtcttgtgattcaacaaaacccttgttgttaaatactggacttattcctaagtgagttgttcaaaggttcagaaatttattaaatatggagttccatacccaacagttggtgtgggctgaattagcagataggccacggtggccaggtgtaataattgatgaaaatgaagttggtgcagaaagacccgcctctgaaaccaacaaggaatacgtacctatacatctattagcacaatctgaaaatatgtggatagaccaagatttacttttactgtatgaagcaaacagggaacaatatcataagggttcagaagatccagcatttttaaaagcagtagaagaagctgatgaacatttacagaagcagaaagaggacactcaatatatcattgctatcaaatcaaaagaaacaaaagtgaaagatgaaggtgaacctgaagctttagttgtggatgaaaaagaaaaagaaaaaactgaaaaagaaactgactatgtgggaaaagatatcactgatatatttagcagtgcaagtaaaactgaagagaatatttctatgtgtgaagaggattctaaaaataatgtgacttcagatatcaataaagattttcacgtacagcagattgtatgggctaagatgatgggtcatcctcactggcctgccgttataataaaggaggaagatatcaatgctaaaagaccttcaaaaaaatccaataaagtacattacccagtacaatttttaggtgaaaataccaatgggtggatagtggacacctatatttgtccatatgaagaaaacaaacaaaaatactgcaaaggttcaaaaaatcaattattttcaaaagcgataagcgcagccgacgaatatgtgcgaaaacaaaaaggggatcctgaatatcaggttccaataaagctctcaaaaaaacggaagaaagaagagtcacctgcagttacaaaaaaagcaaggaaacaagataatggtgagtctcctgtagtagacaaaaagaatggagattcatcctcgaaaaaatcaaaaaaaagtctcaatggtcagacttcggtagtagctgaaaagagtggagaatcatctgcaaaaaaatcaaagaaaaatcttaatggtgtatcaaacaaggttgaagaatcaaataaaaatgatatggacacagagataaacgaaaatggatttgatttttttggtattgctgacattgataaacaatttgcagtacaagagcttgtttgggcgaaaatgatgggacacccgtactggccggcagttataattgaagaatctgaagttaatactgcccgtcctccgaaaattcacaaacaattttacccagttcaatttttgggagaatacgcgaacgcttgggttgaaagcaagtttatatgtccgtatactgaaaataaggataaatactacgagtgctcaaagaatcaattatttttacaggctttagacgaagctgatgaatatgaggaaaagagaaaaggaggatagtaaataccgaatcaaaattaagcaagctactgataggtacgaccaaggcgacggcaacagaccgaaaaaacgtcgcattaaagaagagaaatctagtgatggtgatgtaacgagttctccgaacaagaaagaaaatgctgaggacgataatgcagataataatatggaatacactgaacagcaaattgtatgggctaaaatggtaggccatccgcactggcctgcagttataatcagtgaagtagaagtcgatgccgccatgccatcatcaaaatcaaacaagcaatattatccagtggtgtttctaggtgattttacgcacgcttgggtagaaaaaagccacatacacccattcgagaaaaacatcgagaaatattcaaaaagttcgaaaacccagttctttgcgcaggcgttaggacaagctaatgagcatttaagaaagcagaaagaggacagtgaatataaaatagcgttcgaacgttctccgaagaaaagaagtggagacacggccaggagaagtaaaagttctcctaagaaggtggagcgttccccgaagaagattaacattttagtaccacctttaacaggagaagcattttcgaagaagacagctgataaattaaagattggagttgttggtacagggatgataggcgccgaaatagtaaaagttttggttgaagctggttatacagtaaatatgtggaataggacattagcaaaatgtaaacagttagagaaagaattagggaaaggagagcatctttccgtcttactgactgctagaaacgtactcgttaaatctgatgtcgtatttatgtgtatatcagatagacaagctacaaaacaaatggtagaaaatgagttcgaagcttctatagatacagaaaatttgttaaaaagtaaaggtattttaatgatgacgagtattgacacaaatgaatcaaaggaaataaacgattccattacaaagaaaggaggaaaatatttggaacttgctcttcaaggtggtagcgaagagtcttccaaagaatcacgagttttattgacggcgggagatgaagccttattccaccattgtcatccttattttaaagccatagattgcacccctttatattttggaagcactattggggacgctattaggatcaatctagccatgcagatgatcaaaggtgtgaggatggcggctcttagcgaagcatttaacgtggtggaacgatgtggaataaaaaaggacaaactgatacaatattcaacatgtcagatatcgcaagcccctatttaaaaggcaaaaccgatttcatcgaccaaaa

SEQ ID NO: 2967 - DNA, 963 bp, Diabrotica virgifera
  misc_feature (847)..(847): n is a, c, g, or t
  misc_feature (861)..(861): n is a, c, g, or t
  misc_feature (898)..(898): n is a, c, g, or t
  misc_feature (935)..(935): n is a, c, g, or t
gaaattaatggcttccactcgaaaccaactcgatgaaatgctaaaaactgtagaatctttttctaatgatattagtatgcacttcggactagacaagtgccgtattttaaatatattcagaagaaaagagcatcgaggccatgggtgaaaacgatatgtataaatatcttggagtaaagcaagcgcagaaaattgaccgtaagcaaatgaaaactgagataactacggagtttatacgaagggtaaaacagctgcttcgctcacaccttaacaggagaaatttgtttaaggctctaaacacctacgcatgttccgcgcttagctattcatttggcattgttaagtggacaaaaacggacatcttcagcgaaaagtaagaacacacctcacaaaggcacaaaaacactatcctcgaagtgcagtagaaagaacgacattaccatggaatttaggaggaagaggacttatggatataggtgaacaattagataaacaaactgctaatttaagaacttattttcagatgcaggctgagacatctactctacatcgcgctatttgcgcagtagatgacacaacaccgatcacactgagggaaccagaaatgcgcataaaccaccttactaaagacgaaaaaatgcgcacctggatgggtaaacctctgcacgggcgacatcccaatgaggtcagccaagactatgtcgacaatacagcgtcgaactattggttgacatcaggaaagatgttccctgaaacggagggttcattactggccattcaggatcaggttataccaaccagaaattacctgaaatatatcgtcaaagaccctcagttccaaaatgancaatgccggtatgnatgtcaaacccaagaaaccatccaacatcttacaggnggctgccaggcatttgctgcaactgagtacaagacgncatgacgcagtgggaaaaaatcttcatc

SEQ ID NO: 2968 - DNA, 980 bp, Diabrotica virgifera
atacatgttaaggtaaaaagttctactcacatatttagccgctaattgtttaataattgtttaaacaataaaaattgttttgtataaatcattttaaaaaaatatcgttgaattcatcattttactttgataaaatatgtttctattttgtttttgattatgctgaatccgaatatggcattacaaattgaaaattgtaagatatttagctcttatacagtatgtctgcgtaactaggaacgatatgggaaactttttattatcaattttacgaaaaaaaagttattcttcatagaatgttctgcatagtctaaaatctaaaactcaaccatcagatatcgaattttatcaattttataggaggtatgtcaaaaatatgaatttcgctaaagagtaaagtacctttatatttcagaatataaaaaattgttattatgaaaagttgtttcgaattaaaaactatgttttaatatgcaactaaatcctcccgaagcacccaattctggagtagaactttttgatatgttgtttattaaacatttcttaatcaaattacaaaaagttctatcttgtttgattttttccgaagtctatttcctattgactcccctatcgctgggttatgttggttcgtaaatttagttgcgaaattagacagcgaatcttggaatagaagtaacatttgcattatatttatttgtttttcagatcgaatactatgcatactagggcggtccagtaagtacttagccttcaaaagtaaaacgaacattttggaatagtggcgatttatttctgaacctagtctcttattcgctcgattcctttgactcagcgatacctcatcttctttaacccaactgaaaaatacgttttctcgaggtttgcaaattaggcttccgtggcggtgatggggcgatgaactctttattcgactaaattttctgcccagcgagtgactttcaagtttgggaacaaat

SEQ ID NO: 2969 - DNA, 908 bp, Diabrotica virgifera
  misc_feature (795)..(795): n is a, c, g, or t
agttgttggtgactacgaaaacaaaatgaaattcgcatctttgctttgtattgtgatcttcaccgtccttgtgatcatcagcgcggtgttcgctgttccgtccaagggatcaaccaaggcatctctacagaagaaaccatgtctaaaagactgtagtgctgttgagtacaaaccagtttgcgggggagacggaactggaaagggagacaaaagcttcggcagcgaatgtgtcttgggtaacttcaactgcgaacattcaaccactctgaaagtggtcaaagctggggaatgtccaggaggtggcagcatccgtcttcaataaataataagacaaattctatataatgaatttatttcaactatttgaacaataaaaagctaataaaggaaaaaaaaaaaaaaagggcggccgctcgcgatctagaactagtatcagttttggaactaacattgatatgaagacattttcgaataatacaattgagagtttgctgagagctattcaaaatctaccacagcggtttatctggaagtttgatgcacttcaagttcctaataaacctgataatttgttgatttcaaaatggctacctcagtcggatattcttgcccatccaaatgtagtcgcattcgtttcccattccggacttataagtatcacagaagcagtacaccatggagtgccacttgttgttgttcctatattcggtgatcaacatatgaacgcccttagagctgttgagaaaggcattgcagttaaaattgaattctctaaattggatggagacactcttncttggcggagttcagaaaatcataaatgataaccaataccaaaagaatgccaaggaaatctccaagatgttcagagatcgacccgttcatccatgggacttagcggtacatac

SEQ ID NO: 2970 - DNA, 1000 bp, Diabrotica virgifera
ctgcgccgtggtcaggagtgtttgcactatctctactctactagtgaaaggtgcagtcgccgcggtacatattcggatatcgcttctcgtatcgggatgaagcaagtgactttgatttttttgttcgccgggctgctagctgcggaaagcgcgaatattttggggatttttgtggcccaagggagaagtcaattccttttgggggagaggttgttaggggaactggcgagaagaggacataatgttacacttttggggaaattcgtgcctcaagaaaaacatgaaaatttgcatttaattcgtgttaatttgatggaggaaaattcttttgattttctgtcgtgggaaactcaaaatgactttgagcatgtcaaagctatacacgacaaatggcttaagataacagaaggattgttcgatgaacaactggttaaggatctaatcaattcaaacagtacctttgacatggtcatattcgaatcctttggaagtgaggccgcaatgggttttgcaaagcattttaatgcttctttggtcgtatttaattctttggcaatgaatgagtggtgcagcaacctcattggaaatgtaagaataccatctataacaccttacagtttaacccaaaaaaccagcagcatgacattttatgaacgtctcacgaacactttacttttcctatacgacaagtactacaaagaatatgtatattacccacagcaacaaaaaatattgaaacaacactttggcaatgaaatggatcttcacgaagttatgacaagtactagcttcctccttctgaactctcaccccctcaccactgaaccttctttgcttaccagcgctgctgtagaaattggaggattccatgtttctactagaaagtgcctaacgatatcaagaagttttagacgatgctaagcatggtgcagttttaatcagttttggaactaacattgatatgaagacattttcgaataatacaattgagagtttgctg

SEQ ID NO: 2971 - DNA, 964 bp, Diabrotica virgifera
  misc_feature (517)..(517): n is a, c, g, or t
cttgaaattaaattggcccctgcacttcaagatctgtcccaaaataagactctccatatcagtcgctccaatttcgctggcgacttcctgatagccccattcctcttgcaacctcctcttacatttttctacgaactccccaacactcacatgctcgggtgtcgtataaaatactttgctggcgaacgatccagctttctttttactgacaggagattttcctcctccccagaaaattttctctctctcgtccgcccccatggtagtaactggaagcaacgagaactccacaatcttctttggcaaaccttccgacactgcctccacaccttcagcctcatcaacccacaaactctgtccagggcagtctcacccattcgtcgatgagatgctcaatctcattcacatgatcacccaaatcgatatcctccccaccaagagtaaaacccaatccatcccaggttcctaaatcatcgtccaagagcttactggctattttcttagccttttcactctntgcgatgtaaaatccatgttcggctccattcattatctcctctatagttagaggagtctgctcggtcttcttatagaacccggttttgtccaactttccgctttcctcacgacaaaatctattgaaatcttcatatttttcaccgaaatctttaccggtgaaatatagatttatccacctcgccgtgacgcctgcttgcgacaccgcagcctcagagacctcagtttgcgtccttagacgctcttcgaggtacctaattcctgcaaaattaagtgtcgtttgggcttcaaattctctactccctatgttgatcttacaaacgatcttacggtcgtttatcagggtcaccactctaccccctttcgctctgaacagctggctaaatgttaaaccaaaattacacattatgacgagctgagccaaaaactcggaaatctctaactgaga

SEQ ID NO: 2972 - DNA, 936 bp, Diabrotica virgifera
  misc_feature (835)..(835): n is a, c, g, or t
tgttgcttaggtgatagtgttccgtgtatccagtttccgtgttaagatgagttttagacaaaataatctgccggtggggcagctatacgactccaggtactcgccagttcaggctagatataattatacgaaatcaattgaaaaaatccattcggagcttaaaaagaaaaaattagaggaaatcaaaaaactaaaggaggaggagaaaaaaagacaaaaagaattagaaatatatcaaggaaaatatacacgattattttggaaaatatggcacaacacatttggtcatttaggagaagactgggtgttcttagcatttctaggaattattgtagctgttataagttacacagtagataaggcagtatggttatgtaataacggtcaaaaatggctttacgcagatgtagcatcaggaatgtttgcaaaatgggttgcatgggtggctttaccgttctgtttaattatatggaatgtgggtttaacccatttagtagctcctcaagctgcaggttctggtataccacaaataaaaaccagtcttcgaggtgtattcatgaaagaagttttaaccttcaggacactactcgtaaaatggttaggaacaatggcatcgataggtagtggtcttccgttgggcaaggaaggacctcttattcatatgtcaagcatcattgtaacgaaactcagtaaagtgatgtctaattttaattcaatatatatcaacgaaagtaagataattgaaatgttgggagctgcttgggctgtaggggttgcatgtaccttcaacgcaccgaataggaggagtactcttcagtgtcgaaattaccacggnctattatgcagtcagaaattataggagaggatttgtcgcagtcgtttggggagcatcatctacagctcttacttgtttggatgacggagcaaaacgatact

SEQ ID NO: 2973 - DNA, 1268 bp, Diabrotica virgifera
gctcagcataacctaggaaatcttaaaaatgaatattattttaaacagttttatattatttttttaactatagaattacattgcgactagtgtttctaaattagaccacaatggctttaagtcgaatggtaagattagtacacttaggttcaaaagaaagtatcttcttgcagcgtggaggtctaaaatcggggaatggaaacataagaacctttagaaatggtagaaaagtcaatgatgaaccaaaaatcaaccccgaaagtttagctactccatttactaatgcgcatattgactgtagtaacttacgtgcaggaagtctgtttaggccgtttctatttacagtagcattttcaggatcatgttttgttggggctgctatttgggaatatgaaaacatgcgaagtcgtgccaaaatgcagttacgaaagcccatgaagttttttaggaagagcatagaccaaggagttcattcaacaaacaccctcatcagggatttcaaaagttggtggaatcggctgaccgagggcgagcgtatttttgctccaatatgtgtcctgaacgtactagtattcttagcttggagaattcctagatttcaaccgatgatgcttagatatttttgttccaatccagctagtccgaatatctacgtgcctatggtgttatcaacgtttagccattattcggggttgcatcttttagccaatatgtatgtcctccatagtttttgtacaggagccgttcacagtttaggaaaagaacaatttctgggtttttacttaacagccggagtagtatcaagttttgccagttatacatataaagtgctgacaaggcaacctgggctttcattaagcgcgtctggagccataatgggaatcttaggctacgtttgtactcagtatccagatacaagactaggaatattttattacctgtgttcaacttttccgctggagctgctattaaattctccgggggcctccataccgctgggggtcaactagggtggaaaattttttgaccaggctgcacattttagggggggccgccctgcggaaaaaaagggggggggagggggcggcaaccccaaaaaatctggtcacaaaactttaaacccaattttctcccaaatatgggaattcggttaaagggggggcgggtgaaatttgttttatatttttttttttataattttttttttataggggggggaaaaaaaaaaaatatttttattttttttaaattaaaatatataatataat

SEQ ID NO: 2974 - DNA, 916 bp, Diabrotica virgifera
  misc_feature (687)..(687): n is a, c, g, or t
  misc_feature (813)..(813): n is a, c, g, or t
gtaagtaagcatgttggattggatattttatattttagtctaattcaataatttgaatgggagtgttggttccttcttgaattaatgatatataataaatagatataaaatgctacattatttaatagcagtaacatccattctgtttatattatgtgtttcggcaagtggtcaacttttagaaggaatatattgtggaaaagagaactgctatgatgtgttggaagttacaagggagacaaccaaaaatgaaatatccagaagttatcgaaaactggccagacagtatcaccctgatctgcacagaacaccggaagccaaggaaaaggctgaagaaagattcaaaataattgcaaatgcatatgaaattcttaaagatgaggaagctagatcagattatgattatatgttggataatccagatgaatactacgctcattattatagatattatcgaagaagagtagctcccaaagtagatgtaagaatagtattaatagtgacaatttctataatatcaataatccagtattacagtggttggcagaaatatgaccttgctattaagtactttatgactgtgccaaagtatagaaacaaagcgctagaaatcgccaaagaagacgggcttctacaaaatgataaaaagcagaagaaaaataaaaaagagttaaaagaagaaactanaaccatcataagaaaagtaatcgaagataagatggatattaaaggggcttatgccaagccatctattactgatttgctctggatacaattaattatatttccgtatacaatagtaaaatatatttncttggtatgtgtcttggtattggaggcatagtatattaaaacaaccatatagtgaagaagaaaactgtacattattagaaatatatgaaaatgagtgaacatc

SEQ ID NO: 2975 - DNA, 2340 bp, Diabrotica virgifera
gatcataaggaaagttccagtcgacaaagttaaggtttaaaaagttaattctagataacgcgttttattaaaattcaggtttgttaggaagttagaagtagtttaagtagctgtcataattttataccattttttgttaattcctttgttttgcacgttttctacactatccaataattcgccaccatgtcagttaccacaatgaacgaacctcctagaatttactatgaagaagaaagtcagtcagacaaacttctcaggaaatctaaagaaacacctgtctttccaattgctattggtatttgtgctgcagcagtaggatatggaatatacgcctataaaaacaaaggaaaaatgagcacaagtgtatacctaatgcaccttcgagttggagcacaaggagcggcagtaggatctttaacactaggtttgatatacacaatgatcaatcgacatttcctgaagaaaccagaatagttacctttaacaaagaattaatgcgctcttaatgttgtacgatgtatctgaaaagtattataaaattatcatttttaacaatgtagtaaactagggattgattataaaaacgttttcaggatatatctatattgtttatgaacaattctataaagtctattaaatatgtatttaaagaaaaaaatgttgatctctaacgaatagaaacgtaattaagtattataaaattataatttcaaaattattattgctagggctactatttatgtttttgttacttttttattaagtagacataaatgtaaaagataatatcaaagaaagatactatacatctggaaacatttatttttttgtgattatttttgctcaaataccatgccatagggtgtaaagaaaacagaaactttagatgggctggtcatgtagtgagaatgaagaccatatattgccggaaaacccctaaattgtaaaatgcagggcacaacaccaaaaggaaggccacagtaacggtggcaatctgatcttactgaccttcatctccactttcctcacaatttacagttcatttttatctttacaagtatgtcttgcagcggtatcgggttccatggtttccagatggttaaggctgtgttgttcctcttcatctgtttgttcctagcctgttcttgtcccaagagaagctaggaaacggatgttcatgccagaagaaaactaatgaactctaggtgtcattcaatgacaccttgagttatgccatccttagcttccacttgtttgtgttcagctcacttaattgacagctacaaccatcccacagctctttgaggttgtcgcattactagagttactagaaactttgacagcttatgtttaacatccagtgttttaatgattgttgtaatatcatgatagagatcccgtcatttaggtaggcactaatttgcatattatggcgcatctaaaaatggtccaagaaccgtcttaaaaattggtgattggttataacattgaagtattgaaattgtttaatgctaaggagtggctaaagaagaaacttcaaattttgacttctatataagtgcaataatatgcaaattagtgcgttcccaaatgacgagatctttatcataattatgagagtaggttggtttaggacaactatctccaactaactaggtacatagtaaatttagtaattatttttttgtaatgttggtaaaattgtgatatcgactagatatgttggaagtttggtacaaccaggggcgggtattcatagccaatactaattgtaacttagaagtaaaaaattatccataagcagttttttaacattaactgaatcgattaaaacactaaaacaaaggtttaaatggttattttcaaaattttatagttttttctacaatttttgtattctgagaacaattttcaaagtgaaaatagaaatgtcaaaggtaaaggtaaaaataccatttggaaaagaaaaatttttgttgatgtgctatgaacttggctattgtgagcaaaactgtgaactttaatggttgtatgataattgttgatgattttaggaatgtacaacttgccattttactcaaatgtataactttaataaagaaaacgctttaatatctcactcatgtttatgaatgtaacttggttattgtaatctgtgatatgcatatgaaaaactaactgatagttacatgtaaagttaaaaatgacgttttataattattaacagaaacactgtattaaaattacatagatttattgtgtacgtttacagtagttgttaatgttactttaaatattaatttatttttaaaatatatgatttactttgatataaaa

SEQ ID NO: 2976 - DNA, 1053 bp, Diabrotica virgifera
acccacgcgtccgcccacgcgtccgcccacgcgtccgcccaccttttcgatcgggcatcctgaaagatggttgagaaaaaggctgtacagaagcccgctggggatgcaccaaaaaaggtgcacaaaccaggaaaacctagaaactatgatttgggaaatggagtactcagattctctaggtctaaaatgttccacaaaaaagcattatacaaattcgttggcaagaaagtagaagctaccaagaaacctcaaaagccccaggttattgaaaaaccaattggtggagagaaaaatggaggaaagagatttgttttggtcaagaaacgtagagcatcctatcctacccaagacaaaattaaggccaggccagctaggagaacatttagccaacacacgaggtctattagaaatacaatcactccaggaacagttctcatccttttagctggttctcacaaaggaaagagggttgtattccttaaacaactgtactctggtctacttttggtaactggaccttttggaattaatgcctgtccattgagacgtattagccaacgttatgtaattgctacatctaccaaaattgacgttagtggagtacagctgccagaaaacctaaatgatgaatattttgcaagaaagaggcagaagagatcaaagaaagaagaaggtgatattttccaatccaaaaaagaaggttacaaagtaagcgaagataggaaagctgaccaaaagaaagtagatacacaagttctggctgcaatcaagaagcactcagaccgcaaagtacttttagcttatttgtcagccatgtggggactcagatcatcacagtacccacacagattgaagttttagataggataccataaattgtttatcttttgacttgtatagagaggaaagtgataaataaattatggatttataaatgaggtttttttatgtgactggtgttataatacaataatttaattctttattgataataacgacaaaatgaagaaaaaaaaaaaaaagaaaaaaaaggggaaaaaaaaaaaggggggg

SEQ ID NO: 2977 - DNA, 1082 bp, Diabrotica virgifera
  misc_feature (262)..(262): n is a, c, g, or t
  misc_feature (281)..(281): n is a, c, g, or t
ttgaaaatttcagtccgcgcagcaaattttacaagaagttgcaacccataaattggttataaagttagtgcagtttgcagtaatttttattttccagagtatttcttgaatatcgtatgtccatccagaatctaaacacattcgacccatttgctgatgcaagtaagggtgcagatgatgatgttcaagacggccttgttcacataagaatacaacaacgtaatggtcgcaaaactctgactactgtccaaggactctctanaaaatatgatctgaaaatnattgttcgggcatgcttcctctttctttcatttgtgaaagtggctcatttgtaaaatttgctgcgcggactgaaattttcaagaagttgcaacccataaattggttataaagttagtgcagtttgcagtaatttttattttccagagtatttcttgaatatcgtatgtccatccagaatctaaacacattcgacccatttgctgatgcaagtaagggtgcagatgatgatgttcaagacggccttgttcacataagaatacaacaacgtaatggtcgcaaaactctgactactgtccaaggactctctaaagaatatgacctgaagaaaattgttcgggcatgtaaaaaggaatttgcatgtaatggaacagtaatcgaacaccctgaatacggcgaagtcctacagttgcaaggtgatcaaagagaaaacatttgccagtggctgacgaaagcaggattggcaaaacctgaccagttaaaggtccacgggttctaatgtaccttagaggtgataattttaatctacgtaaatgtcagatgtcgcgcttttatttaaatcacggaatttttaacagcatgtgcccattcaggattgctagcagctagcagttagcaattttgtacaataattttataattgtgcctttccataaatacattagttctcagatattgtgtttttcatttgatgttgactgtgtttagtttttaatgattttcaagtaataataaatgtctggtctagcgaaaaaaaaaaaaataagaatattgttaaatgcacttaaaaaaaaaaaaaataa

SEQ ID NO: 2978 - DNA, 1114 bp, Diabrotica virgifera
  misc_feature (942)..(942): n is a, c, g, or t
tcacgggccgacccaagcgtctacttcgtatgccgtccagaaggcatcaaaccacttccttcgtggtctccctcttctttccttctcttattctactgcgtgcgtctcttaggacgtttctttcttttggcattcgtaaaacatctctcaaccatctagcagtctgtgccctgatatttgtgttactttgggtcgtttatatatccattagctcctggtttgtttttctgcgccattccccgtcagccttcattattcaaacaaaaactttagatctgcagaatctgacaatcccatctgcttcaagtgccaattgagcttacagtgccctgttaacagcccttctgtggctttgactgttttcttgtctttgcttattaggtctgccatatattttggtgaatgttctgtaatgaactgttccacctgtctttgtcctggtgaattcctccaccattccaaagatttgtaagctacctaccctcttgtagacgttcttactcgttcaacgaatgacattgacgagtcatgtttggtcatttggccatttttccattccaaaaacagcgtacctcgcgtttctggacaatcgagtggtatttgccttcttcaatggacttttgcatctttttcttcactgctttgactgttcattggacaggtatcatcgcacaaaatcttttgaattgcgttttaacgttgtaaaaaaattctccgaatccaacgctcttgtttgtttttggttgagagtgatcaaactcggctcaatttccttgaacagttcttatatgcttatcaatatgtttagagcctcttaacgattttgattctttgatctgatgtgatcacatcttggactctgggtcgtgacagtttgtgagactcttaaatctatcatcagacgacaacgaaaaaattctgttttccaaaatttcactattnggttatgacggtgctctccgtaaagtagttagattaatgtcaaatcaccctcacagattgatatattaaattttggctcgggataataataattaaattttgtgtgataaaatttatttttataaaaaataatataatacttaagcaatatactctaacagaataccctgat

SEQ ID NO: 2979 - DNA, 1153 bp, Diabrotica virgifera
aaaaatcttatattgaatcatttttgtgtacaatattattttcccggaacaatcaatttgaacaaaacttttcaactaaaataaaaaaaagactggacccattagaagctttcttcttctctgcttgacatacaataaacaggtcaaacttgatactcccccacagaccaacaataacacgttgggagagaagaaatgtttttattattaaatccacatttactgcaaaattcgcaattttttgcaaaattgcaaaactacacaaagcggattgtagccatctaagacccacaatcccaatctaattttttgacataaaatgcatatgctcctaacttgacatcaatctttgaaaatatccagaaaagcgcgcctttcagagtttaataataaaaacaatatatacgtatagcgtgtaaaaaaggagtaattgggaggagcaactgaaataaacacaacgggagtaataaagtataacactaaagtcccgtttaaataattattatctacaatacaggattcttaaatatattaaatgggcgctaatatgtatttgtggaacaagatgtaataacatatttaagcctccaggtccaaggccaaaccaatcttgtgaccaccttgattgaagttcttgccgtcgatgagggtagacaaagttagagttacaccatcacgtagtttttgttggtatcctaaaccgatttgactggcgttgttaatcttagcgcgaagagatgcgtcggcgtccaagtcatacttgcagcccaaaccgaagtcggtcttttctccgctagctgcccaagacaagttgatggctgtttccaatttggggttgattttttggtagatggaaccgccaaacgtttggccgtcgttaacacatgtatggagaacaaagtctgatgttgaaaatcctaatgcaaaattgctcttggccaattttgagttttgaacggcaaaggcagcctggtaaccagccaaccatccttgatagcccacgacagccgaacctcttacgacaggtccgttactatttaagtcaacatcggcgttgaggtgtattctttcgttgccgtattcagacttcacaactcctgactggtatccttcttgtggggagaagttaacattaccagagaccttgagtccc

SEQ ID NO: 2980 - DNA, 1552 bp, Diabrotica virgifera
ctttcttcttctctgcttgacatacaataaacaggtcaaacttgatactcccccacagaccaacaataacacgttgggagagaagaaatgtctttattattaaatccacatttactgcaaaattcgcaattttttgcaaaattgcaaaactacacaaagcggattgtagccatctaagacccacaatcccaatctaatttattgacataaaatgcatatgctcctaacttgacatcaatctttgaaaatatccaaaaaagcgcgcctttcaggggggggttttaataataaaaaaaaaatattcattttttttgtttatagggtgtaaaaaaaaaaagggggtgttttggggggggggcacaactgaaaaaaacaccccccccggggggggaaaagggaatacacactttaaaagttccgttttaaaaaaatttttttttttccaaatccgggatttttttaaaaaaattaaaagggcgctaatatgtttttggggaacaagaagtaataacatttttaaacctccaggtccaaggccaaaccaattttgtgaccaccctgattgaagttcttgccgtcgatgagggtagacaaagttagagttacaccatcacgtagtttttgttggtatcctaaaccgatttgactggcgttgttaatcttagcgcgaagagatgcgtcggcgtccaagtcatacttgcagcccaaaccgaagtcggtcttttctccgctagctgcccaagacaagttgatggctgtttccaatttggggttgattttttggtagatggaaccgccaaacgtttggccgtcgttaacacatgtatggagaacaaagtctgatgttgaaaatcctaatgcaaaattgctcttggccaattttgagttttgaacgtcaaaggcagcctggtaaccagccaaccatccttgatagcccacgacagccgaacctcttacgacaggtccgttactatttaagtcaacatcggcgttgaggtgtattctttcgttgccgtattcagacttcacaactcctgactggtatccttcttgtggggagaagttaacattaccagagaccttgagtcccttaataccttggtctgaaatggcgatctcagtccccaaagtattatttgtattccatttttctgtgaaagtcaatccataatctttgacggtgtatttgctctccaaagatccagacacttttccagattcatggtctgaactaccacctgtactaaattggaccccactggctgttttggttttgcaatttaatttaattaggccaaagtgataaccgttgccgaatacgtctcttgctcttttgccgaggtctgcgtatggtggaggagccatttcgtattattaatatgtaaaataaatatatctcactaatttagaatttacaaaaatactttttaaaatacttcgacaatgtaattcaactttttttaagtcacaatttttgcacagaaggtaacgaggacgtgaccacaacgtgtgtctgttctttcacagtttgttcttgcgcgaaaggggaccg

SEQ ID NO: 2981 - DNA, 1066 bp, Diabrotica virgifera
cattttgaatttttgaatgtttttgaacgagaaatgacgtatggcgtgttatttgtttttggtttcaatttaaagggatttgaagtttaatttcattaggtttcttctgtttaaaatagtgtaaactttttaataaataaaaaaatgtcacagactggagttaacctcaagtagtgaaaccaacatacaagaaatcgaattaagaagagagttagaacgcgaattgaagaataaaagacaatgtacatatcaaccttacgagtgtagccagttgtgtttggataattatcaatactgcatgaaacacattcttaatgataaaaatgctccctataaacaatgttcctttacatacaatactaatggtaaaaaatgcaatttacctgctccacgaagtgataaaaaggattttgggtactgtagcgaacatgccttgaaggttactctgacgaggaatagacaaaactcaaagcatcctctgccatgtactgctgaggtattgttaagttctttgtcacattatgtttacaaaccaagaaatagaaacagttcatccagtacccagcattctgatgatgatagagttactcctgattctgaattgaagtctgctaaatgtttagatccatttgttgatattgatgccagcgtggtccagggtgaaaaatgtagccgcatattggatgtctgcagtgaatcagaaagtgatatagagccttccacattgtcttctgtatggccagacatccaggctgatagttctgatgacgagagcattgattctgaaaatgaagatcttttaaagcatgccaatgtatatacagccgaagaaattactttactagctagagataaactaataaagttgcagtcattgtatattgaacagtatagatatctacaatatttattaacaaagaaaagaagaaagtatttgcatttgttgaaacgagagaaagaaacatgttgtaatatttataatcaagtgcgtgataacccaaaggaacagagattatataaaaaattaaaagcgttatataactatcaaaagtgccatggtactgat

SEQ ID NO: 2982 - DNA, 893 bp, Diabrotica virgifera
acattatcaggtggaaatgtgattctgagagaaattaatgttttttaatactctaattatatttttgtaactagttaattgcattttattaagtacaaattgattattcacttacacacagcaatatacgtaggtgtttaaaattataaggtttagaaaaaccacttcattaatatcacattaattgataaggatataaattattaatatattattaaagtagtgtcaccccatttcctacgtaatcacaatgaccgacaaaaaggaggatgtaccaaaaactaacgtagatgaagaactatcgaatctcttagacagtgcattggaagacttcacaaagatcgaagctactcaaaaggatgccaagactgacacctccagtaaagaggttagtacttcaaatcaaagtgccaacattgagggtcaagagtggtctaacgatttcatacaacaggcggcgaatcagttcgaagaaaattttgctaatttcctagctggagctgatccaaatgcacaggtcacacccgaatttattcaacaaaagttacagcaaatggctgatgcagctcaacaagttctcgaaaaccctactcaggcagctgataattccgtggactttgcatcatctataacccaagccatacaatctttaaatgctggagctgaaggacttcaggccccattgaacgaggaagaactaatgaagatgttcactggggataaaactggccaagaaaatgatcttttaccgtttatgcaaggtatgatgcaaggcctactgtcccaagaagtattaggaccaagcctagaaagattttgtacagagattaccagaatatatcgaaaaaaattaagatactttagataaaaaagatatcgagcgatatgagaac

SEQ ID NO: 2983 - DNA, 861 bp, Diabrotica virgifera
gcggcggtgaatcaagggcctcagcatcacacagtttccgattcgcaatacgcccgccccataaaggccactcaaacgcagagtgcccctcctccacccaagcagaatttggattctatgctaggaaacctccaagcagacatgagccgccaaggagtcaacaccagccaaaagggatgctgcagcgcctgtgacaaacctatcgtaggtcaagttatcaccgctttgggcaagacctggcatccagaacacttcacctgcgcccattgcagccaggaattgggtaccaggaacttcttcgaaagagaaggaaagccctattgtgaaccagactatcacaatctcttcagcccaagatgtgcctactgcaacggacctatcttagacaaatgcgtaacagctttggagaagacatggcacatggaccacttcttttgcgcccagtgtggtaaacagtttggagaagaaggattccatgaacgtgaaggaaagccatactgtcgtgacgactactttgacatgttcgccccaaaatgcggaggttgcaaccgtgccatcatggaaaattatatttcagcgcttaacgcccaatggcaccctgattgcttcgtatgcagggactgcaagttgccagtacaagggaagtcgttttacgcagtggaaggcaaaccagtttgtcctggttgcattggagctgatgaagacgaagacgagtaaatgcgccgcccccaaaatatgccctctatctatacgccccctccccgaaatgatgccctctaccccttgaattttattgtataaagtatatcgtttgtattttattttattaaataaaacaaataaaaaaataaaacccccatt

SEQ ID NO: 2984 - DNA, 973 bp, Diabrotica virgifera
aaaaatactaataaaaaatagattgcagtctactgtaaatagttttaattacatcgtgatctaaactagtgtacgaacttttaactgattataaccatggatgaccacttagatgctctgcttgccgatctccaaaatacagtttcaggatcatcaggaataggatcaaattattctggatatggccagagaaacgtccggtattctcccgatagcgatggacattattcaaaaacagacagctattcagtgaaatctggaagttacgggaaggtgccgccaaattccggtaaccggagtccgagctacggcctaaacgcaactgctggtcacagtgcttcgtctacgatggagaaacgccctttcaacaacaatttagacgaattagattccttgcttcaggatttgagcaatagtcgacaacatgcttcagaaaatatgaacggtagtcactataatggtgccattgccgattatggaggtcgtagttcagctaattattctagaccatccagcgcacaaagtactctaaataggccatctgtagacagcttacttgatgagttaaattcaggagacgtcatttatactgggcctaaaaaagtagtgataaccgtgaaagaaactaaaacggagactggatatcctggcgagacggaattaatatcgtctcatgtcactcataccgcagcttcatccgcaactagggaacttgatgatctaatggctagtttgtcgaatattaaggtgaatcaagggcctcagcatcacacagtttccgattagcactacgacagccccataaagcacactcaaacgcagagtgcccatcctcccccccagcccccctaaaaaactatgctaggataatttctgagcaggcaagagccccccaggaaaattcaggcccccccccaggggagtacacaccccccccccaaaagggggggttgggggggcccggggacaaaac

SEQ ID NO: 2985 - DNA, 1192 bp, Diabrotica virgifera
ggggggccccccccccccccaaaaatttccaaataaaataattacacaaatacagtgaatatttggtaaagtattttgaaaatcccacgtgtatttataaggagaaaagacaatcatatgatttttatcatcttcgggtaaaataataaatcctatatattttatcatcctcagacatgtttttcttatctaagaatatgctttaatgtcttgcacataacatttttgctgagttttacaattcagcctaaccatttattcattacacatcaaatatctaacaataaatgattttgatataaattaaaacaataaataataaataatgcttatttggcttttccttgggcagctacagcttccatagcctttttcacagtttctggatctcctaggaattctaaactctttattggtttcaaattttcatctaatgtgtagacaaatggaattcctgttggcaaattcaactgcataatttggtcatcagtaagctggtctagatgctttacaattcctctcaaactgttaccatgtgctgcaattaagatctgttttccagccttaatttgtggaacaacagtttcattccagaagggtaaagtacgctcaattgttagctttaaggattcaaatttaggaaactgatctggtgcaggaccatcagcatatcgggcatcttttacaatggtatcataataagcatggtcaggttccattggtggaggtggaatgtcaaaactgcgccgccaaatagctacctgctcatctccatattttgctgctgtttctgctttatttaagccagtgaggccaccataatgtctttcattgagtctccaagtttttatagtttccaaattctcttggccaatttctttgattattgaattaagtgtgttctgagctcttgtaaggacagatgtatatgcaatgtcaaatttgtatcctgcattttttagtgcttttccggcattaatggcttcttgtttacctttttcacttaaatttgcatcaaaccagccacaaaatagattcttttcattccattctgattctccatgacgaaccataacaattttaaagggtgccattattattatttagtatttttacgttttttttcgttgcggttatggggcaccttactagcgataacctgatcgctgtgcccttctatgtggctgtggac

SEQ ID NO: 2986 - DNA, 471 bp, Diabrotica virgifera
  misc_feature (347)..(347): n is a, c, g, or t
cctcgtacgccagtcacgagaaaatttgtatttcattgcccccacatttcaaggttgctggattcgccgttgtacaatctacatgtttgaccacgaatttatcgtacgaccctcgtattatgcgattaaaaaccaaaaaaacagtaaaacaaacgttctaaaaaatttctagagctttcgaaccccttggtactgaattatattatttatgactgtaaacacgaagcgaagataagactcgttactaactactgatacgtgtcatgaaatgtcaaggccactatttttagttccaaataaatattatattgttaagaaatttttaacttccagaaataatttaacanattaacaggtagtttattgttatttatagttaagtattaattgaaagctacgtcacgattattttgtgcaatggtttcccatgttcatttattcacaagattcgtggtataaaagattttaatt

SEQ ID NO: 2987 - DNA, 407 bp, Diabrotica virgifera
  misc_feature (373)..(373): n is a, c, g, or t
cctgaagtagaatgttcagctcctgaagatattctttgtgagaaaaattttgttgagaatgtttgtcgagacggctctggtcgttataccgttgctctacctttcagagaattatctcctgtttttccaggaatgtttgagttagctgtaaatcgttttctttccttagaaaaaaggcttttgaaaaatcctagtgtttatcaggaatattgtacctttatgaaagattatttggatttgcatcatatggagcttgtgtcagaaacttctcgtccattatcttgttactatattcctcaccatgctgtattaaaacctgatagtttgactaccaagttgcgagttgtatttaatgcttctgctcgaattgganatcagaattctcttaatcagtgcttgtttactgg

SEQ ID NO: 2988 - DNA, 404 bp, Diabrotica virgifera
tgaataccacaaaaaaaaaatgacagggcataaaaagaatgagagaccagttagtgctttttctacaataatacaccatgatatgtggctcaataatacaatgcaaaagattgtaaatggagttacagttaaaaataaagtttgcgatttccaaatgtgtgaagtcaattctcctacgatcgatctaatgctcttcctttttagcagtgtagaattacgctgtcttgaaataatgtagataacttaatcaaattctatcacgaagaacttgtaaatatattgaaaaaactaaacgtatacagcgaagaatattgtataaaaaacttttggaagattctacgattaattgtcaagaaagtatgttccacgcattaatgatgatacccacaattattttaagtgac

SEQ ID NO: 2989 - DNA, 307 bp, Diabrotica virgifera
  misc_feature (214)..(214): n is a, c, g, or t
  misc_feature (246)..(246): n is a, c, g, or t
ctcgtgccccgaaaaaagcggttatttaaaaacaaaatctttaattttcaactaaaattttagataagtaattgttaatcaataattaaataacttggtaatgtaaaagcccttttcgtatagattataattcctgaagccgatggaaattgagtgaacagtttagcaacaattaaattgttaattaaaaattacggtcgctataataacgacnataattatgatgaataagaataactatgattntttcataaaaagacactataactatctaatgtactttacagaattgaaatgggactatttg

SEQ ID NO: 2990 - DNA, 475 bp, Diabrotica virgifera
acccacgcgtccgattttttgaaattagtacgtacaatgtctaaaacgattctcattttggttttcgtgtcctgcttcgtagcacatatccaatgtagaatctttatagattgtctagatcctgataatccaggatacctgcaatttgacaaacaaataatagcctcttttcctatgagtatttctgtacattttcctgcaactggatatcaacctgactcagactattcgtgtttaaagataaactgcgataaagatactacagtgacgctaattgacggaggagttggattcagatatgcaaacattaaagttgattttaaatcgtggcaaacattaacctgtggaattcaaatttatactttacagccagaagtttcatccgtttaaatgacaatctaaattgtttttataaaaaattgtcccatttcattttctattttgaaattccataatttaaaattattacactatg

SEQ ID NO: 2991 - DNA, 959 bp, Diabrotica virgifera
tgcaatttgtgtttgttttgttcgcttgtttggtaggtggaattctggctggttacccagatcattcttctggaaatgacataggaactgccaacaacaatggaaattcttacgggtatggttattctggcagtttttcaggtccaggtgctgctcccgaaaatttccaatttcctcaggaattatccaacttgttcaagactttaaataagtatcaggaagatatatttaaaaacttccaagcgcaagcagcatcagttcaaaataatttacaaagcaggggcagctttgctgatgcgggagactcctcttatgggggtggatacggagggtcatttagtactggaaatggaaatggtcaatcatttgggggatccttctcaagtgggtttccaggagctggtggtggtcctggataccaatttataccaggaccttctgtaactgggtcgtttactccagatgccaatggcgcctccgcttttggagtcattggaccaggaggtattcaacaaggagcttctgtttttcccgaaaatgctaatgctcccaacgtaaatgtaaggttctcctcagatcaaccagatggattcaaaagtgtctacacatcaagttccagctacaccaccaacgtggatggaaagcctaaaactgtccaaaagtcctctacgactgtgaatgacaatggaaaagtcacaacgtatgaagctcacaatccataagaaaataattttaataattattaatgaaaaattaaaattattttcttgtttattcaatattttgttcgtttatttgaattaattttttatccagtatacccaataaaaaatatctacatatatagtttcagtatttaaattataaataggcgatattttgtgtgtataataaaagtaatttctaataaaaaaaaaaaattcattgcacactcttaaggaattactgataggctatca

SEQ ID NO: 2992 - DNA, 2262 bp, Diabrotica virgifera
gatgttagctacaacttggctgctgacgacgctagcggaagaaacgtcaatgccgatttaaatgtaaaagtttctaaagaaggcgagagaagagtactagatacctcaaccaaaatctacggatctatattgaaacaagccctcaaatcaggattagtcttcaagtacacagtcgataatggtgaattcgaaattacttcatcatatggtcctgaagttaatggtaaacttggcggaaaatacgatgttagagatgaaggtaaacctgtttctggagaacttgacatcgaacttttgttgcctagccaaaacttgaaaactttgagatctaaattgtctggatctgttctcctaccaagtgaaaaatctactgaaattacattaagcggagctgctagtatctacgctgacaacagagtttcttcggtcccattggtcgattttagcacagacggtcaagttagagcaagtgataaagatggagatcttaaagcaaatcttaaaacaaacaaacttgaccccatttctgtggttgccggatatagctgtaaagatctagggcaagaaaaacatcaagtaactggtaacgtagccttgcagtacagtaaaggcaaaaacttgaaattagatggaactcttacaaaactcgccaaacatcaatacaaattggaagcagaacttgacactccattcgaagccttgaaaaagaatcatttattggttgaaactaaaggctctgaggactatcagcaagtcacaagtaaagtagtattgaccaacgacggtaagaaatggcaactcgatagtgacttaaaatcatcagaaatctcaccattgattcatttgaagttaagatgtcccgaaggaaaacttactgaagttttgctaaaaggaaacaaagtcagcgataaagaacttgcttttgaatacagattgttatgtcaaaagaaagacttcttacttgaaggaaagttagatgctaatgtagcagacattgacaacttctatgttaaaggtagtatcaattctccaaaactcgaattaaacaagatcactttcgaggcaactaacaaaggtaataaagcagctaaaaaggttcaaattcacgtaaaatccgccgacaaaaacctcgttagtggaagtacaacctaccaggccagagaagaacacggaaaatacattattgaaggctcaggaacactaaaaattaaagaagaaaataaagctgccaacttcaaatttatttctcaagatttgacacaggagaagaatggagaacaaggattccaaatttcatttgttgcaggagtaggaaacaacgcttttgactccgaactaaaaatcaccaacaaacaatttagaattcttgactcttactgtgagaaaaacaaggaatgtgcccactttgagctcgattctaaagtcaacgaaaatgatgccgaaagatttagccacgtcttggaaataacccttgacctcaaaaaacttggccttccaaacgaatttggtcttaaagcagtcaccacaaggaaaggttacgttctggaccacacagttgatattcatttccaaagcccacaaaacagcaagtatcaatacagtgtatacctccaccctgacgaagctggagtctctttgactactccaaacagaatagtggctttagaaagtcaaatcagaggacccagaaatgttagactagctggaggtaaagttactgctgaagtatcattctacctcgacaaaaagaatcaacccaatcagaaagctagtctaagtggatggataaacgttgacgataaaggcaaaggagttaaatcagcagtttcattgtcacatcctggacttcaaagaccattatcaattactttcgaatctacgcgaggaggtcaaactcgtcttcccgaaatttatacgtccaccgtttttgatattttcgatcagccaagtcagaagatagtagttgattacacattcacaccagaagtcgccaatgacaattcccacgccgtggtttacaattatctattgtgtaagagcgttggtctaggtattaatatcgaagctactgaagaaataagagtcgacagaaaagcaatttctggagtctattggtcaagaataaaatacgtgggttggaagttccaactacgacaatctgatctccgttaaaggcaatagacaaggatcagaagttatcctcagattattaaatattgacttcctgaagatcgaaaacaaatatcaactgtctaatgatga

SEQ ID NO: 2993 - DNA, 473 bp, Diabrotica virgifera
  misc_feature (320)..(320): n is a, c, g, or t
  misc_feature (352)..(352): n is a, c, g, or t
atcttgaagtgtcaataaggactgtttgaaagattatgaccagaatacagaaatacagagctttcagacacagattttacatctccagtatggaaaattttaaagcaaaagcgaaagttcttataatttttcttttatttttttctgtcgactcgggaacaagttttggatggtgaggttgatatccacagattatctactctagttaaggggaattaatcacaattttatattgacgcttcgattttcacttaaaaattgtgtccaaaatacataaaatgttatgaatttcaattaaaattttgattaattcccattanataaaatagataacataggattcacacagaanatagtttcagcaccacatcgaaagatatttaccgaataattcagtttattaatatttaaaacaatagatcttaaaaccaattattaataaattgcaaaaaaaaaaaaaaacccaagggggg

SEQ ID NO: 2994 - DNA, 1240 bp, Diabrotica virgifera
ctcgaaacgtaagattcatttctaatgatgcagaagttaattatacttttgttaacgctaatatacgtgacttttgtgcagtgttatctagaagaaccgggtcctagatatcccccaactaaaggagaattatggccaaagccgtcttatcagataaaaaatgaaagtttctttatacttgatcctcgaacttttgaaataaagacaacaagttatacatgttcactgattaaagatgccatcgtgaattatgaatacctcattacaaaaggtggagtgtcagaaaagaataaaataaaggcacatgggaaaatattcgacaacacgtggttgcaagatccagcttatttgggaatttttgataaactcgaggtacgacttgatacgccatgtgatggaaatgagtatccatcagagaacatgatggaagcttatacaattagggtgtctgaacatgaaaagctaattaattcatcttcagtttggggaattctcagaggtcttgaatcattctcccaaatggtatatatagccgataagggattgtcactgagaattaacagaacttttgtggaagacgttcctagattctctcatcgtggacttcttttagatacatcccggcacttcatccctctagagagtattttacttacaattaacgcaatgtcatacaataaaatgaatgtgtttcattggcatatagtagacgaccacagctttccttacagcagtaaaaaatttccagaactaagtgagaaaggagcatacaccccttatcaagtatattcagatgcagatatacaggttataatagaacatgctagattaaaaggtgttagagtcattccagaatttgatacaccaggacatacaagatcttggggtgtgtctcaccccgaactattaactgcttgtggaggagaacttacaggaaaatatggacccatcgatcctactatagatgcgacttatgaatttctcaacgatctatttatagaaattcacgaaacatttgctgacagatatattcatattggtggtgacgaagtaggttttgaatgttggggaaatacctccaaaattgttgactacatgaaaaaaaaagatatacgaacttttgaagatttggaaagtttttacattaaaaaagttagtgatatgatagatagtttagaatatcaatctattgtgtgggaagaagtatttacaaatggcgttgagctacctaaggatacag

SEQ ID NO: 2995 - DNA, 1177 bp, Diabrotica virgifera
  misc_feature (1044)..(1044): n is a, c, g, or t
  misc_feature (1079)..(1080): n is a, c, g, or t
  misc_feature (1115)..(1115): n is a, c, g, or t
  misc_feature (1140)..(1141): n is a, c, g, or t
  misc_feature (1150)..(1150): n is a, c, g, or t
aacaagaacaaatcattttgaaaatatttcataatcagctgatggttttggttggttttcagtttccaccatctccaattttttagatgtaggaaggttgatgagtgtattttttgttaaattctaaatggcgagtgtagatatttccgtgggtatgtgttgaacacgagttacatattgggtttatgagggaaaattgacaatgagatgtaatgagtaaattcttaaaatttgggatatgtggtatagatatatccatagagctctcacatttaattcatgttcaaagaatgtttaatgcttttgcaaataccggcagtggcaaacatttaacattagataaattagtagtatcagttgatgtaaacaaaaacttatctgtactttatgacaataagccagaaaaatatcaagatctagaaaatatttcaaatcagataatacaacttggtttgaactcgtgtgataatagtcagataattattgatgaaaataatttgcattacaaaaatcaagtgcttcgacaagatacccttaaaaatcaagtcaatcaacaatataactacaataacaaagtcgcacagcgttattggtcatctcactatagtccatcattgttttcaaatttatatctacacagctacagtagtaatcaattatatcaaaaaatatccccatcatatttgttggtaaggcaatttcatactcaacaagtacagaggaagaaatataagaaacataaatatatagataactgtgctggtaccaatatcatgtccttaagattgtgggaaaacacatgtgataacgtcagtagaacccctggttttatttttactttaatgtcatacaatgttcttgctcaagatttagtggaactgcatccttatctttacaaggagcatgactcagcagcattgtcctggcctacaaggtggaaaaatctatttgaagaaatttctaagtttaaaccagatattctttgccttcaagaagtacaagaatcccacattgctgattattattcaactctgaagattttgngttacgatggtattttcaaaaagagaacaggtggnncaagcgacggttgtgctatctatttacaatcagancaaagtgaaatgctagactatactnntggcgcagntttaccagtctgacatagctgtattga

SEQ ID NO: 2996 - DNA, 1153 bp, Diabrotica virgifera
aaactagagaaatctagaaataaatgacgtgttcatatatctttggttgtttatctaccatcgttaacttcaatcaaaacgcagttacgatttcaaagagaaggtgaaacattgtattaaaattaaagtgaagtaaaataaagtagaacaatagcattgtgaatcgttgagaaacagttgaaattcgaacaagtgatctatcattttcattatggcgacagaatacgtgcgtttcagcccaaacgcatttctaaattcgtttaatgcaaaactagaacaaccagtccgacaacatctcaaaaatgtatacgcctgtttggccatgtccacaatgtctgctgcccttggcgcagcagtccatctcttcaccaacatcatgcaagcaggatttctatcagcaataggagctttggtattcttcttcctcttagtaaacacacccgatgacaatggcaaatcaatgacgacaagagtaggatacctccttgggttcacttttctcacaggagttggcctaggaccactgctagaacatgttatcttggtagaacccagtattatcataacagctttcgtagctacctcaacagtatttgtatcattctcagcagcatccatgttgtctgagagaggaagatggttatatttgggaggtactttgatgactatgttgactacgttgatggttctttcactcgcaaatatcttctttggagccatgtggatctatcagacgcagctgtatttgggattgttggctatgtgtggatttgtgctttatgatacccaaatgatcatcgagaaacgtagattgggaagcagagatttcgtagcacattcattggacttgtttgttgatttcattggaatcttcagaagactgctggtcatcttaacacaaagggaacaggaggcacaacgtaaaaagcgtagagactgaactgaatgaggaaggaggtttgcagtgagcgaatgtgatgaaaggatggattacattgtgatcatataatatctgtcaataaataatcatcactaaaactcccataaatgtagatttttatgtgtgtatattttttttaatttcttatattgttagtgatgtttttattaaaaataaagtttggggttttaaaaaataattggggggtttcgg

SEQ ID NO: 2997 - DNA, 357 bp, Diabrotica virgifera
caagctcctgccaaatcggcaagtatgatcccagttggcgcagtttgtctgttcaatgtctgcctaataaaaaaggtgcgttgacttaccgttagggaaaataattttttgggcttacaaaccaaggcgtttgttcttcaaatcggtgtcaagcgctccaataaagctagcttattgccgattgttgcagtatttttttgaaagtatgtaatcaatttaaatcatatcttttgtattaaaaaaataaaagtacatatgtgccattaaaggacacgtatggtcaaaaataacttccgtattgccaaaagatggtcggatctgtcacacgtggcatttttcagccgactcatgctttat

SEQ ID NO: 2998 - DNA, 969 bp, Diabrotica virgifera
agaaaatgaaaattgccaaagataaaacagaacttactaagaaagctttgaagctggcacttaagtactcgtttgttactgaggtgacatcattggttgtagtgaaacccaactctacacgtcccatatatgcagatgacggatatcttcgaagtgaaggacaagaatattcgaccccggcttttcacgcatacggaagaggtggacgacctgctggaggtcaacacaaagtagcatactccgccgtctcatccagttcattcgtaagcaacagagaatctgttgtacatgtacaacaaataccacgaccacgaagaccaagagtacaaacaacaacacataaaccaacaccactaccaacaccgactgaaacatctaaaaacgccacactagaagactctttaaaatggttgtcggccgctttaagtgaaaagaaaactttaaccgtgccatcaggtgaattaaaacttggtgatgattcattaaaaattgctgccactgaaacttgtccaaaaactcccgaaggcaaagaaggtgtttgctctctcattaaagattgccctcaagtattcccacaattgactgacttcgaagtatacaagaccttctcctgtgttatgcaaaaagaatatgctggagtctgctgcccaaagaaagctgaagttgctgcttaagaatattgttgattgttgttattttctaatgaaatctagaagttgttaaaggttatatttttataagtgtaatttttttttaaatatataaattcatttttcttttactacacacagaaaaaaaaaaccaatattcacctaaacaaataacttaggggggggccccttccttaaagaatcccaacgttaccgcaagctctgcatggaacgcctataagctcttcttaacggggcacctaaattttaattcctctgggccggtcactttaatcgcactggagggggaaaaccccgg

SEQ ID NO: 2999 - DNA, 1190 bp, Diabrotica virgifera
ggtaccgggtccgggaaatttcccggggtcggacccacggcggtccgagttggctcgtaggaggcattgccgtgagaagtagtcgtgtatgtgtagctgctaagaaaaaaataagatgactgaaactttgcaattaaaaggcacccttttgggtcacaatggatgggtaacacaaattgccaccaacccaaaataccctgatatgattttatcttcatccagagacaaaaccttgattgtatggaaattgacacgtgaagatacccaatatggtgtaccccaaaaacgtttatatggccactctcactttatctcagatgtagtactctccagtgacggaaattatgctctttctggttcatgggacaagactcttcgtctgtgggatttggctgcaggaaaaactacaagaagatttgaagatcacactaagcaagaagattttttgttttatttttttttttcgtcgtacatcgtctgaagattactgaagaaataaaatgatgttttgagtgtagccttctctgttgacaatagacaaattgtgtctggatcccgtgacaagaccatcaaactgtggaacaccttggccgaatgtaaatacacaattcaagatgatggacattccgattgggtatcctgtgtaagattttcccccaaccacgccaacccaatcatcgtatcagctggatgggaccgtatggtgaaggtatggaacttgaccaattgccgtctaaagatcaaccactctggtcacactggttacttaaacacagttgcagtctctcctgacggtagcttatgtgctagcggaggtaaagactgcaaagccatgctgtgggatcttaatgacggcaagcacttacataccttggaccataatgacatcatcaccgctttgtgcttctcaccaaacaggtactggctgtgtgctgcctttggaccctcaatcaaaatctgggacttggaaagcagggaaatggttgaagaacttaaaccaaaagtcgtttccaaaacacaaaaactgaacctcctcagtggctttcttttgccctgggccccaaaatggaacaacacttgttcccctggaaattcccaaaaaaccaattaaaaaaatggcaaaggtcaagggggtctggtccttttaaaaaggttaaaatttgaaaaaaaacccgaaaagtttttttttt

SEQ ID NO: 3000 - DNA, 1446 bp, Diabrotica virgifera
aaaaattgtaattgacatgtctcttccgatatcttcctaatttataatgactaaaaaaatgaaaaacgggttttgatctgaaaaaaatcagttttattaaatgaaaacagaaatgcttgatcgtaaacataaaagaatcatcacaagaactggaaccacacacattgaaatcatgaaaaaactgtggcctgttcggactgcgggaaatgagaaagaatctgtgttaaaactgcaaacattgccgaaattgcgggtgggagaggacaagatgggttcgaacagttactatcaagtgttaaattcacaacttgttgaagaagaggcttcaacaagcactcaaaacgtgacatttcatttaaaaaatcttagtgaaggtttataaatggcaaatgagctttgtgatttctttataaaaattgatccatttatggagcgaagtcttatttttaagaggcaaaatgctaatgccactgccgaatatcagtctgaattgaagcaatttttaaaaactgccaagcaagagtttactaaattctttaaatgattgccgaaagctgaagataatatgtaattaatcaatctgtatggccaaaacttcaattaaactgattttttttagctgtttggtattgctatagattggtattgtcacatcaccaatgatatatgtactctatttcgaggggtttgagcgaaaacctgataactagggataacattgtttggagataaatatgattaaagattttgggaagtttgaagaagttttcaaattgttattagaaagtttaataacaatttgattgaacttcctaacgatttgaaatcttgaaacttcctaaaatcgttaatcgtgattatttcgaagcaattttgtttttagttgtcgggtttttcaaactcctcgatttgtcagtgtcataggaatagactgcccaaaaatttcacttcacatggtattttcaaaatattctatatttttgtccatgtgtgtatttcattatatgtattttgcacgttgtttttcacaaatgaatattaatttttctcttggggttgcatgtaatacgaattgtaaaaaagatactaatcatccccgactatgacagcaagaagattttttgttttatttttttttttcgtcgtacatcgtctgaagattactgaagaaataaaatgatgttttgagtgtagccttctctgttgacaatagacaaattgtgtctggatcccgtgacaagaccatcaaactgtggaacaccttggccgaatgtaaatacacaattcaagatgatggacattccgattgggtatcctgtgtaagattttcccccaaccacgccaacccaatcatcgtatcagctggatgggaccgtatggtgaaggtatggaacttgaccaattgccgtctaaagatcaaccactctggccacactggttacttaa

SEQ ID NO: 3001 - DNA, 1154 bp, Diabrotica virgifera
tctttggggtcgcggccgcgtgggtttcttttttgtgcggttgctgtgagaagtagtcgtgtatgtgtagctgctaagaaaaaaataagatgactgaaactttgcaattaaaaggcacccttttgggtcacaatggatgggtaacacaaattgccaccaacccaaaataccctgatatgattttatcttcatccagagacaaaaccttgattgtatggaaattgacacgtgaagatacccaatatggtgtaccccaaaaacgtttatatggccactctcactttatctcagatgtagtactctccagtgacggaaattatgctctttctggttcatgggacaagactcttcgtctgtgggatttggctgcaggaaaaactacaagaagatttgaagatcacactaaggatgttttgagtgtagccttctctgttgacaatagacaaattgtgtctggatcccgtgacaagaccatcaaactgtggaacaccttggccgaatgtaaatacacaattcaagatgatggacattccgattgggtatcctgtgtaagattttcccccaaccacgccaacccaatcatcgtatcagctggatgggaccgtatggtgaaggtatggaacttgaccaattgccgtctaaagatcaaccactctggtcacactggttacttaaacacagttgcagtctctcctgacggtagcttatgtgctagcggaggtaaagactgcaaagccatgctgtgggatcttaatgacggcaagcacttacataccttggaccataatgacatcatcaccgctttgtgcttctcaccaaacaggtactggctgtgtgctgcctttggaccctcaatcaaaatctgggacttggaaagcaaggaaatggttgaagaacttaaaccagaagtcgtttcacaaaacacaaaagctgaacctcctcagtgtctttctttggcctggtccacagatggacagacactgttcgctggatattccgacaacacgatcagagtatggcaagtcagtgtgtctgctcattaagatgttaagttgtagataagcgacagtttttttacaataaaaagactggaaaaaaaaaacaaacaaaaaaaaaaaggggggcccccccccaaaaaggcaaacatatacaac

SEQ ID NO: 3002 - DNA, 295 bp, Diabrotica virgifera
atcaatatgtacttataacatcattatcggcggtaatatatctctaattgtgcctcgacattttctaatctattcgccagtctttcctatccattggcaactttttgcgacaatttcgtcgtgtaggtacaccatcttcccacgtcagtcttgtcatgacatttgagtctgcaagaaaagctggttccgattagcttgattttcttcagtaaccttcttcattaaagtaataataaacactgctattataatgcatttcatgcaataagatcatagcatgctttgttttccatca

SEQ ID NO: 3003 - DNA, 949 bp, Diabrotica virgifera
gaacatttttctttagttatgttccttcaacaccagggagagctcatgtgattccccttcaccaacgcaccgtccctaatccacaaactactactgcttctgaaatatgaaagagtgggactgggaatgctcatcataaaatttttgcatttattaaaattagagatcaaatcctacctatgcgccatatttgattttgcagaaaataatgtttatttgtgtaccaagggcattaagtagatgtttatgactgagagcgactatcttgccacgagggcctctggcctgagtttttgtaagtcgcccgaggatatacacatctattaatgcccacggtgcatacaaacttttatgtcatattagttggttaaagtatccacaatctaaatatttgattgatggattcgagcgttacttgatggaagttcattttatctcacaataaaacactgaaaaaagttcgttttctatacttccacaaaatgcattacaactatgccactactacagctgtttcggcaaagtgcccctctcaagtgatacacttcacaatgtgtccgcccccctaagtctctaactgaagaggctgaggagtggagagctgcctgtctcgagcctgtcattcagaattatatctgtatttttcaatttatcaatttccattgattctaaaagtgatagcttaaggcctttattttgaatatgtagaatttgaaactcttcattgaaagaatgattatgatctagaaggtgaagtgcgtatgtagaagtgtctgtttttctattgttgaaagcccttttgtgttctgctatccgtttgtcaaaagttctgccagtttgaccgatgtaagttttcggacagtcaccacaagttagtttgtacacaccactctgtagttgctttctctttcggcttttattgtttttaatatgtttgcttaagttgttg

SEQ ID NO: 3004 - DNA, 2453 bp, Diabrotica virgifera
  misc_feature (16)..(16): n is a, c, g, or t
  misc_feature (32)..(32): n is a, c, g, or t
caatttattatcattnataattttccatatgnagtattaatatattaaacaaaaaaacctattttcagcagactgtttttaaaacaagtctctcccgaacttgtgcttgattaactataaagttggccactttgtcgaattcgactaattggtaaacattttgatcgtgtgtgaccgtgcatccaacgaaatcgtacaatttgaccgcagacctgccaattagactggcctgtctactgcagtattgcaaaaattgatatcatcgacgatcttgtcgaacgataacgcagtactgtgtactgtgagtggacagcttaaataaaacttcaacttcaaagaaaaatcacaacacttcataacacagttaaaaaaagatgggtcccagatggtacaaagaaaccaagatctgaaacaggcacttttttgactagtataaggagactatccaactatatactcaaaaattatctatctctcatatactgttttcatgtgtgttatttgtaacagtgcagaaggtcacatatcatctaatggatgaaacacgttgctattgaaattaccttctaaatgttaaattaataatttttatgatctgtcaaaaatgaatgaaatatgtttgactagttctttttataaaaaaaatctgctgccgttatcacaaaaaatagtaaaagctaatcaagagtggcttctccgatgattgcacccgactatgttggaaccaaaattacaccagagtgctaaatcacataaatttttacgttttgtattaaacggtatgttctgtgttgtcttaacaataatttacataaatatgcgtgatttgggttattaataataaatcctttgtaattaaaaataaatgctcacaaatcaattacaaatatatgcacctaaattgataaataatccaaatatactttatttacaacaatagaattatgtgtcaacagacattgcaaaatataattgttatttgatatttacaatatctaacacccatgcaaaatttagccttgttagcaaaatttacagtgggattaatgaaatatacatacttttacttaataaataaaatatgtaattaaatcgaattaagcttcatgaaatatattatatacatatacagttaatattaattaatataatacaagaaaattacatatttttttattggtgtagatcatttaacaatcaaatatttagatacgttagatctgacacacgattttaaagcaaaaagacaacttttttatattaggtatccttattgtgactaacaaggcagatatttttctaatacagttatggacttctgaggtggagagttaaatgaatacaaagaataagaagtatagagcgcaacaatgcagaaatacagcatcggtaagaatttaaagaaggtattgactttacatgctactaagtcagaaacacctacttaaaacgatatagcgctattaggtagccgaaatatctcatcgaaatttttccgaatctgtatatgtgagtattatgtaaatgttaacaaaagccgaactttcagtttacgtttaaactttcagttggttgagttagtttagtttttcgagccctaattttatataatttaatggtttaattattagtatatgaacttatcattataatatgaaagatgaaacattagactaatttctaaacagacgcactggcatataaaggcacggagttaaattttataaaatgaggggcatattttttatttggtgattgagtaaatcaagactgccatggaattctactattattgatggattcgacagttacttgatggaagttcattttatctaacaataaaacactgaaaacgtctgttttccacacttccacaaaacttattacaactatgtgactacagctgtttcggcagagtgccttcctcaagtgatttagattactatgggtttgtctttttaaagtctttaactgaagaagttgaggagtggggagctgtttgtctcgagttggccattcagaattatatctgtatttttcaatttattaatttccatagattctaataaagatagcttaaggtttttactttgaatatgcagaatttgaaactgttcattaaaagaatgattatgattacagctttagtcacatagttgcaataaattttgtggaagtacagaaaacaaacgctttcagcgttttattgatagatctactattattgtttaattttacattttaatcaagacagttcaatcgcaatgttaaattggaagaaactggagagtgggttaaaagggtggcggtttatatgtagagcagcgcatgccctatcgattagagcagttgcatggaacgcggagcgccaacatagtggatacgtgcctttatatatacctgcgttcctgtaaatttgccggtttgtttactatttataacataacaatgct

SEQ ID NO: 3005 - DNA, 2308 bp, Diabrotica virgifera
ctaaactaaaagtaaaatatttcaaaaaaaacaaaaacttaatttcgaacttttttgtaaagcattaaatagtacactttgtccttatatttatattatagttcaccgttctctgtttgtttgagagtaagctgagtttttaaataatttatttgtaattataattgatgtgatttaaaataaatggttaagcattgtgtaaaaataaaaataccaaatcagtgtcctttcatcaaaggaatgcagcaagagagacctggttacggatgtggtgcccttgtagtaagtacacataaaaaatgtctaagaaacaaagttttttcctaatatatacatcaattttgattgaatttttaaaagtgacataccgttataatttaacaataaagcaccgaaagcgtttgttttctgtacttccacaaaatttattacaactatgtgactacagctgtttcggcagagtgcctttctcaagtgatttagattactctgggttggccttcttaaattatttaactgaagaggttgaggagtggggagctgtttgtctcgagttggtcattcagaattatatctgtatttttcaatttattaatttccatagattctaaaaagatagcttaaggcctttattttgaatatgcagaatttgaaactgttcattaaaagaatgattatgatctagaaggtgaagtgcgtatgtagagtgtatgtttttctattgttgaaagcccttttgtgttctgctatccgtttgccaaaggttctgccatccgtttgccaaaggttctgccagtttgaccgatgtaagttttcggacagtcaccacaagttagtttgtaaacaccactctgtagttgttttctctttcggctcttattgttcttaatatatttgcttaagttgttgttagttctgaacgctggtgttattccttccttttttatgtatctggctattattgttgttatcttgccagtatatgtgatagagcagaaggtactgggttctttctgtggtggtggaataatggttctggttttttctgtggtaataaattttgtggaagtgtggaggacaagcgttttcggtgttttattgttagataaagtgaacttccatcaagtaacggtcgaatccatcaattaccgttataatgcctgactagtcagtaatgaattcatcttatttcaatgtaatatacttatgatttgtctatcatgaaataatcaaacaaaagttaaaaagtgcactaatctaatggaaattcttaacataaaagtcatataaaacataaaaatctaacaaatgtgtttaactcgttcagtgcccacgccgacagtgtgtcggcacgagggtttcatcaagggtgccgacgacgcacgaggggcggcggtagtactgccttactaaataaaccctttaagtgcgtggtaccagccatgtggcgtttgttcaagctgggcaccgaatgtctgtgttttctccagcagcaataattacagtttgatatcgccttgtcacgtttaagacacgttaacacgtatccagtaactggcgccagtctcactggcatgccagtgctggacaggtacgtttacacgtatccagtagctggcgccagtgtcactggcactcttattaaaaatccaagcactgccactgaacctcttctcatatttgaaggctttttttgtcgtcactccaattgtttaaaattccattgctttattcatactatgtttattcattaatcactagtaatgacgacagtgcataattttgtctattataattattgttatctctaggcatggaccacataatccacacgattcagagatttcactttaagtgaccaggtggtacttccttaaggggaatggtcttccaggtcttacttccagcataagatttcaggattctattggtttttgctatgttgatgttaaactcgcagccctttcactccatttatgatgataaactgcactaaaaatcttgcagttcctctatattgtctgaaatatttttctacataaattttgaacagtagtggggagggaatacaaccttgtgtgacatccataacatacacttttcagatcttaatcatcgattgttagtggacgtttttggagcagaatgtcagtcatcgagaaataggctttgttgcacgtcattgttcttttttgaatctgaagtttttactgcttccacatcatcctttggtgcctatttccccgtgttccggtttgtgtttatggttttgcctttgtatgtgtatttctagtcaaatctccctgac

SEQ ID NO: 3006 - DNA, 984 bp, Diabrotica virgifera
atcaaaatgggtaaaactgctaaaacacaagtccgacgatgaatgggacatgggcaaccttatacatacattaacaaatagacgatggatggaaggcaacgtagcatacgcagaatctcacgatcaagccttagtcggggataaaactatcgcattttggttaatggataaagaaatgtatacgcacatgagcaccttatccgaccagtcgctcataatcgacagaggcattgctttgcacaaactcatacgttacgtaactcacggtctaggaggagaagcctacctaaacttcattggtaatgaatttggtcatccagaatggctagatttcccaagagcgggcaacaacagctcctatcactacgccaggagacaatggaatctcgttgatgatgatattctgaaatataagtttttgaacaactgggacgccgctatgaaccatctagagcagaaatacggatggttggctgataatccaggatacgtcagtacaaaacatcaggatgataaggtgatagtctttgagagagcaggattggtattcgtcttcaacttccatcccaccaagagttttgcagactacagagtcggagtagaagtagaaggaaactacagaatcgttttgagttctgacgacaaagcttttggaggtttcgataggatagacaaatcagttacttttgcaactacccctgaaggatttgctggcagaagaaattatatgtaggtctatattccaagcaggaagtgcataatattgggaaaagagtaaattaacggtaactaaaaaaatcatcgtttaataatattaaacactttatattattttcctactccaaaataataatatgaagtttttttttttttatgccagaaaaaatatttagtgccctgtttaagaagactactattttgatataggacaagttataattttttattgaagtactagacttgttttttttataattttaaaaa

SEQ ID NO: 3007 - DNA, 844 bp, Diabrotica virgifera
tttatttattttaaaataataaaatattttttagtaaaagtaaagaaaaattttatttaatgatagttaattagtattgtgagagaatattttatttttataaaagaaaaatttattttttgtaccttgtgtatcaggcattattaattaataattatatatttattattttccgattgattggagtgaatccaactgatgttcaccaacgagtcgtttttcttttagttccctcccagttaaaaaaatacatcgcaatgaattcgacgtcttttttgcaaaacctaaatggttctgatacgactatcacctccgtttacatccgtctgttggataaggatatcgtcgataatgttccgtttgatcgagatatgcttaaggactttttcaaaggtttaggtcgaatgttctatatagtgcatcctgctgaaaccacctaccaagaccctcaggctgtgccagaatttttccaaaatgcctggccctacttcctgttgttcatgttaatcgaaaatataattttatttatggaaaataagccgatttatagacttaatgatggactaaccagtatttctcatggcttaatacaacactccggaaaattaatatttagaggcagtgagagttatttgtatttttacatacatcaacatttttgccttataaatcttccttggaacaattcgatgacatggtatttagcagcactaggagtagatttttgttactactgggtccatagagcttgtcatgaggtccatattttatgggctcaacatcaagtgcatcacagttcagaagaatttaacctggctgtaggcttgcgacagtcccttttcat

SEQ ID NO: 3008 - DNA, 664 bp, Diabrotica virgifera
agctattagattatttatttcgcataatcaataattaaaaatgttaaattttgtaatgataaggctttctaatcttttagctttttaataaagttagggaagactgcatatttcaatttgttttcggcggctgtcagcgatatacgcagctataattatcgcttatcgttgtttgaattaaattttcctttttcagatcaactaaaccagcatggttcaaatagaaggaacatatataaatgataggagcgagaatttggacgactacttcctagaagtaggcgtgccgtttattccaagaaaactgctgtgctcgtcaaagccgacattggaaatcaagagagagaatgatgaatggacaattacggtgtctacacttttaagaacgaatattacaacgttcaaacttggtgccgaatatgaagaacatatgcctggtggagtgcttaggaatattactacattggaaaatggtaaacttattacattatcgttgggaccaggagatgttaaatcaaaacgtgaatatgagtttactgatgagggatgcgttatcacctactcgagtgaaaagacctccaaagttgcaaaaagatacttcaagaggatttaaaatagttataagaatatttttttattatgtaaaagaaataaaggttgaagc

SEQ ID NO: 3009 - DNA, 948 bp, Diabrotica virgifera
  misc_feature (886)..(886): n is a, c, g, or t
cggacgcgtgggatataaggtgtagtgttgcgtttggtggtgttatataagaaaaaaattgataaatatttcatgtgaatctaaagtgtagtttctgatacccgctacctgttattctctgccgactccagggatttaaatttgttatggtctacacgtacctaatctaatcctaaacaaatattaaaagtgctttcttatactaaggcacagtgagaaaaaatgaaagaagatgacaaatttgacgtaaagtataacgcacaatcctacaatatatatgaatttttaaataaccatccgggaggattaaattatgtgcaaccgtacaaagaaaaagatgttacgaagccgatgagcttatatgaacactccaaagctgcctattaccttttagaagaatatacaaaaggaaaacgaagagcagaggaagacttagagtctttggtaaattgggacaagcccatgttgggccaggtcggtaagttgggtaccaaatattacgaatgggtgacatcaccagtcgacagaaaccttagattattcggaaatcccattttggagtgtatgacgataactccttggtatctggtacctatggtgtggatacctgtttgtatttattttgtgatagaaggaacacgccattacatacaaattacaaaagatgctagtccatttgtgccagtagtattagcttttgtcaatggtgttatactatggacccctattgaatacagtttacacagatgggtatttcatatagaaccgtctggacatttcgaaagccatgatttattttcattttacattcacggattacatcataaagttccatttgattcgaggcgattagttttcccgccagtcccagcagctggtatagttnatattttttatagcatactaaaagcgtgtatttccgagtcaaaacagtttttaacattggca

SEQ ID NO: 3010 - DNA, 1372 bp, Diabrotica virgifera
tctaggccgtaaatataaggtgtagtgttgcgtttggtgcttttatataagaaaaaaattgataaatatttcatgtgaatctaaagtgtagtttctgatacccgctacctgttattttttgccgactccagggatgtaagtacgttacagtttacatgtaccagtttagcattatcaagttataaaagttatttttacaacataaatactaacagaaaaaatgaaagaagatgacaaatttgacgtaaagtataacgcacaatcctacaatatatatgaatttttaaataaccatccgggaggattaaattatgtgcaaccgtacaaagaaaaagatgttacgaagccgatgagcttatatgaacactccaaagctgcctattaccttttagaagaatatacaaaaggaaaacgaagagcagaggaagacttagagtctttggtaaattgggacaagcccatgttgggtcaggtcggtaagttgggtaccaaatattacgaatgggtgacatcaccagtcgacagaaaccttagattattcggaaatcccattttggagtgtatgacgataactccttggtatctggtacctatggtatggatacctgtttgtatttattttgtgatagaaggaacacgccattacatacaaattacaaaagatgctagtccatttgtgccagtagtattagcttttgtcaatggtgttatactatggaccctaattgaatacagtttacacagatgggtatttcatatagaaccgtctggacattcgaaagccatgatttattttcattttaccattcacggattacatcataaagttccatttgattcgaggcgattagttttcccgccagtcccagcagctgttatagtttatattttttatagcatactaagcgttgttattcccgagtcaaaacagtttttaacattggcaggcggtgtatcaggttatgtcgtatacgacatgatccacttctacctacatcacggagcaccaaaggaaaacagttatttttatcacctaaagcgatatcacaatcagcatcatttcgcccaccatgacaacggctttggcattagtagtacgatctgggataaagtctttggaacagctataaaattaagaaatttaaaaattggcatcaaatggtgaaatcttttaaagcgcacatttttgagtattgattgccttaagtgttcgtcatctgtgtgatttttcttagaatacttagaaaaacctttgatatactattattttttgaaaaatgatttataagaattaaacaaactttattatttttaatttaaaaaaatgaaaacacaaaaatagaatagaattatacataattattaagaatag

SEQ ID NO: 3011 - DNA, 907 bp, Diabrotica virgifera
  misc_feature (765)..(765): n is a, c, g, or t
  misc_feature (872)..(872): n is a, c, g, or t
cttaaaatgtataaatttacctgattataaaacctttttttatttcttaacaaataaacattcagtggaccaaaggatacatatcgatacctcagagcaacagtgagataagtggaaaatttcagtttttttaagtctgcttatttacatagaatgtgttgccagtgtggagtgcagtgcattctatgtaaatggcgtacttaaacaaggttgaggttttggacttctcactgttgctttgatgtatcgatataagctacatagtagatacatagaggaaatcttgtgctttattcttttttagaatttcaatggttaatatattagatattaaaataatgacccaaaaaatctatatagtgctatctaaatattgctgctgcaagaatttttttattagttctttaacccagttttatgaccttcatgtacatatatccaaatctatattgccagggtattggaaataataccctggatttttagcctgaagtatattaccaatgatgtacacaaactactagtctaaagaaacaccgactattgaagaatattaagaagctacaggttacttttcatttttccaaaatatcatttgtatttttcagttctattctgtcacaactaaattttattccactttaccacgagagtaatctgttttttcgtaactaaaagaggatcgatgggtagccaagaagttgagaaacagtaagatttcaaatattgcaaaacgttgcaaatatttttaagaatgtattttanaatgttaaatggatacatgaactaatcagaaagcagtcttcaaaaaagaaaaagcagtgttaagacacagtattcgaaaacatcagtcctatttttcagttttattnctgtagttttcaattctatgggatattattctctt

SEQ ID NO: 3012 - DNA, 2326 bp, Diabrotica virgifera
gatttccaatgcttctgatgcattggacaaaattagaatgctgtcattaacagagaagagtgtactggatagccaaccagagatgaatattcgaataaaagcagataaagaatctggcatgttgcacataacagacactggtataggaatgactaaacaagatctcgttaataatttaggaactattgccaaatctggtacagcagaatttttaagtaaaatgcaaaatgctgatacttcacaagatatgaatgacatgatcggccagtttggtgttggattttactcggccttcttggttgctgatagagttatcgtcagcagtaaacataatgaagacaaacaatacatttgggaatcggattcagcatccttcagcatcgtagatgatccaagaggagacactttaaaaaggggaacaactgtaagtttggaactgaaaccagaagccagagatttcttggaccacgagaccgtccgaaatcttgttaaaaagtattcccaattcatcaatttcccaatttacttatggactagtcacactgaaacagttgaagaacctctagatgacgatgcttcagaagaaacatctccgtctgccgatgaagatgatgcggcagtagaagaagaaaaagaagaagataaacctaagactaaaaaagtggagaagaccgtttgggattgggagttgttgaatgacagcaaaccgatttggaccagaaaaccaactgaggttgaggatgcagaatataatgaattttatcaggcattgaccaaagacaccaaagatccacttaccaaaattcatttcgttgctgaaggagaagttacattcaaagctttgttatatattcctactgtgcaaccatcagaaagctttaataggtatggaactaaaactgacaatattaaattgtacgtccgtcgtgtatttatcactgatgaattcaacgatatgatgccatcttaccttagttttgttagagggatcgtagattctgatgatttaccattgaatgtatctcgggagacgctacaacaacacaaattaatcaaggtaattaagaaaaaattgattcggaaagtacttgacatgttgaaaaaacttcccgatgacgaatatgacaaattctggaaggaattttctaccaacattaaactgggagctatcgaagaccctgccaatcgcacaaggcttgccaaattgttgaaattcttgtcatccaacggaagcggtttaaccaacttgtcggattacgtaaagagaatgaaaccaaagcaagacaaaatattctatattgccgggtcatccaaagacgaagtttcaaagtcacccttcgttgaaaggttattacgtaaaggttacgaagtattgttcttggttgaagctgttgatgaatatgcaatctctgcaattcccgaattcgaaggcaagaagttccagaatgtagctaaagaaggtttcagtctaaccgaaaccgaaggaggtaaagaacaattggaacaattaaagaaaacgttcgaacctctcaccaaatggttagccgatgatgcattgaagaatgaagttgcaaaggcaaccgtttccgaaagattgtctgactcaccttgcgctttggttgctagtctgttcggctggaccggaaatatggaaaggttggctttatccaacgctcatcaaaaatctgacgatccacaacgtacttactaccttaaccagaagaaaactttggaaattaatccgagacatcctttgatgaaagaacttcttaaacgagtacttgatgattccagtgacccaacagcgaaagatatggccaagatgatgttcagaacggccacgttgagatctggatatatgctccaggaaaccttagatttcgctgactctattgaagcgatgatgaggaaaacacttggagtgccattagacgaacaaattgaagaagaagaagatttacccgaagacggtatttcggaagaagagcaaatagatgcagatgctgactccaaagatgaggaccacgatgaactttaagtgtcttgtttgtttgagtgtgtgaagtgcaagtgttaagtacaataattgtacgatctgaaaagactgtaattacaattcctttgtatttttgttttacattataaataattatttattgtaatgtgctgctttgtgttaaaatctttaataccacacaatattaaccaaaattacccaggttttgatggtttcgtattgtataatactaaaattaatgctgtgcagactggatccctcttatattagatctcattaggtttcgatataaactactactaagtctgc

SEQ ID NO: 3013 - DNA, 1310 bp, Diabrotica virgifera
gtgaattcaatttctcccatcatctaccaaaaacaccgagccggtatttgtaatattttttgcttgatgaactaaaatttaaaaacagggctgcaaaatgaagcagtttttattattaactattggtttatttgtcttaattggtactgtaaggggcgatgaaatcggagaaccatctgtagaaaccatagatttagatattggagctagcagagaaggatctcgaacagatgatgaagtcgttaaaagagaagaagaggcaatcaaattggatggactcaatgttgcccaacttaaggagttacgagaaaagtctgaaaaatttgcttttcagactgaagtcaacagaatgatgaagttaattatcaattctttatatagaaacaaagaaattttccttagagagttgatttccaatgcttctgatgcattggacaaaattagaatgctgtcattaacagagaagagtgtactggatagccaaccagagatgaatattcgaataaaagcagataaagaatctggcatgttgcacataacagacactggtataggaatgactaaacaagatctcgttaataatttaggaactattgccaaatctggtacagcagaatttttaagtaaaatgcaaaatgctgatacttcacaagatatgaatgacatgatcggccagtttggtgttggattttactcggccttcttggttgctgatagagttatcgtcagcagtaaacataatgaagacaaacaatacatttgggaatcggattcagcatccttcagcatcgtagatgatccaagaggagacactttaaaaaggggaacaactgtaagtttggaactgaaaccagaagccagagatttcttggaccacgagacgtccgaaacctgttaaaaagtattcccaattcatcattttccccatttacttatggactaatccccctgaaacggttgaaaaacctctaaaaggacaatgtttcaaaaaaaaacttccccctccggcccaagaaagatggaggcgggcaggaaaaaaaaaaaaaaaaaaaaaaaaaaaaaccttaaaaattaaaaataagggggaaaaaaaccccgttttgggaatgtggggaatttgttgtgaagtgagcagccaaacccccatttcttgtcccccaaaaacacccacattgaagggtttgggggaatggcaaaaataatattttgatttttttttttccgcggttttgcccacaaaaaaacaaccaaaaaaaaaactccccctttatccccaaaataattttctttttttttctgttgtgtttggg

SEQ ID NO: 3014 - DNA, 379 bp, Diabrotica virgifera
cgtaaacatgaagactactttggttttggctgttttggcttgtgtcgctcttaccgcttacggtgaaaacgtccaagttaatgactttttgtgcgacacctgcgtaacttttgcatcaacagtcaagcaattcgtagacgaagaactcccaattgaagaagtagcaaaagccgcaaaagaactttgtgacctcctaccgggggatttgaaagatttctgcgagaaagatttgcttccagaagtcgagaatatctacaatgatgtatccaaaataacaccccaagaagcatgccaagatttgggattctgtgacgcttaaaaaattaaaagaattgttgtaatatgcataactatagaataagaaaaattttgaagtagc

SEQ ID NO: 3015 - DNA, 1012 bp, Diabrotica virgifera
ctttcaatatgatttcatctgacgcgtccgaaaactaataacaaaaatgtttgtccctaagatgctcttggtcttgggctttgcccttttagcctcagctggaaaagaccttgattatggcatggaagttttgagatgcgccaacaaagcaatgagaccaggagtacctgaattgggagttccacaacatgatcccttcgtcgcctttagtaagaacatatcatggcatggagacatcggtgttgctagcacctcaatcgacatcgacacattgagatggtatggtcttgccgactggaacgttactgctaagcaaatcaatgatgacgctgataatgtagcggtctttgactgggtcaatagatggcccgttttcacaatctccggcaactaccgagcaaccgttaaagaactgttccttacacagcattacaaaggaagcttcaaaatggtcatggagaaaccagtatggactggaaaaataagcgcaaataaaatccaacccaacgccaccgtgaatgacttcactgttaaatggcacgttgatgatgtagatgtggatattagtggattgggactcattggagatgctacagctgtagccattcaaacaggtgttaaaactgccctcaacactggactcatcggaaatgtcgttggagatttccttaaaatgagattcaacactgtgtggtaccccactggcaaactctgggatcttatggcctggtgcaaatcataaggccaacaacagaataatttttttcgattttttcgaatcaaataattaactaatatagatttcttgtctaaatttgtaaagatagaatataataaaatcgaaataattatttaacaaataaaaaaaaaaaaaaaaaaaaaaaaaaagtagggacccccccccaaaaccccccatcaaaaaaaaaaaaaaaggacaataaaaaaaaaaaaaaaaaaaaaaaaaaaaaaaatatttttttaaaaaaaaatggggggggggcccctttaaaaa

SEQ ID NO: 3016 - DNA, 404 bp, Diabrotica virgifera
attatttttttttattctaaaatagtagtacctattttactgacaccatgaataaagtacttttggtatttgttttggcaactgtcctagttcaagtatttgcccagagttccagccgtgttcaattaggcaggcttgagtgcggagaaaatgctgtacaaggttgtgctccctgttgtccagaagcagaagcaacttgttccaacaaagttcctcaaccatgtcctggtatttgcactagagaatgtaggatccaatgtcgttgtgttcaaggatacttgaaagacacggccactggaaagtgtgtcaaagaatgttaatttcttatttctaaatatctcaattaaatttacttaataattatgcaatgtaaaacaaaaatgtagcaaataaatctttatatt

SEQ ID NO: 3017 - DNA, 1118 bp, Diabrotica virgifera
cattacgcgtccgattagttttatcaggcctctattacgtactaatgtgaaaccgtgattagttcttatagaattagtcactggaagtctgttgtggtgtagttttttataaataaaattagttttattataatgctgtgaataggtgaagaagagtatgtgaattttttattaataaatttttatctctctgttggacacagcacctcgctatatacacggtgtaaattagtcgacaggactatcatgaagcgcccctgtatttgttgtagtgttaaaattttggcggtaatcacggccgtgttggtagtggtgttagcaggaatattggtgttaagtttctatggaataccacggatagtaaactctcaagtagacgcatcagttaggctgaccgaaaactcagatcaatgggggagatttctgaagcttccgataccgatatacataggggtatatttgtttacagtaagaaatggaccggctgttatgaacggggcagttcctaaacttgaagaagtaggaccctatgtatttagagaagacattagcaagaaagtactatcgactaataaagatgacgatagtgtaacgtaccaaaagtttacagaacagtcatttgaacaagagcgatccggtcagttgactctagatgataatgttactattgttaaccccccgttactggtactaacccaaattaccagcgtcgtggaacaactcgtcgtagtcggatgcctggacaaaatatttacacctacctacagagacctttttatgaccacaacgataagatcagtgatgttcgagggatttgagtttgccagatcatcatcagatgttggatatgcttgtgaagtaatcagacagcagatcatcgaaaaaactaaaaacatgaaaaacatacgaaggatatacagtaaagaatatccaggaatggtggaaggctttagaatctcatttttaggatttaaaacggagagcccagacggaacctacctcttaaataagaggaattgacgaatatttcttaaattggggaaaaaatttttgaaatgggaaaaaatttccccctttcccttccttttttggggggcccccgcccaaaatcccctttt

SEQ ID NO: 3018 - DNA, 4139 bp, Diabrotica virgifera
agattgttcatattactataatattattatgtggtaaagatataaatatattctgacgtcacacaaaacgttattgatgtcaacattaaaaaacgcctgatggcgtcgcatttctcttttgttctgtaaacaaacgatggaaaaaaattttccctgttctatcctttcaagtgtcgaaccttgaggtacacacacgatatattttttagtttgatttttttcataagtgaataatcaaactaaaatagcgctttactacaaggcatcctggtaagcactgaaacaaaatgaccttaatgttttgacataattttttgtgaatgaaaaaggttacaagtttttgttgtaggttttaggccttctcctacttttgctgttaccctttttttaactgaagctaaagaaagcggtggaatggttactggtctctactaattaaagaagaatcaacagccatggacaaaacggtcaaaagcaggggatggcctttaacaggtgctaagtgtaacatcaaaccattactatttgatctcgaggaagcactttctgtagagaacacctacaggcccagtgtattagcaattcaatataacgttaaaccaggagaagttactctcaagtccagggatggtattgtacatcttcttcgtttcctgaagtcttggtttgataccccagaacaagtcttttttgtagccgtcggctatctggatgcatttatagcacgtataaaggtaccagaaaagtacttgatgtgtcttgcatttgcttgtttcttcatagctgcccgtgaagagcaacttgacattcctttaagcactctgatctacatggctaggtgcaattttactttccaagacgtactaagaatggtggacgttgttacaaacaagctccaattagggtccaaaatcactactattggagatattcttcggctgtatatccagtttttaggaagctgtcactcaaccgtaagtgaaattctggatgaagaagagttgttgaccaagctgggggttctgctgactgacagcagctgtgcatttttcagaccatcagtgttagccttcacacttttgagatttgaagttgacaagcaactatctcatactattaacaaaacagcaagttttggtgacgtcatccatacattagctgtgatgaaggagttacaactgagatgtgagacatcagctgctgacttggttagttgttcccaattcgcatccaaagtgttaaaacgctacaacaaccatgaaccctgcggaaacaatgcgtacctgaaatggaacttttttccatcattccgtagacgtgaccgctcctcccgatcgaccctgagtgtaatcaatgagaaacctaatgggcaaatcaaaaatggaagaatcaataggaagaagaatcgtactaactaattgccaaatttctatgcagtactattgtaagcacagtttgttttaaattcttataaaaaaatggtcttagcttttaatgtatagtgtgtgttaactgcaagtttgttcatgtgtaattaattcccagaatcgtttcaatattaatttatatatccttattcatcctcatttgtattgtggaatcttgcattgacacacacttacctaatttttaaagagacaaacgataatttcttctttgtccgtcagctcctatattttttgaacatcttcaataccatatttactcgttggaaaatggactgcaagaagttatgtttgtctccttatttttattctagagtacctatatgtaacctaagatatctatatcgaaagtgatgtgagtgtaaattatatgtttttatgtaaagagtttactatatatatttttatgaaaaatttaaatctagtgatattaaatataagctgtgagtctctattgagcgccattttttgacttgctacaaaaacttgcgttctggtaaattttgcatgataagctacaccacatcacaaaaatttgtaaaattttatataaaaaaatatatacataattgcaaaatatgcaaaaaaaatataaaatgttttaaccctgctgtcctgttcgggtctatttgacccaaaaaaataatttatttcttattttacaaattattacgctgagtaacgatttggtgtttcgtgactttattacctaatatgaggtctttcaattgcatatgagataaacattcaacttcctgatttttttgataaaaatgaaattgttacctagggtacgttcgggtcaatgtgacccgcgtatttaaaccgttaaaaattacctgtgtatgtgtgtttagttggcagtattatatattagcagtacccgtgtgtttgtcagccggatacgtctgtaaataaaaacaggtttctgcaagcgaaaacttgtaaaataaactgtagtatagctggacgatgctgcaaaccaaattataaatatggccaacatggacggacagcaagtatttggaaccaactggaaagacatgaataaagttggtttccaagcatacattggtcttttattgttagctcgagtttataagtcccatggtgaatcaactaaaagtttatggaatgaagaaacgggtcgtactatatttcgatcaacaatgtcgcttgacatatttacaaaaagtttgcaagtaatacgttttgataacaaaactactagacaggataacagacgttttgataaacttgcggcaatacgtgaaatttatgaaacatgggtagaaaatgtaaaaagaaattttaaccctgatgaaaatgttatcgtcgataagtaactagttgcctttagaggcctctcaaatggtacattccagcaagccagcgaaatatggcacaaaactttggggtttatgtgattatgaacagtaaaacttcttatgctctaaaattgcagatctatacagaaatgcgtgtgctgtgtgacttaagtagtgatttggaatgccacaatattacgtgtataataacttttgtacatcgtaaaatttaggacaatttcttctaaaacaaagtagatacaaggccggggattataaaataaaccggagctttcagcaaaaatcgcgaataaagaagttcatagctcgtcttttttgcttcatgcaagatttgacaatattcctaaaaataataaaaatgttgttcttatgagtactttgcatcatgaatcgatgcatcatgcatcactttcatcaaatgaaaaagccccaaattattttagattacaattccaataagggagcagtggatactctagattagcttgttggcacgtatacatgtgagaagagataaatcgctggccaatgatcgttttttataatctactggacatttctgcctacaacgcgttcgtgttacgggcatcaataaatatccaatggaataccaatcaattgggaaaacggcgaatttttttgagaaattttgaaaaaactaatgaatccagtcatcatttccagaaaaaataaaccaataactaaaggctcttacgaactggtaaaaatgttacgagcaggaacaagtagacaagatggaaatgctagtgaaccgtctattaaatctaaccccgcctgctaaacgaacacgctgtaaacttgccgtaaaaacgatcacaagactaattattatgttatattatatcacaaacatatttgtaaaatccattctttttaatactgtcccagttgtaaactgaattaaatttttgtagataattgttactaggcttttttgaaagaaaaaatgccttttgtttttgtcaataaggtttaatttacattaacaacataatttttgtttaattaaccattatttcttgttaataaagttttatttattaccattagcttattttatttcgattaaggagcgtaaaccatagtttgggtcatattgacccgaacagtacatttgtgtagttgactcgaacgggacagtagggttaaatattaaaaaatatcttggttaaaatgttacatatttttagttttatttttaaaaagattttgattgattataaatgtgcttactcattggtctgttctgtcctgaaactagtccttctgatttgttaccatgtaatggcatgatcttttgaatacgctaatatacatctccacg

SEQ ID NO: 3019 - DNA, 2152 bp, Diabrotica virgifera
  misc_feature (1297)..(1332): n is a, c, g, or t
tactataatattattatgtggtaaagatataaatatattctcgacgtcacacaaaacgttattgatgtcaacattaaaaaacgcctgatggcgtcgcatttctcttttgttctgtaaacaaacgatggaaaaaaattttccctgttctatcctttcaagtgtcgaaccttgaggtacacacacgatatattttttagtttgatttttttcataagtgaataatcaaactaaaatagcgctttactacaaggcatcctggttttaggccttctcctacttttgctgttaccctttttttaactgaagctaaagaaagcggtggaatggttactggtctctactaattaaagaagaatcaacagccatggacaaaacggtcaaaagcaggggatggcctttaacaggtgctaagtgtaacatcaaaccattactatttgatctcgaggaagcactttctgtagagaacacctacaggcccagtgtattagcaattcaatataacgttaaaccaggagaagttactctcaagtccagggatggtattgtacatcttcttcgtttcctgaagtcttggtttgataccccagaacaagtcttttttgtagccgtcggctatctggatgcatttatagcacgtataaaggtaccagaaaagtacttgatgtgtcttgcatttgcttgtttcttcatagctgcccgtgaagagcaacttgacattcctttaagcactctgatctacatggctaggtgcaattttactttccaagacgtactaagaatggtggacgttgttacaaacaagctccaattagggtccaaaatcactactattggagatattcttcggctgtatatccagtttttaggaagctgtcactcaaccgtaagtgaaattctggatgaagaagagttgttgaccaagctgggggttctgctgactgacagcagctgtgcatttttcagaccatcagtgttagccttcacacttttgagatttgaagttgacaagcaactatctcatactattaacaaaacagcaagttttggtgacgtcatccatacattagctgtgatgaaggagttacaactgagatgtgagacatcagctgctgacttggttagttgttcccaattcgcatccaaagtgttaaaacgctacaacaaccatgaaccctgcggaaacaatgcgtacctgaaatggaacttttttctcatatccgtaaaaaaacgtgaccgctccccccgcccgaccaacccatacaagggaaaaccaaaagcaaaaacaccctaggggcgnnnnnnnnnnnnnnnnnnnnnnnnnnnnnnnnnnnntttttattatacaattaataaacataattttttttattgactattcgtgtatgttcccgcgaatgcatatgtctgcaaattttcattcatttgcattgaagaaaaggcagtcaaattaacgtctaaaaatttgacgcaaactattgaactaaataaaaacctttaaaaatacctaacttttatttttgttaataaggtttaatttatattaaaaatataatttttgtttaattatccataatttcttgttaataaagttttatttattaccattagcttattttatttcgattaaggagggtaaaccatagttgggtcatattgacccgaacagtacatttgtgtagttgactcgaacgggacagcagggttaaagcactagtgccttaaagtagcatttttaacgctggtatggagttctaaaaattgcatttttaacacggttgtagaaaaaacattttaaaattaatttaaaagagcgttaaaaatagtaacttactaggacaatttgttacgttttatatatttttgaaagtatttagataaaaaataccgaaaataaaattagtgaattggaatgttttaactatcgagcaatgcagtgaaattttaatatataaaaacaagatggaaaagccaaatgtcaattggaaactcttcgaactaaatgtaaaaggatgcacagatgtactttaatatcaaaatacaatagaagaagacataaaacaactaaaacattgcatagtttttccgcaaaaaagtttatcggcattaatcggcaagtaaaaaattaacccaaaaaaaaaaacccacgcgtccg

SEQ ID NO: 3020 - DNA, 1265 bp, Diabrotica virgifera
aaagggtgccttgtgcaaccggctaacaagcatcaaaaaacaaaccccattacggccagcagcagaactatggcgacgtagagaacaatcaatacagcagccaccccgtctacaacttctggaagacttggaaccagcaacacaatggacaagaaccatggaaccaatgggtagagaatggtgcccaaaaccaacctggtaactactggaggcagtacgctcaagctcaatctcaagttcaagctcaagctcaagctcaagctcaagctcaagctcaagctcaagctcaagctggaaacgtagctttgccatggatgtatcacatttggaacgtccaagatcttaacgaactatctccagttcaacgtgtacagttgctcctcaactatgctagacttcaccagcaatggaaccaatatggttcagatgcatcagacaatgaatatatgcaacatgttttgtaccaacatcttcctggacaggcacaatcctactcccatgaccaaattgtaccatacgtcatgcaatacttcaaccaaaacccaatgaaatataacgacattatgcatgaagtaatgcaaaccccatgggcacaccaacaacttattcaccacgttatgtctgaattaaatcaacattacggtcaagccccatggtctcacgaacaaatccaaaaccaagttatgcagcaccaacttgtatacggatcttccaattcacaacagcaactccagcagttagtagaatttattcaccacatccaaaaccaacttactcctgtacattaccaacaacttgaacatgttcaacctttgaactctgaacaaacccttccatggcatcaaggacaagtatactcatggacccataaccaagttcttccattaaactacgaaaccgttcaacaaagatatcaacatgctcaaccacagctttaccaacaatctcaatcatactaccatagcaacgttttaccatggacacaatcatactctcaaagaaccagcatgaacccacaatctcattatagctacaatctccaccaacaacacattccacagtgcatggaacaacctggatgggggaaccaacacaatgggtgggggaacccacactacaccccgaatatgagttcacacggggatctatatgctgctgtggggcatcatataggtctagagcgcataaaattataacgctgtaactcataatataatatatataatacatctttaaaaaaaaaaaaaaaaaactcctgggggggg

SEQ ID NO: 3021 - DNA, 975 bp, Diabrotica virgifera
cccacgcgtccgcggacgcgtctgctccaagatgaaggtactcattcttctttccgttgttgccttgagcagctgcttaccagcatccagaaatcaacaatacgttgatgtagactacaacagctacaacgctcatcccgtctacaacttctggaggacttggaatcagcaacactatggacaagaaccatggaaccaatgggtacaatatggtgtccagaaccaacccggtaactactggaggcagtacgtgcaacgcagcaaccaagctgaaaatgtcgatttaccttggatgtatcactcttgggatgtccaggatgtgcaaaacttaactcccgttcaacgtgttcagttgctactcaactacgtcagacttcaccaacaatggaaccaatggactcatgatgtaactgccaatgaacgtcttcagaatatgttgtatcaacaccttcctgaacacttatggagctccaacgagcaaattgtaccatacatgatgaactacttcaaccaatacccaatgaaatacaacgacattatgcatgaagttatgcaaaccccatgggctcaccaacaacttatgttccacgttatgtctgaattataccagcacttcggtcaagccccatggtcccacgaacaaataatgaaccagatcatgcaacaccaatacctctacggtacaaccttatcccaacaacaactccaacaattggtagaattcgtactccacattcaatacgaacttactcctttacattaccaacaacttgaacaagttcaaccctggaaccgtgaacaagtactttcatggaaccaaggacaagtactcccatgggcctacagacaacttcttccattgaactatgaaaccgttttaccatggacccgccagtattccgcacaaaacaacatgaacctagagttccaatacactacaatctccaccaacacaaatgccattgttccaatact

SEQ ID NO: 3022 - DNA, 829 bp, Diabrotica virgifera
gaccagaagcgcttacttttgacgtaaatgatcccctgcacttggattatgttattgctgcagctaatttgaaggctgaagtttatggtataccaactagtagaaatagagaacaaatcgcagaagtggttatgcaagtcaatgttccagaattcatccctaaatctggcgtaaagatagcagttacggattctcaaatggctatgaatggtaataatgtggatttggatcgtgtttcccaaattaaagaagaattaccctcagtagcagaactaggtggactacgtcttactcctttagaatttgaaaaggacgatgacaccaatttccacatggactttatagttgctgcttcaaatcttcgtgcagctaattacaaaataccgcctgctgatagacataaatcaaaacttattgctggtaagattattcccgccatagcaacaacaacctcagtagttgctggaatggtttgcttggaactctacaaactcaccagaagctatacatccctaactccattcaaaaataatttcattaacctcgctctgcctttcttcagttgctcagaaccaatcgcagcccaacaaatggaatactgtggtaacaaatggacactctgggaccgcttcgacgttcagggagagatgacacttagtgaatttttggaatacttcaaggaaaaacacggtcttgaaattacgatgtttgtccccaggcgtctgcatgctgtattccgtcttcatggcaaaagctaaagctcaagaacgtttcgacctttccgaatgccataagtcgtcagaagggagccaaagaagaaaatcaaacc

SEQ ID NO: 3023 - DNA, 1322 bp, Diabrotica virgifera
gaggtgtggactataatctgtccaggttccagttccaatggtttaagttgtggtatctgccaaacctgcatatgacaaaattgtgccgatctcctgattattgaactcttcgaaaagaaatatattgatatattactattatcaatacaattagtataatggctacacctacaagaatattaagccgtctattggctgacggtatcaaagtgaaacagcctattagatttaatagttacgaaagcacgagaccaaatttaaaattatcggctcaaaccaaagttatatgccaaggcttcactgggaaacagggaacctttcatagtaaacaagctattgaatatggaacacgaatggttggtggagtgtctcctggaaaaggtggaaaaactcatcttgatttaccggttttcaactccgtaaaagaggcacgcgaagccaccggagctgatgcaactgtaatatacgtgccaccgccaggagcagctgctgccatcatagaagccattgatgcagaagttccccttgtcgtatgtatcactgaaggtataccacaacatgacatggtacgagttaagcacaaattgttacgccaaaataaaactagactgattggacctaactgcccaggtataatagctccagaacaatgtaaaataggaatcatgcctggccatatccatcaaaaaggtgttgttggtgttgtatcaagatcaggaacactaacttatgaagcagtccatcagactacccaggtcggtctaggtcaaacacattgtgttggtattggtggggatcctttcaatggaaccgatttcatcgattgtttagaagtattcctgaaagatccagaaaccaaaggaataatactcattggtgaaattggaggtgttgctgaagaacaggctgctgattatctgataaagcacaactctggttcaaatgctaaaccagttgtgtcctttattgctggtctgtctgcgccacctggacgtcgtatgggtcacgcaggtgctatcatttctggaggaaaaggaggtgctcaagataaaatcaacgcattggaaaaggaaggggtaatagttaccaaatctcctgcacagatgggcaacgaattgttgaaggaaatgcgtcctttgggattaacccaagtatgtttgactgtatgaaaaaagggccccttaatgtctccggtaatttattaacgggacaaccccccatttccttatttttttcctcccccggttttttttgggggaaattccccacaaaattcccgcgggaaaaaaaaaaaaaaaaaaataaaatggggattatatttt

SEQ ID NO: 3024 - DNA, 1498 bp, Diabrotica virgifera
ccgttaaaagtgtacgcacattgaaacatgatgggtgtctatggtattctttgtaccctactagtggtattaggttcagctcattattgtacagcatattacaatgcctcccacgaatcatataaacttccatgtaaccaggacgaattagattaccgtgcatacccatatgactgtcacaaatatatagcgtgtgaagataattctctggtagtcctggactgtcccaacattttcatttggaatgaagatcgcaaagcttgtgactttgctgcaaacaccgaatgccaccaaattccatttccagaacccgactgctcggatggcaaaaattcttactggagatatccctttgattgtgccctattctgggagtgtatgaataaccaattgtatcttttgccatgccctgatgattatttctgggatgacgccattaaaaaatgtgatattaatgaagctgttgattgctctggcatcattcctaatccaaatagcacaactactcaagctccagtcaccacaactagtgaaccttttccatatacaactcctgaaatgatctgtactgatgacaacacctatttcccttacatttttgattgctcaaagtactacgaatgttccaacggaataccagttctaatggattgcccagcaggcgagttatggaatattatcataaacaactgcgattggcccgataatgttgattgctcttacgttgttaccacaagtgcaaaacctacatctgctgccccagatacttccacctcagctacgcaaagcactccttcacaagttcccacggaatcaactgctgcccctggaccatacacaacaccagatctcatatgtacagatgaaaataattattttccttacatttatgattgctcaaaatactacgaatgttccaacggagtaccagttttaatggattgtccaaaaggagaattttggaatattaaactgaataactgcgattggcctcaaaatgttgattgttcatacgttgtaaccacatctggagcatctactgtatctactgaagcacctactaaagcacctacagaagcacctactgatgtacctaccgatgcacctacggaaggacctggaccatactacacgacaccagaaattatatgtaaagaagataatacttatttcccatatatttttgactgctccaaatattacgaatgctcaaacggacagccaattctaatgacatgtcctgctggacagggatggagtaatttactataaacatgaaaaagggccgctggcgtcgaaaaatcatacgtcgtcaccactctggtaccccccccccccccccacaaaaaaacacaacacataataaaaaattttttatattaaaaaaaaaaagaaaaattttttttttttttttttttttttttttttttttgttggaaaaaaaaaaacaaacccccttttccctaataaaaaaaaaaaaaaatattaccccccctcc

SEQ ID NO: 3025 - DNA, 514 bp, Diabrotica virgifera
aaaaaattgggggggttttttaaattaaggggggtttttttttatttcctatttttccccaacgggaccgggttattttcacatttaaccctccaattggttggcccaaattgggaccttattaattttcctaagttgggaccaaattgccagaaccgggttccccaaaattttttttggctgaaacctttttaataaaaaaccccctttttttttcccgggatcattgggcaaatttgggtccttaaaatttcattttcccttttggttggtcccccaaaaaaacttccttttaaaacccttttttgggggggggccaaaccccacctttttaaaaaaaaatttgcctttttgaaacctttcctccgggaatttttccaccggcccatggggccctttcccggaactggggtttttttaacctgggggcttcaggatcggccttccaaagtttttaaggggattttttttgggccggccttttaactgccgggaattttttaacttgggtggg

SEQ ID NO: 3026 - DNA, 1754 bp, Diabrotica virgifera
tcacagtgtcacagaccttgaaccggcattcgtttcgtccttactgttaactgtaacagccacaccaatttacaatgccgagtacagataacatcgcttattttgtaggagtggatgtgggtactggtagtgttagagcagctttagtcacggaatgtggtgaaatagttagttctgcggtaaattgcacaagaacttggaatatccaaccggatttttacgagcaatccactgatgatatttggaatgcagttgtcacatgtgtcaaaatcgtggtccaaaaggttcagccagacaaaataaaaggaattggttttgacgctacttgttctttggcatgtttcgacaaaagtggagcaccacttactgtgagcccaagtggaaataatcaacagaacgtaatcctctggctggaccacagagccgtgaacgaagccgcggaaattaataaattgaaccatcctgttctgcaatatgttggtggaaagatctctcctgaaatggaaacgccaaaattgctttggctcaaaaggaatatcaaggacacttgggacaaagctggttggttcttcgacttgcccgatttcttaacatggagagcgactggagcagattcaagatcctcatgttctctagtgtgcaaatggacttacgaaatgaatatcgccggcaccgaggcttggaataaatcctatttccaacaaataggcctggaagatctggctgaaaacaactggcaaaagatcggtagcgttgtattagctccaggatctgcagtaggcaaaggactgtcccaacaagcagctgcagagctcggactagtggctggtactcctgtgggtgcttccatgatagacgctcatgctggtggattgggtttgattggttgtagggttcccggagtagaccctgcgtttcacactcgagttggtttgatatgtggtacatctacatgccacatggctgtttccagagaagccactttcactccaggcatatggggaccatacaaaaacgccatgatacctggtatgtggctaaatgaaggagggcagagtgcaactggaaaacttgtagaccatatcattgatactcatccagctactccagaaattaagaagaaacttggtgatatgcacattcaaaaatatttaagtgacatccttaacggattagccaaaaaggaaaatctgaagtctgttgcttatcttactaaagatctgcacgtttggccagacttccacggaaatagatctccaatcgctgatccaacactaaaaggaatgatatgtggacttacactgacaactgacgaagaaaatttggctttattgtatctagcgactatgcaggcactctcatatggaactcgccacatactcgacaccctgaaggattctggatatacagatatcaagtccactttaatatgtggcggactcagcaagaacccaattttcacccacagtcaagctgacgtttgcaacttacctacggtgtgtcccaacgaagtagaatcagtccttctcggatgtgccattttgggagcatgtgcagccgggcatttcgaaaatatgactgcggccattatgagcatgggtggcgagggaaaagtagtggagccgaataaggaattggtggagtaccacaataagaagtacaaagtatttttgaaaatgtatgaagatcaagttgcatatagaaatgcaatgaactcctaattgtgtgttaataaattacttgtttttttgttg

SEQ ID NO: 3027 - DNA, 974 bp, Diabrotica virgifera
taaattgtaagtgacagaaaaaaagggcacgtccgtgattacagaaattcaactttgtggcacatttattctagtttatctgattgtcgatagatagcgccttgttttgacaaaaaaaaaagaatgtgtgtgtactttgtacgcacgtaagaagttatacttctattatatgatttaaacgaaattaatatacttattatttatattttgtttaaatattaaactaatttatacttactacttctcaaacatttttattagaacagtgccaaaaattaaaataataaaagaataaaacacacacaaacacattaaacaagccacaaatgatgtctgaacataaattgtcgaaaatttttttaactaaatacgtattttctgaaaatacaattatataataaatatacttacaatcataaaatgtattaaaaaaaacaaaaaagaaagtttctgttgggactcgaaccagcgctgataagagcggttggtattggaattcatttgccttctccgcttagccacggacactatgtgtcattatttacgaagatcgactaactaaacggattaaacttgtgatattttgatatgtattttgaaaattgatcaaattattttaattttgaattgaaatgatttagaattgaaaaaatacaacaaaacatagagtaaataaaaacaatatattaggtgaatattgatagaaattttgatggtaatcaaattatataaataaaagtattacatactatgtattttggcagatcaaataggtaggtttatacccatgatacattaacaattattacgtacctgttgcttttaaaaactatataaaagtcactacaatattataaacttttttgtttctgtcctcacgacaataaaactaatatattatacatttgtttacctttaccttccaaaccacagctgccctccaaaccacatcggataatttttgacatgtcatt

SEQ ID NO: 3028 - DNA, 949 bp, Diabrotica virgifera
ggaaagtgcttgatttttttggttatttcacgttgaaatgtttgatttggaatttgactagtaagaactcacttttcattagctacaactgtgcttctactgggtctaaagaccttatacattcaccatttttttcacttttttataagctatatttttgctaataatatttttttgataaaatacttactttttgaggtatttgcgaaaaaccgtctgcaacgtggttttttgttgaaaaataaacattttcactcgcaaataactcgaaaagtattgacttagtgaaaaaaaaaaaaaagaatgtgtgtgtactttgtacgcacgtaagaagttatacttctattatatgatttaaacgaaattaatatactttttatttatattttgtttaaatattaaactaatttatacttactacttctcaaacatttttattagaacagtgccaaaaattaaaataataaaagaataaaacacacacaaacacattaaacaagccacaaatgatgtctgaaaattaattgtcgaaaatttttttaactaaatacgtattttctgaaaatacaattatataataaatatacttacaatcataaaatgtattaaaaaaaaacaaaaaagaaagtttctattgggactcgaaccagcgctgatacgagcggttggtattggaattcactcgccttctccgcgtagccacggacactatgtgtcattatttacgaagatcgactaactaaacggattaaacttgtgatattttgatattttgaaaattgatcaaattattttaattttgaattgaaatgatttagaattgaaaaaatacaaccggccctaaaagtattacatactatgtattttggcagatcaaataggtaggtttatacccatgatacattaacaattattacgtaccctgtgcttttaaaactatttaaaagtc

SEQ ID NO: 3029 - DNA, 1041 bp, Diabrotica virgifera
  misc_feature (861)..(861): n is a, c, g, or t
ttatgagaatatcacgtcagactctatgtaagctcatccatggatactcgccccccacacttggcaccatatgtccacaataattgtatcatatacgtctcttgtagcgaaaaacttaatcaagtacagaaacaaacaacttatattcatgcagaaagtcgttagaggttatcttgtgaggaagaagcatggacccagaataaatacactcagaaatatcaaaaaactgaactcaaccttggcacaaatagaacagagtgcacagcagctcaaaaaagacaaagactctgtgaggaatgacattaataatttaaagactcagtttgatgcagctattgatagaattaagaaagatgataaaatcgataaagcaaccgcagaaaacctctacaaatccttatccgacaaggtaaacctacaaatggcagcgttacagaagaaaatccaagagcagaagatcgctgatgagcaggaaaggctgaggaagttacaggaagagatggaaagacagaggaagttaaaggaagaagaggaaagaagactgagggaggaggaagaaaacaggagacttaaagctgaaatggaagctagaaggaaaattgaggaggaagaaagaaggaagcaggaagaggctgataggttattagcaaaaaaacttcaggagcagcatgccaaggatgaagaagagcaaagacgtctccaagaacaggaagaccaagaaaagcaagatagggaattggccttgcgactagcacaagaaagcaacggatcaattgaagaaagtccacctatgattcgcaagtcagaagcacacagaaaccatcaagctactttggccaatagcaaatatgacctgtctanatggaaatactcggaacttcgtgatactatcaacacttcctgtgatattgacttgctagaagcttgtcggcatgaatttcatcgtcgtcttaaggtttaccacgccctggaagcgaagaacccgcaacgcaccatcatggacgagaacgaacgcgcccctcggtctgtcatggagtcggc

SEQ ID NO: 3030 - DNA, 255 bp, Diabrotica virgifera
acctagagtcccaatacaactacaatctccaccaacaacaaatgccattgtcccaatactggaaccagagatacggacaacaatacccacaacattatgaagccatggaacaacccggatggtggaaccaagaatggacccaaaacttggttggacaagagaatcattatcctctcttggggcaaaatatgcccttagtatattaaaaagtattctgttctaagcatatgatttaaaataaaaaaaggcatatat

SEQ ID NO: 3031 - DNA, 1196 bp, Diabrotica virgifera
aattctcgcaagaataatggaaaccgaaaccttcttccatctagaccaaccagccatcagaatcacaggtgccgatgttcctatgccatacgcgaaatccttagaagccgccgcccttccaacagccaaagatgtcgtcgacgcaacgaaaaagctattgaaagtcaagtagatctcgtagaattatccagtaacaaatcatcataatacatccgatcaacaagatgaaactgcaaggaagaaagttcaaagtagaattctgaatgcattagattcgagtgaaactttttgatgtaaaatatgtcaaaagtgcaattcttgatacatcgggttattcatggctgccatttttccgtactcttgacatatgacgtacaatatatacacgtcatacgtcattggtaggcatgtaccaattatatataccaaagatgtatgacgtatgacgtgtatatattgtgcgtcacatgtcaggagtacaagaaaaatggcgacgatgaatagccctatttttagttttttaagttttaaatgggcctctgggtttgcgtataatacgaataataaaattgaatttcaagatgcaaattttttgaaattaagtttaataatgtcacaaacattcttcagaatcagtatgtaatggcatattctacatcagttaatattgtaacataacctcaatttttctcaggtaaaacttgcaatagtcaatctttaaaatactcaaaaacgttgggaatggtagattgtctcaacaaccagaggttgtgttgaaatgttttacgcataaagttattaggtcaaaatctgtgatatacgaggcactagaaattgcgtcttgatttgtgttaggtcactcgttataactttttatatattttatgaattacttatatgttctatctttattatagtatgtattcgtttacatctgggacgcaatttaaaagataatttgtcattataaatcactttctagttaccttgtatatcctcatgttataatgaaattgtggttgattgcctaattgaaaatagcattttatttacaattacttattgcacaaatttctcaatttttcaatttgttgtcttttaatgttttgttttgttgcgtacttttattatcaaatcaattttactttattaattcctcgcatgtaaattatcgaaaataaattattatttgttat

SEQ ID NO: 3032 - DNA, 1811 bp, Diabrotica virgifera
agcagctacaccaattcacaaacttcctatacggttaagtacgacctctctcaccttgaattcaagacatcccctcagttaaaatggcatctatcaaatctttgaatttaataggaaacttaaaaaagggaatcaccagaagatcattttcaacaacaaatgctgtagcctccaagcaaatgactgtcagagatgctcttaactcagccatggacgaagaaatggagagagatgagagggtgtttattctaggtgaagaggtagctcaatacgatggagcttataaagtaaccagaggtctttggaaaaagtatggagacaaaagagtcattgacacaccaattactgaaatgggattcactggaattgcaaccggtgctgccatggctggtttgaggcccatttgcgaattcatgacatttaactttgctatgcaatcaattgatcaaatcatcaattctgctggcaaaaccttctacatgtcagctggacgtgtaaatgtaccaattgtgttcagaggacctaatggagcggcttctggtgtagctgcccaacattctcaatgttttggagcttggtacgcccattgtccaggattgaaggttatttctccatacaattccgaagatagcaaaggactattaaaagcagccatcagagatccagatccagttgtgttcctagaaaacgaattattatatggtgttcaatatccgatgtccgacgaagccttgagcaaagatttcgtactacctataggaaaagctaagattgaaaagccaggaaaacatataacatttgtagctcactcgaaggctgtagaattgtgtctcgacgctgctaaagaattagctggtaagggcatcgaagccgaagttattaatctcagaagtcttagaccattagacacagatacagttatgaaatcggtagctaaaacacaccatcttatatcagttgaattaggttggccaacatgtggtatcggcgctgaaattctcgcaagaataatggaaaccgaaaccttcttccatctagaccaaccagccatcagaatcacaggtgccgatgttcctatgccatacgcgaaatccttagaagccgccgcccttccaacagccaaagatgtcgtcgacgcaacgaaaaagctattgaaagtcaagtagatctcgtagaattatccagtaacaaatcatcataatacatccgatcaacaagatgaaactgcaaggaagaaagttcaaagtagaattctgaatgcattagattcgagtgaaactttttgatgtaaaatatgtcaaaagtgcaattcttgatacatcgggttattcatggctgccatttttccgtactcttgacatatgacgtacaatatatacacgtcatacgtcattggtaggcatgtaccaattatatataccaaagatgtatgacgtatgacgtgtatatattgtgcgtcacatgtcgggagtacaagagagatggcgacgatgaatagccctatttttagttttttaagttttaaatgggcctctgggtttgcgtataatacgaataataaaattgaatttcaagatgcaaattttttgaaattaagtttaataatgtcacaaacattcttcagaatcagtatgtaatggcatattctacatcaggttaatattgtaacataacccccatttttctcgggtaaaacttgccatagtccctctttttaaaaaaaactgaaaaaaggggggggaaaggggaaaaattggtccccaaaaaaccaaaaaggtggggggtggaaaatgggttttccccccgaaaaa

SEQ ID NO: 3033 - DNA, 1495 bp, Diabrotica virgifera
  misc_feature (1318)..(1318): n is a, c, g, or t
  misc_feature (1485)..(1485): n is a, c, g, or t
gtcagacacttaccagcctgttgcgttcataactgtgaagagttattaagaaaaacaacaactcaaattacatcttattttattattaattttgttaaattaaaattaacgtaagctttattttttaatcttataacttaaatagtttttgttgccgttggacaaatgtcataaaaatttgatgccgaataattactaagatcgatgcatggtcaatgaaattaaatactatatatagactacaatacgtacaactcttgacatttcccattaattttgtggcagcaaacaaaatagcgccatctagtggtatgcttttgatataaaaaactataaatttaaaataaaggtatttttatacgattaaaacaaaatacaaatttagttttgagctatttactttaattttatattgttactttttcatttacataatttttcctttttactatcggtaattttatttacgtacgcttttattaaaagattaaaatatttacttataaagttttgtgacaatttgtacatacattctggagagtttcgtgtaagtaacattttaattttaaattatatttaacattttcaacactcttgtatataattttgaaaataccttaaatatatcattaattttatctgcagctcccgttataagttacacctaaatttcacactatcaggtgtattattagaccttagaccgtataacccttagacctaatagtagaaaataaatgtgttatacagttttgggttagccttcttgtaaaatgaaattgcagctaaacaccctctcatcggggagaatgagggcaaagtaatacgctttttagttaattttgttgacgtcctagttatttgcttagaatccattttaccgaacctattttattgcaacattttgtgtaagaatacaaacacaatataccaagattagctagttatccaacaatttaacaaaattaaatttgtatgtatacgttgaaaaaatgtagttatcaacttgagccggcagaggcgctagtggtaacgtgctgccagttttctgtgggagttggatgtattatagtctgtagtatttgatgaaatgatgcgccgacgtttctatggttaataaaaaatgttcaccaacgtctcgcaggatttttgccgggctttcacttaatgactactctatatatgcaaaagtattagcatttaccaaattaatgttacaatatttatcatgaacaattagttaatcaagcctaaaggagagttcaatttgaaaagcttggatgtattgtttctgacgatgtttagctgttcatattgngctaacttttagaagttgtaatatctatgttgtacatacaatgaaagacgctatgtaatttattgaacattccctttaatgaatgttttttacaaattacaatatttctgtaacttattgttgaataaaaatgtgaaaattcagtaaaaaaaaaaaaaaaaatcttnagggggggcc

SEQ ID NO: 3034 - DNA, 1876 bp, Diabrotica virgifera
gtatttggatccagttgggaaattcgaaacatatcgaaatattttgaccctggtctgtacgttctagatcctaaaactacagagaactatggaggaactccttatccaatcggaatggatcccgtttggcagttggccaagaacaaaattattttccagaattcgtttaaaatgaagatttccatcattttgggaattctgcacatgttgttcggtgtagtaatgagtctcttaaacaacatgtattttaaggacaagctcagcacactagcagaatttatacctcaaataatctttctcgttttcttgttcttctacatggttatcttgatgttcattaaatggttcctttattatgctaatgaagttgatactgacgaagccttccgattgggtacacgatgcgctccaaatgttctgattacgtttatcaacatgattcttcaaaaagaaactcctttcgagccgcgttgtggaacttacaacatgtattctggacagttaggtttccagaagttcctatttgcttgtgctatgttttgtgtaccatggatgttgttggcgaaaccaatagtcatcatgcgagaacgcaaacgaacacaacagtattctgtaactcaccaacagatgcaatcagctacagaaaacggagacgccgagcaaccaatgcacaacaacacctcacagccaccagcaatgggaggaggcggacatggtgagcacgaagaagaaccaatgagcgaaatctttattcaccaagccatccataccatcgaatatgttttgggatctgtttcacacactgcttcctatcttcggttgtgggctttgtctcttgctcattcacaactttcggaagtgttatggatcatggtattgagcaaggggctgaaagttgatgggtgggccggaggagtagccctatatgtaatattcgctttctgggctgttctcactgtctctatattggtactcatggaaggactgtcagcattcctgcacactcttcgtttgcattgggtggaattccagagcaagttctacaaaggtactggttatggtttccagccgttctctttcgaaatcattctcgattctgcttctcaagccaaggaggaagtttaagaaaactatactatataaatccatgtttccatgtttggtgtgtacttatccaaaaatataccctcaatataatacataagcatgtgctgtagcataccttaagtctaatagaataatgtaatatctcattttatctaaaaaaacagttattgaagttttctttaaagtattaatggctgattttaaaaattctttgaaaattcttcttctcacataaaatcctatacgttttccaattaatttattaattatactgagattatctaatgagtaagatatttagaaaaatttgaaagggctcagtttataatttccaagagtaacgttaatgtttgtctagtgtcttcttttggcatcataatcctggacggatctttgcctgtctagttatgtccttccatttagttctctcttgtgtccttctccatctgtctagtaaaatgtggaattaagaaattacactatgtagttgattacattttaaaagaaacgtgatccgtattataataaacattagtcatgaaatttaatctaataataataaaaaccaatttaaataaggttgccaattttgtgtggcaacaacctaggataatgtttaaaaacatatatatgacgtctcgttttttaggttttaaatcagttttatcagtgtatgctacatttctgtaacaaacatctagatgtaatctttttttttataaattattaactagttcttatttatgcttcaaataaactgtacaatttt

SEQ ID NO: 3035 - DNA, 901 bp, Diabrotica virgifera
cgcctcgcgagggaccgcgtgccgcgaattcccgcgggcgacccccccgcccgcgctcgcaataatagaatttaaggggtcggcaccctgaacaacttgctacataatttttcaaaaatgaacagctacgtagtgctcgttgttatgtttttggccgtggcctttgctgcggaggaagaagccaaggctgatggcccgaaaacttacaggaggttgatccctgctgacgttcttagggatttccctggaatgtgcttcgcctccaccaaatgcgcaacagttgaaccaggtaaatcatgggaccttacaccattctgcggtcgctcaacctgcgtcgtttctgaagacaaaccaccacgtctcttggaattggtagaagactgtggaccacttcctttggctaaccccaaatgcaaacttgacgaagaaaaaaccaacaaaaccgcagccttcccttactgctgtccacaatttacttgtgaagaaggagccaaattagaatacccagaaattccaaccgttgcaccagtcccagaagacgctgcagcaactacaaccaaagcttaatttctagaatcaactaaattttccttcttattttttctcccttctatactcaaaaactgattaaaaaagctcacagaaaatctttttagcagcaggtagtaaaaatttggtgtcgaaagtatctatacagtttatgttctattgcgcaggcgccaaaaagctgttagaaacaatatgaagtaacctacatattaaaaaaaattgttaaatatttaaattattgcaaaatatgcattttcaaagtttattcattgtttcactaatttataaacacgctttgtaatacttgcctccattttatttttcattgtttacgttacttttgtatttttgt

SEQ ID NO: 3036 - DNA, 1515 bp, Diabrotica virgifera
  misc_feature (78)..(78): n is a, c, g, or t
gagcagatgagacttgaattgtaatttgtaaaattccctcattcgtctttattcttatgactgaatatattatatctntattcttatgattgtatatgattgtatatatatgagttgctgctcacaagaatcgtctaataaggttcaaacaagaaaaaaccgttaaacgtataaaagagatatgtatacaatgtattaaataaatttagtataaaaatagtgacaacagatttttgtgagctaatattacaacgtcgtctgaaaaggaacatttttgattgataaaaagaaacactcaaagaaatggataaaaactagtagtgtcaaacgaaacaaacgaaatattgtcaaataaatagaaaagatttcagccaacccacaaaaatttttattgaagaaagacgacacataaaaaatgagatacaatataagcaaggaaactctcattaaaataaataatactctgggctaattaacaaaatacaaggaaaagttatttacataccagcaattttattgctggaatcgaatcttatgattgtatatactaataatataggtatgcaaagtccgcagagagtgtgctactttttttataaacaaaatggcgcccgaaaatcgtgttttttcaattttgtcctataactccaaagattttaaatttacaccaagaacacccaaacaaaaattcaccgtaattaaattctgcatagagacgtgtttttcccgatttacttcgacgaaaattttccccggaaaatgcgggtttttccaacaaaatctttaattttcaactaaaatttagataagtaattgtttatcaataattaaataacttggtaataaaaagctcttttcgtatagattataattccagaagccgatggaaattgaatgaacagtttagcaacaattgaattgttaattaaaaatttacggtcgctataataaccacaataattatgatacataagaaaaactatgatttttgtataaaaagacactgtacctatctaatgtactttacataattgaaattggactatttaagcggcctcaggaatattttaaaattataaaacaattttttggcttataaacaaatagaatatatctcgggaaatattaaattaaattaaatcatgaaaacggtattggaaaaaaagcggcaggacgcttttttaaaagaaaaaacgtttaattgtaatgagtggttcctgagatacaaccggtcaaagttgaccggcatttacggcaaagatataaacaataggatcataattttcgaaccatcacctttttatttttgtcctctttctccacaccaactttcatatctttaaaatactcatatattatattattataataaaaactatcgatattacgagtgaaaattgccaaaaatagcaaaattccaatcaaaaattaggttggaaaaaatgtaatctctaagttcaaaatcggtatacgttaaaaaaatgcattttctcggcttcccatggagcaattttc

SEQ ID NO: 3037 - DNA, 875 bp, Diabrotica virgifera
tttgcgtccgataatgtttgatattgatggagttgtattggtgtatttgagtccaatcgtaggagcatcagaatgtgtcaaaaacttgaaaaaattaggcaaagctgttcactatgttacaaataatactgttatgacgacggaagacatagctaaagctctaatcgagaggaattttgataccacaactcgtgatattgtcactccaatagagacaaatatagcctatttaagtaaacagaatgtgaagaacaatattttcctaatgagtaacaatccgcataaagatgcacttaaaaaggctggctttaatatattacctgaaaaattccaaattatagaagaaaacacaaacgcactttttgaacattttgatagcaaaataaatgtagatgctgtcatttacgactttgatttcaatagtaactatgtacagctgcagaaagcattgtggtgtttacaaaacaatccggactgtatatttttagttacacttaacgataaaactggaccaactggcccaagaggatgcatacttgggccaaatatatttgtcgaaacactaaagaatttgagtggaaagaactttattcaggtcggaaaaccttctgaaacttgtgtcaatttcatcaaagaaatgtatcatgtaatcgaccccaaaagagtactattcgttggagattcaattgaatcagatatgagtacaggagctataggaggtttccaaaagatgctagtgttaactggttcaacaaaaatagaagaaattacagattggaagtttcctgaagaatataaaccagaattctatgtagaaagtttggatgttttaaacaaaattattaaatccatttttccagatttgtaacctcacc

SEQ ID NO: 3038 - DNA, 1170 bp, Diabrotica virgifera
gtcttcaatggtctctcatttacaactatctcccttactggtaacttgatctctaaaatcgaagaaggcagttttgatgatacagaagcgcttcgtaacctgaaacttggaagcaacaaaattggcgatttaactcctacttctttgggaacactaaacaacaaagatttagaactaagtcttgacgataacgggatttctaatattgcacccaactcattcagtaaagttaccttactttcattgaaacttcacaataactccttaacggccattaaaagagatacatttaagggcgccgaaatcggtttcattggtttgcccaaaaaccagatttccagcgtagaagaaaacgcttttgaagatgttaaggggctgaatttgattgacttaagctttaacaatctacatgtgccagttagttccaattcaaaacatatcaatttatacgtcactgctggagctgacttaaacagatataatagtgaaactttaaacaatttggttaggtcaacatatggaggtcaagtcgaatattaagtacaaaactataaatttaagactgcatgtatattaaacatttttgtacatttttactgtaaaaacgtagtatttttaaattattagataaatattaataatattgttttaactttttaaattgttgtagatttccttttttttttcaaataagaaaaattttttgatttgcctgcaaaatgtatttttcagaaatttatttgtctgttgttatgtatatacaaatagtctcgttgtctttattttaatgtatgcagctatgtgatattctaagtgatgccaaccagtttgacagggttaatcagtttttcaaaaaatatatcattgtatcataaactttaaatttgtttagacattacttgttaatgctattatacctcttgtaatcttgtttataatcgccctgtgcgagtagccatagttgccgagcacgtaaatataaataaataaagatttgtaaataattattgttgacctctaaaagtcccacagattatgtattcaatgtgtttaattggaaattttatatatgtaattatctcgtagatatttataaacagttgttacatatctattagtttaaaaataatatgttgtttttgttttttattaaataaaaattatgttatc

SEQ ID NO: 3039 - DNA, 1015 bp, Diabrotica virgifera
caacaacttaattaaagcactcaacccaaacaattttgcaggctctaaaatatctgctctttccattaataacaatcagttggttcaaatcggcaagggagttttcaatggtctctcattcacaactatctcccttactggtaacttgatctctaaaatcgaagaaggcagttttgatgatacagaagagcttcgtaacctgaaacttggaagcaacaaaattggcgatttaacacctacttctttgggaacactaaacaacaaatatttagaactaagtcttgacaataacgggatttctaatattgcacctaactcattcagtaaagttatcttactttcattgaaacttcacaataactccttaacggccattaaaagagatacatttaagggcgcagaaatcggtttcattggtttgcccaaaaaccagatttccagcgtagaagaaaacgcttttgaagatgttaaggggctgaatttgattgatttaagctttaacaatctacatgtgccagttagttccaattcaaaacatatcaatttatacgtcactgctggagctgacttaaacagatataatagtgaaactttaaacaatttggttaggtcaacatatggaggtcaagtcgtcgaatgataagtacaaaactataaatttaagactgcttgtatattaaacatttttgtatatttttctgtaaaaacgtagtatttttaaattatttagatgaatattaataatactgttttatttttttaaattattgtaaattttcttatttttttcaaataagaaaaaatttttgaatttgcctgcaaaatgtattttttcagaaagtcatttgtctgttggttaatgtatataaaaataatctcgttgtctttaatttttaatgtatgcagctattggggatatttttaaaagggatgccaacccagtttttggaacgggggtaatccaagtttttttaaaaaaaaaaaataattgtgattaataaaaaattttaaaaat

SEQ ID NO: 3040 - DNA, 2132 bp, Diabrotica virgifera
tgtcaatcagtaacaatggtgtcgaaactgttatttttggtgttagtggcattttttgcctacgtgcaaagtgaaattacggtaaatgtttactctagttattgggaatcagaagaagcagttattccatcaatcgaaaacctaaagagtgttatcgctaatacaacctacagggtagaaattgaaaaccagaccatacctaaattacctagtggagcgttagatggtgtgactatcagcgaactaaaactcaaacatgacgaattaaaagacatcgagcccggtgcgctacagggagcccacatcaacagaattgagtttcccaacaatgacattgaaactattaaaaaaggcgtcttcaacgataggtcattatgggagcttgatctatccaacaaccagatttctaccatcgacgatgatgcttttgacacattggatgtgaattccctacacttgaacgacaacaatcttgaaaaaattacagcaggtacatttcataatactaaagtgacaagcttagatttgaacaataacaaaattcaaaaaattgaagttaatgctttaaatcagataccaagtttattttacgttcaactaagtaacaatcttattaaagatcttggaggaagtttctctaagttggatactgtaattgaccttaacttgggtaacaataaaattgaagttattgaatcaaatagttttgctggttcaaggctaaactcattacatcttcaagataactatataaaagagttaaaaccaaattcttttaatggcttaaatttgaattatttgaatcttagcaacaatgatatttcggtaatagctagtgacgcttttgctgatcaaccaggactttactcgattattctctcacacaacaatattggcggtttgaaaccaaaattccttaaaggtatcaactcacaacaaacaactttgtctttagacaataacaacatcgataatgtagagcctgcatcatttgacgaaattgttattagtggattagagttacaagaaaataaaattgaaataatcaaaaaaggagtctttaacaaaaagaatttcaactccataaatttagcaaagaacaaaatttctaaaattgaagatggggcacttgaagatctggttttaaacagtcttacactttccgaaaattcactgactgctcttacagaagaaatgttctttggagctaatatcagtaatgttaaattagacaaaaaccaactaagtaaaattgaagatactactttccatcaaattaatggcttgactagtctagacctcagtaataaccgaattgaagatattacaaatctgtttagccatttagatcatttgtacgatcttaacttggataataacttaattaaagcacttaacccaaacaactttgcaggctctaaaatatctgctctttccattaataacaatcagttggttcaaatcggcaaaggagtcttcaatggtctctcatttacaactatctcccttactggtaacttgatctctaaaatcgaagaaggcagttttgatgatacagaagcgcttcgtaacctgaaacttggaagcaacaaaattggcgatttaactcctacttctttgggaacactaaacaacaaagatttagaactaagtcttgacaataacgggatttctaatattgcacctaactcattcagtaaagttatattactttcattgaaacttcacaataactccttaacggccattaaaagagatacatttaagggcgccgaaatcggtttcattggtttgcccaaaaaccagatttccagcgtagaagaaaacgctttttgaaaatggtaaagggctgaatttgattgatttaagctttaacactacatgggccaatccaattcaaaatatctatacgtcactgcggagctgacaaaaatttaaaaaaaaatggttcttggaaaaaaaagtttttgtgaaatttttttgggcaaaaacagaagattattttttctttctttcttgtaacactttcccaaacaaaccccccctccctccgcccccactctcaaaaaaaaaaaaaaaatttttattatggggggggcgcgacaaaataaagtattggttttttttttttt

SEQ ID NO: 3041 - DNA, 437 bp, Diabrotica virgifera
cagacgcgtgggtttcaactctttcctgaccttcaccggtagatactgaatattgacctatttcaaattttctgtttataacttaactgttatttactaaataaaaaaaatatggtgcagaaaaaagtctgggcagcgagcaacgacggtgcaatcgagtacatttcgttgacatcagaatatctcgaggacgccttggatgtcctgcggaaaagcttttatcgatatgaagcaggatgttttgctacaggtttgtcggaagacctcgaagctatggctgaaatggatagctacatgattgaagtggccaaaggaggggtgtccatagtggcagtggagaaagcaactaatattgtttgtggcgttgctttcaacaaaattcagttggaccacggaccaagcggcaaaaaatattacaagaactacttgaacatgtt

SEQ ID NO: 3042 - DNA, 1258 bp, Diabrotica virgifera
aaattcactccttctcctcagttgagtgagttggtggaaattgagcaaaggtcatgccatgttgtataacagattatctatgatatcgttataaattatttaaattttttatcatataatttagaagccttttctccaccccaagagggtccgagcatcgttgaaacaatggcacccttagcagcaaaagttatcccaaaagcaaatgaagtggaagaaggaataagagctgtattgctgggtccaccaggctctggtaaaggaacccaggctccattacttaaggaaagatactgtgtctgtcatctctctactggagatatgcttagagctgaagtacaatctggatcatcattgggaaagaaaatccagcaagtaatagatgaaggcaaactagttaatgatgaccttgttgtgaacatgattgataagaacttggataagccagagtgtcaaaatggtttcctccttgatggttttccaagaactgtagtacaagctgagaagttggacgacttgcttgaaaagcgcaacactcaacttgatgcagtaattgaattcaggattgatgacaatcttctcttcagaagaattactggtcgtctgattcactctgcaagtggaagatcatatcatgaagagttcaaacctcctaagattccaatgactgatgatgttacaggtgaaccattaatcagaagatctgatgacaacattgaggctcttaaaaagcgtttagccacttatcacacccaaaccaaacctcttgttgattactaccaaataagacatattcatcatcatgtaaatgcagcacaggcagccgatgccatattcgctaacatcgactccattttccaaggcaaaagagctcataaactgtaaaaatttagttatgttctgttccttttcatgcattttatacaggtccagttaggttttgtctatatttttgtaattctttgtaaattttggtaaataatttatttttctaatcatctgtaaattttagccgcaattttaccaaaaaaaaaaatgattttattaacgtttcgaagcccaaatcgggtttcgttgtcaaaatacaaatgtggcttatttcccattgaaaatagtggattataaaaatacaaggaaataaagcttcagaacaacatttggtaaataagttatacatatttctaatctatagatatatttgaaaatggatgcctcattattgaaatgttattagaatttaaataaaatcagatcattt

SEQ ID NO: 3043 - DNA, 1062 bp, Diabrotica virgifera
  misc_feature (127)..(127): n is a, c, g, or t
acgtccccctcggacgttaggtgggcatccattggaatgtttggcaacgtgccatttggaccaaaataggcggtcctgttaaggtccaatttacgtcccctaggacgtccgattaaggtgcgatgtncgggccctcggaccttaagtggacgtccaacgggacattcggtagcgcgacattggaccaaaataggatgttccttggacgaaaactaacctcctaaaagtccgtgaaggacatccttgtgctattagggatgtatctatgtaggtatatagtctctttattctattatattctactctatttcaaacctattctatataagtatctacacattacacctactatcatcatcatcattctctttgccttatccctatgcagtgtcggcttccctaattgcatttctccacacaattctatcttgggtcatatcaatgttaatcccctttaccaacatgtcctgccttatcgtcttctttggtcttcctctcctactccttccaggaatctgcacttcagctattcttcgtattgggtgattaacgtctcgacgttgaacatgaccaaaccatcttaacctatgctctctcattttggcatcaattggtgccacacctagacttcccctaatatactcatttctaattttatccttctttgtcactccactcatccatctaagcattctcatttccgccacatgcattcgttgttccgctttctttttcactgcccaacattcagttccgcgcatcatagccggtcttgtggatgttttatagaattttcccttcagcttcattggaatttttctgtcacacaacacaccactcgcttctttccacttcatccatccagccctaattctactgcatgcatctccatctatttctccattactctgtaataccgatcctaggtacttaaaactattgcttttcacaatcatttcacctattatattatattttactttattctatactatatatctattctaatctatctatatatttcatttaatctgttacattctactctattctgttttaaat

SEQ ID NO: 3044 - DNA, 1615 bp, Diabrotica virgifera
  misc_feature (29)..(29): n is a, c, g, or t
  misc_feature (47)..(47): n is a, c, g, or t
  misc_feature (57)..(57): n is a, c, g, or t
  misc_feature (68)..(68): n is a, c, g, or t
  misc_feature (99)..(99): n is a, c, g, or t
  misc_feature (175)..(175): n is a, c, g, or t
ggaacggtttgcacgatttttataaattntagtctgtaagggtctgntgatgcagcngatattatgangatatgtacattgtgtcagatctttccgttnttataaaattcaaagaatttcgaatagattattctgtatattttacttttgaagcccgtaagaaataatgattatnttacatgtaatgtttcctgtacctaaatcatcatcattctctttgccttatccctatgcggggtcggcttccctaattgcatttctccacacaattctatcttgggccatatcaatgttaatcccctttaccaacatgtcctgccttatcgtctccccccagctcttctttagtcttcctctcctactccttccaggaatctgcacttcagctattcttcgtattgggtggttaacgtctcgacgttgaacatgaccaaaccatcttaacctatgctctctcattttggcatcaattggtgccacacctagacttcccctaatatactcatttctaattttatccttctttgtcactccactcatccatctaagcattctcatttccgccacatgcattcgctgttcctctttctttttcactgcccaacattcagttccgtacatcatagctggtcttatggctgttttatagaattttcccttcagcttcattggaatttttctgtcacacaacacaccactcgcttctttccacttcatccatccagccctaattctactgcatgcatctccatctatttctccattactctgtaattccgatcctaggtacttaaaactattgctttttacaatcatttcaccatccaaagataccattttatttgtagtagctccatctttaaatgagcatttcaaatactctgtttttgtcctactaagttttaaaccgttttcctccagaccttgtctccactgttccagtttttgttctaagtctctttcactatttcctattaacactacatcataagcatacattaggcaccatggaatgctaccctgtagtttcgctgttatctggtccaaaactaatgagaataaatacggactaagcaccgagccttgatgccatcctactttcacctgaaatttatcagtctctcccaaacctgtcctaacactagtccttctccctcatacatagctctcacagtctttacacattcgccagggactcctttcttagtgagtgcccaccacagaatctctcgaggaactctctcatatgctttctcaagatcaatgaataccatatgagcgttggtctctttagtcctgtatttttccatcagttgccttacaatgaaaattgcatgtgttgttgatctgccctgcataaagccaaattgattatcggatatttcggtttcttcacgtatccgtctaacaattgctctctcccatatttttcatagtgtggctaagtagttttatagccctgttgtttgtacattgttgtatgtctccccttgttttttgtagacaggtactaatatactgcttctccattcgtctggcatttgtccaacttccataaatctattaaatagacctgctatccaacttattcctgtctctcccatgctctcatact

SEQ ID NO: 3045 - DNA, 2513 bp, Diabrotica virgifera
ttcatctcggacacatctaatctgattaaaatcttttgctttctttgctctctgtttggctattttatatatcattgtttcgccttccctggtatcaagttctgggatcgtataggtttgaatgcgcgtctgctttggcttttgctactgctgttttcgcttcctttttcgttttcgcttccatatagctttgaagatctgtgtcggatctggtctcttgccactttttatatagcatgtagcatgtcatgtttgaatgaagcatgtctatcgatttttattttctctacatccatgtcataagcaaatatttttatgcatgtgacaatttacccaagttaggtaattatattacacaatgtagacacaaaccgatagatatgtagatgcatctctaaaaccgtacatatttctgaggggtcttattttcttggggatcattttatatttctccaaattgaatcaagccaatagatctaggatctaggtcaatacaaatcttaagttaaattaaaaaaacgtgtataaataagagggtatatttaataaaaaaaagtgatatgatcgatgactaagtacctacacattttaaaaccttatcataaattctaacgtaacttttatcataaatgaatagaaaagggatttaaaaatgaattaattcgtgttttctgttaaataatttaaggaaaataaattattttctaaaagtataaatattctgtatcacctgtgtatataattttctatcagaatgactgctaacaaatatttagatttatataatcctcccaaaccctgcaggtgccctgcagatgtacctccaccatatattagctcttaacacaggggagttcgttaaggggggcccgaaaaaaaaatctatccttaaaaatactcgaaattgtcagattaaaataaggtaagttaaggacatgcaaaacagtgtatttttaaaaaatctgacgatttgagcggagcgtaagaaaatgggcgagttaaaaattttcacaaaaaaagagcgaataattcgcgaaatgaacgttagatcgaaaaactaaaaaatacgtgttcaatatttttcaaaaatatattgaataatactaaacatgaccccccacggagaggggtgggggtaaatttaaaattttaaatacaaatcccgcgatatttcgcaaaataaaaattagatcgaaaaactgcaaaatacacttaatcaatatttttgaaaaatttctcgaatggtaccaaacacgacccccacggaagtggggtgggggttactttaaaaccttaaataggagccccaaatttttattccagatttggattctttacgtaaaaataagcaactggcaagcgcccactaaaatggaaaattttacttaactttttttggttttaggacctacatactcttcccaacccaataggtccccaaagcgctcgggtgactgcacatttagcatacttcgctcccctactataagtagttttacagccctgtagtttgtacattgttgtatgtctcccttgtttttgtagacaggtactaatatactggttctccattcatctggcatttgtccaacttccgtaactctattaaatagacctgctagccaccttattcccgtctctcccaatgctctccatacttccccaggaatatcatctggtcctaccgctttcctttcttattttttgaagcgcttgggcacttcctcgttggttattttggtgaccattgctgctactgtctccgttgcctctacaggctgtctgtcaaattcttcatttaataagctgtcaaagtactttctccatctctttttgacttccctttcgtgaactagtattttattattttcatctcggatacatctaatctgattaaaatcttttgctttccttgctctctgtttggctattttatatatcttcgtttcgccttccctggtatcaagttgatcatataggtgtgaatacgcttctgctttggcttttgctactgctactttcgcttcctttttcgccaccatatagttttgaagatctgtgtcggatctggtttcttgccactttttatataattttctcttctcttttatttttccttgtacttcgtttgaccaccaccaagtctctttatcctcaaacttttttcctgacgttttcccaagtatttccatagcagtctctctaatactactggccatttttctccaaattgtattagggcttcctttcatgttccaacatattttttctactattcttctcctgaatagaccttctttctcatctttcagcaaccaccatttgattttttgtggtcctctccgatatttttgtttagtttcgctttttacttcgatgtagctaaaatatatatagtttaaatgtattttaattatttctgtaggtacctacgtatttattaaggtttaacatatttatgcccttaaatacattattatataatgatttatacaaaattatttttattttgt

SEQ ID NO: 3046 - DNA, 2026 bp, Diabrotica virgifera
tatgcgggaaataccacaaaataatataaaaaaagtgcaaaaatagaataactaaatagttcagtgggtccatagattgtgtttagaattaaataaaatcatacgtttttattagtcgttacactaaaattttacaatttttaatgaaataatactacatgaatagggtcataaaagccttatttaagtttcgggtttcagatgagaaaacatgagatttcagtgtatgtacgccttggtaacagatcgcattgattatgccatcaaaacgtgcgaaaggctctaccatgcctctacaaaagtgggtttaaagatcaataaatcaaggacacaagtgatgacaaacctcgttctgagtgagaattatcaatatggctggaacaagtatagaacaaacagctacaaatatctggggcacgaaattcgcgtaagcagagataaccagaccaatgaactaatacgtaaaatagggttgacttgggcgacttatggaaagctgagagatgttttcaaatcagttcttcccatctgcttaacgagaaagtctttgatcaatatgtgctgctgattctaacctatggtgtggaaacgctaatgctcactaagacgcccgtaaacaaaatttgatcaacacagaaggcaatggaacggcctatgttgggattaaccctgagagaccgaataactaacacagaattgcgccgtagctctagagtaaccgaagcaatcaaaagattcatcatcatcctctttgccttatccctatgcggggtcggcttccttccctaattgcatttctccatacaattctatcttgggtcatatcaatattaatcccctttaccaacatgtcccacctaatcgtctcgccccaggtcttctttggtcttcctctcctactccttccaggaatctgcacttcagcaattcttcgtattgggtgattagcgtctcgacgttgaacatgaccaaacggtctcaacctatgctctctcattttggcatcaattggtgccacacctagacttcccctaatatactcatttttaattttatccttttttgtcactccactcatccatctaaacattctcatttccgccacatgcattcgttgttcctctttctttttcattgcccaacattcagttccgtacatcatagccggtcttatagctgttttatagaattttcccctcaacttcattggaattttcctgtcgcacagcacaccactcgcttccttccacttcatccatccagccctaattctactgcatgcatctccatctatttctccattactctgtaataccgatcccaagtacttaaaactattgctttttacaatcagttcaccatccaaagataccattttatttgtagtaactccatctttaaatgaacattgcaaatactctgtttttgtcctactaagttttaaacctttttcctccagagcttgcctccactgttccagtttttgttctaagtctctttcactatttcctactaacacgacatcatcagcatacattaggcaccatggaatgctaccctgtagtttcgctgttatctggtccaaaactaatgagaataaatacggactaagcaccgagccttggtgcaatcctactttcacctgaaatttatcagtctctcccacacctgtcctaacactagtcgttactccctctcacaatctttacattttcgccagggactcctttcttattgagtgcacaccacagaatctctcgaggaactctatcatatgctttctcaagatcaatgaataccatatgagcgttggtctctttattcctgtatttttccatcagttgccttacaatgaaaattgcatctgttgatataaaattagagaaatatgagtgaaaatattatttatcttcacacgttcatataccccaatgatttgtcttaaaactccctatagaagagatgtccattaaggaggtaaagagggaaaagtaggttggtcccgccaacatattttttatgtcct

SEQ ID NO: 3047 - DNA, 981 bp, Diabrotica virgifera
caactacttaaataaatataaaaggttcggcggaaatctcactttaaaatttgttaaaaagtaaattattttttaaaaatggtgaaaggcaagcgattcgttttgcagaaggtcttcgatggatttcccaaggagagtgactttaaagttgaggaatatgagttaccaccagttaaaaatggagagttcttggcagaagccctttacctcagcgtcgacccttacatgagggcatatgtatctgactcatctgtgattgggacaacaatgataggatcccaggttgctaaaatagtggaaagcaaaaatccaaagtatcctccaggtaaatacgttgtgggctattttggttggcaaactcacacagttgcagctggcgaacgggctggtatcacatttcctccatttttgatcccagatcttggagagctgccaatatcacttgctcttggagttcttggaatgccaggaaacacatcctattttggtttacttgaattgtgtcaaccaaaagagggtgaaaccctcgtcgtttccggtgctgcgggagctgttggcagccatgtcggacaaattgcaaaaattaaaggatgcacagttataggaattgcagggtcagatgaaaaaggaaaatggttgacagaagaacttggattcgaccatttcatcaattataaaacggccaacataccggaggaattgaagaaagctgctccaaagggcattgactgttattttgacaatgttggtggagaaattagttcagcagtaatacatcaaatgaatttgtatggtagaatctcagtatgtgggtcaattgctaactacaacgatactacaagatcacttgctccggttgtccaacctttcattgtatctaaacacttaaaaatggaaggattcgtcgtaaggcgatgggaaaacgatggatggaaggtattaaacaaatatgggatggatcaaacagggtaaagtcaaata

SEQ ID NO: 3048 - DNA, 799 bp, Diabrotica virgifera
ggcgtagtcgggtgtattttcgaatggaatagtgaaatttttagtgaggatcgctatttttggattagccgctcaaaatggagagtctgatctactggcgtgatcccaagaaatctggtccagtctttggaggagtcctcgtagttctactcgctctcacatatttctctctaatcagtgtggtagcgtacgtttcactcatcgccctcggcgtcactttagtttttaggatttacaaaagtattgtacaagctgttcaaaagactggtgatggacatccattcaaagaatatctggaactcgatatatcgctaccgcaggaaaaagtcaaacagatcacagaagtggccattgcacatatcaatgccgctatcgtggaacttagaagattattcttggtcgaagatttggtagattccatcaaattcgcagtattgttatggactcttacctatgtgggagcgtggttcaacggaatgactctaattattctcgcttgggtcgccctcttcactcttccaaaagtttacgaagtgaataagactcaaatcgatgccaatttggagattgttcggacaaaattggctgaaattacttcaaagataaaggcagcaataccgatgggcaagaaagccgaagaaaagaaggaacaatagatttaacaacatctatcagactatattactatacatatattaatttattggtgtttctttattccattaaacgttcttatgtaatgtttctaaatataattagtgtacttatataaaaatgttattttttaaaaaaaatataa

SEQ ID NO: 3049 - DNA, 877 bp, Diabrotica virgifera
  misc_feature (550)..(550): n is a, c, g, or t
  misc_feature (649)..(649): n is a, c, g, or t
gtctctttttaactaactcttcttgtatgtgtacgctattttaaggctttatgcgcacattgatatcttgtagtgctattataggattttgtttatttttcattaaaaatgggtagaagacaaaataaataccaagatgtatccgaggatctaccggaaagaggacctgtggagagtctgatctactggcgtgatcccaagaaatctggtccagtctttggaggagtcctcgtagttctactcgctctcacatatttctctctaatcagtgtggtagcgtacgtttcactcatcgccctcggcgtcactttagcttttaggatttacaaaagtattgtacaagctgttcaaaagactggtgatggacatccattcaaagaatatctggaactcgatatatcgctaccgcaggaaaaagtcaaacagatcacagaagtggccattgcacatatcaatgccgctatcgtggaacttagaagattattcttggtcgaagatttggtagattccatcaaattcgcagtattgttatggactcttacctatgtgnggagcgtggttcaacggaatgactctaattattctcgcttgggtcgccctcttcactcttccaaaagtttacgaagtgaataagactcaaatcgatgcncaatttggagattgttcggacaaaattggctgaaattacttcaaagataaaggcagcaataccgatgggcaagaaagccgaagaaaagaaggaacaatagatttaacaacatctatcagactatattactatacatatattaattttattgttgtttctttattccattaaacgttcttatgtaatgtttctaaatataattagtgtacatatataagatgttatttt

SEQ ID NO: 3050 - DNA, 1075 bp, Diabrotica virgifera
cgaaattagtaaggaaccaatagttccagtacaacctgcacctccaaaacctcaaccagagaaaattgtaccatctgctcctgttacagtatcagctccagagaagaaagtagaacccgaaaaaatcgtcaaaaaagtagaagaaaaacctgagaagataatcaaaaaagtagaagaaaaaccagtaccagtagttactcctgctaaaattgcacctactgatgcagcagctatattctgtaaaatgggcctagatgcatgggttaatcctgagaaattgtatcctaaagaggagagtctgatctactggtgtgatcccaagaaatctggtccagtctttggaggagtcctcgtagttctactcgctctcacatatttctctctaatcagtgtggtagcgtacgtttcactcatcgccctcggcgtcactttagcttttaggatttacaaaagtattgtacaagctgttcaaaagactggtgatggacatccattcaaagaatatctggaactcgatatatcgctaccgcaggaaaaagtcaaacagatcacagaagtggccattgcacatatcaatgccgctatcgtggaacttagaagattattcttggtcgaagatttggtagattccatcaaattcgcagtattgttatggactcttacctatgtgggagcgtggttcaacggaatgactctaattattctcgcttgggtcgccctcttcactcttccaaaagtttacgaagtgaataagactcaaatcgatgccaatttggagattgttcggacaaaattggctgaaattacttcaaagataaaggcagcaataccgatgggcaagaaagccgaagaaaagaaggaacaatagatttaacaacatctatcagactatattactatacatatattaatttattgttgtttctttattccattaaacgttcttatgtaatgtttctaaatataattagtgtacatatataagatgttattttaatgtttttttatttgaattttttgatgttatttatttcttgtaatacatagagtcgaagaagaatatagaatttaacat

SEQ ID NO: 3051 - DNA, 1175 bp, Diabrotica virgifera
ctgcaatcgggcaggcaggtagttttcctatatacgaacttcacttattcacttcatatatgaactaaatataggcgagcgtgtaattatatccttcaatttaaactcgtcattgtagtcagtatatagcgacaagtacatagcgaccttacatctctaattcaaggttgggtgcggattgttttggttcggtggtttattagtgcatgccattatgtcagaagattttaaaaaattagccaacgaaatagtccaggacgttgtggacggtgtacaggagattcaacacttacctgccaatgataataagtcaggttgttgtcagagatcgctgctctgtgttttattcagccctaatgcatggtttaatcctgagaaattggatcctaaagtggagagtctgatctactggcgtgatcccaagaaatctggtccagtctttggaggagtcctcgtagttctactcgctctcacatatttctctctaatcagtgtggtagcgtacgtttcactcatcgccctcggcgtcactttagcttttaggatttacaaaagtattgtacaagctgttcaaaagactggtgatggacatccattcaaagaatatctggaactcgatatatcgctaccgcaggaaaaagtcaaacagatcacagaagtggccattgcacatatcaatgccgctatcgtggaacttagaagattattcttggtcgaagatttggtagattccatcaaattcgcagtattgttatggactcttacctatgtgggagcgtggttcaacggaatgactctaattattctcgcttgggtcgccctcttcactcttccaaaagtttacgaagtgaataagactcaaatcgatgccaatttggagattgttcggacaaaattggctgaaattacttcaaagataaaggcagcaataccgatgggcaagaaagccgaagaaaagaaggaaacatagatttaacaacatctatcagactatattactatacatatattaatttatttgtgtttcttaatccattaaacgtctttatgaaggtttcaaataaaaataggggacaattttaaaaaagtttttttaaaaaaaaaaaaaaaaaaaaaaaaaaaaaaaaaaaaaaaaaaaaaaaggggggcccggcttaaaagaaaccaagttttta

SEQ ID NO: 3052 - DNA, 456 bp, Diabrotica virgifera
gtgggtttttgaaatcaagactcagccgaactagtatctacacacaatggttctttctggaaaatacagtgtaattggggaagaaaacttcgttcaatatcttaaagactatggtataccagaagaacaaattaaaaatagcggtcaattttctatcgaattcaaacaagacggtaacaaagttatagttactgaatctgctgccggcaaatctaaagttacctcttttactcttggagaggaatttgaagaagaacgttttggtcacaaaattaagagcaacgcaaaacttgagggtgatatccttgtaatcactaacggagaccattctaggaccttcaacttcactagcactggtttggaaattgcccataaatccccttaaaggtcagccaaacttcatttccaaaaaggattagccgccaaaaacttacgttggtttatattaaccttatg

SEQ ID NO: 3053 - DNA, 916 bp, Diabrotica virgifera
  misc_feature (849)..(849): n is a, c, g, or t
  misc_feature (869)..(870): n is a, c, g, or t
  misc_feature (875)..(875): n is a, c, g, or t
  misc_feature (887)..(887): n is a, c, g, or t
gaaaaatcaataaaatacatattcgatagttcacttgctaaagtgacatacaaagagaaaatgaaggtgattctttgtttactgggggttgttaccttagtactgagcactccagtgtaccaggaagatttacagaaatattatcctcaaggatcaattccatgcccattcttcaaaaaagacgccagttttaatgcatcttccgatgatattaaagtttattttagaaacaaagatcatcctgagagttcagtaccaatagacattaaccatagttcggaagtcgatgcgttgggattttcaccaaataaagatacaatgtttgttgtccacggctggcacaacggtcacgactcgccagtctgcgatgagatatccaaagctgtcctccagaaaaacgacataaacgttttcctaatcgattggaacaaaatcgccagcaacctctacttagtagcttacaaagcagttccagaggtcggtcaattactaggaacactcattagaaatttggtcaacaacaataaattggatttgaataaagcttctatcgttggccattctttgggagctcatgtcgctggattggccggagctgaactgaacggacggattagtaacattgtaggtctggaccctgctctaccatgcttctcatacaacgatatcagtacaagattggacccctccgatgcacaatacgtcgaagtaatacacacatgcgcaggtttactcggttttgatgtagatattggacactcagattattaccctaatggcggaaaagatcaacctggttgcactttggatgttgtaggaatgtgcagacacagtagatcatattactanctatgcggagtctttaattnnagtgnaggatttgctgncaaacaatgtaattgctacaaagatttta

SEQ ID NO: 3054 - DNA, 1216 bp, Diabrotica virgifera
  misc_feature (707)..(707): n is a, c, g, or t
caaagcaccaaaatacaattacgatttctggtaccaaccctacttcgacactatggtagctacggaatggggtgttccaaaagtattcaagaagggttttcaaccgtccgacacaagacccgaaatttacggaagaagtcttaacttcttctcgtggaagaaaagagaatttattcaaagcattaatttaggtgaagacggcattgcaccgctagaagtcagatttttacacaaccccaaagaaccacaaggatatgttggttgtgctgttaatgcaaatatctttaggttctatcgtaaagatgacggtacttgggctgcacataaagttatcgacgtccctcaaaagaaagtttctgggtggattggaccctacattcaaggaatgataactgacatcttaatctccttagacgacaagtatttatactttaacaattggctacatggagatgttagacagtacgatatcagtgatagagaacatccaaaattaactggtcagattttcctcggtggcagaatactcagcgattcagaccttaaggttctagaagaccaggaattaaaagagcaaccgaaaccagtctacattaaaggtaaaagattccaagcaggaccacaaatgatgcagctctcgcttgatggtaagagactttatataacatctagcgtgctttctccttgggacaagcagttctaccccncagttgtagagaatggtacaaagatggtgaagattgatataaaccacgaaaacggcggtatgaagcttgatgagaacttcctggttgattttggagaagggccgacgggccacttttggcacatgaacctaggtatcctggaggagactgcacttcagatttttggtgggggtctaaatgaaatcacaatttaattgaaaaaaaataatataaatttaatttttattattaaggataattttgtttggaaaatttggttaaaaaaaattggtctttttacttaaaagttatttcattaaaatggggttttatttaaggagaaaaaacaaacaccaaaagaagagcaacgaacagaaaaaaaataaaaaaaaaaaaaaaaaaaaaataaaaaaaaaaaaaaaaaaaaaaaaaaaaaaaaaaaaccacaaaaaaaaaaaaggggggggggggggggccgtcgaagagagaaagcaaaacgttttatatgccgcgccgcggggggggggggg

SEQ ID NO: 3055 - DNA, 1358 bp, Diabrotica virgifera
ctagagtgtttgtatcaaacattccctacgaatatcgttggcaagatgtgaaagacatcttcaggaatgaggtgggtgacgtttccttcgtggagctattttacgacgaatcaaattactacagaggaaacgtgcatcggtgtatctagacgagaaagagatattctccacttctttttattcctattctcttgtcgttctaatgtcatgaaaactagctccgaggcttatttaaacagtgttgttgacattgtgccaacttacatcgttcactctgtcatacaatgataatatcaaggtttaaggtcgatggaatggagggaatggaggaaagtgtgtcgctcataatctaataatcagtctaattcgtctaatggactgggagcagttccgaataatactttgcaacaattgagtagtttgacaggtttgagcgctcttaatgctctgcagtctgccaaccttggcagtctattgggaaacaacttaggatctaacgatctcagctcattggtttcaaactcacttggtggtggtggaggtggtaacccacaaccatttggtaacaattcaagttcaaattacaactcacagacttccaactataactcgcagtcgtcgaacttgggatctggaaattcctatcacagaggtggcggtggaggtgatgattaccaaagtggaggaggaaatagctttggtggaggcggaaattacggaaatggaaataacgatggatataacagttcaaatagtctatcgggaagaggtttccaaaattctggcaacatttccacatacaccagcgacaggctatcatttgttgataatacaaacaaaactttctccaaaaaagttttaatctcaaatctgccctctacattgagttacaacctgctgaatgaaaaatgtcaagaatttggcgatgttcaaggatttgaaacaaaaggacaaggctcagtgctattgacttacgcatcagattggcaagctgaaaaagctatcaaaaatcttgataaagctagaattgatggaaggatgatcgacgccagattgtacttctaaattagaacattaagatctttttttactattattttaaattatgtttagttttgaggtgccttggtgcaaatattattgtgtaactcattcagttatgtgtgtttgacattcagaataaaggaatagttttaagagtactcaaggtgaatacatatcggcatataggggatcagaaaatgtgatatttgtaattatgtcatttgcgtatatgattctggcaattatatgtcgtatgacttagagtacatataatagttagctaccggctcacatggcatacctatctgtgtaac

SEQ ID NO: 3056 - DNA, 1475 bp, Diabrotica virgifera
ggtgacgacgcgaatagacgccggtgactcgtttgttcccaattttcaatttatccaaaggtaagccttaaattcacttatttaagtacattaattgattaaggagggttaaaagattttagaatgactgatacggaatctaacaacgaccgcggaaggcgcgataataaaagaccacgggaagatagcttcagggaccgcagccgagaccggggtaacgccagtacaacacaaaggagcactaaaccctcccaaactagagtgtttgtatcaaacattccctacgaatatcgttggcaagatgtgaaagacatcttcaggaatgaggtgggtgatgtttccttcgtggagctattttacgatgaatcaaacaaatccaaaggaaccggtatcgttgaattcgctgataaaggttctgttgacaaatgtatggagaagatgcagcgatatgaagttaatggtagaaagttagttgttagggatgactcaggcgttactagggacagaactggagctatactatctggaacttccagaagacctccagcagagaggaacttcggtggtggcggaggcggaaatagcttcaacaacagcatctccttcagcagtaataatgatggaaactggggcaacacctatggtttgagtcctcagttcttggaatcgttgaaaattgaccctccactcgttaacagagttttcattgctaatcttgaatacaatgttgacgagaaaaagttgcgagatgcctttaaattggcaggtagaatagtaaatattgatcttcctcttgacaaagatggtcgtattagaggttttgctgtcattgagtatgatcaccctgtcgaggctgtacaggccatttcgatgttcaatcatcaatctttctttgatcgtacattggcagtgagaatggatagggcaaatgataatatcaagttgcccgagggtttaaggtcgatcggaatgggtctagggcccaatggagagcctttgaagtgtgtcgctcataatcttaataatcagtctaattcgtcaactaatggacttttgggagcagttccgaataatactttgcaacaattgagtagtttgacaggtttgagcgctcttaatgctctgcagtctgccaaccttggcagtctattgggaaacaacttaggatctaacgatctcagctcattggtttcaaactcacttggtggtggtggaggtggtaacccacaaccatttggtaacaattcaagttcaaattacaactcacagacttccaactataactcgcagtcgtcgaacttgggatctggaaattcctatcacagaggtggcggtggaggtgcctggaagtgataagctactgagaagaaaataatattatcttaatcttaacttgtaatgtatgtttctaatttgatggaataaattaatttttaagtctctaaaaaaaaaaaaaaaaaaaaaaaaaaagaggc

SEQ ID NO: 3057 - DNA, 1305 bp, Diabrotica virgifera
aattggaataaatcacgaatctttcaggttatcgtcggtcgaaacacgcgtcgtgtgtggtgacgacgcgaatagacgccggtgactcgtttgttcccaattttcaatttatccaaagattttagaatgactgatacggaatctaacaacgaccgcggaaggcgcgataataaaagaccacgggaagatagcttcagggaccgcagccgagaccggggtaacgccagtacaacacaaaggagcactaaaccctcccaaactagagtgtttgtatcaaacattccctacgaatatcgttggcaagatgtgaaagacatcttcaggaatgaggtgggtgatgtttccttcgtggagctattttacgatgaatcaaacaaatccaaaggaaccggtatcgttgaattcgctgataaaggttctgttgacaaatgtatggagaagatgcagcgatatgaagttaatggtagaaagttagttgttagggatgactcaggcgttactagggacagaactggagctatactatctggaacttccagaagacctccagcagagaggaacttcggtggtggcggaggcggaaatagcttcaacaacagcatctccttcagcagtaataatgatggaaactggggcaacacctatggtttgagtcctcagttcttggaatcgttgaaaattgaccctccactcgttaacagagttttcattgctaatcttgaatacaatgttgacgagaaaaagttgcgagatgcctttaaattggcaggtagaatagtaaatattgatcttcctcttgacaaagatggtcgtattagaggttttgctgtcattgagtatgatcaccctgtcgaggctgtacaggccatttcgatgttcaatcatcaatctttctttgatcgtacattggcagtgagaatggatagggcaaatgataatatcaagttgcccgagggtttaaggtcgatcggaatgggtctagggcccaatggagagcctttgaagtgtgtcgctcataatcttaataatcagtctaattcgtcaactaatggactttttggggcggttccgaacaaaaatttgcttcaagcaaataattagacaggtttgggaaaggggttttgtaagggctccttaaaggctctacccccgccccgccccttgccttagacaccttaggatcgggggaaaaaaaaccctccttttgggtcaaaaacctcccctccggggggggggggggggtcaaaaactcctttttttggggggggggggggggggggggggggggggacaaaacccccccac

SEQ ID NO: 3058 - DNA, 446 bp, Diabrotica virgifera
cccacgcgtccgcgaaatctgagtaggtaccaactataacaatgaaacaagttattgtctccttgtgttgtttgattatagcaactgcagctataccaattgaaagttttgtagatgaagatggccaacaatatgttttagttcctttgcagaggcagagaagggatctaacatggggagcaaaccaaaatggttactctcttggccaaaaaggtactatctacagcagtggtaatcaccaatttgacggctcgtacggtgcatcaaaagcttggggatcacatggtattaaacccgattcatttggcggccgtgtagattatactcacagtactagtggttcaaacgcctttgttggagcaaacagaactccaggttggggtactgatgtggctgccggtggaaggtacaatatagttcaaggaaagaactggaatgttggtgca

SEQ ID NO: 3059 - DNA, 1951 bp, Diabrotica virgifera
cccacgacatccgtgcgaaaatagcatctagtatcgcgcttcacgctataaactgtaaccaatttagactgttgtttgtatgttcagcgctcacacattctagatctagatcgagagacgtgtatttcgtgtataagtgaaaattaatgttataagtgaaaatgttttaagaatgtggtgcaatgcgtggaaatatgaagctaattcgcgtgaaatctaggcatagatacaggactgggactgaaaacaataacagtgttaagaatagtgaatattgtgagaattattcgtataaagccaaatcgaacgtctctgcgaaagtccagaaagaagatgaagtagccttttcagccagaaaaaaatgtacattgcgaatatacttgataggagtgttattagtatttctcgtatctactacagctgtgatattagtattcgtcttacgaaaagatgctcaagatcaaatcccacataaagaggataccataataataaccaactcgtcctctagactgataccaaaagaggtttgggggggaagaaaagcggtggggaaaatggaggagctgaaaactcctgtaggtttagtcattctgaaacatacagcaggtggaaattgctctaattttgagcagtgtgccaagaagatgcagacgttgcaatcaacggacatcggtgataacgatttaccagacatatattttaattttggtattggtgctgacggaaacgcttattttggaaggggatggaacatcctcccagcttctagggcaaactgtatcgagatagtgttaataggaaatttccagatagatcccttcacacttaccatgtttaaagcaacaaaggcactgctgaagcacggaacagatcataagtatttatccgaagactacaaattgattggccacaaccaagttaacacgactaaaagtccggggaaaaatgttctggctgtaatcaatcagtttcaacatttcgatcctaccgactacaagggtattccgctagactccgatccaatgatattgacttcgtctacaatacctacaacccttaccgaggacgaggagtagacgaaaagctaccaccaaaaaaaaaaaaaaaaaacaagaaagggataacatggatctgctgttctattattgtgatcatagtgatgtgtgcaacactaatttttataaaactattactcctccgtagccgtcaagaaatttttgctgtttcaaacagaagtgctgacgacaaaaaagtgttccatgacgctcccaatgttttctgtagacatcagtgggggggtgtgtttcccaagaaaataacatggtttacaactcctgtagatttggtggtgatcaaacaaactggtgataggttttgtgagagtgaagaggtttgcaaggcattgaccctcaaaatacaaacattccatatggcgcccatgaactattccgccattggttataattttttttttgggggagatggtaacatatacataggaagaagttttggtgtccccaatgaacccatgcataaaactatagacatagcaatccatggtaacttttactttgatcaatttttcgattatatgcagaatttttcgaaaaatattttagatgctggattggaaatgggttatatttttcagaatttcagtttggtgtgtcataatcaaactgagctgggagtttccagtccaggacgaaatgtatataaagtagtgagtaactggactgattataactataagagttccccgttttttaataagcaactttgacgtttccttgtacatagttaataataaaaaaatgtgagtgtatttttgtaaataaattaatataaatagtaaaaaaaaaaaaaaaaaaaaaaaaaaaaaaaaaaaaaaaaacaaaaaaaaaaaaaaagggcggcgctcgcgatctagaactagcggacgcgtggg

SEQ ID NO: 3060 - DNA, 1871 bp, Diabrotica virgifera
gtgtacaggtgactcacaacatgttccaataaaccttgggttaccattgcacaaaaatattattttagtgttagtgttcattcaatcgtttgagtgtggtttttatagtggttatgaattacataaatgcctgttaagaagccagcgcccctcagcaaagatccagacgtagttgaatctcaggaagaggaagaacaaattctgaaagccatcgaattgtcgctgaaagagagcgggggctcccctcgttcttcgacgaacactacaaccacccattcgacttctctgtatccgtcaatgaacttgaacgctccttcgagagcgccggcaggagcaactgctgctgccgctccctctgctaaggaacccaggaaggttagagctttgtatgattttgaagctgccgaggataacgagcttacgtttaatagtggggaaatattatttgtattagatgatagtaatccaaattggtggaagggaaccaatcagcgaggtgaaggactttttccagcaaatttcgtcacagcagatctttccgtggaaccagaaaaattcttgtacgagaaagcaaaaaagatggtacaatttaaggaaaccgctgaggtaaaagttgtaaaagacgaaccagaagatgtagaaataaatgaacaaaaaatagacaggctgttacatctgttacacgaagcggaccctactaatcctgaaaaagatactgatgaaatgttaaatttggaaagagaagcaaacggtatgggacctctaatagacgcagagttagagaaagtcgatagaaagcatgcccagttaacacagcttagtgccgatctagttgaagctttaggtctttaccatactttgatgagggaaccacctttcccgtcaataagtaaaatgccttatggatatcctccgtcgtcacacatgcccttcaatggtacgctaccccccaacgcccatattccgatgatgctccaagggaaccaaggccccgatagagcaccttttatgcatgccccaggtggtgttccccaagccatgatgcagcagatgcatatgcaacacatacctcccatggcaggtggacctcagttacaacatccgcagatgcagcaacatctgcaaggacctccttctcagataccgccacagatgcagcaacagatgatggaggaacggaggatggaacctcatatgatgcatatggacttccaaactatggtccagctagttcggtgcctcagccttttccaccacagtcgatcccggggtcaacatcacaaacgaacgtatccaatggcgcccaacaacacccaggcgtccaatatgttacttccagtactcatatgacgaactgagaagatttacgtacctaccgaaatgataatatgtgatgtattatagttttatgagattattgagtgtcccccgaacttctgtcgaataacaatcgtattctggctgactttggtcgtatttatattttagagtatgctgaagagctttaacatcactttttttgttgttgtatgctggttttgatactaaacgatagaagtgaatggtaccaaagaatttgtttaatgtaggaggctttaacaaacattaagacttgtaatagcttgttaatagtcgaaattttgaaaaatgtgttacgcacttttgtaaatcattccagacttgttaaagtgtccttaattgaatgtggactttggcgatactcgataataatcaatattattgtgtatagatttgtttccttattataacgcctaaaatgtatatcctttctgttcattattgtataaaactatttttcaagttatgaacaaaacataattattaaagaaaaaaaaaaaaaaagggcggcc

SEQ ID NO: 3061 - DNA, 1127 bp, Diabrotica virgifera
cggacgcgtgggcaaaactcagattatttcctagttatgtcgattaatttattagtgtaacagtttaaatcatatttagagcaatagcgaacaaaatttaagagtttagtaaaaatagttaaagcaaaatgggtatatttggtaccgcagctgatgcagctatcacagaagaaattgaaactgcgactacagaaaaaaatgatgatgaagattggggtcttatcatgaccatttgtgataaagctggacagacgtcagataatgcaaaagcttattttagagcaattataaaacgattgtatcatgaagatccacacgttggagtaaaagctgttacattattagacgcttgtgtaaagaattcaggaaaagtattccacgtagaagtagcttctagggaatttgaaaatgatttttctaaattaatgaataaatcacaccatacagtagcgaaaaaattacgagcatctctttgtaaatgggcggagaacgaattcaaatctgatccacaactaaatctcattccttctatgtataataagctaaagaacaaagggttggattgttcctctacagatatgcctgttaagaagccagcgcccctcagcaaagatccagacgtagttgaatctcaggaagaggaagaacaaattctgaaagccatcgaattgtcgctgaaagagagcgggggctcccctcgttcttcgacgaacactacaaccacccattcgacttctctgtatccgtcaatgaacttgaacgctccttcgagcgcgccggcaggagcaactgctgctgccgctccctctgctaaggaacccagggaagggtagagctttgtatgattttgaagctgccgaggataacgggcttacgtttaatagtggggaaatattttttgtattatatgacagtaatccaaattgggggaagggaaacaatcaccgaggggaaagaattttttccgcaaatttcctctcaccaaatctttccttgggaacaaaaaaattttgtatcaaaaaaaaaaaaaaaaaggacaaatttaagaaaaccccccggggaaaaattgtaaaaaccaacccaaaaaagaaaaaaaaaaaacaaaaaaaaaaggcgggtccctcctt

SEQ ID NO: 3062 - DNA, 549 bp, Diabrotica virgifera
taataaggtgcttgttcgagatgaagtttttatatttgttttggctgcttgcacagcacatattgttagctcagctgcagtagaaacaagtgacaaccaattggttttgcatcaactccgtcgactacaaagagacttacaagctagaggctcagtagacttgtcaatagacaacataataaacacggttataagcacggtcataaatgttgtatcaagcatacttattaaagctttttgtggtgctataacaccttatttacttctcgtatcagtctttagaagtacagttatcaaagctcttagtttaattgtgcaatttttaggtgaggtagccacatcactgttgccagctttgtctgatactgttacacaaattactagtttcatatctactgtagattccacaattggtaatgccttagattatgtaaacaaagcaggatgttctgtttcagtgtaaatgcacctttaatgtagttgtttatgtaaaatgtgaaatattaaaaattttatttgggctttaaaaaaaaaaaaaaacttgggggg

SEQ ID NO: 3063 - DNA, 1023 bp, Diabrotica virgifera
caactgtgatatttcagcctatttcgagtttaagctctatatatgatgtctgttacatacgagctgataaacaattgaataatactttgcaagctgtgccagaatttacaacaccagatgaattcaaagataccaaagaacttataaatcgaattaaaataattgtatcaaaaatagaatcaactaacgttcaacgacaaataagagatattgaaggttcattagacgaatatcgtaaaacaactgaccacctcaaagaaaatcttaatgagctccaacgaataaaaaatgcttttgatacttttaataattataaagcatttaacaaaaagacgcaaactgtttgtacatcagctaaaatatattatggtaaattaaagaaagattatgaaaatctgaaactgtatctagaacaactttcagatgacataaagaaaaaagtcgacgacataaattcgaaaagtctaaaaatcaaaaaaagcacttgatgggttaaaatttccaaattatatcaataaaaaatatatttgcgataaaaccattttaggtttaaaggatataataaaaatagcaataactaataaaaatacgttgacgagtattaaagatgatctaagatctcatttaaacgatttaaaagaaaacttaagacctggaccaattagagatccaattccagaaatgccattgaccaaagaggagctgaaaaatgcaattaaaattgttaaagaaaagttgagcttggtaaaaaaactacaaaagatgctggaaaagaaaagaagagttaaagaaaattttgatcaagttctaaaaattgctttagagttatgcaatcgaggtgtatgtgaaattgaagaaactgtttatgttgaaaattaatgtataagcctaatcgcaatcgcctaatggcctaatgcaatacatatttatatacctataatttttttaagttttatgaaattttcttaggaaaaagtttaaataatttgtaattattaagaaataaaataaatttaattaata

SEQ ID NO: 3064 - DNA, 790 bp, Diabrotica virgifera
attagaagaaggacttgatggagaaacattcttcctctatgtcttcctcgccgctggtgtagtattgcttctggttattggacaacaaactctgctatcagttggtaagaagcgcagtggaggaagtggaggtagcagcaggaaatcggcacctgttgagactggaactaacaatccaaacaatgttgactacgattggttgccaaaacaaacactagctagcttaaacaaggaaaagctgcaaaaatcgcccaaaggcaaaccacagagcccaaggcagaggaaagtcaaacgtactactggatcagagtagtgttaactagtgactgaataaaaaattcatccaattcgttttcatcttgatcaaaagactcgtcattgaagttactaaattctacttcatcagaaagacggaaaattactactttctttagatgtatctaagaaaacgtttttttgtggaacatgaatggcttacatatgtattaaaaatatgtgtggaataatcttgcacttcagaataatcgattctaacaccaatatagaaacgttttcttagagttttcatagactgtcattactgtacgtactcattttttaagtttttccgggaggtagttgttttttgttctttcgaaaaactatttataattttgtatatttcagtgtgttgtgagtttccagttgttatatttgaaatagattattatatgattgaatatatcccgtgaatattcaaattaccccataatggtgctcaaatgccctattaaagcgtaatttgatttgt

SEQ ID NO: 3065 - DNA, 1362 bp, Diabrotica virgifera
  misc_feature (1282)..(1282): n is a, c, g, or t
gggtccacccgtcgaaaccaaccgtgcttgtagaaagtcaagaaaggtggccggtcatttagtttagagacttgttaaaatacaagcaagttaagtgaggctgtgagatcttgtggttcagtaaacatgaacaaattaatatttttagctttattagtgttcccagcagtcattttcattttcgaaaatggcaaaatggtatcgtatgctgaagaggaccccattgaggacgaagtagaagttgaaggggaagtggactctgatgttgaagcgacgactccagatgaagaagtggatgaagatacaaagtcactttcatcaccatatgctgatactaccctgttgtttgtgaagcctgaatctactggagcctctcaactagaaattccggctggccttcctgtcgaattccttgtaggattccgcaacaaaggtgatcaagattttgttgtagacacccttgaagcttccttccgctatccaatggacttcaacttcttcatccaaaacttctcagctgttggatatagcaaaattgttcaacctgaagaagaagccactttcctctacagtttcctaccagctgaagcctacgcaggccgaccatttggattgaacatcttgttgaactatcatgatgcttcaggaaacgctttccaagaagctgtcttcaatgaaacagtccaaattgttgaattagaagaaggacttgatggagaaacattcttcctctatgtcttcctcgccgctggtgtagtattgcttctggttattggacaacaaactctgctatcagttggtaagaagcgcagtggaggaagtggaggtagcagcaggaaatcggcacctgttgagactggaactaacaatccaaacaatgttgactacgattggttgccaaaacaaacactagctagcttaaacaaggaaaagctgcaaaaatcgcccaaaggcaaaccacagagcccaaggcagaggaaagtcaaacgtactactggatcagagtagtggtaactagtgactgaataaaaaattcgtccaattcgttttcatcttgatcaaaagattcgtcattgaatttacttaaatctacttcatcaaaaagacggaaaatactacttctttaaaggatttaaaaaaacgttttttttggtgatggctactatgattaaatatggtggatatctgactcagatatcatctacacattagaactttctaagttctaatgcatatgacgatcttttagtttcggagaatgttttgtctcgaaaatttattngtattcaggttgagtccgtgtaattgaaaatttatgtgaaatcggaatcatacctatgcgtcagctataagattgatggg

SEQ ID NO: 3066 - DNA, 536 bp, Diabrotica virgifera
gagcgttggttttaatttattggatccgttctccatctccattcggcagcgctggtttgacacgaactcacctcacctcacttcattcaagtcccagtagccaaatcgttagtttatcagatccttccctgttctttatcaaaaaccgaaaatgtctttagacgagagattccaaaaggctgctgccgatatcaagaacttgaaaagcaagcccactgacaatgatctattagaaatttacggattgttcaaacaagctaccgaaggagactgcaccacagcccgacctggactgttggaccttaaaggaaaagccaaatgggactcgtggaacggcaggaaaggatccagtcaagacaaagccaaggaagaatacatcgcaaaagtacagtcgttgatcgatagcttaggactcgcataaggcatttttatcatcacttttttttaagggaaaactattttgttatcattatactctatggttctaataaaaacaattttcttgtaataaaaaaaaaaaaaataaaaaggggggc

SEQ ID NO: 3067 - DNA, 852 bp, Diabrotica virgifera
ctgaattacttgattaatacacttccagttcctctcccgaaatcaaaaatgttttgtaaagtatttgtacttgctctcattgtagctgttgctgttgcatcacaaactgctgaagaagcatggccaaaatacaagactgattacaataggaactacgacgctcaggaagatgctacaagattcgccattttcaagactaactacgaccagattgaagcacacaacaaaaagttcgaagctggtgaagtaacatggtccatgggattgaaccaattcgctgacaggaccccagaagaactaaaacatcttcatggactcagacgtcccgtaggtggtagtggagtacattaaattagttattaataaaaaaaattttaaaataaaattatatctttgaacccacgcgtccgtgattaaaaaataaatttaatcaccccaattaaataaatttattatataaataaatttaatactaaatttatttaattggggtgattaaaaaataaatttaactttttttatattattatattaattaataattttttgatccaatttttttgattataagaataaattaccttagggataacagcgtaattttattggagagttcaaatcgataataaagattgcgacctcgatgttggattaaagtttataattggtgtagcagctatattattaagtctgttcgacttttaaattttacatgatctgagtttaaaccggtgtgagccaggttggtttctatctttaatttattaatatattttagtacgaaagggacaaatatataaaataatttttatatttagataaatattaaaaaaaaaaaaaagggcggccgct

SEQ ID NO: 3068 - DNA, 471 bp, Diabrotica virgifera
catgaagtgtctaattattgttacggtgttctgcattttggttgtggtcaatgcaggccctacccctaccagcgaacaaaaggaagctgtcaaaaaggcccatgaccattgccaaaccaacgaggaaactagaattgacgacgatgtgtttgaaaaagttaagaagggcgaaaaggtagacaacgcaaaactgtcaaaacatactctatgtatgaacgtacaaactgggcttcaaacgcaaagtggtgatataaatgtagacaaattgaggaaggctctgactgaagctataagcgacccaaatcttgtaaatacaatcgtagagaaatgcggcaaacgcgtagcaggtgaaaccgctgaagaatctgctgttacttttttcaaatgtcttcattcgcaaggtccaccacatggtcatggacaccattaaataagttttagcctagaattagcgtaaataaaagattatat

SEQ ID NO: 3069 - DNA, 1776 bp, Diabrotica virgifera
  misc_feature (35)..(35): n is a, c, g, or t
  misc_feature (77)..(77): n is a, c, g, or t
  misc_feature (117)..(117): n is a, c, g, or t
tgattagtagtaaaaaccattttattgtcagagcnaattatataatctcacatataacagaaaggattagcgtcacnaattagggagcgagcgttcataaaacgcaacacaaactgnttactctcatcgggactgctcctcccctttcgtctggtgaatgccgccattgttatattcttgctcccatttagctaatggataaatctacagtcagaaaacaaaaaaaaaaatattcaaatacgaacgaaaaattcaacttttgggaggaatgcgatttaacaaacttcttgttatctaggggtatcttgtcaaggatacaccgatgatatcccattaaaaccatattgagagcattttttgtaaaggaaagacgaacacaatcaagtttgtacatatggtttatattccaaatgcaccatgaccatggaaatatagtaggtggaaaaagaataacagaagatatttataatatatctccaagtggaagctacatctttaggtatgattactaaaaatataaagttaactataagggcaagaagactatgaagatcataaatgaaaaggaataaaaaataatgatacctaagatttaaaacaagaaaaaaaactagaatatatgcatttttagattcaactataaccaacatatcgagaaatataaaaataaatcagataaaatcagtaatttttaatttttttcttgatatgtgttaatataataaatattaaacaaaatagttagaactagaacatttaggtgtgataacccataagtgcgcctttctcaggtgttttattaaccctccgttagtcgctatcggtgtcacacaccgacgacagaattattcattcgggatttacaaaataactggttttttctatcgccactttctgtacctcttcctatcaactaacctcgtgttagtatacattcttacctacttgggtacagttgtgcgagttttatagctactttcggtgcaagactccttagcgactaacggtgtggttattactttattggcataacttgcagttcacgtaaagatttagcatcttattattgcattttatcagtaagttttggtcaaatcttatttataggatgtcctttgaagtcgaacaataacgtttgttggaattatgggaaatggttcctagcgaataattttatattacaaataacaatatgtatattgctatactagggtttttcattttatattgttgtttttcaataaaacattttcaaaaatatttttcagtcattcctatacacaatataaaatatttgtatgaattttatagcaataactattttttttaaattgtcggtttatgacaccgtagcgactcttgatgctccgtttatcctagcgactaacggagggttaatatctaggtataattttcagaaacctttcaacaggatcacggccttttacgtatcgaattataaaagtttgctggtcaacatgtgacaaatagggtgtactgtcaacgctaatggaaaaatattttgctaatttatttttgtatatctatatttatcatatttatttatagtttagttaggtgatattcgtatcaactcgtgtccaatacgataatctttgtggtagccatgacagctgtcataatagtatgcagttatacagctctatcactctatccaactgcatagtatttagtacctaaaatatatacagtgatgagtgcactaataaccagcaaaataacgtaaaagaccccacgcgtccgcccacgcgtccg

SEQ ID NO: 3070 - DNA, 1225 bp, Diabrotica virgifera
aagaaagtcaaggcagttagtctccgttaatgtttaagttattaagactgtgataatgctggtcagaagttacttgtgtgttttgttggtgttaatttttgaaaacaatggggtgttctcacaaagaggtacatcctgcaaaactcctaaccaggaatgggctacctgtaactcaatatattcctgcagagctctgttgtcagctgttcaaacaagagatccaactcagctaaagtttttaaaagaatctcaatgtggatatgactcagaaccattagtctgttgtggaagtacatcgacctttgctctaacagggcgtagagtactaaataatgatgtaactgctgtagccaccggtggctctaattcgaattatagggttaattctgccattcccgatagaccaaaatgtggacaagacttttctgacaaaatttttggaggaactgcaactaaaattaacgaatttccatggatggctcttctgcaatacgctaatcctgctggacataggaggtgggcttgtgccggatcactcattaatgagagatatattttgacagctgcgcattgtgttacaggagatatctcaagggtagtaggaaaacttgtaaacgttcgtcttggagaatataatacagaaagtgaagttgactgtgacggagaactgtgtaatgacccccaagatattggtattgaagaagtactatacaacgaaggttataataataacaatgttcataggtacaatgacatagctcttattaggctaaaccgaaatgtcaagtttagtagatttatctatcccatatgcttacctcatcctaacgaagctgccagggtcggggaccgtgtgattgtagctggatggggaaaaactgaatcatccagtcgcagcaacataaagctaaaggttgagattcccatagctcagaggtcacaatgtaccagagcatttgcttctgctggaattattttgaaaaactcacagatttgtgctggaggtcaaagaggacgagactcttgtgcaggtgatagcggtggtcctttaatgaagaccgttgaagatgattcttctacttggtaccaagaaggaatcgtatcattcggtgcaagatgtggtactgaaggatggcccggaatctacacaaaagttgaaaattatttaggatggatccatagaaatgttagagaataggcaaagactggtaaataatttagatta

SEQ ID NO: 3071 - DNA, 1697 bp, Diabrotica virgifera
cggacgcgtgggcttttcttaaccttcgagtccaccgggttctgcggtcctgcggcgcctttttaaaaattagagaaataaaagtcgctatttcgtcacttattttttagttgcttattggcaaccacttcgagtgacgagcaacggtgttatctcttctagtttttatcaaagaagttatttttatcagaataccgaacaaacaaccagaagaaggcagtgaacatgtctctgaaacaaacagtgtcacttttacatagcaaaaatggaattaacgccgttgcacaaagagccagttcttggtggtctggtgttcaaatgggaccccctgatgtaatcctaggagtaactgaagccttcaaaaaagataacaacccaaacaaaatcaacttgggtgtaggagcttacagagatgataacggaaaaccatatgttttaccatccgtccgtgcagctgaagaaaagataaaagctaaaggtttggacaaggaatatgccccaatttctggtgtagctgaattctgtaaaagaagcatagagctcgctcttggtgaaaactcatcagttttgaaagatggtatgaacgccactgtacaaggtatctctggaaccggttccctcaggataggaggtgcttatttgaacagctttttccctggaaacaaaataatctacctgccagccccctcatggggaaaccacaaccccatcttcaaacactcaggattagaagttaagacttacagatattatgatgctaaaacctgtggattggacttccaaggcaccatagaggatatttctaaaatccccgaaaaatctatcatccttctccacgcctgtgcacacaacccaaccggagttgaccccaacaaagaacaatggaaagaactgtctgacgtaatcaggaagaggaatctttttgtatacttcgacatggcataccaaggttttgctaccggaagcgttgacaatgacgcttttgcagttagatatttcgtcgaacaaggccacaggatagcactcgctcaaagctttgccaagaacatgggtctgtatggtgaaagagccggagctttcagcatcatcgccaattccaaagaggaagctgatagagttatgtctcaaattaaaatccttatcagacccatgtactccaaccctcctcttcatggtgccagaattgtagccgaaattttaagcgactctactttgagaagccagtggttgccggaagtaaaaggaatggctgacagaatcatctcagtccgtagcaaactcagggaaaacttaaagaaggaaggttcaagcaggaactgggagcacattacaaaccaaataggaatgttctgtttcaccggaatgggacctgaacaggttgacaaattggtgaaagaacacagcgtatacctaaccagagacggacgtatctccatggctggagttacctcaaagaacgtcgactaccttgctagggccatgcatttagccacaaaataagttcataagatacgaaacgaagttatatttcgatattaagtattaaaatcgtattgattctgtattttaattttacacgcactctactcagttcacgcatttagattttttgttattatttttttagaattgttgttctaaattgtgtacctatcgaaaaatgttatattttaaaaaatagatgtgtttatttactt

SEQ ID NO: 3072 - DNA, 700 bp, Diabrotica virgifera
  misc_feature (3)..(3): n is a, c, g, or t
ttntttttacgcggaatagtcatctgtgcgcgttgctggacggaaactgctctccagaattaaaaataatgattttataaggatataaatactttgttccggtgaccacttacatattgtatttgtttctctaattgttgcaggtttttatcttgaaaccgaatccaaaacaacatgcattacaaaattttcatagttttcgttgcgttgctcggtgcctgtgtagctactgatacggtgaattggtctgattgtggatcaacagctggtgaggtaaaatctgttgttgtagctaattgccattctgacagatgtatcttaaaaaggggaacgaatgcaacattggccattacatttgattcaaaagtcagctcaaaaaacctaaccgcagtagtatatggtgacgttttgggttacaagaccaaattccccctaccaaattcaaacgcatgtaaaggagtaggagtggagtgccctctagaagaaggaaaaacctatgtatatactgatacctttgacgtaaaacaagtatatcctagggtgattgttgagatttggtgggaactcataactgacactggagacaaagcagtatgtgtcatcataccagcaaagataaattaaatgtatttatatttttagtctaagaaataagtacctataaattctctcaatgttaccttcatatcatttctcgaat

SEQ ID NO: 3073 - DNA, 920 bp, Diabrotica virgifera
cccacgcgtccgattgtgaacacatgtaaatatacagtatttttaagttatcaccccaattagctcattacttattaaaatggctgaaataaatattgacatagacaattttgaaccaaaaaaggctcaaaaacgtggagtgtccaccagcgaagacatggaagtggaaattgtgaatggtatagaaggaaccaataacaaagttagagcaccaagaacgaaaaaggcaagatccaaatcattttccgaaaccaaagatgacatgagaaaaatagctgtaccttcacatagatactcaccattaaaagaaaattggttaaaaatattcacacctgtagttgagcacttgcaactccaaatccgatttaatttaaaaaccagaaacgtagaaattagggcatgtaaggaaaccccagatatttctaatttacaaaaagctgcagatttcgttaaagcttttatttatggttttgaagttgaagatgcccttgccttaattcgtctagatgatctgtttgtggaaacctttgaaattaaggatgtcaaaacattaaagggagaccaccagtctagagctataggaagacttgctggaaaaggaggaagaactaaattcacaatagaaaatgttacaaaaactagaatagtattagcagacagcaaaattcacattttaggtagctttcaaaatatagccctggcaagaagggcagtatgtaatctaattttaggttcacctccttctaaagtttatggacaattaagaaatgttgcatctagggtatctgaaagaatgtgaataaattatttattaaaaaaaaaaaaaaagggcggccggccttttttttttttttacataaagcccgcccatttttccgggcgggaaacttgccgtgtttatcctaatgggatccaagacc

SEQ ID NO: 3074 - DNA, 1208 bp, Diabrotica virgifera
attgacttttactgctgtctattactgtagcggagctattgagctttaccttactaatcaatcaccctgtatacctagatagacttttagtatagaaatataaaaaatatgcaaaatgcatatgttattaacttctgtaatcctgaatttcctaaaaaataattaaatgttgaccttacgaattataccgttacgaatatgtagttacgaactctcgccgttacgaattgtccgttaccatttgtcgggttacgaactgtcgcgttacgagatgtcatggaaccataataacacacgcaaggataaaaagatacaaggataagataacagattgtacgtggccgacattatcagttatgtttggagataaaatggttccggttcgttagaatttaacagaaatattcaagtgttcaaggttagaaaactaaactgtttgattaaaaaaaattttttttcattaatttctaagtaaaaataccattttatgttcaaagagccgatattgtagcccccttaataattatttttatgtttgtcccttgtccagtgtgtgttatctatttgtattatttttaattaaatgtctgacattccgggatttgctggataacttccttttttgacggaatgccccctgatgatgctatgagagcgaaactacttgggcaaaatttaataaataactgctcgatatctgcgttttatttgtaaaattcatatattcgagcattgaactatatattattgaattgtaatatagttaaaaggcaattaagataaatttttacagagtttatcgtgttcttctatgattattaaataattctagtttatttgttatctcattactagatctagtaagagataacccatgaattttttaaaatgtttatccaattctgatatatctgttaagtacataataatgaacctattaaataagtcgcagattctacatagtaaaaaaaacttgtttcaataaatttgaaagttcaaaacgctttatccagaaagtttgtaaatatatcaaaaatattatcagtagtaattgcacaagagctctaaaattattgaatttttcccgagtgacactttgacagttttaatttcacgagccgaagtgtcacgagggcaaaatactatattaattttagagatcgagtgcaatttgttgcgattatttcatgaataaaactgttcaacac

SEQ ID NO: 3075 - DNA, 2470 bp, Diabrotica virgifera
  misc_feature (2357)..(2357): n is a, c, g, or t
  misc_feature (2366)..(2366): n is a, c, g, or t
cggacgcgtgggcggacgcgtgggaaaattgaaagtactacagactgtgaaactgatacagaaacagacgatgaatatagtggccatctacaaataaatcccctgcagtctatgaaatctataacaaatattacttctcttaatgcatacagtagtgacgaagatatttctaaagaagaaatacaagaggatgagtattcgggtgagtctaatgacgaaattgatgatgccagttcaataggttatgaagacgatgcttactctcaccaacttagtgttattatggaagagagtgaaaggacagaatctagaataagaagttttagtgctatgagtgatactactactatagcagaaagaagtgatccagaagaagacattgtagactacagtaagacagaaaagcttgacagtagacacgaaagtatttcagatgactacaataaacataatgaagaagaaaatattgtaaattgcagagaactagaatcggatgacagtaaacaagaacgtgcttcagaccactatgatagacataatgaagaagacgtactactagacacttataaagaagatgacattaatgtagattgtgaacatgacgatgatgacataaaaagtaatgacagtgaagattggtgggggataataggaaaagaagacgacgatttaccagcaccaaagaaaacacaacttttttgcaatgtaaacgtagaggaaaagagcattttgaatgaatatgccgccagtgaagatataatagaaagtgataattcagatactgaagatatagttagtattaaagttaatgatgtagaaactgatagagtagataatttagaaatacataaaaatgatacagtaagtaattatagcacagaggttactaattcaaacaaaaacacaactcaaaattgcaatgaagaaagtaatgagtatagttcagaggtcactaatacaaataccaatacaactcaaggttgtaatgaagaaagtaataactacacagaatatacagtggtacgacgaattaaaaagaaaaacaatgttgtacacaaagaaacagaagttaaagaaagcttgtctcgacctccgagtatataccaatctttagaaagcctccaatcagaaccaaaatctaggcctagaagcatatacgaatcgttagaagatatccaggcagaatcaactggaagtcttataaaagttgataattttgtaggtattttggaacaaattcagaaagagactggtttttggaacttaaattcaagactaaacaacgaaaaaggtatcgaacctgttaagtttagaagaactagatctgtggaggaaaaacatttggacgaagagaaaaggtttacttggacatcgtttgaaaactttaatagagaatccctggatgatttggagaacaaaataaaaagaatgtcttgtggttcattggaagatttgaaagtaaatattaaaacggacgaaacggttgagggttctactaattatattaagtataattctagtttgagctcaacacctgttattgaaacccaaattattcttgaagatataaacgatgataataagtcttccactaatgaatcacatacagaagattctgactcttctgcttcagagaaagacgataaagaaactaacaacagtctagtgagactcgatgatgacgctgatgttaaaatacctacaataaaagaccgaattcaagctttaagagaaagtattaacttaaagagaagaatattctctgatgacactaaagagttaagtaaggataagatttcaataaatgattcaagtaacagaagcaaaacagcttcttcaaaaagtagcttaaaatcttttgaagagttcagtgaagaagaagaggtagattcaggagttacatcagacatgagtaggcatatatcagataccgaagaatttcccgagttgaggaagcttactaaataccaaagagcagctacacactcaagattgtttaaacttttacaagaagaatgcaataacgaggatgtagaagaagatgctgaagagagcaagcaagctttagatctgaatttaaacgaggctaaaaatccagtaaatgaaaggctagttaatgagttggtagatagtttactaaaactcaaaaaaggacaagcgtttaagaacttacctaaagaaaaattgtatgcagcagccgtgaaaatattgcaagaagatatggaggttacagataccctttctggatattccacaagtgtccaaacacctcaagagttcggaaccaattctgatgattataacatactacgatacgtgggatagaagcgaagaaagctttgacatatttccttcanaagccttcnaaagtctgcaagaattatcgagcaacaaacaaggaggtggattgagccctataataaagtgtcccaaggtggtgtcctctaaaaacatccacaagaaactgatc

SEQ ID NO: 3076 - DNA, 1280 bp, Diabrotica virgifera
gttataaatatgtatttgacggttgaaagtcatcacttttataatttttaaaacatttgtcattaatgtcactgaatgtaatttttcgtagcaacctagcaacgaagggcatctgacgtaatatgcttaacgacgggagattatcaaaaattatcaccttaatttgcatgtctgtagctttctattggtcagaatctcctatgaaagaaataatcaaaataacttacaattgttttgtcgatttacccatttgtcatgccactgacttattttccgatgatgtgaaggccaattctcttctctttttttaataaaggataaatatttttgaaataaattcattttgattgccgttatctttatattagaatttaataatgtttaatgcacactatttgttaataaaaatgagtctgtaaaacgtgtttaatgactagtgatagtacaattactgatataataaaaaaataaaatagatacataaattaagtggcctaggactaatcaacacctgacatcatttcactattttcatttaaatattttcaaaatttgaagtgttttcaattattacttatacacatttagttttcattttaatttaaacgtgaagattataaaatttgtccttgtttatatgcttgaataaccagaaccagacaaaactatcattccactagtcagccttcagaatggaagccttatccaatattttgcagccctataaaaatgtagtgggacaaacggcaagtattgttaccattgcccagttcttctctggggcctttatatgcaaggacatttataaaaagaaatctacagctggaattcaggctgtcccttttattgggggtataactattggtatattaatgctaaaactagcacttttgatgaacgatgctgccatgctccaagtcaatgttgctgccattgggttgaatgtactataccttgcattttactactattattctgctgataaatataacgaagtattaaaacctggcagtgtaggagtcgcaattgttgctgtttttatcggatattcacttgttgaagctccacaattactcgaatatagatacagtttggtggtgacaattttaatgctggcgtcatttggagctccactgttagatgtaaaagccattattgacaaacgtgatgcttcttccataccgttcccatttgacttttatgagaaccattgttacagcactttggttatatatggcatcattttacaaaatgcatttatgatagttcaaaacgtcatc

SEQ ID NO: 3077 - DNA, 2123 bp, Diabrotica virgifera
  misc_feature (206)..(206): n is a, c, g, or t
aaaaataaaaaagacgtttttattacacctcatttaacaaattataacattttaataccttattttaccaaaatatacggagtttgactgatcaaaccacaaatttcatgaaattagttcgacggtcgcctgaccaaattagtctctcctaggtttgacgaaatttatttggtcaaaggccgaaaaacgtcatttagttgggcctntactaagaccttaagaccttaaaactttaagaccttaagaccttaaaaccttaagtcataagattgactagctaaacctaggagtgctagaacatcgaggtttgactataacatatattttatattatacaactttttatttgtactaaatatagaaattagttattttcctaactagtggggaaagtgatactttcacgcacgagactgccttgacgcgaacgacgcgatagaggagttcgggcaagtagtcgagtgaggggaagacactttctgcatgagttagaaacaatattttttctagggccgtacgtttggtaaaaagccataaaaatagagttatatcaatttttatttagaagtgaaaatacacaaattaactctttgacaaggttgtcaaaaccaaactcttaatataatgggttaccacgacgatgatattggtttccatgacgacgactcaaaaccattgtaaatgtctactgatctaacttttaaatattatgtcaaaataattttctttcatcgaattatcagtagtaattgcacaagagctctaaaattctatattaattttagagatcgagtgcaatttgttgcgattatttcatgaataaaactgttcaaaaccaaacttttattgtaatttattatgtaagtacaaattagtacaattaaacacacagttattataaatatttgacggttgaaagtcatcacttttataatttttaaaacattaattgtcattaatgtcactgaatgagttttttcatagcaacgaagggcatctgacgtaatatacttgacgacggcaaattatcaaaaattatcagtttaatttgtatttctgtagctttctattggtcagaatctcctatgaatgaaataatcagtagtaattgcacgagagctctaaaattatcgatttgtttcccgagtgacactttgacagttttaatttagaaattagatcaaagtggcacgagggcaacaagccgataataattttagagatcgagggtaattcgctcagattatttcatgaataaaactcttttttaaatcattttaactaatattttattgatatcttcacctgaatatttgctaaacgtatttcttattattctttgtgacaagttttaaaacattaattgtcgttaacgtcactgaatgttaatttttgcatagtaacgaagggcacctgacgtaatgcttgacgacgggatattatcaaaaattatcactttaatttttatttctgtagctttccattggtcagaatctcctatggatgaaataatcactgcaatttttattcttgtagctttctattagtcagaatctctatgaatgaaataataaattttatttttaaaaatgcaacaaaaactagagtttttaatgttagacatatttagagcgttaagagcatttatcaaataagaatatatcttcacatatatttgtgtcttgctgtataattttagttaaaacttgtaatgttaacaaatttagagtgaaatttgtgaaaaaatagttaatttaatacttgaaagctgaacaaaagaaatctagtctggatagaaaattataatatgccattacataattcattatacgtcatcccatgacacgtcatacattgcatgtcatttttcatgttcagtcgaaaaaatgaaagttactcatgacgatcccacctttttttttttttgtttgtttttgccgttcttttttaaaaaaaaaccaaacgtttggttaaaaaaaaaaaaacagaaaaaaaaaaaaaaaaatgaattggatggggaattttttcttgggaaaaatttttccttttttctccccacatgaattcttacatcccaaaaacaaaaaaaaaaaatattttttttcccaaattttttttttttt

SEQ ID NO: 3078 - DNA, 629 bp, Diabrotica virgifera
cgtctccaaaatgttgaaaatattaattgtgacgctggtcctttgggctggtgtcagttatgcaaaagatgtcaaaaatgacctaagtgacggtattttatttaattctgcagatgataaaatattgtttccatcattaatagacccaaagccaacagaaataccaccaccacctcctatcaatctaccaggtccaccagagcctccaagtgacgtaccggaggccctatataacaaacgtcccagacctccaccaagcaaacgacctagaccaccaggtcctccaccaagcagacgtcctaaaccgccaggtcctccaccaagcagacgtccaaaaccaccaggtcctcctccaagcagacgtcctagaccaccaggtcctccaccaagcagacgtccaagaccacctggccctccaccaagcagacgccctagaccaccaggtcctccaccaagcagacgtccaaaaccaccaggtcctcctccaagcagacgtcctagaccaccaggtcctccaccaagcagacgtccacaaccaccaggccctccaccaagcagacgtccaagaccaccagggcctccaccaagcagacgtccaaggaccacagggcctccaccatgcagacgtc

SEQ ID NO: 3079 - DNA, 534 bp, Diabrotica virgifera
cggacgcgtgggttcggaagttagcacgttgtggaataaacacttccacaatgcaaattttcgtgaaaactctcactggtaaaaccatcaccctcgaggttgagccatccgatacaatcgaaaatgttaaagctaagatccaagacaaagaaggtatccccccagaccagcaacgtttgatcttcgctggaaaacaactcgaagatggacgtaccttgtcagactacaacatccagaaggaatccacccttcacttggtgctccgattgagaggaggtctcatcgagccttcccttcgtattttagccatgaagtacaactgcgagaagatgatctgccgtaaatgttacgccaggttacacccaagggccaccaactgcagaaagaagaagtgtggacacaccaacaacttgcgccccaagaagaagctaaagtagactattacgaggttattttttacaatgttaatatcttacaattccagatgttacttgaacatttatttaactaattataggaaatgacatcaatcct

SEQ ID NO: 3080 - DNA, 895 bp, Diabrotica virgifera
  misc_feature (800)..(800): n is a, c, g, or t
  misc_feature (855)..(856): n is a, c, g, or t
aaacatatttttggaaaaatcagctttattgtttttcaaagtattcgcttttaaggtgaatacacacgcttgtcgtcttaacctgtgattcccggaaacaaaaaaaacaaacggtgcaaaatctgggctgtatgcaaataaatgtatttcgccttcaaatgctcgagatgttatacgagtcgtgtgagagctaacatagtatggtggcgggggtagttaccccctatgatggggttgattaagtcgaacactgttaccagatatatatttatttatcaacactaactataccagtaacgagttggtgggcaaagtctatattctaactacttgatgtctaaatatggaataaagaatgatctacaatactttctccgtatctataaataaactcgataattgtttttattatgattgccgacaccgaatcgaccgtgatattaataatatcaaaatagctgactagggcgttctcgaaacgagtgctctacattgtgacatcaatgtcacctagttattctactataaacaataatgtttgtgtaagacctttaaaaattaaattgatatgaattgttcttaattttttggatgctaatataaatcctgtacaatagtccttatgcaaaggatacgactctatattctatagtatggaaaaaagtggagcattttcgtctttttaggttttttgcgtagaaaagacagttttactagatattattaaactaactttagttattgcttgcacaaaagtttgaatatcttaattttatcaaactaaccaatgttggaactanataattttgatgaccatacatttatatgaagccaaaccatttgagctattccttnngtactcatcgattcctggactttgaacctcgtgagtttc

SEQ ID NO: 3081 - DNA, 941 bp, Diabrotica virgifera
  misc_feature (918)..(918): n is a, c, g, or t
tttttacattccgacagatgtaacattccattacgaatcattcttcattctaagtattaacccattccagaaacaatgctatttatgattcacaattttaatttttttaccttcgtgattttattttactgttaaatatcaagatggattttataaaatttataggtagctagaagtttagatttcttatatcaatgacaccttcaagcaaaaaatgaaatggcatatgaaatatgacattatcaagaatttaagggaagtttaaaaatatatcattttgttctaaatttgttaaaaattgattactattagatcgtctcgaaattagagtatactgaatatttaataacaaaaattttaacgcagtgttaaatatctttgtagtattaaaatctcaagaggctcttcaatcaaagtctccagaacctaagtaactcaaagttttagtattactcaaataattagagtatactgaatatttaataacaaaaattttaacgcagtgttaaatatctttgtagtattaaaatctcaagaggctcttcaatcaaagtctccagaacctaagtaactcaaagttttagtattactcaaataattacaatttctaaaatggttaagttgatattgagggcctttgtaagaacttcaagaactagtcttttcaagaattctcattttgttacttttcacatacctgttgatataaaaacattttagatactttagtgtactataatgttgttattacatagatggagtatgaataatatattaaagaaaataattttccattaaggaaagggcggccgtacaaggactgttgaagcagtttaccactgagaaacatacacggactgctcgagcggtcgtcgttgatatctggagcagtcgttgactactttgagtgtcacttgntgctttgcaccgcctctcgagct

SEQ ID NO: 3082 - DNA, 3590 bp, Diabrotica virgifera
  misc_feature (2691)..(2691): n is a, c, g, or t
aagataacttattattccacgaatgtgatatcttcgtatttcttggctccagggaaaccgttaatgctaccgttggtaactctgtaatcttcaaggtccttggagccaagaaatacgaagataacttattattccacgaatgtgatatcttggtacccgctgccactgaaaaagtgattaccaaagacaatgctgacaaagtcaaagctaaaatcattgccgaagccgccaacggaccattgacaccagccgctgatcagatcttactcaagaagaatgttctagtcattcccgatttgtatgttaacgctggtggtgtgacagtctcattctttgaatggttaaagaacatcaaccacgtctcatacggacgattgacctttaaatatgaaaaggactccaactaccatttactacaatctgtacaagaatctctcgaaaggaaatttaccgacgtaggatcaatccccatcttgccatctacacccttcaacaagagaattgctggtgcttctgaaaaagatattgtacattctggtctcagttttaccatggaacgatctgcaaaggctattaaggatacagcagaaaagtacggtcttggattggaccttcgatcggccgcctacatcaactcagtgcaaaaaatcttcctcaccctcaacgatgctggtttcgcatactaaacaattttaaccaaacttaaccaatcatttttacattccgacaaatgtgacattccattacgaatcatttttcattctaagtattaacccattccagaaacaatgttttttatgattcacaattttaatttttttacttttgtgtttttattgtactgttaaatatcaggatgattttataaaatgtataggtagatagaagtttagatttcttatatcaatgacaccttcaagcaaaaaatgacatggcatatgaaatataacatgatcaagaatttaagggtagtttaaaaatatattattttgttcaaaaaaaaaacccacgcgtccgttgattacctactattagaccgtctcgaaattagagtatactgaatatttaatagcaaaaattttaacgcagtgttaaatatctttgtagtattaaaatctcaagaggatcttcaatcaaagtctccagaacctaagtaactcctcaaagttttagtattactcaaataattccaatttctaaaatgggtaagttgatattgagggcctttgtaagcatcagcttcaagtactactagtctttttaataattctcattttgttactttttcacatacctgttaatataaaaacattttagatactttagtgtactataatgttgttattacataaatggagtatgaataatatattacagaaaataattttccattaagagatcttcaaagatcttcctacaaagggaaatacctccaggtgaaatcgtcacacacataaggaaaaatcaacacaactcactctgctttgacctaccctcttgatttggaggaattataaaacggaatcaaaatcagctttaactgtagattttaagaatataatatagctctaagggcggccgtacaaggactgttgaagcagtttaccactgagcgacatacacggactgctcgagcggtcgtcgttgatatctggagcagtcgttgactacttgagttgtcacttgttgccttgcaaccgctctcgagctgtcaacagcacgatggattttcatcgtgctgttgacagtttgaagaggtcgtgactgtgctcgagctgtcatgtgtatatcagcgaatataggattatagttcaccgtgcggtcgctggttcaagctgtccgtgtactgccgacctaagatgtgttttcaaagaatatcggatattaagaagatgaatagatgtacagtgtcaagcgaaagaaagaaaataataaattactttaaacaaatcagacaaaagaaggtcaatatctaattaataggacttaactattcaattggatcgaaatcaaaatagaaaaatcaatcctttagttttgtggaatgcattcgtctatctacccgtccgaagaattggtggaacggaaactctaacgtatagagaaaaactgacgacgattcatatatataaaagagtaatttcaaaagtcctctaccgactagtacagaggaagaacatattcatacattttctacttcccacccctccccattttgtaaaggttcacgttttctcacctttatttaatataattaaataactagagagatcatattttgagatgggtactccaaatgagaacgaaaacgatagattccaatattataacaccttcaagttgttatattgataaaaaaaatgcttgaatagctggacaatcataaaatgatcattcattatggatattgtatatataaagctacttaaaccataatactcaattaaatccacgtctgtatataatttattctttaaaagatctaattataagaaatccaatatcttactaccaaatttttgaattatctctaaactaaccttccccgctaaagtaaacgtattgtaccctattattgacacaataaaattgtagcaataatatccattctaaattacttttatttatgcatttaaatgtttgtaaaacaattattgtaattactagattattttatctttccagcatcanatgctggatcatttagcggacataccatatcagtaattaatacttaatttgcattacttagtacttcagtataaagattgattaaaaaaaacgctctttggtaatcacttttttcagtggcaagcggtgaccaagatatcccattcgtggaataataaggtttttttcgtatttcttggctccagggaaaccgttaatgctaccgttggtaactatgtaatcttcaaggtccttggggtcaataccgttttcattgaagatagaaccatcgtattcaataacaccaattactttggctcctgccctgtggaggtacctcatggtgtgcaaaccgacattaccgaaaccttggataattacagtttttcctctgatgccagttgtcaatccacacttttgcatgacgctttcctcgttgctgaaattttcgataccatggaaaactccacgaccggtagcagagacacgtccgtggataccaccttggttgatgggttttccagtagtgcaggcgtggttgtttatatcttggtaaccaatggttttggcatatgtgtcggctaaccaggacatttctctttcgccggtacccatgtctggagcaggtacatcaatactgggtccaataaatccttttttgactaattccaaagtgaatctcctggtgatcttttctaattcatgttcagagtattttttgtgatcgattttaactccagctttcgctcctccgaatggtacatctacacaagcgcatttgaatgtcatcaaggctgccaaagctttgacttcgtctctggagacgtccatagagaaacgcataccccctttgcatggagttctgtgggtgctatgttgagctctgtaacctttaatgatttcatactgcccattgtccc

SEQ ID NO: 3083 - DNA, 2182 bp, Diabrotica virgifera
  misc_feature (1986)..(1986): n is a, c, g, or t
atactaactaatattaaatctaacacaaattatcaaaatgttgaatttaataatagcagtgaggtgtgagataaggcttgttggtgcgtttcggtactggtattttgtcacgttggtgcttagcgcggtaattacgtaaggcgttacaactgccgggtggtgtcgggtttctatgatttggggattatatactaactaatattaaatctaacacaaattatcaaaatgttgaatttaaaaatgatttctaaatttgcgcctcttaaatcaaggagtgcggaagttagcacattacttaaagccttaccagcagcatgcaaccagctccagggaaggacttacgcggatcatgtcattccagacagactaaaggatatgcctaacaaccctaatcctaggtttttcgacatggttgaatatttcttccacaaggcctgcgttttagtagaggataaattggtggaagacttaggaaacgttaagggatccaggttgaatttggatcaaagaaaagccaaagtaaaaggtattttaaccttcatggaacaatgcgatcacattctcgaagttgcatttcccattaaaagggacaatgggcagtatgaaatcattaaagggtacagagctcaacatagcacccacagaactccatgcaaagggggtatgcgtttctctatggacgtctccagagacgaagtcaaagctttggcagccttgatgacattcaaatgcgcttgtgtagatgtaccattcggaggagcgaaagctggagttaaaatcgatcacaaaaaatactctgaacatgaattagaaaagatcaccaggagattcactttggaattagtcaaaaaaggatttattggacccagtattgatgtacctgctccagacatgggtaccggcgaaagagaaatgtcctggttagccgacacatatgccaaaaccattggttaccaagatataaacaaccacgcctgcactactggaaaacccatcaaccaaggtggtatccacggacgtgtctctgctaccggtcgtggagttttccatggtatcgaaaatttcagcaacgaggaaagctacatgcaaaagtgtggattgacaactggcatcagaggaaaaactgtaattatccaaggtttcggtaatgtcggtttgcacaccatgaggtacctccacagggcaggagccaaagtaattggtgttattgaatacgatggttctatcttcaatgaaaacggtattgaccccaaggaccttgaagattacagagttaccaacggtagcattaacggtttccctggagccaagaaatacgaagataacttattattccacgaatgtgatatcttggtacccgctgccactgaaaaagtgattaccaaagacaatgctgacaaagtcaaagctaaaatcattgccgaagccgccaacggaccattgacaccagccgctgatcagatcttactcaagaagaatgttctagtcattcccgatttgtatgttaacgctggtggtgtgacagtctcattctttgaatggttaaagaacatcaaccacgtctcatacggacgattgacctttaaatatgaaaaggactccaactaccatttactacaatctgtacaagaatctctcgaaaggaaatttaccgacgtaggatcaatccccatcttgccatctacacccttcaacaagagaattgctggtgcttctgaaaaagatattgtacattctggtctcagttttaccatggaacgatctgcaaaggctatccttaaaaccgccagtcagtacaaccttggtctcgatttaagaagcgcagcctacatcaactccgttcagaagattttcacaacttactccgaggctggtcttactatgtaaacactttttacctaagggtgaaatataaaatactaacaatcaaatgttaccttactaactatgctgttatacatttgctatccagaatctggataattntttcgctagactttttaggtatacaagttttataatcattcctaactatctttaatgaatgatattatacacatactttattagtggcactgttaatatcgtaaacattttattataaatcatttctttatacaactatacaactatgtaattataaagaatgtattttacatcgtataatgtacaagttactttt

SEQ ID NO: 3084 - DNA, 1609 bp, Diabrotica virgifera
  misc_feature (51)..(52): n is a, c, g, or t
aaaacaaaaaaaaaataatagcatagaccgtttcgtgatttagaacatttnnatgagaagtgatctttcacttgtcatcgacatattattactgctctccggcatgttggatccgtgacactcgaggtctttgagaaagatatactatattttgcatttgtgccaagagctggatggagggacaaacaggtccggaccttcgagaaacgaacatacatcttgcaatagtgcaaagtattcaaagcgtctttctaacacagtttatagtccgagagctagactagaagtatattatgagtatgtatttgaacagtgtgaaaatattatgtaatccccattcaggaatgaatacaaattcgaatacctggcatatcgtggagaagagttttggctttattgtcccttgaattttttaagttctattatttaggtagttcttgaggtattttaatatcttctaatttaaccactactctcttatctcgtaaatatatctcgttcatttctgttcgttctttttgcatccatttgtgaacagtcgttcgcttgatgttatcagtacgtctggtttgtggtctgcacctacttctcttattttctcttggtcccaattcaacaattcgcttcgtccaacggttatcttccattcttcctatgtgacctgccataactagccgatgccgcagcatcggctactgtattacgtgacataaaatagcgctgttgtcgataaacgataaaacttctgtatgtaccattatttaaaaaataggtattcaatcccttgttaacaatcccagtctataataatgtatacttaaatttacaatttggtatacagcttggttgatacacgttgatacgtgcatgatgcattgatgcctgattgtggaaaaaaagatatttttaagtttctgcactgtattttcttaaacatttaataaaatattaaaaattctgaaactattttagtgtattaggtattaagttttaatattaggtataaaaatccacttagagtggccatattgctggcactatgttggtaatatggccaacagcagtattttttaaattatatcataaatatcgtatttttataattttttaaaaatcataaaataaatatatctttagataatctatataactgtaatatcagttactctttaaaaaaaattgaatttggcatcaaatacagacaaaagattttaaggtacctgcacatattattaagaattctgctctttacttatgtatatattacctttggaaaaatctcctcacgtgtggctacccactttacaacaactatcaaaaataagacaaattaaaaaaaacctatcgcccgccaggtaaccacaagagattcttataaaaatatacgttttaatatcaaaactagcccctctattcttataaccttgttacttaaaagatctaactactctttcattttgttaaccgaatagtgcaaataaattaagatattgttcgaacgaaacttgctaaagtatattccaataataaaagaaaagactgtcgaattattctttatataactgaagtcttaataattgccatataatttatcagcttaactgtcgat

SEQ ID NO: 3085 - DNA, 924 bp, Diabrotica virgifera
  misc_feature (764)..(764): n is a, c, g, or t
  misc_feature (823)..(823): n is a, c, g, or t
acgaaactatccgtgtattttgtagtgctgtgaacattatctgaaacattttgatacataagttttgttcaacacaaaattattattaacacaaaataagactatttttaagatggtctaacaaaaaggtaactaaaaaggataaattattaccacactaatagattgttaactaattttaaactacaagttaatataattaacaatatcaaaatggcgatgataatgcctgaactgtacgcaaaattatcaaccaacaatgtaaacattacaaaaactcttctaaagaaatacaaacatttattaaatttcaaaaagaatccatcaatcctggaattcggcttcgctagtggcgagaattcaaaacagactctacagccttatcttcctcatgattataaggagtttgtagctgtcgatatctcagaacctatggtagaacgagcccggaaaaacaacacgcatattccaagaagcaaattttattgcttagatacatcagcaccagacttaccagaaatgttccaaaatcgatttgataatgtatttagtattatgacaattcatttagtaaataatccaagacagacattcgccaacacatttaagatgctcaaagatggtggtgaaaccttccaaacattttttaaacacacaccgtgcgacagtgccttcctaaaattgagcaaacatcccaagtggggaaaggaacagtataatcaaaagaagatgttgaatccttattatgataaacccgaacctanaggatacattacagcagatctaaaggcagctggtttccagaatatccaaattatggagnaagatacgacatataatttttgaaagtgaagaaagtttaaaaggtctctacacgtctgtcaacactacattatctcatattccagctgatgaacttgagga

SEQ ID NO: 3086 - DNA, 1359 bp, Diabrotica virgifera
  misc_feature (1314)..(1314): n is a, c, g, or t
  misc_feature (1323)..(1323): n is a, c, g, or t
cacgatggtccaagataataaaataagtaacaatttggtgtatcaactcgtaaatacagaaatcaaagagggagatgacgtaacggcaagaattgaagaaaaaaaggatgacaaaatagattctggtcccaaatttggaaagcgccatgtgcaagttatatttttatttacccttttactcataggatattgcataagagttaacttgtctctcacaattgtggctatgacagatccgaatgccaatgaaaacaaagatattccgacttttgactggaaaaaccgaaacgtcatcctttcagcgttcttttggggatacgtaacgccacagatcctagccggttggttaatgacccgatatggcccgaagtggttccttgttggatctatggctattggcgcaatattgggctacgctatacctctgttggctacatattatggatcaacggcagttattatatgcagagttattcaaggggcttcgcaagggttcttcgttccaggtatatcttgctttacaagccgatggataccaatcgcagaaaggggaagactgggcacgtttatgtatgcagcaagtccaatgggatctgtagttagtatgatgttatcaggagcaatttcagcaagttcgtacggatggcctatggtttttcatttctttagtacactgggaattgtgtggtgtgtcctttatcttttctgcggttctaattccccttcggagaataaaagtattaccgaagtagagaaaaattacatactccgaacttctgttgatgttaacaagaaaccattaccaacaccttggaggcacatattaacctcaatacatttttatgccttaatatacacatacacgtgcaatgtgttgggactgtggcttcttttaacccaaattcctacttacatgagcaaaatcatgaagtttgatataaaatctaacgggactttgacagcctcaatataccttagtcaatggctactgagcatcattttgggatccgtgtcagattatgtgattaacaggaaaattctcagtttaactctaacgagaaaactagtgtctggtgtaggtaccttcggaccagcgatttcacttgtattcctagctcaatgtaccgaagaaaatactgtcaagggtgtgattctgctatttcttgcagtcggtacaggaggtgcccaaatttgtagcattttaatcaacagcgtagatctttcacctaaccatgcccggtgttctttcaggaatttgtcatgcattttctcacgtctttgctatattcgcaccgctgatagcagaatttttgntttctgacngatataatcccagctcatggcaaatcgtattttact

SEQ ID NO: 3087 - DNA, 933 bp, Diabrotica virgifera
attatttttattaaaccatattttataaatagatctttcatttccaaatggtacaaaatgtattaaacatataaatatatcaatagttccaacatataaaataaaacatcaaactaaaggatttccaacagctaccaacaacctggttacaaagccaaaaaaaaaaaaaaagggcggccgccctttttttttttttttttttttctgattttctatctcgtttttcgccacctttcgattctgctctctgtattcatttatttatttatttataatcaaaatcaaatattcaacgaaaacagctgataacgtgttggagttggtattggaattgggagcaaagtgctcatctgtaattcattttttttgtggataaatccaaggtacaaattaaatttctggaagacaaaattaatgttaaaaagtttatatagatgtaaaaagatacaaaagactgaaataatggccttaaaattaaagacttccaacaatctggcaaaacaagttcatattttgataaggaattattctaaaattacaactcattatacaatacatccaagggaaaaagatccaagatggaaagaagtaaacatggaacgttttaccgacgaaacagacatcttgattgtaggaggtggtcctgctggcatgagtcgctattcgggccaaacaactcgctgaaaaagatggtaaggaacttagggtatgtttagttgaaaaagcctctcaagtaggtgggcatatactgtctggagcagttatacagcctacagctttagatgaattgataccagattggaaagaaaagggagcaccacttaacactcccgttactgaagataaatttggttttttgacagctacgggtagatttaacattcctgtttttaaaggtcttccaatgggacaccatggtaactacatagtcag

SEQ ID NO: 3088 - DNA, 1184 bp, Diabrotica virgifera
  misc_feature (1061)..(1061): n is a, c, g, or t
  misc_feature (1166)..(1166): n is a, c, g, or t
cggacgcgatttgtatttcagtgacaagtgatcgtgctatttttgactgtttctcagtgtttttatcagttttcttgtttactttcgtatttaccggcaaatatcctaaataaaaatggcagcaataacagaagtaagtgaagctcccgttgctcaatccaacctaacctgcttggagtctgtcaacagattttcaaagcttccagttgttgattccaccatcaagacagctacaagtctatacgaaaaagtgaaggacttgaacggtctcacccactggactttctcgacagcagaaaccaccctctgcaaggcagtcgacttgggaatgcctattgccactcccgttatcaagaacttcgaaggacctattaagaaagtcgacaatgttctttgctcaggtttggattatgtagaagaaaagatccctgctgtaaaacttcccaccaacgagatttacaacaccaccaaagactacgtcaacaacacgataacacccgctgttgaaaccgccaaagcctacgcagagccagctgtcaagaccgctaaagatctcgtggaacccgcttatgaaagggccaagtcagctgttgaaccaaccctggagagggccagacatattgtagaaccaattgtacagcctgctttggacaaagctaatgccatcaaagaaaatgttatgcagagggttgatgagtacttgcacctctcccaccaagaaggtgaagtagtcgaatgccaagaatgcgtacaaatcaggaaaagattagaagcacaacaacagcaggacaaccagaacgaacagcagcaacaagatcacatcccgaggggcaataataaagcgcgttttgtattagtttatagtgttttctatgtttaacgtcccaattgtattttaagactgtttttagattttaatcttagggtggcttccagaacattagtctgaacatgtgccttttccaaaaagttttcagaattagaaaaatttaaaaatattacggtgttttcaaaaagaaatactctattatttaataatacatttattacttttgtaattntccttctttctgtattcagtattcaaataagagttttctttaatttgaatactggaaagatggtaaagttattggtattttaacgttaatatctatataataagntgatggtacatatctagc

SEQ ID NO: 3089 - DNA, 1053 bp, Diabrotica virgifera
gcccccccttttcgtccgattgtagagacctagactaaaaactttcgattttacctttacaaccaatctgtgaaactttttcagtgtacttaaggatcctaaataaaaatggcagcaataacagaagtaagtgaagctcccgttgctcaatccaacctaacctgcttggagtctgtcaacagattttcaaagcttccagttgttgattccaccatcaagacagctacaagtctatacgaaaaagtaaaggacttgaacggtctcacccactggactttctcgacagcagaaaccaccctctgcaaggcagtcgacttgggaatgcctattgccactcccgttatcaagaacttcgaaggacctattaagaaagtcgacaatgttctttgctcaggtttggattatgtagaagaaaagatccctgctgtaaaacttcccaccaacgagatcgctttattacaacaccaccaaagactacgtcaacaacacgataacacccgctgttgaaaccgccaaagcctacgcagagccagctgtcaagaccgctaaagatctcgtggaacccgcttatgaaagggccaagtcagctgttgaaccaaccctggagagggccagacatattgcagaaccaattgtacatcctggctttgaacaaagctaatgccatcaaagaaaaatgttttgcagaggggtgatgaaggacttgcgcctctccccccaagaaggggaaggaattcaaatgccaaaaatggcgtaccaattccggaaaaagaatataagcacaaacaacaggcaggacaacccaaaacaaacagcaagaacaaaaaataaacttccccaagggggaaaaaataaaagggcgtttttgtattaaatttataattgtttttctatgtttaaacgccccccaatgggaattttaaagaattgtttttttataatttttatatttaaagggggggggtttccacaaaaaaattaattccggaacattgttggccttttttcccaaaaaaagttttttcaaaaaattaaaaaaaaaaattttaaaaa

SEQ ID NO: 3090 - DNA, 989 bp, Diabrotica virgifera
  misc_feature (779)..(783): n is a, c, g, or t
gattacttggttttgttttctgacgtggattaccatctgcaaagtatttactacaaatttagtaacaattatggagtctttaaacgttttcgaagatttaaggcggatgaacaaacgccagttcatttaccaagttctcagtttcggtatgatagtctcctcggctttaatgatatggaaaggactcatggtggtaactggtagcgaaagccccatagttgtagtattatctggcagtatggagccggcattccacagaggagatctattattcttaacgaattatccagaagaacctgttagagtaggagaaatcgtagtcttcaaagtagaaggtagagatattcccattgtacatcgcgtgctaaagctccatgaaaagaaaaatggtactgtaaagttcctgacgaaaggagacaataatagtgtggatgatagaggtctgtatgctccaggacagttgtggttaaccaaagatgatgtggtaggcagggcaagaggatttttgccttatgtaggcatggttactatattaatgaatgaataccccaagtttaagtatgcggtattggcctgtttaggactgtatgtgttggtacacagggagtgagattacatttttaacatcttaatttaatttttgttacttaaaattaataaataaataagactataactagatcgcgaaaaaaaaaaaaaatttttggggggggggccgggccccaatttccccttttaggggggtgattaaaatttccggggcgggggttaaaaaaaannnnntttaaaaaaaaatggtttttattttatggaaaccccacttttttaaacccttttagcccccctaaaattggggggcccctttttcacaatatatttttttttggaaaaaatttttttttttttggggggccccccaggggagtgtttttttttcttttggggggggacccaaaaaaaaaaaaaaaaaaaaaaacaatgtggggggg

SEQ ID NO: 3091 - DNA, 1024 bp, Diabrotica virgifera
  misc_feature (875)..(875): n is a, c, g, or t
  misc_feature (881)..(881): n is a, c, g, or t
aaagtaacaggaaatggatagatggttgggaaaagtagccctagttacaggggcaagtgctggtgtaggggccgctatatcagaaaaattggttgaggcaggtttgaaggttgtcggtgttgcaagacgtaccaaagttttagatgaactagctcagaagttatcttcaaagaagggaaaattttttccttatactggcgatgtctccaaagaagacgacattataaaagcgttttcttggaccaaagaaaatgtaggacccgccagtgttttgataaataatgcagctgttttacttctagaggatttgagttcgattacaactcaacatttaaaacaagaatttgatataaacgtaatttcagtttgcattgcaaatagagaagccataaagcaaatgaaggaaaataacatcgcagggcatattattaacatcaacagtattgcaggtcataaggtgatgaattttccaaagcttaatgtatatgccgcaaccaaacatgctgttagtgcacttactgaaactctacggttggagcaatcaaatcaaaaaaccaacattaaagtaacgagtattagtccaggggcaattgtaaccgagatgatgatgaatgtttcaaaagagatgggtatgccaattgagaatcctgaggagattgaaaaagtagctgctctgagtgcgaaagatatagctgattcggtctattatgtgttatctacacctcctcatgttaacattacagaattgacgattcaagtggtaggagagacagcttaattcgaattttcgaagatgataaatatatagggagacaatacatttacattttttaactcactattgcatttttcacaataaatattttatatacctnattagnaaagataacaacagaaataaatttttagaaacaaccaaagacataaaaaaaaaaaaaaaaaagcaatatagtaaaaagaccctaaaaacaaacaaaaaaaaaaaaaaaaaaaaataagaggaaaaaaaaaagggggggggggc

SEQ ID NO: 3092 - DNA, 978 bp, Diabrotica virgifera
accttcttttcgtccgcgtagagttgcaaggtgacagatcatctgcaggctaaagaaaatgagtaagtcactgacgggggtaaatttgaagatcgtctctttggatgtcaaggatgtgcgctttccaacttctctccaggctgatggatccgatgctatgcacaccgatcctgactactcttgcgcctacgtcaccataaaactccaatcggggttagaaggatacggactaactttcacttgcggtagaggcacagaagttatcgtagcagccgttgaatctctaaagtcattggtcgtcggccaagttgtaacagacatctacaaagaattcggtgtgttttggagatctttaaccagcgaaagtcaaataagatggattggtccagagaaaggagtaacccatttagccaccgcagccataatcaacgccttatgggatctctggggtaaactcgtaaagaaaccagtgtggcaactcttggcagatatggaaccagaacaactagtatcctgtatcgatttcagatatctcacaaacgtcgtgaccaaagaagaagccattgaaatgctcagaaagggtagagagggtagagaagagagaataaataagttgctcgaaaaaggttatccttgttacacaactcaagcaggttggttgggatattcaaacgaaaaaattcaacaattagcacaaaaatacatggatgccggattcacagctttcaaagtaaaagtaggcaagaatctaaaagacgattgcaaaagattggaatatataaggaacattattggatgggaaaaaactttgatggtggacgccaatcaagtctgggaagtacaggaagccattgactggatgaaacaattggccaaatacaagccactctggattgaagagccaacatcacccgatgacgtactcggtcacgccgaaatctccaaagccctcaaaccccttggaatcagcatcgcttc

SEQ ID NO: 3093 - DNA, 1549 bp, Diabrotica virgifera
ggccgccctttttttttttttttcgctgccgtaatgatcactaaagaagtgtggcttctatgcattgtgttgtcaactagtttggcaacaacaatcaatgtatccaaattccccaaagattttatgtttggtacagcaactgcttcttaccaagtagaaggtgcatggaacgaagatggtaaaggggaaaatacttgggacgaagtatctcacagagtgccatcaccaattgtcgataactcaaccggagatgtagcttgcgactcttatcacaaatataaagaagatgtggctatgcttaaacatttgggagtcacccattacagattttcgttatcctggtccaggattctacccacaggtttcaataataaggtcaacccccttggaatcgcttattacaaaaacctcatcaaggaacttagagccaacaacatcgaaccattagtaactatattccattgggatacaccccaaccattggaaaacttgggtggatggaccaacgagctaatagttgatagatttgtagatttcgccaaagtagcctttgaaaatttcggtgatgatgttacttactggttgacattcaacgaacccaaacaaatatgccacgaaggttacggtagcaaaaataaggcacctcttgttgactcacctggtattggggaatacctttgtgcccataatcttcttaaggctcacgctaaagcgtggcgtttgtatgacgagcagtttcgtagtacacaaaaaggaaaggttggaattactgtagatacagcttggtttgagccagacacaactattgctgacgatgtagttgctgcagaacgagcacaacagtttaatcatggattgtatgtaagacctttaacaataggcgattatccagagcaaatgaagaaagcaatcgcaaggagaagcttacttcaaggcttcagccagtcgcgtcttccagaattcactcaagacgaaatccagtacttgaaaggtactcttgactatttggggctgaactattataccacaagaatggcacgaaatgctgctgataaacagatagacgttgtttcttacgacgcagattcggaagttgatacgtaccaaaaagacgaatggcctaaatcggcctcatcatggttaagggtagttccatggggactaagaaaattattgaactggatcaagaacacatatggcgatatcccaataataataacggaaaatggtatatcggaagacggtacctctctagaagatgatatgagggttgactattaccagcaacacttgagcgctgtgctagatgcaatggatgatggagtaaatgttttcggtttcacagcatggagtttgatggataatttcgaatggttacgtggatatacggaacattttggattgtaccacgtagattttactagtccaaatcgaaaaagaacaccaaagaaatcagtggaatattttaaaaatgtgatacaatatggatgtgttttaggaaattctacctgtgataattaattttttttatttcttattaaaaaatcag

SEQ ID NO: 3094 - DNA, 2034 bp, Diabrotica virgifera
gactgtgagtttgtgagtgttcattaggccggtttgacgatgataaaatcaacagtatcacctgtagctacccttctacgaagaagctattccaacgtagctcccaccacaaaattattcctcgacggaaaattcgtagactcaaaaaccacggaatggatcgacctacacgacccagccaccaataacgtggtcaccaaagttcccaagagcacagctagcgaaatggaagctgcggtagaatcgtcgaaaaatgccttcaagagttggagtcaaacatcagttttaaccaggcaacaattgatgttaaaactccaagctgtcctcagaagggacctcaaaaaaattgcccagaacatcactttggaacaaggaaagacgttggtagatgctgagggtgatgttataagaggattgcaggtcatcgaacacgcctgtgccgccggaactctcctccaaggtgaatctctccagaacatctccaaggatatggacgtagtatcttataaactgccactgggagtaacagcaggtatatgtcctttcaatttccccgctatggtgcctctctggatgataccgttagctctgattaccggaaataccatgattatgaagccctcagaaagggatcctggtgcgactatgttaatagcagagcttcttaacgaagttggatgtccaccaggtgtagttaatgtcattcatggagctcatcaagcggtagactttatttgcgataacaaagatatcaaagcgatcagttttgtcggatctgatgtagctggaaagtatatttattcaagaggaactgccaatggaaagagggtccagtcaaacatgggtgccaaaaatcatgctgttattctgccagatgctcacaaagaatctgcattggaccaaatcatcggagcagcattcggagcagctggccaaaggtgtatggctctcagcgtagtaattatggtcggagaagctcaacaatggatccccgacctagttgctaaagctaaacaactaaaagtaaatgctggacatgaaccaggaactgatgttggacctgtcatcagccctcaagctaaagaaagaatcttgcgattggtagcccaaggcattgaacagggagccaaatgtgcattggacggaagaaacatcaaagtagagaaatatccaaacggcaacttcgtaggtccaacaatcttgaccgacgtccaaactaaccaagtatgttacaaagaagaactatttggacctgttctttgcgttatgtctgcagacactctggacgatgctatcaaaatcattaatgccaatccatacggaaacggaactgccattatgacaaccaacgggaaccatgccagacagttcgtacatgaaacggatgttggacaggttggagtgaacgtgcccataccagttccactgccgatgttcagtttcaccggatccagaggcagtttccacggagatcttcacttctacggcaaacaaggattaaacttctacactcagacaaagactgttacttctttatggagaaaaggacaagtagactctagaccatcagtcaacatgcctgtccagaactaaacaagaccaaatatgatattttttagctgttaggtccaaaataattcatccgatttataaaggtatggtaacatggtctcgaaaatattgtcaccaataatggtagctggaataagttacgttacattaggtaattctggtatatattgattgctcaatttttttttaaatacgtacctttgtaaatttgataatttctgaaaatacattttagttgtaaattaaaagtattacttttcgtatcatgtaattgtctgattgtctgttcttcaaatgtcctacgactgtaaatatgatgtaaacctattttttataaatttcttttgaagccatataataatttgcatttacgtaagttgtgtatgtcagagtgatgtctgagtcaccaaactttcgtgttttaacgataaaagcgctgcaaatgttattttgtattgtttt

SEQ ID NO: 3095 - DNA, 795 bp, Diabrotica virgifera
cacacagtttgagtgtagttctgcaagcatcactggatcaactccccaaggccttcgctactttggtaattgatcttccagtagatggagagagtaattcgatagatttcaagaaagctttatatgaagcaaactatactattagcagtgatgatgaacgttcatttggaaccgaaggaatcactattgataccaaagaagctgctggtaatctcaaagttctaatttcgcctgattctttatatggagcgtactttgacgttaaacaggacaattatgaagttattgttaccgtaaaagctaaaattccttctgatgtttatgaaaaggtgtctgtaattcccctagctcttgaagctacatcatcaggaacacagaaagttggaaaaaccgtcgtcaatgtcaacatagaatataataaaggttccgtaaaattcagttcttctctttataatggaaactacactgttaaagagggagaagctaccatatatgttgatgagattgcattggcgacagatcaagatgcagatcatatatcggttgatgtagacaacgactaccacaaatattttaaagcttcatacgacaaatctaaagtaacaataactaaaactgccgatataccaatagctgatcttaagaaaatttcaacaatatctatacaattaaaagcaacggtcaagaattccaaagtcgaggacaacactgtaataaacttattgattatcacagatgatactccgacaccagagcaaggaaaaataatgtttgacaacactataaatactggcg

SEQ ID NO: 3096 - DNA, 630 bp, Diabrotica virgifera
ctcttctaaaagatctattaaccatttgcatttaaaacaaatatgaatgccactattgtgatattatgtgtcttgattgccagttttgtttgcctacaggcagctccaccagcaagaaaaacctcggccgaaaagcgtgaagatatgaaacaacgtacggtaataggactttcgtgtttaaaggaaaccaaactggatagatcagttgttgagaaagccatggcccaattaggtcattcagaagatccaaagtacaaggatttcctatcatgcagttataaaaagcaaggttaccaagacgaaaacggtaatattttatacgaaaatattagcaattttttgagcaactattacaaagctgatagtcttaaaatagttgagaaatgcaagggaacaactggttctaaccatagtgaaatggcgtataacgcaatgaggtgtgttatatcaacgctcaacgacattccagacgaagagttgatataacattcacatactagcaaatttttaaattattttctaccattacttgctattaaaaaataatttgtgtaatttaatttattattatttatgtttaataaactcttttaaattgtttgtttcaaaaaaaaaaaaaactcagggggg

SEQ ID NO: 3097 - DNA, 1351 bp, Diabrotica virgifera
  misc_feature (7)..(7): n is a, c, g, or t
cttcacngcgtccgaaaatataagtaccatcgataagataaactaataaaaagacaataaatgaaagtacttcgttgcataagtttagggcattaaatccattcatcgggaaaacaaaaacaagaaaacaagatgttaaagttttccgtaattttaggtcttttgacagtatcattggcgcttcctagtactcacaatgaagtttataaactgggaaatactaatcaggcgcttaagatcattaatggaaacccagctaaaccacatcaatttccctatcaggtaggaatgtacgtgtatacttcttccagatccgatttctgtggaggttcgcttatatctcctaactatgttcttactgcagctcattgcgttgacaaagctgtgagggtaaatatggtatttggtgctcacaacataacagatcccgaagaaaaatcccaagttaggttatcttcgacaagttttattgttcacgaaggatgggatggagataacattaacaaaaacgatatagcacttatcaaattaccatcacctgttcaaacttcgaaagtaatcaaaactgtatctatcgctgcaggcactaataaatatgtgaactctgttggtaatgtagccggttggggattgaccaaaaatgatcaaacagtagtgacacccgttttaagatatataagtccttctattttaagtaatgacgactgtaaaaaagtggatcaagattatgaagctgttattttagacactcttttatgcagcaatccgggatctcataagcagggaacgtgtcaaggtgactctggtggccctctagttgtgaatggtgtacagatcggtattgtgtcctttggttctaccgattgtgaagaaggaaaaccatctatattcacaagagtaacagaatatcatgactggattgcaaaacattctgacgttaaattttaaatcttgatcaagtaattctttgtttattatttttaaaaaataaataaaaaaactcccctcaaagcataaaaaaaaaaaaaaaaaaaaaaaaggcggcgccgcaagtaaaggaagctttaacgaagacccggggcaatgggcagggcctagcactttttttctaggcccggtacccctaaatcccctggcccgtgggttttaaaaaggccggggcgggggaaaacccccgggcggttcacccaaatttaaacgccctttgacgccaattccccctttttccccaaatgggggaaaaaaaaaaaaaaggccccccccccaatcccaccctttcccaaccgggtggccacccctgtataggggaaaaagggggacgcccccccggtgaaccggcggcttatttaaa

SEQ ID NO: 3098 - DNA, 1382 bp, Diabrotica virgifera
ctcctctacgcgccgcaaaaatttgttggtcattttgatttaaaagaaagttcatttcattcacaactaaacaaaatgccgattgaaaatttagaagaccagggtcttgagaaaaaccctgatttagaattagcacattgtaagtttctgttaactttaccagaatatcgcagtgataaaaacgtccactccaaaataacagaagctataaagaaagatgatatggccccatggtatgaacttatttgtaaagatgctggttggaaacttgatgctaatctactgagtgcattaaaagctaagaacgctgagaagatcaagcttttggatgaagccatagaagatgccgagaaaaatttaggtgaaatggaagttcgagaagcctacttaagaaaagcagaatactacagccgaattggtgataaagacaacgcagttagtactttcagacaaacatatgataaaactgtatcacttggtcatcgtttggatattatttttcacttgataagaattggtttgttcttcatggaccatgatctcatcacaagaaatattgaaaaagctaaaacccttattgaagaaggaggtgattgggatagaagaaatcgtttaaaagtgtatcaaggtgcatattgtatgtcagtacgagacttcaaatcagctgctaacttgtttttggacacagtaagcacttttacatcatacgaactaatggactataaagcatttgtcaggtatactgtatacacctctattattagtttgccaaggaaccaattaagagataaagtggtcaaaggttccgaaatattggaagtactgcattcagaaccatttgtaaaagattaccttttttctttatataattgtcagtatgctgaatttttcacaaatcttgcagaagttgaaacagttctcagaaaagattatttcttgaatcctcactatcgtttctatgtaagagagatgaagatacttgcttatacacaattattggagtcatataggtctcttactttacaatacatggcagaagcctttggagttactgttgaatacattgataaagaactgtccacatttatagcagcaggaagattgcattgtaaaattgatcgagttgggggaattgttgaaactaatagaccagatttaaagaatgcccaatttaattctgtggtaaaacaaggagatttactgctgaatagagtccaaaaattatctagggtgatcaatatctaaaaaatgtatttttaagtttataagtaaattataaaacatactgataatttgacttgattgtactaattttctatgtttatctagtgctaaaataaagtataaaaaaccaaaaaaaaaaaaaaagggcggccgctcgc

SEQ ID NO: 3099 - DNA, 303 bp, Diabrotica virgifera
cgtaaatattcaactaaaaagatggtgcagacacacgtcattcaaggatacgaaaaattccaagagtttttcaagaactttgatagccagggccaaaaagtgcatgtcttgtattccagccctagaaagccagacaacacaagttggtgtacctactgtgtcagagcttggccagttatagacaaagaattggaggcaactgatccaaattcccattttgtcagggtcgaagttggtgatatgccaatatggaaagatcccaactgccctttcagacacgaccccaaaaccaaattgcgagtt

SEQ ID NO: 3100 - DNA, 1032 bp, Diabrotica virgifera
  misc_feature (967)..(967): n is a, c, g, or t
caaaacatcaaaacccgataagtttatatcactccgagctttggtacggttaagttgacattgactgcagcagtgaacttgattttgaaaatggtaaaagataatgctagtttcgaaataagcggtccgcagcctcacgaagctctcaaaaatgagactttggggcaagcttttttgagagttttgttggaaaatccgtatggacacaaaattatgattgactcgcacaccggtagagatctcacaagccaaaagctactggaggagtcatgtcaacttgccgaagcattgagagtctatggttgtacctcaaacacagctatctgtataggaagcgagaataatctcgagttctttgtacccatcatggcttctatttttgcaggcacaatcatggcaccacttaatgtaaactacacagaccaagaactgaagcacacgttaaacataaccaaaccaatattggctttctgttcaaaacgtgtaacacaaaggtacttaacgctgcaacgggagatgaaatttatcgagaaaattatcgttatagacagtgaagaagaaatcgaaggaactgaaactatgaaatcatttataaatcgtcttcttcaaggaaggatagtctctccccaaaagtttattccattcgatggtgacccaaaggaaaacgtagcctttgtgttatgttcttctggtactactggccttcctaaaggagtaatgttaacacactttaatgtagttacacgattattacagtctaggtatccagattatttatcacatcattccatagtgctcggactaatgcccttctttcactcatacggattatttttcggcctcacgtcattctttaacagacatctcacaattatgatggacaaatttgaggaagactcgtttctgaaagcacttcaggactacaaagtatcagttgtaaggctggctccacccttagcgattttcntggcaaaaagtcccaaagtaagcaaatacgacttatcctctgtcgcagaatattctcagcgggag

SEQ ID NO: 3101 - DNA, 918 bp, Diabrotica virgifera
atctggagcggggctctttgttctcttggcgtatagtgcgaattgattgcgagcgcagagcaaaccaaatttctgcaggttcgcgtcttatctaactttactacgcttttgggtgaacaaggagttcacctttaccacataaatcatccaaaccgtgaacgtccacgttcgtgaagctgggaattttcttgcactgagtaaaggttttgggcactttttagagcccactcagttactcattgggaagaagattgctgattacggtggggtgtacccgaaaggtagtgtgtgcaaggactcaaaaatctcacttctaactgagattcccaattgcataccgtatagctacttgccgatcgggtttcgaactaacttcttaaggctatacaccctcccagactcctgggagctaggaatagagctaacgtacactccaaattgttcagaggccggtaagttaagatttctactggtccagttagctccaaatccatcgaactgagaggatggttgtctgcatctgtggcacaaacttcgccacgcaagccggtatagatactcatctacgcaggctgcgctgccgagggccgcaaacaggtaacgacgacatctgcaacatatgtgcccggaccttcaaatcatatgcgggggtccgtcagcatatgcgcactgcacatcctgacgagtacaacggggagctcgagcgaaaatacgagaaacctggaaggctgacaaggatcactggtgaggaccagatccgtatgagtgaattggagatccaatatgagggtagatgggtccgtaagtatctggaggagcaattcccccatttcacacgggaccagattcggcggacgcgcgcccgaccctcataccaggaactccctcgaagactcagggaggacaggggacggaccc

SEQ ID NO: 3102 - DNA, 2080 bp, Diabrotica virgifera
ttttatagttatggatggtaatggtgcattattcggtacactacaaggaaacacaagggaggtacttcacaagtttactgtagatttacccaagaaacacggtagaggaggtcagtctgcacttcgttttgcccgtctgagaatggaaaaacgtcataactatgttcgaaaagtagcagaagtagctacgcaattatttataacaaatgacaaacctaacatagctggactcatcttggcgggtagtgccgattttaagactgaacttagtcaatctgatatgtttgatccaaggttacaagctaaagtaatcaaactagtagatgtctcgtatggtggtgagaatggatttaatcaagccatcgaattagcagctgaatcacttcaaaatgtaaagtttattcaagaaaagaaactgataggcagatatttcgatgaaattagccaagatacggggaaatactgttttggagttgaagatactcttaggggcttggaattaggtgctgtagaaacactaatctgttgggagaatttagatattcagcgatatgtattgaaaaaccatgctacaggttcggaaactatactgcatttaactcctgaacaagaaaaagataaatcacatttttcggataaagagactggtgtagaattggaattggtcgagtgtcaacctcttcttgaatggttggcgaataattacaagaacttcggtgccactttagaaattattacagacaaatctcaagagggctcccaatttgttcgagggtttggtggaattggaggtttgctccggtacaaagtagacttccaaagtttacaactagacgatatggataacggcgaagaatttgatctagatgattattaaatgtagagacaaatttgtagaaattttcatttaaaacaatgtgggcccgttatgtaataaacacgtgtaaaaagtaaatgatggcaatatactaatttatcctaaaggagtataatatgatgtgcttttttgtaatattatttccaaatttatgctttcacaaacttgaaagtttattccatgaaaagttttaactatatcattaaattaataagtattattgattaattttatttattgattaatctatgttagtaaaatgtacaaagcacaaagataaagatagttaggataaccctttacaccaactgaaagtatagaaatttccggattgtttggtacggcaacaaacaaattcacacgaaattccaaatttgataatgtctactacagttgaagatgacaatagataattccagaccacgacctatacgctcagaaaacaatgtaccattacaaaacggctgcgaaagcctacattcatacttgattcgtatacatactgtccatgggcgctcatacccatgggcagggtagggggcgtggccccctggcttttcgggtgctttaaactatatgtcgttatccaaagtatacatacctaaggtaatgtgcaacatcttcacgtctgccctccccctaaaaatttttatatgggcgcccgtgatactgtcctaagttacacatccatttttgtccacgtgtgtgaccaggagcgccattaccaacggttcccaagactgagagtcatagcttactcggagcagtagggatttaaagaagaaaaaacgagctatgtacttgtcagtgtgtcggatcacacacagatcggtttagtagtttgtataaattatataaaataaaaatgtagatttggaaataatattacaataatatcggagtgatcatgtgttttgtataaattatattgtctcaaaaaatgtttaccgatatttattatttaattgttaaaattatgtatgtatattgcaagtgtttataattaatagtgaaaaagaccagtatttctacagtggcttgtttttttcattggtttttatatatttagaacagaatattttttgtatttacttttttttgttaacgaggtaataaatcaggtttggaaattcttcattctattttagtttgtaaccattggcatttttttgtttttaaattaataaataatgacttattcac

SEQ ID NO: 3103 - DNA, 1484 bp, Diabrotica virgifera
cccacgcgtccgatttaatcaaaatttggtggacaaaataaaatcccaattttcaaatttttgttttttatgacagatatctgaactgaattatcaattggatatgccaaatcacctaaacagaatattgttctttacctgaatttacagttaaggccgtgaatatccagttaaaaccagttggtttcagttaataatagttcaaaagtgactgtcctcgctcgccttctcgaccggctaagaggctgacaccacgccattttgctttgagaacacgtttttggattttatatacagtaaattagtctattaatttatcaaaatgtctggagaagaaacatctgccgatagaaatgttgagatatggaaaataaagaaacttataaaaagtttggaactagcaagagggaatggaacaagtatgatctcacttataattcctccaaaagatcagatatctagagtaagcaaaatgttagctgatgaatttggtacagcctctaatattaagtctcgagtaaatagactttcagttcttggtgctatcacatcagtccagcaccgtttaaaactatataccaaggtccctcctaatggattagtcatttactgtggaactattgtaactgatgaaggaaaggaaaagaaagtaaacatagactttgaaccattcaaaccaattaatacctcattgtatttatgtgacaataagttccatacagaagccctgacagcattattggcagatgataataaatttggttttatagttatggatggtaatggtgcattattcggtacactacaaggaaacacgagggaggtacttcacaagtttactgtagatttacccaagaaacacggtagaggaggtcagtctgcacttcgttttgcccgtctgagaatggaaaaacgtcataactatgttcgaaaagtagcagaagtagctacgcaattatttataacaaatgacaaacctaacatagctggactcatcttggcgggtagtgccgattttaagactgaacttagtcaatctgatatgtttgatccaaggttacaagctaaagtaatcaaactagtagatgtctcgtatggtggtgagaatggatttaatcaagccatcgaattagcagctgaatcacttcaaaatgtaaagtttattcaagaaaagaaactgataggcagatatttcgatgaaattacccaaaaaacggggaaaaactggttttggagttgaaaaaacccttaaggggtttggaaattaggtgctggaaaaaacccttaatctggtgtggagaatttaaaattttctcccgaaaatgattttgagaaaaaccatggttacgcgggtccggaaacatattactgcttttttaactcccccaaaaaaaaaaaaaaaaaaaaaaaccacaatttttttttcaaaaaaaaaaaaaaaactggggggggaagaaaatgtgtgaaatgtggggggggggggg

SEQ ID NO: 3104 - DNA, 408 bp, Diabrotica virgifera
cgcaattccaacttctaggctcgcgtctctttggcatctcggtacgaactactctccgtatcatttcctccagaggttcatcgttgtgttcgtcactttcttcaatggttcttactctatggcttcgtgaagtttgactagccgtttcgtgctccaatgcaatagcaagtgcttcatctaaaactttcggtcttgctagtcgtaaggctttctgtagttcactctctttcaacccattgatgaaagtatctacggcaatttcttctaaaatactgtctggcgcctccggataagccaaccgcaccacacgagcaacatctgcttcaaattcttgcagattctcacttgttcgttgacatctacttcgcagttgtgctttgtatacttgttgtaaatgagcatctccat

SEQ ID NO: 3105 - DNA, 311 bp, Diabrotica virgifera
  misc_feature (202)..(202): n is a, c, g, or t
  misc_feature (307)..(307): n is a, c, g, or t
  misc_feature (309)..(309): n is a, c, g, or t
attcggcacgagctcgtgccgaatggtaccaaacacgacccccacggaggtgggggggggggttactttaaaatcttaaataggaactcctttttttatttcacatttggattctttgcgtaaaaataagcaacttttattcgaaacgttttttctaattacggatatgtggcgctataatcggagataacgggtgttgganatgggaaattaaattaaaatatggaaagttccccactaaaatggaaaattttacttaacttttttggttttagaacctaataatcacaacccaataagttcccanancg

SEQ ID NO: 3106 - DNA, 1225 bp, Diabrotica virgifera
cactatagtggaaagctcggtactgcctagcagagtacgcggtaccaggaatgtccccggacgcgtcgcggaaagtcgagtggcaacatgtggaggtttttgtgtctagtgttcgttattttcagagtgggatctgcagatttgggtccttgcgtccaccaggtgacttcaccagtaggccatgcagaaggacctcactgggatgctcgacgaaatatactatactttgtcaatattccagatggagaagtgtatgcctaccactataattcaaaaatattaaagaagattacacttagtggaactgcatcaccagttgtgccttctcgaaaagatcccaatctcttaatcgtgggtgtaaatagatctgtggtggcagtcgaatgggacggaaaaaataaactgggaggtcagcaagtccttactacactgagtcatcaattcccaggtagcaggctaaatgatggcaaggctgacaaacaaggaaggttgtggtggggaacaatcggaccagaggtcaatttggttgtcgcttccgatcagggtctcttttacaccattaccagagaaaatttaaacgaccctaaagtagcagtgcaacccgtgacgaatagtaacggtctagcatggaataaggcaaacaacaaattatactacattgatacgcctacactaaaagtagtgtcgtttgactatcatgacggaaatggcacaatttcttctactaaccagactgtttttgatcttagatcaactcataacgttacaggtttacctgatggaatgacaatcgataccgaagacaacctttacatcgctttgtttggaggaggttcagtaattaaagttaaccccgcaactggaaaactactgaaggtcatagctattccagctagagatgtatcttctgtaatgtggggaggtccaaatttagatatactattcgtcaccacatctgacagaaacttatctccttctgaaagaattcagtatccagctgctggaagtgtatttgctgttactggtctaaaggccaaagggtttgaagctcacactgcagatattattgacgaaattgcccaaacagaaggagtgtgggacatcgtaattaatacattccgtaacttttttccccttaattacaatggtatgtattaaattgcgatttattctattgttacccgaaaaatattcaaaaaatgtgttatttattaaatacactctt

SEQ ID NO: 3107 - DNA, 329 bp, Diabrotica virgifera
catgccctgacacgtgtttctgggtttactcgttaacaaagaggctttacaagaagactgaattgaatcaaatcacacctactcgttggttttatttaaatattgttctgaagctattttcttgtggcatttttgcaattaactagtttttatgggaaataagccacaattttactaaataaacgattttattaacgtttcttctaataatttatttaatctgactcatttatatcggcaattcagacatatattatacattttaaagtagaagactttaaaatgatattgccaatattatgagttgctttcctgggacgactctactg

SEQ ID NO: 3108 - DNA, 1180 bp, Diabrotica virgifera
  misc_feature (1015)..(1015): n is a, c, g, or t
  misc_feature (1136)..(1136): n is a, c, g, or t
gttgacgttgagattgagtgtatttctatgaagaaatttggggttttattttattcctaatatactaacattagttttgagcaaaatgtgggggaaaatattcttttgttttagttttatacaggtatctttatcagtttactattatcagccggaacaaatccatatcgcctatggaaataatatttatgatattgtggtaacttggtccacctttgatgacacaaaacagtccctagttgaatatggcataggaggtttagttcttacagctaatgggacgtcgtcattatttgtagatgggggtaaagagcagagatcacaacacattcattctgttgtcctaaagaacttaacaccaggaagtacatatctgtatcattgtgggagtgacttgggatggtcaaatatatttaccttcaaaacggctccaaattcgccagactggcagccgcatttagctgtttatggagacatgggtaatgataatgctaaatctttaactagactacaagaagaaactcagagagggttgtatgatgccattctacacgttggagattttgcatatgatatggactcagacaatgctctcattggtgatgaatttatgagacaaatagaaccggttgcagcatacgttccgtatatgacttgtcctggaaatcatgaagaggcttacaattttagtaactatcgatacagattctcgatgcctggtggtctaaattcacccatgtacagcattaacattggtccgatgcatattatctctatatctacagaggtttattatttcctggactacggcattaaacctctcgtattccaatacgagtggctggaacaagacttggcaacggcgaatttacccgaaaacagagaaaagcaaccatggattatagtgatgggtcatcgccctatgtactgttccaacactgatcatgatgactgtacacatcacgaaaccataacaagagtaggattgcctttcttacaattcttcggattgganaacttgctttacaattatggagtcgatttagctatatgggcccatgagcattcttatgaaaaggctgtggctgtttataattacaccgtttacaatgggagctacgagcagccttacgtanatccaggggctcctgtacagttcaccactggctcggccggctgc

SEQ ID NO: 3109 - DNA, 1966 bp, Diabrotica virgifera
ttgtttttagactctgaaataggaagagggagtttgggtgtgatgctattttcaactctttctggcctgaagtttacagtctctatctgtattcaataaagtcagagccaccaccatcctgcattgttattggcaatagcaagacgttcaatcctgaattgaagagaagaccatcaggacaagcatgttcatatggcacaccgttggaacgttgcgagaatttagtacaatctggggggggggaaaaaaaaagaaacgggtccatctgatgctgggcaaacggcactttcttttttgaatgaattaggagctggagttggggtttgtgttgtttccactgtcttgtgtttgtgtgacagtctgttctgttgtcactgggtctgagcctccgcatcctgcattctgtggccaatcgcaaacattcagttttgggttaaagtgaagaccagcaggacaatcatgttcatatggcacaccgttggaacattggcagaatttagtacaatcgctgagagggaaataaactgaatcgggtccatctactgccgggcaaacgacaccttctttttgacatgaattaggagctggagttgagtttgtgttgtttccactgtcttgtgttggtgtaatagtttgttctgttgtcactgggtctgagcctccgcatcctgcattctgtggccaatcgcaaacattcagttttgggttgaagtgaaggccagcaggacaagcatgctcatatggcacaccgttggaacattggcagaatttagtacaatccctgagagggaaataaaccgaatcgggtccatctactgccgggcaaacgacaccttctttttgacatgaattaggagctggagttgggtttgtgttgtttccactgtcttgtgttggtgtgacagtctgttctgttgtcactgggtctgagcctccgcatcctgcattctgtggccaatcgcaaacattcaattttgggttgaagtgaagaccagcaggacaagcatgttcatatggcacaccgttggaacattggcagaatttagtacaatcgctgagagggaaataaactgaatcgggtccatctaccgctggacaaacgacaccttctttttgacatgaactaggagctggagttgggtttgtgttgtttccactgtcttgtgttgttgtgacagtctgttctgttgtcactgggtctgagcctgcgcatcctgcattctgtggccaatcgcaaacattcaattttgggttgaagtgaagaccagcaggacaagcatgttcatatggcacaccgttggaacattggcagaatttagtacaatcgctgagagggaaataaaccgaatcgggtccatctactgctggacaaacgacaccttctttttgacatgcattaggagctggagttgggtttgtgttgtttccactgtcttgtgtttgtgtgacagtctgttctgttgtcactgggtcggagcctccgcatcctgcattctgtggccaatcgcaaacgttcaattttgggttgaagtgaagaccagcaggacaattatgttcatatggcacaccgttggaacattggcagaatttggtacaatcgctgagagggaaataaaccgaatcgggtccatctactgctgggcaaacgacattttctttttgacatgaattaggagctggagttgggtttgtgttgtgtccactgtcttgcgttggtgtagcagtctgttctgttgtcactgggtctgagcctccgcatcctgcattctgtggccaatcgcaaacattcagttttgggttgaagtgaaggccagcaggacaagcatgctcatatggcacatcgttggaacattggcagaatttagtacaatccctgagagggaaataaaccgaatcgggtccatctactgccgggcaaacgacaccttctttttgacatgaattaggagctggagttgagtttgtg

SEQ ID NO: 3110 - DNA, 1208 bp, Diabrotica virgifera
gccactctcgcgtgtggtgcattgttcatgattgttcatgataaaataataaattacgtttggaaaaaaagcaaattaaattatcgggtgaaatttaacgttttataaaagttattgagcatggattgcgctatgtgtatgaggggctattcccgttacatgttaatactttttaatttcatatttgtgatcactggtattgtaataatttctgtgggtctgagctctaaagcttacttcaatgaattcgatcaacttatggataacaaatatttctacatttccgattttctgatagtcattggagtggtaatatttttcatcgctttctttggctgctgtggagcgatgaaagaaaatgcatgcatgactaccacatactcaactttattggttattatatttattctcgagttggctgttggaattactgctgtagtcctcaagggtaaaaccgaagaatttttagctgataaattagaagaaacaatgcatacttataacaaccacagctttaatgaaactacagtagtttgggataccatacaatcacagttccaatgttgtggggtccataatttcaccgactggaaaaatgttcctgctgtcaattatactacaggcttaccattgtcctgttgcaaaattcctgcaggttctacgcaatttacctgcaatcccatttttgcttaccataaaggatgtttggaaaagttcggtgatttcgtaaaacaaaacatttcgtatgtcgaaggggttggtattgggttggccgttattcagcttctgggtatcctcttttcctgctgcttatccaaatttataagaagtgattacgagactgtttaaaaatgatgaataaaaagtagtaacttgtatgatggcaatacattacaaaatattagttttaggtctacttgataattgaatttattaattgctccataatgtccagtatatgtctattaaaatatggatgtttcaatttacaacaaatattgtatcatgttttaaattttattatttagggggactatcttaacgtgtgatattctttacaaaacttaattttaatgattcattaataaaccatggtaaaaaaaaaaaaaaggagcggccgaaataaaaacaaagacacaacaaagtaacacaaacacacacaaaaaaaaaaaaaaaaaaaaggggaaaaaaaaaataaaggggggggg

SEQ ID NO: 3111 - DNA, 843 bp, Diabrotica virgifera
aaagtaaatcagtgtttaaacaatggaacttcttcaattctttactgtggtatttttcgtcgtctttgtgaaggcaagcgacttggacgatgctcgtaaaatcctggattgtgcccaaaaagctttgaaagttggagttcctgatttggatttaccaagttacaatcccctagactacgataaagatataccatattttaaggacctggcgggagagctatactttttataccacaacacccaagtttatggaattcccgattggcaagtaaaagaaataaatcagataaatcaagatagtgatgcattcgctgtgtttaattttagtttaacctttcaacaactgaatgcgtccagcaacttcgatcttaatatgacagatttctttttccaaactgagtataatggaacacaaacgcttaaactatttaacaatgaatggacaggttctattaatgttaccaaaccgaatcaagacagtgttgaacaaataaatgatcttcaaatcagttggcgcgcccaacgtctattgcctgtggtacacacaaatccatcaggctatgagtctctgttcgcatccgtatataactacactattatgacagctcttagcaaaccaaatacatttgttggagattttcttcaagaaaaacttaatacagattggtggctcaacggaaaaatatggaaactagtacaatggtgtgaggataacgagtacatataataaatattgattgattttactaacagtaatatatatatttttgtgtacaatgtacaaattaatgatctatgttataatttataatgtttacattcaataaattatgtatcaatatc

SEQ ID NO: 3112 - DNA, 400 bp, Diabrotica virgifera
ggcatacgcttaggggtttattcatcattgataccaagggagtggttcgtcaaatcacaatgaatgatctaccagtaggaagaagtgtagatgagaccattaggctggttcaagctttccaatttacggatcaaaatggtgaagtatgtccagctggatggaaaccaaaacactgaagagtgaatccaaattcagttgagaaaaagaaatacttcgaaaaacactgaagagtgaatccaaattcatgattttatcactgtaaacttaaataactagactgactgaaattttcttagaaccatcatctgacatcacatctttaccctgtgttactgactgttaatttttgttttatgattcatatagatattattggtatgttcattccatcacatttttt

SEQ ID NO: 3113 - DNA, 1597 bp, Diabrotica virgifera
  misc_feature (1394)..(1394): n is a, c, g, or t
aattcgttgaaagttaaagttgtgaatcataattaaaaatcgacttaattaactgatttattcagattaaaatacacttcaactgagatcttacgttactgtgataatatacctgtagctaactttcggttatttatttttatacacttttctaagttcctgtttttgtgattttttcactatgttggatattgtgccaaagaataagcctgctgctggagactgcttcgagatgaaagaactgacggcgagaatttgcagggattaccttcaaggggcctggaagaaggtcaatgccaaaaacattggtttcaagcatatcagcggagggctctccaaccatctgttccacgtctctcttccggactctctaaagacggctgatgccaacgtcgagcacgaacccaaagacgttctgatccgtgtctatggacaaacccacggagaaggcgcattggaggccctcatcaccgaatcagtaatcttcaccttactctctgaacgtaatttaggaccaaaactgcacgggattttccccggaggaagaatcgaacagtacatcgatgccaggcctcttttaaccaaagagttgtcagacgaacgactgtcggtatcaattgccaaaaaaatggcagctattcattcgatggaggtacctctacacaaagctcccgaatggatctggaacactctcgataggtggttgaacagtttgaagaacatgcaactgaccaacatgccagaaagcaccaaacacatcctggaaaaggtgaatttcgggtcggaaatcgaatggctgagaaccagattggagggcgagaacagtcctgttgttttttgtcacaacgacatgcaagtagggaatatattgttgcccagagatgctgagctggaaaataataatgacgaagaaccaaaactcgtaataatagatttcgaatactgctcctacaactacagatctttcgacatcgcgaatcacttcctagaatgggtctacgactacaccctcaaagaataccccttctacagcgaggatcacagcaaatatcccacagaaaaacaaagactggcgtttattagagcctatttgcgtgaaaggggttcacgagagaacccgaagaagattcttagagaagtggaggtgttcaccttggcaccgcatctcttctggagtgtgtgggcgttaattaatgccgaaacttcaagtattcctttcggatattgggaattcgcaaacaccagactgaacagctatttccagctcaaacagaaactcagcagccagcagctaaagaggaagatggatgaactaatagtgtaaccctaagaaagaccgtcaagaagctttcaaaaaatttttctttggcttcgtccgaggaagaatttctcanaacatgactgtgaatttgtgaagaaagaagcagaggcggatatagacaaatttcaaaagggggaattaaataatcgtcatcttagatcctcttagactagattccagtcaaatcacatcaatcaaagccttaaacaaatattctaaaccagtcaaaccgttaacgtaaacaacggaagtaaaagactttctgcctacagaaat

SEQ ID NO: 3114 - DNA, 1091 bp, Diabrotica virgifera
ctcctcgcgtccgcctttataagatatgccagttataataaacatagagaatccctcttccagcgatagaagcaagaaagccatggacgatgtagaaggagccaaatctgctataaaaagatttataggagatgttagcaagagctctgctactaagcaaataatcttgggggcctcctctggatgggtaaccggattcttatctatgagagtaggaaaaactgctgcaatggcattaggtggaggaattattcttcttcaaatagctaatgaaaagggttacattaaagtcaattgggacaaagttaatagaaacctagatcaagttgcagataaagtagaagaacaactaactggagaagcagtatcctggatggataaggtaaagcattttgctagaaataacactcctttttcttctggatttgttggtggttttctaattggtttagcctcaaattgaagaagctcaaatataaattacaagaagaacagttttattttcctattttgatttagttttattgtactcttagtttatgttgttacaaatttgcttatatactgtgcaagtcttatctgcagagggtggtcaaatgatagagatgtggggtagaatggaagtttttgtttgaaaaggattttgtaactactacacaatatgtctttagtagtttattatgttatacacacgtgattacccgttaacttattggcaagttttatataaattttctgtttcattcctatatcaaaattctattaagatatcaatcaaccaactgttctaaataaattaggacctctggaatagtgaaagaagtcatctggacaaagcaagtcgaaacagtttattatagaacagtcgccaaaatttatggcagaccttacaaacaaaacaggaaaacagtcattggtctgctaataggacactgtaagctgaataggctgttaaagttgatgggttttccaaagatttcctggtgtaattggatccccttaaagcaccaaaccgcaaagcccattctgtggccttggaccgtctggccaaccgcgccggttttttgcttcggccaattatactccccccc

SEQ ID NO: 3115 - DNA, 986 bp, Diabrotica virgifera
aaagattatgtcaaactagaaataatcctttataagatatgccagttataataaaaaaagagaatccctcttccagcgatagaagcaagaaagccatggacgatgtagaaggagccaaatctgctataaaaagatttataggagatgttagcaagagctctgctactaagcaaataatcttgggggcctcctctggatgggtaaccggattcttatctatgagagtaggaaaaactgctgcaatggcattaggtggaggaattattcttcttcaaatagctaatgaaaagggttacattaaagtcaattgggacaaagttaatagaaacctagatcaagttgcagataaagtagaagaacaactaactggagaagcagtatcctggatggataagggtgaacggtttgttgatagaaagttagaccaagcaaaggacattgctaaaaagggacagaagaaagcgaagcgatggtactctggtgaaaattgccagctgcgagaagtgcatatatttatgatatcgtttgtagctggtgtcgccataggaataggcactgcgtagacttaaaatattgttagaattttttagatcttattacaattgctataagcaatataacatttaacaaacgcttaaagacatcaatatctcgaatgatttctagttttcaacgttttaagtattgtttgaacagtatttaactgtagtgatatcaatttttatttgctaatatagcgtatttgccaaaataaatagaacgtaacataaaaattatattaagtactagtcaataaaacttaaagccctgttcacattattccagtagaaggctagtccagtggtcgaaaaagctcttgaaatgtcaatatcacagtaaaaatcatttcaagaagaaagcagttctctgttttaagtgacaaactatagattctggtctttatttaactttttcgccatgaatacgtaaaaaaacttatccacatg

SEQ ID NO: 3116 - DNA, 707 bp, Diabrotica virgifera
cgagagccaagcaccagtcaagtcgtatacggacggtaataaatgtttgcaggttatacaatctacaacaaattttgctatatttagcattcagattatacaattagaacgctcctgctcatataaattccactggtagttcctgattcagtttattgcgaactattaatcatcggagttgttttgtggtatcgctaccgaccaaaaagcaccaggcttaagagttgaggatgttcttgtctcaagcccgttgcctcgctttacgtctcacagtgccagtgccacatcagaatgtacccataaacagaagcggaggtaaactagtgcccccatccgccatcttgttagcaggtttaggagtaggagtgtcatccttcagcctcaagcagatgcttcagtccaaacgtccaaaattgctatgaacctctcttaaacattgacttgtcagttttgtgacaatgttatcataattttttgttacatgtagtgagtacgttctcaatgatgtgtggctagtctttttatcaaagttgaaaatggttaaatttatacagattccgatactagcgtataaacgatactactttaaatttatttttactataaatttgtacagttttgtgtatggtttaggtaattagtaaatttattgtttaattttttctatcgttctcgtttttcttaagaaaataaatcacttatgtagt

SEQ ID NO: 3117 - DNA, 913 bp, Diabrotica virgifera
gatgggagaacacggagcccttggcgaatggctctacgacaagaacaacgtttgtgtgaaaaagatgagaggccaagttgaagaggaacttaaagcttcaatgcaatacatggccatgggtgcatatttcgcaagagacacagtgaacaggcccggttttgctgatttatttttcaaatcagctagtgaagaaagggaacatgccatcaaattgatccattatttgctcatgagaggagaacttacttctagcatcagtgatctcatcaaaagaaatcttgcacctgctcaaaccacatgggaaaacggtgtgagtgccctcaaacacgcccttaaactggaagcttcagttaccagaaagatcagagatgtcatccaagtttgcgaagacggctcaaacttcaacgattaccatcttgttgattacctgactggcgacttcttggaggaacaataccatggacaacgggacttagccggaaaagtctccaatttacaaaagatgatgggagaacacggagcccttggcgaatggctctacgacaagaagctccaaggagcctcttcataatttcattagagttgtaaatatttttagtgcagtttttgatttgacgtccgtgaaactgtgttacgtgatatagtgatagttcttatcattttttcttttttgtaaattgtaagatggttccatttatgcattcgttatgttcattttggaaattataacagaaataaagacaacttttaattaaaaaagcttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggaaaaaaaaaaaagggggggccccttcaaaagaacccaagttaacgtacgcggg

SEQ ID NO: 3118 - DNA, 1272 bp, Diabrotica virgifera
cgtcgtagaaaacaagtatgagaaagagataaatgtcatgatagtgctgtgcgcaaaatattatatttacgtataatctaactttttcaagttgtattgtcatagtccaccttctgcaccagtgagtgtaaaggcagactacagtgattacttacgtattgaataaactttcgttatatttataacatcaatcaaaccatcataccaaaaacaacatgaagtccgtagcggtattcgtatttttggcctgcttcgcaggtttacaggctgtccagctgaaatgtgcccaccaagaactggatatcccaaaagattggatcgacatgaacaacgtttgtgtgaaaaagatgagaggccaagttgaagaggaacttaaagcttccatgcaatacatggccatgggtgcatatttcgcaagagacacagtgaacagacccggttttgctgatttatttttcaaatcagctagtgaagaaagggaacatgccatcaaattgatccattatttgctcatgagaggagaacttacttctagcatcagtgatctcatcaaaagaaatcttgcacctgctcaaaccacatgggaaaacggtgtgagtgccctcaaacacgcccttaaactggaagcttcagttaccagaaagatcagagatgtgatccaagtttgcgaagacggctcaaacttcaacgattaccatcttgttgattacctgactggcgacttcttggaagaacaataccatggacaacgggacttagctggaaaagtctccaatttacaaaagatgatgggagaacacggagcccttggcgaatggctctacgacaagaagctccaaggagcctcttcataatttcattagagttgtaaatatttttagtgcagtttttgatttgacgtccgtgaaactgtgttacgtgatatagtgatagttcttatcattttttcttttttgtaaattgtaagatggttccatttatgcattcgttatgttcattttggaaattataacagaaataaagacaacttttaattaaaaaaaaaaaaaaagagcggccgaaaaaaagtttacgccccctttttggaacaaaaaaaataattctaaagagagccccaaaaattccatttaagggcggaaattaaaaaccccccgccgggggaaaaacattggccgcgccccccgctaaaatcctctgggcttaaaaaacccccttcctcccttttttaatggacgacccccaaaccccaccccgagcacaagagcttcaatg

SEQ ID NO: 3119 - DNA, 1096 bp, Diabrotica virgifera
ctttttttttttaaaattgaccgttgactgagaaacagcggttttaaggttaaagatggatcaagttaagaatggttggtttagcgaaatttccgaactgtggcccggtcagtgtttttcattaaaggtaaaagaagttctatacaaggagaaatccgagtaccaggatatcttaatatttgaatcaactaacaatggaactgctttggtgctggatggaataatacaatgtacccaaaaggatgaattttcgtaccaagaaatgctaacattcctagctttatgctgccatgataatccccaaagagttcttattgttggaggtggagatggtggagtagctagggaagttcagaagcatccacttgttaaggaaattgttcaggttgagatcgacgagaaagtggtaaatgcaagcaaaaaacaccttcctttcatggccaaaggtttcgattccgccaaattaacgttaaagatctgtgatggattcgaatatatgaagaaacacaaaaatgaattcgatgttattataactgactcttccgatccaattggacctgctgtgaatctctttactgaatcgtattataaacttgccaaagaagcacttaaaccaaatggtatcatcagttgccaagctggaactgtctggtctgatctaccacacgtcaagaaaaccctcaccaattgccgcaaacattttaaaacagtaagatatgggttttcaaccattccaagctatcccgatgggcaaattggttacctcgtggcatccacagatggcagcaatgacctaagaactccaaaattcaagtttactcaagagcaacttgataatctcaacttgagattttacaatgatgaaatgcattcagctgcttttgttttaccaaattttgtaaagagagaattaagagaattagctgaataaataaattgttgtttttctttaaaaaaaaaaaaaaaaaaaaaaaaaggggggccgtttaaaggatcccaggttaagaccggggaagggaagtttagtttttttatggggcacctaattcatttcgggggcggcgttttaaacggcggggggtgggaaaaacctcgg

SEQ ID NO: 3120 - DNA, 2693 bp, Diabrotica virgifera
gcaaaatcgggcaaattccaaaaaaaattggaggttatttattaagtgattatcagcaattcaaaccacttgatcgcggctagagaggcccgagcagtggaaagttcaaattttgtatttttataaaaaaagttcgtcgtgaatatataaccatggcctcctgtattcgaattataagtcgaacgagtaactccaaaagtctcatgttcagtgagatccaatcaagatgttttcacgtttcacccctggctgctgctgcagctaaggttgcgatgagcaaattggatactgatccaattccatacgagaaattaaacaaaactcttggggtagtcaagaagaggttaggaagaccattaactctttctgaaaaagtcttatactcccacattgatcaaccagagtcccaggatattcaacgaggtacctcttacttaaggttacgtcctgaccgtgttgctatgcaagatgccaccgcccaaatggctatgttgcaattcatctccagtggtctgaagagagtcgccgttcctagcaccatccactgtgaccatcttatcgaagcacaaattggtggacctcaggatcttgctagagctaaagatatcaataaagaagtatacaactttttggcctcggctggaaacaagtatggtgttggtttctggaagccaggatcaggtattatccatcaaatcatcttggaaaactatgccttccccggacttttgatgatcggtactgactcccacacaccaaacggcggtggtcttggtggactctgcattggtgttggaggagctgacgctgttgatgtcatggcaaacatcccttgggaattgaaatgtccaaaagttattggtgtcaaactaactggtaaactttctggttggacttcccccaaggacatcattttgaaggtagctgacattttaactgtcaaaggtggtactggagccatcatcgaataccacggtcctggatgtgagtcggtatcttgtactggtatggcaactatctgcaacatgggtgctgaaatcggtgctactacatctctattccccttcaacaatagaatggctgattatctgtctgctactcgcagaggagacatcgccaatgaagctcagaaatacaaggaatccttactatcacctgacaaaggtgccgaatacgacgaactcatcgaaatcaacctcgacaccttggaaccccacgtcaacggtcccttcactcctgatctagccagtccaatcagcaaactcggagccaacgccaacaagaacggttggccagtagacatcagagttggcttgatcggttcctgtaccaacagctcatacgaagacatgggaagatgtgccagcatcgccaaagaagctatgaaacacggcatcaaatccaaaattccattcaatgtcactcctggatcagaacagattcgagctactatcgaaagagacggaatttctaagactcttaccgaatttggaggcactgtactagctaacgcttgtggaccttgtattggtcaatgggacagaaaagatgttaagaaaggagagaaaaataccatcgtaacatcatacaatcgtaactttacgggacgtaacgatgctaaccccgcaactcactgctttgttacatctccagaacttgtaactgccttaagtatcgctggaagactcgacttcaaccccttaaccgactcactaaaaggttctgatggcaagagcttcaaactgactgcaccattcggggacgaactccccagcaaaggattcgaccccggccaggacacctacgcagccccagttgccgacggttccaacgtaaaggtcgacgttgatgtcaaatctcagaggctacaattgttggaacccttcgataaatgggacggaaaagatttggatgacatgaccattctgattaaagtcaaaggaaagtgcacaaccgatcacatctcagcagctggaccttggttgaaataccgtggtcatcttgataacatctcaaacaatatgttcattacagcaacaaatgccgagaacggtgaactaaacaaaatcaagaaccaaacgaccggtcaatggggcgctgtaccagacgtagcccgtgattataaagccaaaggtattagatgggtaaccattggagacgaaaactacggagaaggtagctccagagagcacgccgctttggaaccaaggcatctgggtggccgcgccatcatcgtcaaatccttcgcccgtatccacgaaaccaaccttaagaaacagggtatgttacctctcaccttcgccaacgccagcgactacgataagattcagcccacagataaaatcagcttgaaagatcttaagaatcttagccctggaaaacccgtagactgcgaagttaagcatgcagatggatcagttgataaaattaagctaaatcactcaatgaacgatcttcagattagttggtttagagcaggtagtgcattgaatcgtatgaaggagattgctgcaggaaagtgaagagaatcaccataatttttaattgtatttaatattatttatacatgtaggtagaagaaacatcgtcatcgaacggttgcatgtaagctgaaaactgtgtttgttattatgtaaaaagtatttttatgtagatgctaaatattccttctaataaatatagacaataattct

SEQ ID NO: 3121 - DNA, 218 bp, Diabrotica virgifera
atataagaggtgtgccaaaaaactatacacgaatttcctctcttaaagcgatcaagaaattacgtttaagtctaagatctcttgacaatcgggcgaaaatctttatcaccaccgaaatattttaggtacccgatataatatattgtcgagagatattttgttatatcaaaacattttattctacgatcacaaagataataacgtcacttattttaaca

SEQ ID NO: 3122 - DNA, 1676 bp, Diabrotica virgifera
gcgtccggtttgggggagttaaaccaggttgctttaagatttgggaacactcggaggaatgatggacaacatcttacactcaaaattgtacagaccaggcagtgtagcttacgtctcaagatctggtggtatgtctaacgaattaaacaacatcgtgtccaaagcaaccgacggagtctacgaaggtgtagctatcggtggagacagataccctggaactactttcatggatcacattatgagatatcaagctgatgataatgttaagatgatcatccttcttggtgaagtaggaggtactgaggaataccaagtatgtaaagcattgcaaaccaaacaaattacaaagcctttggtagcttggtgtataggaacttgcgctggaatgttcacttcagaagtccaattcggccatgcaggatcttgcgctaactcaaaccaagaaactgccacagctaagaacgaagctctcaaggcagccggtgcacacgtacctgattctttccattatttaggtgatatcgttggcaaagtatacgagcagcttgtaaaacaaggcgtgatagtgccaagaccagaaggtcctccaccaaccgtgccaatggactacagttgggctcgtgagttggggcttattagaaaacccgccagcttcatgacttccatctgtgatgaaagaggacaagagctcatatatgcaggtatgcccatttctgatgtgcttcaaaagaacgtaggcatcggcggagtcatatcgcttttgtggttccaaagatgcttacctccatacgcttgcaaattcttcgagatgtgcttgatggtgacagccgatcatggacctgcagtatcaggagctcacaacaccatagtctgtgcccgtgctggtaaagatctagtttccagtttggtatccggtcttcttacaatcggtgacaggttcggtggagctttggacggtgcagctaagatgttcagtgaagcctatgacaaaggtatgcatcctgccgaattcgttaaccacatgaggaacattggtcagctcatcatgggtattggccacagagtcaaatctatcaacaaccccgatcagagagtaaaaatagtcaaagagttcgtcatggctaacttccccgccactcccttacttcagtacgcactagaagtagaaaaaatcaccaccagcaagaaacccaacctcatccttaacgtcgacggtgtcatcgcatgctccttcgtagatatgttgaggaactgtggtgtcttcacaccggaagaagcccaagaatacatcgacatcggtgctatcaactcattattcgtccttggtagatccatcggatttatcggccattacatggaccaaaagagactcaaacaaggattgtacaggcacccatgggatgacatttcatacgttctacctgaacaatacaacaatgataattagagtatagcatttaactaggtaaaaatcttgtaattattgaccgatagaggtctaggcacgtaccgtggcaccttacgcaatcggctcagtgtgtaagatttaggtttttaggatccaaatgttcgtgaagatgaaactagttatcagttatatttatgtagttaacactatattgaaacatcgacatgttaatctgatgtttttattacttttgtttatgttattaaaa

SEQ ID NO: 3123 - DNA, 1022 bp, Diabrotica virgifera
atacggtcttgatggcaccagagatatcgtttcaggtgcctggtacttttagtatcttaaattacaccaaatcggatctgtgggctgctgcaacaatagcatacgaaatatttggagctaggaatccattttataaaagcaacgatcaaatttacttaaaaagttctggttacaaagaagaagatctgcccgctctgccaactgaagcgccatatattataaagatgttaatcaaaaatctactacaacgaaaacctaataagcgtcttaatccagaggtggctgcgaatgtttgccagttgtacttatgggcgccaagttcatggctaaaggcagaagccagaaagttgccttctagtgccgagattttgcagtggctcttaagcctcacgaccaaaatactctgcgaaggcaggattgctaatagacgcttttcccaatctgcccagccagactcggagcaagctaacatggaaaaaggtggcaggcgaacttaccctgaatatcttctgatatccagtttcttagtaagggctaagttatcgaacataaaatccgctctggcttggatccaggaggtaaactgcgttgatttttgagttagttctagtaatacaatgtataagtgatattttatccttccagtgtataatttagttgcaccttctttggttaataagatggaaataaaactatgaagtagagcaacttactttaaagcttgcaataagaaatgttaaatcccttatttaatgctgcaatggatactcttttaagtcttcctgtatcttttctcatccgaaaggatgaagtggcgttatgtaatttgattgactatttcggtccaattatctcttcctgtgcaggaatgagtaatcagtcatgtcctttatttggtccgaccatcctgctggagatcttcctctggatctatgtagctttcaactttcattcgtcccaagctttctcttcgtctaattatatgttcaaaatatctcagtatctgttggttgacagtatct

SEQ ID NO: 3124 - DNA, 1357 bp, Diabrotica virgifera
cattggaatatgttttttgaatcgaggagtaatctacaaaagagaaggcgaacagttgtttaacgtttctcactacgctcaagcgtgctggcgcaaagtcgcggcaaagcgagtcgattacgaaatatttaacacgctgtatctctggtaattttactccgattattttgaaattttcagagagtattcttgaaagtatgcacttttatttgaaataataaaaaaatttaaatatttcaaaccaaccccccccctaagtcttcctgtatcttttcttatccgtaagtatgtagtggcgtcatgtaatttgattgactatctcggtccaattatgtcttcctgtgcaggaattagtaaccagttatgtactttatttggtccgaccatcatactggatatcctcctctggatctatgtagctttcaactttcattcgtcccaagctttctcttcgtctagttatatgtccaaaatatctcagtatctgttggttgacagtatctgtggttttggtcagtctagttttgatgttgtttttctcctattgaattattagtgcgatgagcggtccatggtatgcgaaacattttatttcaaacgcccacggtttatttcaggcccacatttcaaacggctttatacgtttctaatcggcttttttcatgattcatgtttctgaagcctagatggcataggaaattttaatgctcgaacaaggcgtaattttgtgttttctttttttaactagaagagctgatttctgagcgatcgtgtttcctcttaacttctttgataatctcttctctaacatctattcatgtttgtaaaagaacacaaaaaacgtatacctttattcgaagacaggaatttttacttgttctaatggaataaactggaaattgatgatacttgaaggacaaaccccagttccttgcgaaaatttgcccgaccaccgtcctcttcagagacccaaacggtaatgactaatatttctcagccgttcccatgcctagagagcttttacttatcgaactatttaattaacccaaaaaaaaaagttagacgtaatgcagaaacaaattgctcttacccacgttgacattctaagaggatgccttatcgatgcaattagactgaataaacaaacatggatttttccttaaaaaatcaaaacgccaaacctggtatggttataaataataattataaaaatcccttttgatattaaggggtcgctttctatttctcttctgaattcatcggaatatttttttttttatccctataaagaaaaaaaaaaaacattcttctcctacatttttctcactgcttaagtgtttcggaaactttttttttg

SEQ ID NO: 3125 - DNA, 887 bp, Diabrotica virgifera
aacataatcaataatatcagaaaagcttcatcaaacttaaatagaattgttgctaataaatcataatatttaaatgttaataaaaactttcaattggaaaccaaaaggaaataagattcccatgtgtaaatgttatgtctaagaataataagatatagcaaatattaagcagtgattgccatttaaataaaataaacaatattttgattacaattgtaacccatatatgttattattttactcttttctttcctatcccgattaggaaccattaagaaatacttagaagccacgtaagtaagtaattaattttataaaaagccctgagattgaaaacatattgatatgtgatctggtaaattaattagattattattaatgcattgattaaattaaatgacatataaaaatattatctcatatcaataataaagatcacatcagtacatatgtactaggtttatgaactttgtatgtattattttgaacatatgttcgataatccgaacaatttgataatccgaactacccctgtaccaattagttcggattatcgacgctctactgtatatactatatttaaaatatatgacacaatataactttataaaataaacacaatataagttttaaagtccaataaacacagcaaatatgcttatgtcactgtcattgaaaatgataaatgtaaaaattcataatattaaacagggtataaaagtaaaaaatatactgacccatttttacagataaaaatcctttaaaattttttcaatgttatctaattattgatataaattacaatataactttataaaataaacacaatataagtttttaagtccaataaacacagcagatatgcttatgtcactgtcattgaaaat

SEQ ID NO: 3126 - DNA, 1031 bp, Diabrotica virgifera
aaaattgaccagctccttaaatatgcctctattttctgaattttctttttcgtcgtgacctcttaaagctaactcgaaagctccacaccaccttataacggacgcgtgggcggacgcgtgggcatttgtagttttttttctagcgaaaaaccaccaaaaaaatttttaaaatactaatcttattgtcaattaataaattaaacttaataaataatcaaaatattatcaaatacccacgatcatgatgcactaaaagtttaattataaatacaaaaactttttaacagaaaatatacataataaaagcgacaaaccagcacgtaaagaaactcaaaataaatagacctggcttcataccctcgtgcctggcacagagattctaatgttaaggtatactaatagtccaatatagctctttctctgtcacttacatataatgctcgtaaaatctttctctctttgctcgtgccagtactgacttcggcgcgaaggagattctcctgtcgaatactctccgctgtcggcagggattgtattgcgcccatagttgccatattttatataatttatgaagatcaaaagaaatacacacaaaaaaattaataggaattaaaaagttttgaagataaaaaatatgtttatggatagttagcaaggtagtgccatggctctatggcacttcctcacgggccgccactggtatgtcagacaatttgaaaatatggttcagcttgccgaaggctgtcacaagtcagtcttatacgacggagaagcttaacagtttggatatcttttcctatgcgaatctcatgacctaggtatttataggtcattacctggtctatgcatcttgttcctatgcatatatatattcgctgactacaagatttgtcattatctagattttagatatatttattttcaatcccattctagcgaggaaaagaagagctgattaaaagttctttggcctcatccttcgtatcagctattagtacaatatcatctgaaaacctcagatggctaagttt

SEQ ID NO: 3127 - DNA, 901 bp, Diabrotica virgifera
  misc_feature (793)..(793): n is a, c, g, or t
aaattggaagcaactaaatgtccggagaaagtagacctttgaaagatctggtactttgaatagtatgaacctttaagtagttgtctaattcggcgctaaaattgaccagctccttaaatatacctctattttctgaattttctttttcgtcgtgacctcttaaagctaactcgaaagctccacaacaccttataacatttgtagttttttttctagcgaaaaaccaccaaaaaaaatttaaaatactaatctttattgtcaattaataaattaaacttaagaggatcggaacgtattttcggctgcaatgctattcaaatggggattcatttttttcaaatcctgagaaaactaataagtagtttggaaggatttaaacgcggaatgaaagattacgttattggcgagggccgaaagtccctgagaacttctacaatgtttattttaataagttacaggggtgaaaaaactaagagaaaatttagtgtgatttttaaattcaaatatctcattcaaaataaactttttatttattctaagggattttcggccctcggtaatgatttagtctttcattctgcgtttgaatttttcaaaaatatttattggttttttcaggatttgaaaaaaatgaacacaatgccgtggtaatattttccaaatctgtctttgtcttacaacgcactcaaccgaatataatattgtcagcatatattgtcagtcagacactgacaatcagtgacaattttaaatatttgacattgcatcgggaatattttgagaaattgattanatattattgatatatagtgtatttgataaataattgatttaagacgtgaacttaataaaagttatttattgtgtattatttgtgaaagatccaagcagagaatacatc

SEQ ID NO: 3128 - DNA, 1309 bp, Diabrotica virgifera
  misc_feature (1281)..(1281): n is a, c, g, or t
ggggggttttttttttttttttaaaaaagggaaaaatttttaaattttttttttttggtttttgttggaaaaaaattaggaataaattaaggggaagaaaaaagtaaaccttaattaattttatatttttaatagaatatggaatgtttccaattatttaggaaaaaattaatgtttctggaaaaataataataaaaaaaaatactaaatccctgtccaacaccaactaacgtaaatcttttcccaaaattccaaacaaaataatgatagtccaaaaaccaactcaaaagacgattccagctcttaggctaccccgtgactgcgctaaaatttttttttatttcatcccggatgttagtggggatgaatattccagtggttccaagtggctaaaagatacaaacccattgttaatttgggtaatcaatcttatggaattaggaaataagttggaagttaaacttccaataaaaactggtcaggatccattaaaagaagtgttgttttttttttctgtaccaaaaacataggttccacttgaccttgaataactttatggaattttatatagaaacatgtggatttagagctaggaatgatattaaaaattgtatctatagatagttagtcgaaatatataataaagacaagaagaaatgaaaagaatttatggaaattataaattttccggtcatcaatatggcttcctatatggatgaagtaataatacaacttacccgatagcaatcatcccaaatttttaccaaattaatacttttcttcttcaacaaaacaaaactttctcctccttcaacttaattacgatagcttccgtataaaaaaaaataactaaaaggtgattcctttttttgttcaaaaagccaccgaccacttggaacttatttatttggaggttcagctaacagtgaaactttttaaaaatttgacagttcttcttgatacttgcgacagcggctactcgtggaactaatgtccagtgttggcggtgttgcaagatggaaaagtagcattttataaatattaaattattgatttttaattaaaatattttcattaagtaacgttccgttacattcccctccaacttgatgaaaaaaaaattttaggtacaaaattttttttttctaaacttaatatatcactaaccatagtggtctattttttcaggagcacattgattaacaagattaagacaattttatcaagaaaaagtatggacttcttcagattccataagattttaaggggtcatattaaatntctgtataaaccattagtgcgcctagaa

SEQ ID NO: 3129 - DNA, 1676 bp, Diabrotica virgifera
taaaactctaataggggtcttttcatcttttaaaaaaaatctatgctttttaacctaagaaaaaaaattctttataaattaaataaagacagtcatcttttcatccagccttccattccagctttcaataaaaaaactaatgattatgctaccttagcacggtcaaaaataacgcggccattcaaattaatcagggggcagacgacactttatatatcatacaaacagacatgtttttcataaacaggtgaaaaaaatgttgccgaattcctccattaaacctatatatttctgctaaatatacaactttttaatactaatatcatcatcattagtaaatttaaataatagaaatttatattctaataaaaaatttataaaaaataaaaataataatatataaaaataaataataacatattttaaaatatgaaaatttttaatcctaattgttctctataaaattatattttaataaaattctacttgtaaggtcatcctaaaacatatttaatattaataatatgagaaaatttaattatatatatcttgcagttggataacagcaatctctttaatgacagagaagagacccagctgctattccatggggcaaagctggtgcagattatgtagtagaatctaccggagtgttcaccacaattgaaaaggccaagaaacatcttgacggtggtgctaagaaagtcatcatctcagctccatctgctgatgctccaatgtatgtatgtggtgttaacttggatgcctacaatccagctgatcccgtaatctctaacgcttcttgcactaccaactgccttgctccactcgccaaagtcatccacgacaacttcgaaatcgttgaaggtttgatgaccaccgtacatgccacaaccgccacacaaaaaactgtcgacggaccctctggaaaattgtggcgtgacggtcgtggtgccggacaaaacatcatcccagcttccactggtgccgccaaggctgttggcaaggttattccaagccttaatggcaaactcacaggtatggctttccgtgtacctgtaccaaatgtatccgttgttgacttgactgttcgtttgggcaaacccgccagctacgaccaaattaaggccaaggttaaggaagccgcagaaggtcctcttaagggaatcttgggatacaccgacgaagaagtagtctcaaacgacttcgttggagacacccactcctctgtctttgatgctaaagctggtatccaacttaacgacaaattcgtcaaacttatctcatggtacgataatgagtacggttattccaacagagtagtcgatcttatcacctacatcgacaccaagaaagcttaaggatgtcaggcacttctttaagagcgtttttccgtactgaggcattaggcgcctcggagaatgtttcatgatcagtgtttaaagcatctttattgtaagggactagatagtagtcctttgttcatgtcaaaattatattatcaagttttatttttatttaaaatttaggattatgtataatatacatgttgaaacaaaaaaaaaaaaaaaaaaaaaaaaactaaaaaaaaaaaaaaaaaaaaaaaaaaaaaaaaaaaaaaaaaaaaaaaaaaaaaaaaaaaaaaaaaaaaaaaaaaaaaaaaaaaaaaggggggc

SEQ ID NO: 3130 - DNA, 950 bp, Diabrotica virgifera
gcgagcggccgcccgcgatctagaactagagtgatttcgtggcgttcaaaccactttactttcatcaaccttgatcagtcgtattctccagttttaacaaaatcgagaaaatggcccccaaattgtactgctcagaggtcagccctgccgtcagatccactcttttaacgatcaaggctcttggtttggatgttgagttggttcctatgaatttggctacgggagaacacctcacacctgattacttgaaactaaaccctttgcatacagtgcctacactgcaggacggagatttcgttgtatgggatagtcacgctattaatatttatctgatcgaaaagtatcacccagaaaccgacctctatccaaagtgcaatcaggcaagagctaccatccaccaaagattgttcttcgatgctggtatcctttttgccaggatggctgatatcgtcaaaagcgtcgttagagaaggtgcgaaaatggtcagcaaagacagggcagacaaagtcatcgaaggttacagtttcttggaagcactcttagaaatgaataaatacgtcgctggagatcacgtcaccatcgctgacttcagtctagtaaccactactgcttcctgcaatgttgtggtgccaatagcctcgaacagataccccaagatctctgaatggttggctaatatggaacagctgccatactacaaagaagcagtccaggctggactagacatgttcaccggaatgatgaaaagtaaactagcctaatttaaagataaattcgctagttacgatcaaaataatcacaacgttggcagagatgttgtttagccgacatgacaaatattttataataatcattatatctacaaatgcatgtcatatttatgtgctccatctttatttatttctttgttatgtgcaaacctaaataaatatatattttaatggtcgaaa

SEQ ID NO: 3131 - DNA, 322 bp, Diabrotica virgifera
  misc_feature (242)..(242): n is a, c, g, or t
gaaaaacgtctctcagccgaacgaagtattcctgcgtcttcgcaacgtcgtgaaatcgtccaagagatcacgacgatcaaacaacaaagtctcgtagaagacaaactagcggaggtgaaggagaagataaaaacagaagaggcaacaaaaaccacagtaacgacaaccacgatctcgccggatacaaaacggtttctaaaaccatcgaagtaaaaaccacattaccatctgattcgaaggtntcggaaccggtttcgtctcctcaagagacccacgttagcataaccaccatagtaacggaaacacgcacaattcaacctga

SEQ ID NO: 3132 - DNA, 946 bp, Diabrotica virgifera
gactcgtttattttattacttcggttagcttacgttagttagtcttacgatgaattttaagcgagcaccacactttcagcgaagttacttcggcaaagtttacagaagtccgaagtgcccgtcactacacactcgttctacttcgcgaggaacacattcacgccgggcgataaggacaaggacttcgattcctttgagtcgatcgcaatatcgccaccgaatggaagtagaccgaggcgcagcgaagtcgcacaaggttactgtctacactctcgtacttgatgaacttcgatcgacttcgcgagtagtatagtgagcgttttagatcttgtttgtagtaataaaccttttttataaataaattaataatttaactgtagagaagtagcactatttcgtcttttattcattaattgtataaaggaatcaagtcccagcctttaaaaacgactctttggctttaatcgttttcaaagccaagtttgctgtatcacatgtcactctactagtctccttctacatttcatctgtagaacaaaatttgataggtcatcaagtttctaaactaaatagtttttttttcgtttttctcaaaactcagtattgtggacttataccctttatacaataagcgcttcatatgtgtagtttaaaatcactacactgtatatggaaaacccaatgaattgctatgttaaatcacaatcatgatttttatttacagtaggttactttaaataatgatacagtataataatctaggattctaggattcactccttcttcagatgtaaattcactaatggatggtaacgatcatattttcgattaaactctctgtttcttgcaatatttatcagagattgtatgtcattaatccctgtacatttgccttatgttttgaagcagatttttttgcgttcatttctctcctgccttcatttta

SEQ ID NO: 3133 - DNA, 278 bp, Diabrotica virgifera
cagccgctctctcacttcaactctgtaccatccttcaactacaactaaaatgggcactagtgaatctaactcagttgtggatgtaaatatgaaagttcatggtatttcaaacttgagagtagtggatgcaggatcgatgcccaagctagttcgaggtcatccattggcggttatttgggccatggctgaaaaaatcgctgatgctattaaagaaaaatatataaataatttggaagtttagaattaaaataaataaaataaataaaatttattcaatt

SEQ ID NO: 3134 - DNA, 833 bp, Diabrotica virgifera
catttctgatgtgttttcaatataaattttcgcaatatttggacaatatgatataatttgtgtttcatatatttcatttactaaccaattgtcacggattgtctctaaatcacttgttatgaaaatatagcattatggactctgttactgatgaacaagctccaagtaattcccaagaagatagaggtagcaatacagagacaggggttcaagtacacactaaagactccgccagatactgttgggtatgttttgcaacagacgaggaagacagaaccgctgcatgggttcaaccctgtaattgtaggggcactacaaaatgggtacaccaagcttgtttacaaaggtgggtagacgaaaaacaaaaaggtggcaatcttggaaaagttacatgtccacaatgccaaacagaatatataatagtttttccgaacatgggtgttttagttttggtgttggacacagtagatagttttatttacaaaggatgccccttcttagcagcagggatagttgtaggagctatatattggtgtgctgtcacttatggcgctataacaattatgcaggtaattggacaaaaagaaggtttggcaataatggaacaagctgatcctctagttttattgataggtttgccagctataccagtagctttagtactgggcaaaatgattagatgggaagatgctgtgctcacctttatgaggaagaacctatcaaaaattccaattataagaaatgtttttccatttagcgaatgtaccagactagaaatgaatgccagctcttcagaaacatcgaataacgaagacatcccgccactatcaaat

SEQ ID NO: 3135 - DNA, 1453 bp, Diabrotica virgifera
aaagacagtccgaggaagaagagaagtacgtctaggaggcgatccgatagcaggcggagaagtgcatcaagaagacgaagcccatccaggggaaggagaagccctagcagagatagaagacgacgcagtatgtcgagaggacgtccaagtcctaggagaggacctggtggacccagagggagctacggccgcagaagcagaagtcgcaataggagaggaaatagcagacagagacgcagcagtcccaggagacgttctagaagccacagtagaaataggttccgtcgcagtagaagtcgaaatagaaatgcctataggagaccatccccctctcgtgatagaaggatgtcgagggatcgtcggtcgaggtccaggagacgctcccgtgaaagaggcagcgtcagaagacgctcaccaccgcgagacagatcacgccccaggagacctagccctagtccacagaagagagacaatcgaaaccaaggacgtccaaggaaagatgatcgtcatcccgagccacctccgaagaaagtcgaggaagccaggcgaaggatagaagaggagatcaatcgtcacgagaagaaagaaagagaagagggcgagcggaagaagaaggccgaagctgcagcagccgaggaaagatcaaggaaggagaaggaacgagagaaggaaaagaagaaatctagaagtatcagtcctgaggagacttacccgataccaccacatggtcctccgaggtattctaggagtttgtcgagaaccccgtcgccgttcatcaaggcacacgagttccctccgaagcccgctaagacgacgagcgtcaaggaggacaagaaaaaagccagcaaggagaagccagaagcaaaaccgaagaaggttaccaagaagccacccaagagcgagtcggagtcctccagcgagtccgaaagtgacgaggacaccaggaaggataagcgcaaagtccgaacgaagaagaagccaaagaagcgggactcaagcagcagcgagagcgaggacgagaggtcttcaagagaagtagaagtaaaaaagaagaaaaaaaagaagaagagggacagcagcgaggagaagtcttcgaagaagcgccaccaaagctccgattcagaagaggataagaagaaaaagaagcggcgatcgaagagttcagagaaatcgaagaaatccaagagggataccagcgagagcgacgtgcccgccaagaagaagaagagtcgacaagacagctccgatgagtccgaaaaggaaaagtccaggaaacacaagaaggagaaggatagttcatccgagagcgacgacgattcatcgaagaagaggaagcacaagaagaaagctacgaaatctgtcagcgattctgacgaggagcaagaggtgaagaagaagaagagggataagaagcacaaaaagaagaagaagcatactaagaaacacaagaagc

SEQ ID NO: 3136 - DNA, 358 bp, Diabrotica virgifera
accacgcgtccggaaattgtgacagtatcgtgaattattccaacatggaaccgttagcaataataattcctgtatattcagtagttttgttaatgctccttttacagattctatgggcgtttaaaatcaagaaaaaattgtacaaaatgatcgatgaaggttactactttttggagttggaaacaggctggggaaggaaaattttgaaacctattcctccaggcaacgtagatttatcatccggctctccgagactgatcagcaacatcataattcgccaatgatatcgccgaaaatgttaacgaattttggaaatcatggaaattgttaatacttaagtaaatacaaaaaacttttg

SEQ ID NO: 3137 - DNA, 986 bp, Diabrotica virgifera
ccacttcacgcgtcctattatatcaagatgtatcgtttacttacagtattgcttgtagtttctagttctttagcatttcctgcaaaggaagaaatttcaacaaaaaatagcaatgtaagattttatgaggcagccaacaagactcccttttcgacagacaacattacgatcgattatagtacaaatgaagaatttggcctgaatattacagctatttctcgagttaacaatcttgaagattttctattgcttgttagcaatctaacacacaacgtttcaatactgaacattggtcaattgtcattcggacaatcttcaaagcataaattaaatccgtttgaaaagaatgcttacgttgttgcggaaactgtctcgacattcagcgtttctaaagaaggtgatttggttcttaacgcaagtgcaggcactgtgcagtctctgaaacttgtaacagattttacagatcttcaaaagcgaccaagaattgaatataacctcactgttgtaacagaagtcaatatgacatggattaccaaatctggcccattaaagaataaagtaactaatctaccctcacatataagtgatccacagccatataccactccaaatttcactgctttggttccgttggtcaatggaacattcaatgatgaatcttcctgtcgaaacgaaatatgtaaatctacttcgaaatcaagctacaacacaggctcatactacgtatttgatgatattactgtaacatttgaaagatacatcagtaaaccaaatataaccagtactagatttgaaaatggaagtaacacgacatatgcagtcatttctactacggatgttaaaactgtcattgtggtaggcccgcatagatgttaaatgaaataatataaactcttatgatatacctctttatatgtaatataaataataaattattttggaaaactataaaaaaaaaaaaaaaacgggggcccgcttctaaaagg

SEQ ID NO: 3138 - DNA, 1741 bp, Diabrotica virgifera
ttttaatatcatatgaattaataatatcggcacgagatgctatacaattcaaccatccaagcaacgtttatacaagatctctgaatacgaaaagtgatgataagtgttaataagtgatattaagtcatgatatgtgataatacgaaatgacaagtgacgataaataataataagtgatgaacaattatccgctctacagagaactatttcttctgcgttcttggtataaatctaacttttacttcgttagacggtctcatcactatatcagctttatggataatatctgaaggtttcgtaactgcttccaatttgaaattgcaaagtataccggacagagcagatttcagctccaacattgcatatttttgacctatacagtttcgacttccagcactgaatggaatgtaagcgtaaggatgtcgtgaagaactattctccggcaaaaatcggtcaggatcaaacttctctggattttcataataatccggactgtggtgaacatcgtatatacaaatggaaacaatcgcagattttggaattgtatatccagttttggtctttacgtcttctccagctattctagaaatcatgggagcgctgggatataaccttaaactttcttttatgcatctttcaatgtatttcaattctcctaattcggtgtaagtgggatttttaggatctcccactattgagattgcctcttgatacatttcctcctgaatgtccgggttgtttgctaaaagcatcaaagtatgacataaagaaagggcggtggtatcgtgaccgcctaaaataaacgtatcaacttcttccctaataccaacatcatcaatatcagcaccattatacttcgctttaatcatcaaatccaacaaggctagtcttttcctctcagagtaactcatagttccatcttttttaaacagcttatacctctctgcgatgattccattggaaaaatcatgcataactttcacgatttccttatttcttcttcctacttttgtcaagttgaagaacgtatccggaaatagccatggccggaccattctgtatacgaaattgtctccatactcatatactgcttgtttgtactcgtcacagtgaggctcttcacgaaggtcttttccaagggaagtttcaccaatagaatacaaagtaaattccgtgactggtttgataaggtcaattggttgatcacactttgatttaaagagttctactaagtggttagtttctttgttaaaaacgtcaacaaactcctgcaaaatgttaaaatggaacgcaggtgtcaagattttccttctcttatgccaatttgcccctttgctcgttaatagcccatttccaagccaactgtgaaggaaatcgtagaaagcacctttttctatatgttttgaattgtttaatatgagctcaatgtcttctggagctattagattaacaattgcaaaaggtaaactatgttgttgatatattggatggtatgccttagcattggccctatctcttttaaaaacatcctctgcagactcaaaatgaacctgcgtccccaaaataggataggctttgggtccaggaattgctaagatgtgtttccaaaacgtttcatcttttctattgatgcggtaaaaaatataaaccaaagctacaactgcagcaatcagtaacacgatcatttttttttcaccttgcttgatttgcgaaagagaatacacacactgtctcttgtttt

SEQ ID NO: 3139 - DNA, 885 bp, Diabrotica virgifera
ctagcgtcgtcagcagccaagttgtagctaacatcatagactccttccttgatgtttacgttattatatttaccagacaaactgagtttacgaccgggagtgttcttgtttttcctatattctacactggcttgaccttgtccgttaagaatatcattcctagtgttgtaggctccattaacttttccttgcaagtattgatcatttggaagaatcacttcgacttctccgttatacctcttgttttcagcgtcaccggattttgcaacgttcaaattgacttccaatacttttcccaaaagattaacactattcttggtgtctacacttgttggagataatttgctgtttgtggacaaaataattttttgattggggtctttgtcaaagcttggatataatgttactacaattttgtacaaagttggtggctgtatttcaaagtcactctcagcttttactacttttttaagagattgtgcgtcgatcttaatgtggccgttaccaacacctttgactgatttgagctgtccattaactaccagaacgtttttaatgtttactttaacgctaccgttagcattgccgtttttgttagcattcaaaaaggcgtctacaaccactacattgccgctgagaattttgttgtgagcagcaaagtctgttggattatattgtaaaccactgtctactttgaatggagttgggtgggtaggaaggacaacagttagatcagcgccgatatctacgctagatggtttgatattgtgtgtaataagtcccttaactgctagtttcagtccattgatatctaactcgttgttaatttggctcttatcagctcttaccagttctcggcttgctttaaaatcaactttgttttcc

SEQ ID NO: 3140 - DNA, 2085 bp, Diabrotica virgifera
ccagcttcgaacaaatgattatgaaccaaacaaatggtagaggagtagattgcgttctgaactccttggctgctcaccaactccaggcttctgtaagatgtttggcaattggtggtcgcttcttggaaattggaaaagtagatctttctaacaattctgcgttgggaatgagcatcttcttgaagaacactactttccacggaatccttcttgacgctctctttgattcagacagtcctcagaagagacaagtaatgagattggtaactgaaggaattaagagcggagctgtaaggccacttccaaagactgtatacaatgaacaccaagtagaacaagcctttagatttatggcttcaggtaaacatattggtaaagttttgctccaaataagagaagaagaacctaaaactgccactcgcccagctgttaagactgtcagcgctattcccagaacatacatggatcctgaaaagagttacattttggttggaggtcttggtggatttggtcttgaattagccaactggttggttactagaggtgccaagaaaatggtgttgacctccagaagtggaattaaaactggataccaatcactatgtatcagaagatggagagaaaaaggtgtgaacgtacttgtttctacagccgatgcaacaactgacaaaggtgccagaagacttcttacagaagccagtgaattaggacccgttggtggaatctttaacctggcagtagtcttgcgtgacgcaatgatggaaaaccaatctgaagctgactttaagactgtctgcaaaccaaaagttgacggcagcaaaatgttagatatggtttccagagaaatggcgaacaatttggactatttcgttaacttctcatcagtttcatgtggacgtggtaacgctggccaagctaactacggtctagccaactctgccatggaacgtattgttgaagccagacagaatgttggtttacctcggtattgcaattcaatggggagctattggtgatgtagggcttatcctagaaaccatgggaggaaacgacactgaagttggaggtactttacctcaaagaatgtcttcttgcttaaacacaatggatattctattgcaacaacctcattctgttgttgccagtatggtacttgctgacaagcacaagggatctgcaggaggtagccaagttagtcttaccagcgctgtagctaacattttaggtattaaagatcccaacactgtagcacctagcaacactttagctgatcttggtatggattcccttatgggtgctgaaattaaacagaccttagaaagaaactatgatttagtacttagcgcacaagaaattagagcccttactttcgggcgattagtcgaattgagcgacgggggagctcttccagcaggaggagctgcaactgaaagctcaccagctcaagataacaatgttcagtttgataagtctgccgatattatgcccaaaaaatcattagttcaaatgaatagtaaaggttcagatagcaaaaaggctccagtatttgttattcatccaattgagggagtagtaaatgctctagaaaacttgtcaaagaacatcgagattcctgtttatggtctgcaatgtactgctgaaactccactcacttcaataactgacttagccaaatattacattagcttgatgaaatcagttcaaccaaaaggaccatacacaatcattggttactcctttggtgccagtgtcgccatcgaaatgggaatcttattagaaaagagtaaggaaagagtatctctcttattgttggatggatctcactcttatgttgctactcacaccggaaaagcaaagaataccaagatccaaggaaatacagtagctgaacaaagcgaagtactactgtactttatcttgcattcaaggacgtcgatcagcaaagcttttcggcgaacttatgggcctgaatcgtgggaagaaagacttgctagagcaacttccatcgtcgccgaagtacccaataccagaaggaagatattgctgatgccgcactagttctacggcaattggcactgctgacag

SEQ ID NO: 3141 - DNA, 568 bp, Diabrotica virgifera
aagacgttggtgctaaaacaattcggttgaaaataacagaatgttcaaactactagtcctcctctctgtagtctactacacccatgcgtactccactggagcgcccgtagaagtatgtgatgacatgacaccaaagcatccctataacccacaggcctcagaaatcccatacaagttcggtttgagcaaaaatgaagtaaaaggaggagaacaagtagaaatcgccatcactggtacatttaaaggattgttgttggaagttagggaaggagacaaagctgttggtgagtgggttgttgcagccaacgatccagacttccaaactattgactgccacggcaataagcacagcgctattacccacaaaaatgctagtgacaagtctaatgttaagttagtatggaaagcacccagcaaagtaggaaaatatgttttatatgccaccgttgcagaaactggagaaagattctgggcacgaaaacctaccgaagtcattaatgttttctaaacaaaattgtgttaaaaatatttaatttttattaaaaactattcagatgtgatatacttt

SEQ ID NO: 3142 - DNA, 408 bp, Diabrotica virgifera
agcggacgcgtgggcggacgcgtgggttgattagtaagtacttcagtaccattcagttttaacctcgagatatcagatatttaccagcaacttcatcatggctgatagagattcaaaggcaaatactgacaatcgggccacacagctaaatgccaacaatgacagattctatcaaagtagagggcttgattctaggccagataattggaaggatactgcttcagccggtggccaaggatatacccaacaggatagagacaacagatccaatcagctgaatcccaacaatgacgcttatggaaaatccaggcaaaattagcaaatatttactaacggcaatgcatattaatactgtgtattttaattcatttttgacatagtggtactttaatatttcaataataaaat

SEQ ID NO: 3143 - DNA, 1292 bp, Diabrotica virgifera
gtcgaaaggatgccataaattgtttacttttttaatattcttgacaacactacacagtataagaggaatcgtagttaaaaatggtaacatcaccttgcaactcgagccaaaatcaaatgggattagttttgctgcatacgatggcaaaataaagaagttggaaggcatcttaggccgcggtattaacatttctaacgtggactgtattggtacacaagtctgtgtaattaatgactccaattttagtgttgagcctatttcagctggatttaggctgaagtggaaaacgtttaacacacgaagagctttccaagactgttacgatcttactgaaggtgttcaatggtatggaggaccaacaatattttctctaatttggccaatacaaacgaatgaaattgatggatcttctccatacgttcttgacaatggtaaaggcatgccatacgccgaaagatactggttaaattcgaaaggctcatacattttcttagacgacgatgttccactttatgttgatcaaaataaattgagaaataatagcgtttgcttcaaatcatatatccgtgatccattccatgcgtactttaatagaacaaggaatgtacttcagtattaccttatttttaaagatgatgtaaaacaggctcatctccatgccgtaaacaaatttctaggaaaacctaaagaccatcccaatgaagctatggtagctgaacccatatggacaacttgggcaaaatataaaacgaagataaatgattctgtcgtactaaaatttgctaaagacatacggaaccatgggtatgaaaaagggcagatagaaattgatgacaattgggaaagatgttatggcgcagagcagttttcacataatttcaccaacatcaaggatacggtgaagatactaaaaagtattaattttcgtgtaacgctgtggattcatccatttgtaaatgataattgcaacaacaattctcagataggtttagagaaaggatatttcgtaattgacaaatatgggcgtcatacaggatggtggtggaatagcaacgatgcgtatgttatagattttacaaacccacaagcaactgaatggtggctacaaagggttaaaaaacttcaaaaagattttggctctgacagttttaaatttgatgctggagagactgacttcagtccacagcctgctgtctataaaactgttgatcaggaactgattccaaacatcttttctggaaagtacctacgaacttgtgccacatttggaaattttgatagaagtgaggact

SEQ ID NO: 3144 - DNA, 665 bp, Diabrotica virgifera
atcatgcgcgaccatgcgcggactattatcgaacgagagtgggtgaagtgaaagtattagtaattaacaattaatatataattacacagattaaaaatgaagttctctgcataccttgcactgctcatggtactggcggtagtagtctcgacttcagctaagcaccacaagaagaagaaaaactggcaggttcaaccagacgttggtcgtgacggagctggaaacgtcaatgcaggagtagaagtgaaaaactctggaaagaaccatgatttcgaagctggctggagcaaagtagtacgaggacccaatagagccaagcccacatggcacgtaggtggtacgtggaggttcaaaagatcgccggatccacaatgggaagtcaatcctggtgcaaaccgagatgaaaatggtaacgttaacgctggtgttgagcttaaaaggaaaggagaaaaacacgactttgatgcaggatggaataaagtagtcagtgggcccaatagagctaaaccaacatggcatgtcggtggtacctttagattcaagagatcacctgtacctgattggcagtcaaccctgggggtaatcgagatgaagacggtaacgtaaatgctggtggttgaataaagaacataggcaaagatcatgattttaatgcttgatggaac

SEQ ID NO: 3145 - DNA, 1595 bp, Diabrotica virgifera
aaaaaaaaaggtgtgtttttgcaaaattaatataaatagagtcatctacccaccccaaaggtaaggagaggagaaaaaaaaaaacttttccatgaatccgggggggtttcccttgctccccgggagggcccccactaattttcatacctccaattttaagagtgtcgcgaaaatatagtctcataaaattttttttgaagtccctaaatttgtggcggaagaaaattttgccgattcccgatatccaaaaccccctcgaaaaaatctaatcggagttgtgtgctctcgaggaaattttgaaatacgtcacgaggcggacaaaccatatctcgaaaggggagtagtttttccgaaataccaaggggaaaaataccggccttttttgttgaataagtttagaggaataagaaaaattctttctgtaccttaaaaaataaaagtcgaataaaaattcgacccgctagtttattggaattagaagtaatccgttaatcacgctacaattggtgtcggtgttcggtaaacttagtcggatatgaataaggaatttacagggaggctttaaaagacttttgacctttattcgccgggaaatatccggagtgcgttaattgttcggtattcggaaagactttaaaagacttttggactttattcgtcgggaatagttaaagtgcgttgattgttcggtattcggaaagacttttaaaagactttttggaaagtacgtgtgtgccgaccaaagatgttgctacaagaacttacagtaaaacagctccgtgaacagctagaggaacgggatctggacagcagtgggctcaagatagtcctacaagcacgactcgaggaagtcctaacgaagaacggagaagacccagagacgttccacttccagtcagcagaacaagcaatcttatcaaaattaaaaactgtttctgaaacgatcgatgatacttctaagataaataatgagaaattcgaaagtatttctcaaaagatcgatgaaacttctaaaaaaagcgacgagaaattcgaaaacgttgctaaaaaatttgacgagacttctcaagtaattaaagaagtttgtagacagagcaacgagaaatttgaaagtgtttctcaagtaattaaagacgtttgtagacagaacgacgagaaatttgaagaggtttctagaacattcgataagatacagaaaagcgtagacgacagtaaagaaatgttagaagagaagatcaaacaactagagactatggtaaccaatacgaaagtgctaccttcagttaatgcagtagttttggccgtagaagagaagatcaaagaattagagagcatgataaccgatacaaaagtgcaaccgtcagttcatgcagtagctttagatcctgtagtgaaagatgaactaccgagagacgaaatgtcgcacaatatcagattcaaattaccaccatttgatggaaagtcctcttggtccatataccttagacaatttgaagctattgcgaccgccaatcattggaccgaacaagaaaaggctgtttccttgactgctgctttacgaggtgatgctgcagatatactaacccacgcgtccg

SEQ ID NO: 3146 - DNA, 822 bp, Diabrotica virgifera
tacaggagaaccaagagaataccaagattcatcacagacaccactttttagcatacctatcaccacgacaggaacccgcgatcacagattcctctacctatacttttagtgttagctgtcgcaacatccatcaaggctgaagtctctccggatattatagcagttcccaatggtttaagtggaaagggaattaccactagatactgggattgctgcaaaccatcatgtgcttgggcagacaatgtcaacacgcctgataaacaacctcttaagtcgtgcagagttgatggagaagctgtagccccacctaatgatccgtctggatgtgatataaatggttcttcgtttgtatgtaacaacaaccaaccgtatgtggttaactccactttatcctatggttttgcttctgcttccttttccggtggtattgatactagcatgtgttgttcctgcatgttactaaattttgagggtcagctgaaaggaaagcaattcttggttcaactcactaactctggtgaagagtatcagaccaaccaatttgatctcggtatccctggaggtggagtaggtttattccccaaagggtgtactgctcagtggaacgctcccagtactggttggggtgacttatacggaggagtccatactgaagaagagtgtaacgagcttcctgaagttttacaaccaggatgcaaatggaggtttacatttatggaaggcgtttctaaccccgaagtgacattttatcaagtacaatgtccaagggaacttgttgaaagaagtggttgtgtattgtaaatagaatgagatagatacaat

SEQ ID NO: 3147 - DNA, 600 bp, Diabrotica virgifera
gcgaaactgcgacaaacgttggtaagtctctagagtgtgcaacaagtatggcgacggtatgtagagcccagtctacttactcgaggacctggttcaggtcgaggcagaattacaacagctagagataaccattttgtcgtttatgacattatccacaaaaaataagaaatataaacataagtgaatggaaagttaggaggcaactgcatgctgctagtttatcttctcgaactagagaaactggatagctgctttcccatgaacaccgaattgccagattgagttttgcacgagaacacttggcctcaacaagatagggttgaagtcgtgtattattattgtgttccgatgaatcgagattttaccttatgggaccagacaaacgtgtaaagcctgatttatgttaggacggggacgtggacgacacggctgtcttacggggcacgttgaagaatcctctgatatgaaaagcattggctagtttatcatacaagggaatggggcgacaccggggacgtgcgcggtctataaggctgatttatgttaggacggagatgtcgtcgccagtaccgtcttacggagcacgttgcggacaaatga

SEQ ID NO: 3148 - DNA, 408 bp, Diabrotica virgifera
tgtttataaaagtatagtgaacgtgaataaaatacaaggaatattccagcgtgacaaatacgttaataatggcgaaaatgttggatagtagtcccaatgcggcactcaacaaatcgcttcttcagcattaccttactctacccattccagatggtaaatgccaggctacgtatatttggattgacggatcaggagaaaatgtcagatgcaaaactaggactttagattttgttccaacatgcccaaaagaattaccagtgtggaacttcgacggaagttcaacaaatcaagccaaaggacacaactcagatgtctttctgtgcccagtagctatgtacaaagatccattcctcagaggaaacaacaaattagtcctatgtgatacatacaaatacgatagaactccca

SEQ ID NO: 3149 - DNA, 848 bp, Diabrotica virgifera
aatatctcagttttacttgcacttttctcgattttcgatttatataactatcgttagatgtttaattcagaattaataatggcgaaaatgttggatagtagtcccaatgcggcactcaacaaatcgcttcttcagcattaccttactctacccattccagatggtaaatgccaggctacgtatatttggattgacggatcaggagaaaatgtcagatgcaaaactaggactttagattttgttccaacatgcccaaaagaattaccagtgtggaacttcgacggaagttcaacaaatcaagccaaaggacacaactcagatgtctttctgtgcccagtagctatgtacaaagatccattcctcagaggaaacaacaaattagtcctatgtgatacatacaaatacgatagaactcccacggagaccaaccatagagtaacatgcctgcaggcaatgaaagcggcacaagaagagaaaccgtggttcggaatcgaacaggaatacacattgttagatatggacttgcgcccgcttggctggcccaagcacggttttccaggaccccaaggaccttactactgtggtgttggagcgaacaaagtgtatgctcgtgatattgtcgaggcgcactataggtgctgtttgtatgctggtgtcacaatctccggaaccaatgctgaggttatgcctgcacagggggaataccaagtaggaccttgcgaaggcatttcaattggggatgaattgtggatcttttttaggatcttattgcgagtaggaaggaaacccccagtaatttgtgcttttgttctttaccgatggaaagtgactggaaacgagctggagct

SEQ ID NO: 3150 - DNA, 2185 bp, Diabrotica virgifera
cggtgtattgaagtctatcacggcaacgaaaaatatatccaaaaatacagaaaaccctatcacagccttatctcccattgtgtactatcatactctcgtctctattgctccggcaatattcaaatagacattaattagtttaaaatgacgtggtgggtataatatctcaacatcccatcagtgtataaatgtacaacaaattattacttcgacttattccaattggacttgtttagtgtatcagaggtcggaatacccatatcacggcgcgagggtatccgttttgtcgaacagtgtactcggtcagtattaataataattattgttgctagaataaacgcaagttaataatggcgaaaatgttggatagtagtcccaatgcggcactcaacaaatcgcttcttcagcattaccttactctacccattccagatggtaaatgccaggctacgtatatttggattgacggatcaggagaaaatgtcagatgcaaaactaggactttagattttgttccaacatgcccaaaagaattaccagtgtggaacttcgacggaagttcaacaaatcaagccaaaggacacaactcagatgtctttctgtgcccagtagctatgtacaaagatccattcctcagaggaaacaacaaattagtcctatgtgatacatacaaatacgatagaactcccacggagaccaaccatagagtaacatgcctgcaggcaatgaaagcggcacaagaagagaaaccgtggttcggaatcgaacaggaatacacattgttagatatggacttgcgcccgcttggctggcccaagcacggttttccaggaccccaaggaccttactactgtggtgttggagcgaacaaagtgtatgctcgtgatattgtcgaggcgcactataggtgctgtttgtatgctggtgtcacaatctccggaaccaatgctgaggttatgcctgcacagtgggaataccaagtaggaccttgcgaaggcatttcaattggtgatgaattgtggatctctaggtatatcttacagcgagtagccgaagattacggtgtaattgtaacttttgatcccaaaccgatggaaggtgactggaacggagctggagctcacaccaacttctcaactcaggttatgagagaaccaaatggcattggggcaattgaaaaggccattgaaaaacttagcaaaaaccacgctaggcacatcaaagcctacgatcccaaaggaggaaaagacaacgaacgtcgtcttactggcaaacacgaaacatcttctatccatgactttagtgctggtgttgcaaatcgtggagccagtatcagaattccccgtggctgtgccgaagacaagaaaggatacctggaagacagaagacctgcctcaaattgcgatccttactcagtatctgaagctatcatcagaacatgctgtttaaatgaatgaatgtagaatgtacacctaattgtattatacttccttacacattttataaattaatgttatatattttatgttataatataggtattgttttaatttaattttccaaattagtgtaaaattaaaatccatcagtttattatgatggtatagttatcacatcacacgaaataatattattgttgctatttgtatatgtattctattaaataatatctattgatatttaactgatgataaaattatgagaataacagaaaaaagagaaaaagaaaatccaggaaagaaagaagaaaataaccaaagacccaaaaaaaaaaagaggggggggcgcttcaaaggtaccaaattttatataaccggggggggggggcggatattttattaaaaggggatcctaaaatttttttcgggggcggttttttttcaatggggggggcgggaaaaaccttggggggcccccaatttaaaccccttgggagggaaaccccctttccggcgaccgcggaaaaaaacgaaaggggccccccccccccccctctccccacgggggaaaaaaaaagaggggcgaaagggaccccccccctaaaggggcgatataagagggggggggggggggccccccccgaaggggcccacttaaacgtgggggggggggggggggccccccccttttcttttctttccttttcttcgccccccaggccgcccttttttttcttttttttttt

SEQ ID NO: 3151 - DNA, 410 bp, Diabrotica virgifera
catggacctacagacaagctcaacaaggatatggatctgctcaaccatggacctacagacaaactcaacaaggatatcaatctgctcaaccatggacctacagccaaactcaacaaagatatgaagctgcccaaccatggtcctacagacaaactcaacaaggatacgaaggtgcccaaccatggtcccattatcaaaccgtttcacaaacatacggaaatccattagctcaatactattctaatcaacaaaaccaacaaccatggacccaatactggaaccgatatggacaacagtaccaacatcaacaacagtatgttatgtaaaattatttatttttattaattattttaaaaaataagtgagtcacattttgttatatatcaaatatatacaaataatgatttgcc

SEQ ID NO: 3152 - DNA, 1308 bp, Diabrotica virgifera
ccccttacgtcatgtttcttcagatcaaattcctggtccttttgttttgggcagtaattgctgcatcagaccgaactgtgttagaaggaagtgcatcagatttaactgaatccaatcaattgatagctgtagtccagatcattagacatggacatagacttcctacagtattttacaaaaacgataaatattctgatttatcaaaatattggaacggccttgacttgggagacctaacaaatgaaggaaaacgacaacactatagactatcgatgtttacaaggaacaggtatggaaaatggctgcctaaaaattataacaaaaacgatttctacgcccaaaccacagaatacgatcgaacacatatgtcaggacaagtaaacatttatggcctgtatccttccaaattggatcaaagatggaggttgttgactgattggcaacctattccacttcatccaggtgatgctaatatttgggaatcaatacctaaaaactgtgcagcttatacaggagaatacgcaaaagttcttgcatctgatcggtatgccgctattaataaacagtacgcagatgtgtatgcctatttatcaaaatattcaggtaacaacgttaccaacgttgaacaggcctttccagtgtttgatagttttaaaagtgaatctactgttggtcttcgtctcccagtgtgggcatcaaaagtgtatcccaaaccattaacagaactgattggacatatgtacaacgcttgggtttataccactaagcaacaacgactgtacgctggagctttgttagattctatccttaactactttgacaataaaataaacggttcagtatcccaaaaattcaaaatgtacagcggacatgacctcaacattgcctctatattaagcgcgtttggtgcatttaatccaccctatcctccagattttgcgagcagtatatatttggaattaagaaataattcggggagctattttgtaaacgcgtggagcaaagatggaaccaacttcaaaaaggtttctataaagggatgtgctttggattgtcctttagatgaagttagacaaagattggatgggatagtacttgacgttgataccaaagtcaaagagtgcaatgctaaactggaattcgaaaatgttgatgtagaaaatatgtacaaaaagtttacccaaactggtgaaatggaacgacttaaagatttattttaaaataaattatacaaatttagattacatactgaaaaaatacattataaataataatttgtgaaaaaaaaaaaaaaaaacctccgggggg

SEQ ID NO: 3153 - DNA, 449 bp, Diabrotica virgifera
cccacgcgtccgattttgtttaggtttaatatattccagataaatgtagtgaaatgctttcttaatgaaaaattagagtttttttgaaagggccgtatacgagataaggtgaaaagataagacggatggttctcaatataccaaacggtattcatcaacattaacattcaaccctttcgtcaaaaatgttcatcaaaataaataaacgagcgtggatcaacttgtttatatttgtgatattaagtgtaactattatatttatgttctcagacgatcacgtaacagaaataagtattaagacaaatagtgaaataaaagagaaacatgccattatatcatataccataaataatacgactaagacgactgctactagtacttctacaactactaatactgctactgctacttccattagtactactcctagtgccgatatacactgctac

SEQ ID NO: 3154 - DNA, 972 bp, Diabrotica virgifera
  misc_feature (844)..(844): n is a, c, g, or t
  misc_feature (905)..(905): n is a, c, g, or t
cggacgcgtgggttatttttgaatcgaaaactgcatttggagttgattttaaaaaatggtaaatttttttaaccgtattcatagaatttcagtaggatttacataatagtggaatggagtgcagatagaattgaaactagacaactagtgtggtatggtcacgtgaaacgaatgagtaaagatagatgggcaaagaaagctttgaattacataccacaccaaagaagaagaaggggaagaccttcatttgcctgggaagaaaatgtacggcacatcatgaaagatagagccatcaaagaagacgaatggatggacagagaacgatggcggtcgaaatgcgagaagcggcagaggctgtaggaacctcgcttatagatagatagagataataaaatctataggttctcaatataccaaacggtattcatcaacattaacattcaaccctttcgtcaaaaatgttcatcaaaataaataaacgagcgtggatcaacttgtttatatttgtgatattaagtgtaactattatatttatgttctcagacgatcacgtaacagaaataagtattaagacaaatagtgaaataaaagagaaacatgccattatatcatataccataaataatacgactaagacgactgctactagtacttctacaactactaatactgctactgctacttccattagtactactcctagtgccgatatacactgctacagagaaacaagtttagcttcccttcccgatatttctgaaataagccctagaccagggaagtcaattttcttccacgaaacttcctgtaaatccttcaacaaaggcaaaattaccatcaattncaggcaagcgtgcgcagtggaaagtgcagcaagacttaatcccgatttagatatttatgtngtatactcctctcccagtcttatcaaatccgaaggagacgagtctgataagtttctaaatgcattac

SEQ ID NO: 3155 - DNA, 899 bp, Diabrotica virgifera
ccttacgcgtccggccatttttaaatttccatcccttttctttttctgatcagacactaagcactaagtcacgtcagttttaatttaaataacttaccaattttattaacgcaaccatgggagtaatggtagacacaattacacccggtgatggacgtaccttccctaaaactggtcagtttgtttctgttcattacactggtaccttggaggatggacaaaaattcgattcctctcgagacagaggagctccttttaagttccacattggaagaggagaagtaatcaaaggttgggacgaaggagttgctcagttaagtcttggacagagggccaaacttacctgcaccgctgattatgcatacggatccaggggccatccaggaatcattcctcccaacgcaacactcatctttgatgtagaacttattgcaatagagtaaacttaagattgccttagagaatgttagatgatgactacatatttctaagagtaagatttggttttatttagaactgaattttacacggtttgtgaattttatattaaagttattagaagtgtagaaagaggtaatttttttatttagcatatcgttgttttcataagcttgacatcaaaatgacaataaaaagcacaaaccgacaaagaaaatgttgtagtgtaaattcgtctaaaataaaaacaaataatagtcattaacaggttaattttgtgcattttttcagtatatttaagtccttgcagtgttaaagtataatttcaattaaataacgaaagtgttctgatactttcacatttcattgcatttataggtgttgtgatgttctaataaaaagaatttgatgtccgaaaaaaaaaagaaagatggtctcactcaaaattaccattgcataaa

SEQ ID NO: 3156 - DNA, 848 bp, Diabrotica virgifera
actgtcaatggttagggcatagataaaaatttgcgttattaaatagttttatttccattttaaagtatttaatactaaaaacagcataaaattacagttttacgtgtctattacttaagttaataaatatcaaatatgccacgaggaaaattcacaaaccataagggacgtaaccgtaggtttactaatcctgaagaattagaagaggaaaggagaagggaagaacaacagaaaaaatggagacaacaaagaggagaaagcagtagtgaagaatctgaagaagaggctgccgctgacaaaaaaattagtgaagaatcaggttcagggagtgagtcctcagaggagagcgatggcgaggatgcaaaagctaagggtgtatctaagctaattgaaatagaaaatccaaatagaattcaaaagaagactaaaaaactcaccactcttaacacaactacggatttagatagtaaacctcagctgtcaaggagagagagggaagaaatagaaaaacaaaaagcgcaggctctttatcaaaagttgcatgcggaaggaaaaaccgaacaagctagggccgacttggcaagattagctattattaaacagcaaagggaagaagcaaaaaagagaagagaagctgaagtgaaagaaaaagaaaatgcagccaaagagaagacagctcaaacaaagaaggccctaggaaaaaaatgaatatttttaaattgttcatacctgagttactctaatattttttaacaataacatttttacctatgttgtaacaatcccgtggaataaaaaaaataatattgtgtttataataaataagtatctatttgtcattttattct

SEQ ID NO: 3157 - DNA, 1170 bp, Diabrotica virgifera
actcaagtggtaagaagcatagattattactatatatttttcgctaaatatacgaatatttaatactgagaatcataaaaaactattgtttcacttaaaaaaattccaggcccattgatttctacgccgatgacgttccagtaccttccagaaaaatcgagaatgttctttctttaaatatataaggagggaagacattgcgcatgggagtgagctttttgctttgaaatcgagtagacgtgaaaccagtgaattcacatataaggtacataaagtgatttgaagcaaaacttaacatctgtgtagaaattaaaactattttaagtattgtgtgcattttacaatgggtaaagatttttataaaatattaaacatccaaaggggtgcaagtgatgatgacatcaaaaaagcatatcgaaaacttgctctaaaataccatcctgacaaaaataaagcagctggagcagaagagaaattcaaagaggttgcagaagcctatgaagtattatcagataagaaaaaacgagaaatttatgataaatatggtgaggaggggctacatggaaatcctgaaggaacaggcaacagttcttctggcacaaacttctcttacacataccatggtgatccaagggcaacgtttgctcagttctttggcaatccaagtccctttgcaacattctttgacaacagaatgtttggagcaatgcatgatgatgatatagatgttgatgagccatatatgttccttggagattggagacaaccaagagaaggtccaggtggtgcattccgaagccattcgtttaactttcataatgcacctaacagaagacaaaatgcagacaaaattcaagatccagctattgagcatgatctctatgtctcattggaggatattaccaaagggtgtcagaagaaattgaagatctgtagaagagtgatgcagcctgatggatcaacaaagaaagaagacaaagtgttaacaattaatgtaaaacctggatggaaagctggtaccaaaattacattccaacgagagggagaccagggcagaaataagatacctgcagacattgtttttatcatcagggacaaaccacatccattattcaaaagagaaggcagtgacatcaagtatacagctaaaatatcacttaagcaggcctt

SEQ ID NO: 3158 - DNA, 1134 bp, Diabrotica virgifera
caaaaacgaaaatgttgccaaaaatattgaagcccgaaacaaactagacattgtagcaatagatatgttaagcgatctaattatgaccactaaaaggaacaaacatattctggtaatggtggatgtgttttcaaaatacgtaaaattatatagttgccgcaccacaaagggtgaagaaatattaagaaaaatcgacaattgtatagccatagtaggaacaccaaaaaagattctactggacaatgcaacgtatttccgaaatgatcgtttcaagggacaacttcgagaacgaggaatagagacaaattttgtcagcatcaggcatccacagagtaatccgtcggaacgattcatacaggaagtgacgaaatttctccgcattgcaacagatggtcaacatcgccactgggacaggaaaatggcggaaatagaaaggtatctaaatacaattccgagcacagtaacaaaagagacccaagaatacatcatgaagggtgtactgccgataaggccatgggaagaccaagagccaaaagaatatcaacaggtgattgaaaccgtacagagaagattacggcgaagcaacgaaaaatatatccaaagacaggaacaaaatagaaaaagaagaccagtgactttccaaaagggtgaaaaagtactcgtgagggcattacgagtatcaaatcttcctgggggcatttgcgcaaagttgatgcctgttttcgaaggcccgtatatcgtgaataatgaaaatgggataaatagttatgagttgaggcataggaactcggaaaagatccgaggaatttataatattcacgatgtatacaaatatcacgaataaaagacagaattacatgaagtagatagtaagttaggatataagacgtagattaaagtaaggaaatatacagggagttggttttgcctcgagaaaatttatttaaaaatgcagataaattttatcgaatacaaggcggggatttgttatatttctatttgatatgaaaattaaaatttgataattatagacaaaaattcaatttaatataaaatattttcaatttttcctcaccaccgggcatataaatttaaaacaacctgtatacaacaaattgttatatttaattttaa

SEQ ID NO: 3159 - DNA, 1292 bp, Diabrotica virgifera
atcccagaagggaaaacgaaaatagagacaacggaagaggaaattatgaacaaagaaataggcaatggaatgaggacagaaatcgagaataccagaatagaaacaccacactcgcaaatcaagaaaacagaaataatggtagacaaaatgaacagggatatcgagaaaaccgaaacagatccgacagaccaagagaaaatagaagagaagtaaataatacccagacagatgaatatgacggagagagacattatgacgaaaatataaactacgatgagcaaccggcgtcttttcacgacggcgctcactaaaaaccaaaaatcaaacaggaatcttttgtaaccccaaggagtttattaaattggcagggaacaacgaaaagaaaaatggagttaatttaaaatttgtggatggatttatcaacgagaaaccaattaaaattatgatagacactggatctgaaataacattggtcaacagaaaactaatagaagaagttaacttaacaaatttaatttataaaatacctagggtaaatttagtgggcgcaaacaaacggacattggcaactataaatgaaggcatacgagtaatggtacgactgggtaagaagatgtatgcactacaatgtgtaataatgccaaacatgtcacatgacatgatagtaggagttgacgaattggcagaaaaacatgtagtgatagattttaaaaataatacgatgaatctaacagaagaaaaagaagaagaacaggacaaggaacaggagaaacaaaatacggacgaatcaggtaaagaccaaacagtggaaatgaatttggcaacgaagcaaggacaaagaaaaagaaaagcagaaggagaaaaagtcagaaaaagacatgaaagcgtgaaacctgtggctcctcaaagtgagattgtgagcccaggagaagaaaaattgagagtatcaaaagcaaacggaaaacagattgtcctcaaatctggggaaaaaagaaagaagaatgggtttggggaaaaggggaaagaaaaaataataaccccccacctctaacacacggagggggggcacgggaaaaaaaggaaaaaatttttcctaccgggggggacataattaaagaaaaaaaaaaaaaaaagggggggaataaaaaaggaaaaaataaaaggaaaggggaaaaaaaaaaagggggggggggggttttttgcccctcgggaaaaaaaatttttttttttaaaaaaatggaaagaaaaaatatttttatttttaaaaaaaaaagaggggggggggggggggg

SEQ ID NO: 3160 - DNA, 1932 bp, Diabrotica virgifera
aaagaatggtcaagtagctgtttctggatcatatgatgacataagaaactccaatacagactacagtaaagttttggcaaatatagaagaggaagaggaggaaataagaaggaagtccagaattgttcaaacaaaacaagagaaagatgaagaagaagaagaagtgcaggtgttacaaagagaagctaagagtactggtaatatttctggacgtgtatatctaaaatacgctcaagcaggtgggcatctgtttaaggctttctgtttaatatttctgtttgtaatgggccaagctttgttgagtatgtgccaatatttcgttactttctgggtcaatattcaacaatggaaagcttcacaaaatagtgcatccccaacagcacctgcgtctttagaaaatatgactgcaccgttagacattaccagtccttctcctcaaccagttgatcatacaggattcgcagactggtggctaaccccattgtttataagcgaaaacactgtgatctactttagcgctctaaacattcttatggtcgttattatgaacattagatcgtcttcattctacgcatggtctataactgcctcaacaaaaatgcacaataccatgttcgagaacatagtttatagtcccatgaggtttttcactataaatccttctggaagaatacttaataggttttccaaagatatcggtgccttagatgaagttttaccaatgactttcatggatactgttcaaattggtctcgaggtaggtgcaatctgtttcgtgataagcagtttgacatattggatcatgatacccactatctgcatgggtatattgttttatgtgatcaggatcatatttttagaaaccagtcgagacgttaaaagggtggaatccgtaacacgaagtcccatctacactcatttaacagcatcgctgcaaggactgactactatcagagcattcaaagctgaagatatactcaaaactgaatttgataaataccaaaatactcacagcgctgcatttttcatgtatctaggagctaatagaacctttggattctgggtggactttatatgtgtaatatacattgccttagttatattgtcgctgatttttgttgaaagcgaaacatttggaggaaacatgggtcttgcccttactcaaatcatgggtctgacgagaatgttccaatggggcatgcgccaatggtccgaactcgaaaaccaaatgacatcagtcgaaagagtacaagaatatgctgacttaaaacacgaagaagacaatcacactgtagaaccataagacgtggccagatcaaggaaaagtagaatttaaaaatatgtctcttcagtattcaccagacgatcccccagtccttaagaatctcagttttgttatccaaccttctgagaaagtgggtatagtgggaagaacaggtgcaggaaagtcttcgttaattcaagtggtttttcggttgactcatatcgatggtagcatacttattgatgatattgatacaaaatatgtggctttgaagaagctcagatctaaaatttccattattcctcaagagccagtcctattctctggaacattaagaaataatttggatcctttcgatgagtataaagatgaggtgttatggaatgccctggaacaagttgaactcaagagtgcagtggacgacttaccagccggtctggacagcaaaatggcagaaggtggctctaacttcagtgtaggtcaaaggcaattggtctgcttagcgagagctgtaatccgaaataacaaaatactagtattaaacgaaaccacagccaacgttgatccatatactgacggtttgatttcaaccacaataaagaaaaaatttccacaagtggcacagaattaaccatagctccccaaataaaataccaatatgggattcg

SEQ ID NO: 3161 - DNA, 1525 bp, Diabrotica virgifera
cccacgcgtccgtgcacatttgtactgaggtgggttaggttcaatcgaactatttttgaccccagaatgtgtggtataatttatgaccagtcttttcgggacaccctgtataataatgtatttaaagccagtaaatacaggggtgaaaaccctttaaatggtataaacgttgtgttatatttttacaaagtattgttgctgataattttatcggatgtttaaattttaaggtgattcacttcatggcaacgcaagttgctgtctaaggtccgtttagagagggtctcttcggaccagcaaccccctggttggtagtatgccccccaacacatatacaaacaattacttacttactttccgtgtccggaacaccaacaactttaaattctgtatttccaatggttggccacatagatggccctgtcatttgctataattaagtcttgttctgtgcaggtctctctcatctctgtgcatgatagtagatgccggctggtctgaaccgcgccacagtcgcaggtatcgtcctcctggtatccccattttttcaggttactagcacaacgtgaaacgccggttcttagtctgtttagcgctttccaagtcggatacggtaaattgtgtccagcagccatttcctccgagggaggaaaatgtgtcgcagtagttgacgcttgccataggtgtattcggcgcgtctctggcgcttcggggatggatcttgatgttttcaggaagcttttccgagatcttagtctgcttggctgagtttggtggtcatatatggggtatgtcttcggtccgtctcctgctttttccgttctacctctgacgtgaccttcctcctgataggtggtggagcaattccagcaatggggtatacctcttcgataggtgtcggtttcaggcaacccgatattatacggaccgtttcatttagagccacgtcgacgttctttgcgtgagcagagtttgaccatactggtgcttcaaactccgcggccgaaaaacataatgccaaggcagaaatgcggagagtgtgtggttgtgctccccattttgtattagttagcttgcggatgatattatttctggcacttactttcttcttgacatcttgacagtggtatcggtaagacagagttctatccagacggacgccaaggtattttggcgtcttgttgtgttccagcatctgaccacgccattccacctccagcgaccttcgggcatgcttgtttctcaggtggaaagcacatacctgggtttttgtgggatttggtttcagatggtttttatcatagtatagagctaagtctcccagggcatctgtcagtttcacttcgacttcattgaaggttcttccctgagctgccaccgctgtatcatcagcgtaaataaattgccttgtttgttggtgtatgggttggtcgttggtgtatatgttgtatagaatcgtcgcgaggacacttccctgtggtagcccatttttttttggtccctccaccgactgttcttggactag

SEQ ID NO: 3162 - DNA, 1207 bp, Diabrotica virgifera
aatttcgcaaacaaccgcacacatctttattcccatatataccgctcctaaaaacacatcaaaccgctttcgtacaatttatataaaacaaggtttaatttaaaaatttgatctgacctagacctctgtttagattaactacctacgtttaataatagtaataatggctcgtttaaaggaatatggacagttcgagttcgagcagcgaatctggtgatacaggtggtggtgaaatcaaaaatgaaaacaaacccgaacgaaaagagaagaaacaagccagcatgaaggaaattgctattagttttgctaagaagggagcactcttctttcttggatacttaatatgttacttaaacttttctctaacactgccgatccttgccatatgtaccttagtttatttcgagacacaaacttcacaaataaccaggaaaatatcgagcaagtcgaaggcgagttcatatacaaagaaggatctgttaaaagtggtagatgaattgccatcttgggttacctttcctgatagagaacgtgctgagtggctgaatgagattattggacaactgtggcctagcatctccctatatgtgataaagctgtgcagaacaaaattacaagcgaaaattaaaaagaaattcgattctttcagatttgaagatatcgattttggagtttcgcctccaaagattgatggcgtaaaagtttacaataagactattactaaggatgctataattatagacttcgacgtatactacgatggtgactgtgatatcaaattttccttatctggacaacaaattggctgtattaaggattttcaagttggagccgagttgagattagtattaaagcctttaatggtgaaaatgccgattgttggtggcatacaaatatttttcttaaatacgcctgacattaattttgaattggaaggaatcactggaattccaggattcagctactttatccggaaaaaaatagaagaacgaattaaaaagaagtgaggctttccaaataaaattaccaaacgagttatcataatcagagtacgctgctgatcttacgtaagatgaatctgagtgtcgtttaggtcggaacacttagttcgaattacaaggtgagaatagtagatgttgggatgtgtttgaagaaagatcatgtgtagattttagttgatggagaccccttcatgccacctgcttat

SEQ ID NO: 3163 - DNA, 1289 bp, Diabrotica virgifera
gtttcacagtcacagtagacgaactgaatacggagacggaatctcaaataagtctcaagttagtttccgtggagtttggtgagagattattttcttccgtacattatttaatacataaaccttgcgtgtgtataatttttttacctcaaccggttgctacatggcgtgccacagtttggcactgtcatcaataaaaaaatcaatggattagttttgtttgtaaacttctttaacctcaaagctgcgtgtacaaatttatgttcagtagattctcagtgttgtttatgtgtaaaaacagtgttcgtattgatctaccaaatatagttttcgataacttgtataatgagtggaaatacgaatatggacagttcgagttcgagcagcgaatctggtgatacaggtggtggtgaaatcaaaaatgaaaacaaacccgaacgaaaagagaagaaacaagccagcatgaaggaaattgctattagttttgctaagaagggagcactcttctttcttggatacttaatatgttacttaaacttttctctaacactgccgatccttgccatatgtaccttagtttatttcgagacacaaacttcacaaataaccaggaaaatatcgagcaagtcgaaggcgagttcatatacaaagaaggatctgttaaaagtggtagatgaattgccatcttgggttacctttcctgatagagaacgtgctgagtggctgaatgagattattggacaactgtggcctagcatctccctatatgtgataaagctgtgcagaacaaaattacaagcgaaaattaaaaagaaattcgattctttcagatttgaagatatcgattttggagtttcgcctccaaagattgatggcgtaaaagtttacaataagactattactaaggatgctatattatagacttcgacgtatactacgatggtgactgtgaaatcaaattttccttatctgaacaaaaaattggctgtattaaggattttccaagttggaagccaggttgaaattagatttaaaggcctttaatgggggaaaatgcccaattggtgggggggataaaaaaaatttttttttaataaaaccccctgaattttaattttttgaaattgggaaaggaaactccctgggaaaattctccgggattttcccctcttttttttcttcccgggaaaaaaaaaaaaaaaaaaaacagaaatttaaaaaaaaaaagtttttgttcttttttctcaaaaaaaaaaaataaaaaccaaaacacgaattattttttttcaaaa

SEQ ID NO: 3164 - DNA, 1142 bp, Diabrotica virgifera
  misc_feature (1019)..(1019): n is a, c, g, or t
acccacgcgtccgaaatataaaaatgaaacttcaaatttatttaggatttgtttcgttaatatttctgtgggcgtattctactccagcaaatggatacaacgtagtgtgttacttctcgagttgggccatttatagaaacttttccggaaaatttgatgtttcggacatcgatcctcatctttgtactcacgtcaactttgcctttgtagaattgtatgaagatggttcattatatattgtagatccctgggaatccaatgataaaaataatggtggatattatgagggatttaaacaattaaaaaatctgaagaacgcaaatcctggactaaaaatattactcagcttgggaggatggaacgaaggttccaaaaatttctcgatagtggcggctgatcagtcaaaacgagaaaggttagctagagaatgcctagctttaattgaagaatacgattatgatggaatagacatcgactgggaatatcctacgttgagggaaggatcacatccgtctgataaggacaactttgtagaaatgttaaaagacttccaagctatcatgaaaccaaaaggtttattactaagtgcggctgtagctggagctgtagataaaattgaatctgcttatcatgtcgaagaagtagcaaagtatttggatatgataaatgtaatggcgtatgactaccatggggcatttgataatttagtgggacacgtatcgcctcttcatgcctcttctaaggattaccaacatggaaggaatgctacttacacagtagctactggtttagaatactggctatacaaaaacgcagatccttcaaaaatcaatcttggacttcctacttacggaagaacttttactctggcagacagaaccaaaaccgaactatactcagaagtacttggtccaggcgaaagaggactttacacgggaataagaggaagtttgggatatcacgaaatctgcgaattctattctggttccgactcaacttactactgggatgacgaacanaaggtgcctcatagggtatgggaggatcaatgggctggatacgatgaccagagatcgatacaatataaagtggactttgctgtgagtcataacctcgctggcgttttgatttgttctttggat

SEQ ID NO: 3165 - DNA, 1123 bp, Diabrotica virgifera
cggacgcgtggggcagtatgataaggagtatgatgatcaattgaagagaacggaagaaaagtttaatgggtcttcgaaggtgtcgatatcatttgataattatagaagagcgcctctcaatgaggattttattagtgattcagaagaagaagaaattgtagatgtcagagacaggaaattctgggatagatttgaaagtttagaacgtgaatttgcttccataccacaatgtggttataaagttcaaccagatggacaaatggtaacaaaacatgatgtagtgatgagtggaaggaagaacgcttgcaagttgctctcatttccacctgaatttcaaacaggagatggagaaaattttgatttgaagttgtctaataaagtttttaatagtttaaaaatgtactctaaaaatgaacaacatgccagaagacataaggtgcatgataaaaaagaagaccaagccactgcagaatttggtgttgatgagtttactcgtcttctattgtataagatgatcaacaatcaacttttagaaagggtcaatggtgtcattagtataggtaaagaagcagtaattctccatgcagattcagacccttcgttcccctttgactctaacttaccaaaagaatgtgtgataaaaatctttaagactacactttctgaattcaaacaaagggataagtacatcaaagatgaccatagattcaaggacagaataggaaaacaaactgctaggaagactgtatacatttgggccgaaaaggaaatggccaacttgatgagacttcagaaagcagaaataccttgcccaaaagttgtgacacttaagaatcatttgttagtgatgtcttttataggagaaaaccacaggcctgcgccaaaattgaaagatgctgtcatgtcagatgctgattacatagttgcttatgaacaggttactgaaaatatgaaggccctctatgacaaagcaaatttaatacatgcagatctatcagaatataacattttgtggtatcaagaccaatgctattttattgatgttagtcaatctgtagagcctagtcatgaaaacgcattccactttttgtataaagattgtactaacgtgacaaaattcttt

SEQ ID NO: 3166 - DNA, 841 bp, Diabrotica virgifera
cctgtcaaagaaaagcggtttgatctgcaataacaaaagccgaaaaagttataaagaatgccagagatgactgaagtagacaaaaccgtgatccaagagacaaaacctgaacaaagtgaatcgtcaacagacagtgactccgatgaagacatccctgagttggaagatgcaggaactgcaagcgccgcttcagctacattccctggagctgcagctgcaggtttgcccatggatatggtctccaaggccaaacagtccagaggagagaagaaagcaaggaagatcatgtccaaattgggccttaaacctgtacaaggagtaaacagggtaacaattaggaagtcgaagaatattctttttgtcataaacaaaccagatgtatacaaaaaccctgtaagtgacacctacatcgtatttggtgaagctaaaattgaagatctgtcacaacaagcgcaggtggctgctgctgagaaattcaaagaagtcagtcctgctggagataatgctgctggtacaacaaccacatctgtggcaccaatagctgaagaatcagaagatgaagaggttgacgaatctggagtagaggaaaaagatgtagagttggtcatgtctcaggcaaatgttagtcgatctaaagcagtaaaggcgctcaagaataaccaaaatgacatagtgaacgctataatggagcttacgatgtaaccttgaatgtttttttgttaataaaaattgctccagttgatcataatgcagttaattaagtcttcagtatatataagtaaataaaattataaaatacaaaaaaaaaaaaaaagggcggccgctcgcgatctagaactag

SEQ ID NO: 3167 - DNA, 622 bp, Diabrotica virgifera
  misc_feature (473)..(473): n is a, c, g, or t
  misc_feature (481)..(481): n is a, c, g, or t
  misc_feature (485)..(485): n is a, c, g, or t
  misc_feature (516)..(517): n is a, c, g, or t
  misc_feature (558)..(561): n is a, c, g, or t
ctgaggttaggaagctcaagatgtcgtcgcatttggtgtggggaattatccgcaataacaatgcttttcttctgaagaaaagaaacatttccaaaccttttagcactgaagctaacaatctcacaaacttgagctcataccgttacaatggtttgatccacaaaaagtctgtaggaattgtagatgctgctgacaaaaaaggattcacagttgtttacaagaaggcctgcaaacaacacaaacctaaacaaaacgttgtaaagaggacaatgaagtctggccccagaagatctttacataagttaaagagattgttgaatgccaacaaatacagaacagaccttaccaaggctgcccttcgcagagctagtgcagttctaagatcacaaaaacctttaccagccaagaaacagaaggttgcccctaaaaaagaataggtgtattttttaatgtaataaacaaatttataaaanagaagaanaaanaaataaaaaaaaaaaaaaaataacccccccnnaaaaaaaaaaaaaaaaaaaaaaaaaaaaaaaaaaaaaaaannnntttgggggggggggggcgccccccccccccccccctaaggggggggtttaaacaccccccc

SEQ ID NO: 3168 - DNA, 967 bp, Diabrotica virgifera
agtgcctaaaaatgtacctttaacatctcatacaatatttgtttacaacgtaaattacaggacaatatctacaaaacttttactttgaacgtgactgacattccatttttatatttttttgacattacatcaaaattgtctatacggtcaatacgaactgcagtgccttaaaaatattttaaagcactagtgtcttaaagtagcatttttaacgcacgtatggagtgctaaaaattgcatttttaacacggttgtagaaaaaatcattttttagccaaactgtggctcatttcgtatttagaacagttagtaattattaaattataaattacaaaaaattcacacgcacagctgaggcttttacagaacatccatttttacggacccgaaggtcgagtgtacatattataacctcattttttttgttttttaataggtacgtataactttttttggcgatggctgctaattttttttgtgtttagtgtattttacaaaccatttacgtttggctcataatgcaaatagtccacgctgtatgcttgtcccgttaggtaaattattccgattaatttttttgcacaaacttactcaaaaacaggtccttataacaaattcacaaggtgccaggcagtaccgcggtcggaaagttgttctacacatttttttaaacgaattcaaaaaatcaattttttcacttcggacaaacttgttttagattttctggatcaagctgagcaaaaaaggtatcttgtgatttttctataaaattgactgttgccgagttacatgcaatttcaaatttgaaaaacgcgaaaatggccattttcaaggcttaataactcgattaaaaattattattataaaagtcataaagtgaccaactcaaagtttaaagcccaccctgcaatagcctaaagaaatttttgtcattattttattactaactattatttttaataattgt

SEQ ID NO: 3169 - DNA, 1267 bp, Diabrotica virgifera
gccgacttgatcggtcgatttaggtagtaggtgtaataaattttgaaagtgataaagacagtttgtgataaactgtagtgcagttcttttcgtttattttctcacctctcacataacaattaaactgaaacaatggcccccccgggtatcgggaattcggtggagatccgccccgaggcgacagcatcgtcggcagagaggagcagtagcaacggagtcgctacattccaaaaggacatcgtcgttttggatgggggcttcgctactcaattaggctgccacgtccaacaaccgattgatggagacgtcctatggagttccaggttcttggccaccaatccagaggctgttattgatactcacttagattttctcagagctggtgcggatgtaattattactaacacatatcaagcagatgtcaacttgtttgccaaacatctcaatatgaccaaagaagaaggatacaacttaataaaagactcagtgaagatggccaaaacagctgttgaaagatatttaaaagaatatccggaagcaagaaaacctcttatagctggttcagtgggtccttacggagcttcactacatgatggttcggaatacacaggagcctatgcgaaaactacttcggcagaaaccatgagagaatggcacgggcccagaataaaagccttggtggaaggaggagttgatctcttagcaattgaaactattccgaatgcagttgaagctgagatgttggtccagttaataaaagaagaatatcctaatgttaaagcgtggcttgcttttagtgtagcgcaagacggaaaatcaatagcctacggagaagacttcaaaacaatcgcccgaaaatgttatgactccaatcctgagcaattagtagccataggaatcaactgcacggccccacgactaatcgaaccccttctcaccgggataaatgatgatagaaaagacaacccccgaccacttattgtctaccctaacagcggagaaagttacaatgtcgaactcggggaatggtcccaatcttcattgacggacggaccaagatggcataaccgagaaaactgcgagccagtagacacaaatattcacaaatggttagatctgggagtcacgtgggtcggaggctgctgtagaacctacgccgtggatgtcacaagaatacgcgaccaagtgcagttatggaaggagaaacagtagctaaactttgaatttatattttaatttttatttttataaaataaattctcactag

SEQ ID NO: 3170 - DNA, 992 bp, Diabrotica virgifera
gacaacattagcttgatgtatcataattatctttcctcatctgaacattaagtactctttcactcctataatctggctgggaaagttgcctgtatctttcatcatcgacaaagcaaatttcatgaccgtcagggtcagctaaaattaaaacacgaacatctgctttaccaggagttggtagaactgtaagaggtgttagaactttgcaattgttttcattaattttcgtggagaggggttcttgttctgcatgtggaatcgaaaaagcaatacgaccgaatgcttctccccggtcaattgcttcactaatttcttgtatctctaattttgcctcgttttctttaaaaccaaggagtgctgacttatcgttagttttgaatattttcagtcctaaaatgccgttccagtattcaatggatttctttaaattcgaaacattgagtgtgacagagtccataggatctctatcggacggttggggctcatctactatttgaaatcgataacctcctggagcaactaatatattaccgttctcaacgggccaattttgttcttttgctctttccaaagcttctttactctttattgtaattttctcgaaatcgtttccttttttgtaattagtgatgccgtagttgtatgttagttcgataacgaaatggttgtcttcttctccgtagccgaccatggttttgctccatctgccatcgtacggtccattacaagtagcctcgcagccttcagcaaactcttcgtgtcttagcaatttcattcctagcacttggaaataaaatctcatcgattcttttctattcgggattttgaaaacgaaatgtagagctcttcctgacaacgacatttttatcacaagttttagcacaaagttaggaaagtatcactgctcctgtcgtctagtagatcaattttccaaagaacaacatatgctaactacttttaatctcataaataattatgatttttaatttaat

SEQ ID NO: 3171 - DNA, 958 bp, Diabrotica virgifera
  misc_feature (767)..(767): n is a, c, g, or t
  misc_feature (790)..(790): n is a, c, g, or t
gatcgctgcaaggacatcagcgacgatggtcaacgactcgtttccgaaggcaaccatcattctgacagtattaaccaacgttgccaacaattgcaaaccaaactggatcatttggcggctttagctggtagacgcaaggctaagctagtagacaattcggcctatttgcaattcatgtggaaggctgatgtagttgaaagctggatcgccgataaggagagccacgtcaagagcgaagagtttggaagggatttatcttctgttcagaccttgttgactaaacaggagacctttgacgctggtcttactgcatttgaacatgaaggtattcaaaacataactgcacttaaagatcaactaatttcttccaaccacgaccaaactcaagctattgtccaaagacatcaagctgttatttccagatggcaaaaacttctaaacgactctgacgcacgcaaacaacgtctgctgcgcatgcaagaacaattcaaagaaatcgaagagctcttcctcatgtttgccaaacgcgcgtccgcgttcaactcctggttcgagaatgccgaagaagatttaactgatcccgtacgttgtaactcaatcgaagaaattcgcgcgttgaaagaagcccattcccaattccaagcttctttgtcaagtgcgcaagccgactttgacgggttagccgcgctggatcaacagatcaagatgttcaatgttggacccaacccttacacctggttcaatatggaagcgttggaagacacctnggaggaatttacagaagattatnagccgagaggggatgttgagttgaacaaggaggcgcagagacaagaggagaacgataagcttagaaaggagttcgctaagcatgctaatgctttccaccagtggttgacggagacacgtacctccatgatggagggctcagggtctctggaacagcaactggaagcga

SEQ ID NO: 3172 - DNA, 552 bp, Diabrotica virgifera
gggtcgtacaacgcgtccaagcaactgtccagcattcacctaaaatgaaatattttgttttgttggtaagcattgtcgccattacagcatccgacttacaaggtacagccgtagaccaatgtttatgcagagacgaactcactcaaatctacaatcaactcgtcgaagctaatgccgaattgaaggaggccaacgatgaaatgattcagctggactccgatatggaatacatggacaataggttcgaagcccagaacgaaaatttggaagaactcgaaagtgcacttaccatgcttcgttacatccaactccaaactctacaagagctttccagtcaagaccagattctcaattgcattgtcgtcactgttcaaaacatcgatgtccaggttaaaaatgaaacaacacatgtcaaccagcagacaattgatattggagcactccagcagctaacgaacgagattcaacaatgtaataatgttaatacttgcgtaacccctacgactacattagcacctacggacatcatagtcactacgataacaacagtag

SEQ ID NO: 3173 - DNA, 195 bp, Diabrotica virgifera
attcggcacgagatgttgaaatatctattcacccaggattcttcgaatctcttcattataggattgaagtgtacaggcaagcagaatctaccactgcagctgctgccacaacaacgcctgtgccttagaatgaatgtatttttttcaatacatttttaatgttcaataaatatccgtaataaaaaagaaaataaa

SEQ ID NO: 3174 - DNA, 412 bp, Diabrotica virgifera
ctttcggatcaattgaataggaatctttcaaagcatttacaagaatatagtgccagtggatcctatgcagcctacggaaacttcgatagatcccaaatggcagatcttagagctaaactggaagaatctctgatgaaccaattgcgacaaggactacaacaatcaatgcagactcacagctcatacagttcaagtagcagcagcagtagcagtagtagcaactccgctggctacagaccagcagctaattaccagatgggaggatacagcaatggctaccgatcaggtagagatagctacgacggtcacaactatcgataaaaaatagcaacaatgacagaacttatttaatttaaagtgtaataggttacaataagtataaatataaaaaaaataaagtttttctacaatg

SEQ ID NO: 3175 - DNA, 1283 bp, Diabrotica virgifera
  misc_feature (1120)..(1120): n is a, c, g, or t
caaaatgttttgatattttcttaagcgtagttcaaataatttgaaatgtttaataatttaaaataaagctgtttttttataatttctttccttagcatggaagtcgagttcccttctatagatcccaatgaggatttaacccaggacaaaacagaagaccccaaaaaagcgaaaaaagaagaaaatggtgcaaattcagacggtgaggatttagatgaggaagaagaagaggccattgaagaagaggaagacacgggcgaagaagacgtagttgaaggggatgatgaagaaatagaggctgaagatgaagaggatgtagagggcgagggtgtagaagaagaagaggatgatgacgcataataaagtgggtgccgtcaaaccctgtgaactttacttggcggactatctcagtgcaaagtctcgagttactttgtggacattttattttcattttcaattagtcgttgttcagtgcgccttaaacgccaggatgttccacgtcgccaacgttgttataacttcattcatataatacaccatccatcgacacatccttcatcattttatccacaggctacctcgtgacctttgccgtcggagctagggctcttcagtgaccgtgagaactgcacgtgacccgcggtacctgactatttctaacttattacgtatccccttcgatttgtaaaaatgtccattttgtgtaaagatagatataaatttagtttaagttggtctcagacataacatatacgatttttggttttcttattttctttattgatttaactaattgtacaaaaagatgaacatgtcaggatggcatatcctgccaccgtcacacccggaagtcttgaaacataaaaatggagtacataatggtctttagattggtgatcaatcattatcgtgtaatgatttcaccaaatatttttgacgagggagacagaagggcaataaagcgttactgtaggctaaaatagaacttagtctaatctgtttttagatcagtgtgttttctgtatgtatgatattgtaattattttttaattaatttttatttaaagaattgcgttcattagctgtgctagtcttcgcactttttttattcactcgtcanatgtttattgaaaataacaaaaatcttcacgattggtgtaatccaaaaatgtaagtacattaaaataccaacaaagtcactttttctcataaatataatctttcacagtaactgaaagatttttttattagaaaggattgtttttgttacttttttaaattga

SEQ ID NO: 3176 - DNA, 3706 bp, Diabrotica virgifera
gtggtcaaaactggaagaataaactcctccctgaatagttctatggagttcgtattcgtccattgtcgttttcatgccaaaagttgaatttgaagtttgagcccttttgctattgattttgccttcgattataagctggcccagcgaaagttgaagtggtcaaaactggaagaataaattataatcatgaaggttccctttctgtttataacagtactgggatgttcgttggctagtcctaatgggtactaccatcaggagtacaactataaaacatcacaatcatcttacaaaaacaatgaattgcaacataagactgatgatcaaggttattataaaaaagatggtgatttagaaaatagatataagcctatcgaagattcaaacagcgaacattcagaatatataaatccaaaactgcaaaacggccagtatggattggacacaaactcctatggtcacatgagagctgacggaacctatggatatggcaaccaaaacagcatgggtgtcgaaggtctcgccagaaacgacaggatctatggcagtcaagctggatattctgctggttacggtagcagcaacagtcacagctacagtacaaactccaaccttaggatgttaacgtctcgtcttcaacaagaattggagagagatttgcaagaagctgttcgccaaaacagcgcctattctcaatctaggatagatatgactgaacttgaaagagagctaaggaggaatttaacggagaggctaaacaacgagctgaatcttaaatacggtcaacaaattgttcgcagtgggatgtcctattccatgagtggaggaagattacaaccaactgcaaactacgataaccaagaacttgtagaccttaagagccagatagaaaacaccttgctcaatcagttacgcacccaatatagccaatacagtcaacagagcagctatggtagttcaaactcttaccaacacaatggaggtgcctacgtttaccccgtaacacagagaccagtatactacaccacaacctacaggccgatttacccaaccttgacatctggaggatacgtcgacacccacaatcaacaatataacacggttaagacacgatacactccaattgctaatcctgaaagtctcacatcgattgcttcaagagtccaaagtcaattggacgcaaatctgaacaacgtactggacgaaacacgtagaactcacttctcatcaagtcaacagtactctttgacgaaccctgatgctcttcttgaaagattgaggaacgaactgagaaacaacatcacctaccaattagacgatatgatcagtaagaattacggatcgcagacgcaaaaagacggatacttgtactctgtcggatctaacggtgccatatcgacagattacaattacggattgagagatatggaaaatttgaaggagcagatccaaagaaatttgattaataaattggaaagagactttgaatcttccagaaagagttggtcttcctcttcctcgtacagcagccagtccagctacggtaacacctacggttcagctcaaccagcttattaccagccaggtgtcaaagcaggatacaattcaggcagtgaatacaattcagccagtagatataactcagccagcggatataacacagcaaatcaacataactcagccagcggatacaattcaggtggcaccacctacagcagcggaaacatggcggagttgcagagacaacttcaagctgatctatcgagacagcttaaccaagcgttaaaccaagagtcgcacagttcatacagctatactcctcaaaattaccagtcttccctccaagacctgtctgatcaattgaataggaatcttacaaagcatttacaagaatatagtgccagtggatcctatgcagcctacggaaacttcgatagatcccaaatggcagatcttagagttaaactggaagaatctctgatgaaccaattgcgacaaggactacaacaatcaatgcagactcacagttcatacagttcaagtagcagcagcagtagcagtagtagcaactccgctggctacagaccagcagctaattaccagatgggaggatacagttcagatgacgcatgttataggagattaccggagatataaacgatccacaaacacagccaatatcgaacaagttctacaaaacctgtgaactttatttggcggactatctcagtgcagagcgatctcgagttactttgtggacattttattttcattttcaattagtcgttgttcagtgcgccttaaacgccaggatgttccacgtcgccaacgttgttataacttcattcatataatacaccatccatcgacacatccttcatcattttatccacaggctacctcgtgacctttgccgtcggagctagggctcttcagtgaccgtgagaactgcacgtgacccgcggtacctgactatttctaacttattacgtatccccttcgatttgtaaaaatgtccattttgtgtaaagatagatataaatttagtttaagttggtctcagacataacatatacgatttttggttttcttattttctttattgatttaactaattgtacaaaaagatgaacatgtcaggatggcatatcctgccaccgtcacacccggaagtcttgaaacataaaaatggagtacataatggtctttagattggtgatcaatcattatcgtgtaatgatttcaccaaatatttttgacgagggagacagaagggcaataaagcgttactgtaggctaaaatagaacttagtctaatctgtttttagatcagtgtgttttctgtatgtatgatattgtaattattttttaattaatttttatttaaagaattgcgttcattagctgtgctagtcttcgcactttttttattcactcgtcaaatgtttattgaaaataacaaaaatcttcacgattggtgtaaatccaaaaatgtaagtacattaaaataccaacaaagtcactttttctcataaatataatctttcacagtaactgaagatttttttattagaaagattgtttttgttacttttttaaattgatttaaaggctgataatacttacgtttttatttttatcaatcatcaaatgacaatttgtatttaccaatagagatgggatcggattctatggttaagttataggtcattaaaatgtattatcaaacatttagatacattttagtaataaatttggttgtgctataaagggggttgccaaagttgaacgcagaagtttgtattattgccaataacttgtagcaaccccacttataactctttgataatacatatttttgttgtttgctcgtaagagatttttgcgaaattttgtaattgacatttgacataggttcattccaacttacaattaaacggcaatttgggtggttgcgcctcaattcgatatatttttactacagagaatgttttatgaactgtttgtctacttaacataatgatcttgtagaaattcattttgtaacagtgctgtatgatttttgagtgcatataaacgatggatacaaattgtttcataacgtttagtttcatttaaattgcctactataattttttacagggaaaaaaggaaaatacattctttgtttaaaaaaaaaaaaaaaaaaaaaaaaaaaaaaaaaaat

SEQ ID NO: 3177 - DNA, 1523 bp, Diabrotica virgifera
  misc_feature (1515)..(1515): n is a, c, g, or t
cgaaatacccggaccatcccccccgcccgctcaactgtagatcggaagccggtaaatcgggaaagcacggttttactcggttcgagcggcgccatcttagattttgaacaaagctagcccacgcgtccgcccacgcgtgccgagctttgatcgttacaagtggaatcgatcccaatcaaaatataaacaaaatgagttccaaagacaatagcgatgttgcagtcgacaaattagacaacgaaaaaagtacagatggcaaagcagagataaaaggaacgaagcgagcggcagaggacaaaacagaagaccccaaaaaagcgaaaaaagaagaaaatggtgcaaattcagacggtgaggatttagatgaggaagaagaagaggccattgaagaagaggaagacacgggcgaagaagacgtagttgaaggggatgatgaagaaatagaggctgaagatgaagaggatgtagagggcgagggtgtagaagaagaagaggatgatgacgcataataaagtgggtgccgtcaaaccctgtgaactttacttggcggactatctcagtgcaaagtctcgagttactttgtggacattttattttcattttcaattagtcgttgttcagtgcgccttaaacgccaggatgttccacgtcgccaacgttgttataacttcattcatataatacaccatccatcgacacatccttcatcattttatccacaggctacctcgtgacctttgccgtcggagctagggctcttcagtgaccgtgagaactgcacgtgacccgcggtacctgactatttctaacttattacgtatccccttcgatttgtaaaaatgtccattttgtgtaaagatagatataaatttagtttaagttggtctcagacataacatatacgatttttggttttcttattttctttattgatttaactaattgtacaaaaagatgaacatgtcaggatggcatatcctgccaccgtcacacccggaagtcttgaaacataaaaatggagtacataatggtctttagattggtgatcaatcattatcgtgtaatgatttcaccaaatatttttgacgagggagacagaagggcaataaagcgttactgtaggctaaaatagaacttagtctaatctgtttttagatcagtgtgttttctgtatgtatgatattgtaattattttttaattaatttttatttaaagaattgcgttcattagctgtgctagtcttcgcactttttttattcactcgtcaaatgtttattgaaaataacaaaaataaaaaaaattgatgtccctcctaggatgtacgtacattaaaaagggaacattgtacttaaaaaaataaagatcaactatcgcagttttttgaagagatatctctaaaaaattttaaaataaaattatatctttgaaaaaaaaaaaaaaaaaaaaaaaaactaaaaaaaaaattaattacctatagaattgttagaataaaaaaatttttttttaaaaaaaangggggggg

SEQ ID NO: 3178 - DNA, 1084 bp, Diabrotica virgifera
cagatgatgaatcagatgaggaacaagctgacaaaatcaaaaaacagaaaatcgaagttgttaaattagttaatcccggtttaatctatattaagttccccgcattcgaatcacaagcaatgaagctacatgaggaattacaaatacattacaccaaggaacataaaacaagatcatcgtggaatgccgacgagcagtgtgttgtttttcataatctctctttcgcaagagcgaaagttttagaaaaacttgatgacagaaagtatagagtgaatatttttgacagagctactgaagatgtgataaacgtggacaaaatgtatgaatttgacaaatatttcaccaaatttcccaatgtcgtcttcaaatcacatttggctaatattaaacctgcgggcggagataagtggagtttgtcagcgattgaagcactagaatgtgtgtttaccaagtacaaggagatttgtggtgccaaagtgccaggtgatatatcaggaaaatccatacctatgaacatgtggtacacgaaagtcaaaattgctggcgccttggaaccctccataatgaaatttatttctcttagtaatttgttggttaaaatgggagttgcatataaaatttcttcgccttccgtaaaaagtgaaagtggtagcgtcaaaagtgaaaggtcagcagtttcttcaaagatatcaaatggtaatttatccggcttagagaatgatgaagtgccagttggtaaagaatctgttacgtcagtagaatccctcgctattccgaaaaataaggcttggagtgatgcgggggaggaagaagaagaaactctcaaagcagtcaaaaatgcctctgactcattagaaacaccccaagaagtagatatggacgattgggtgcctgcttttccggaacaacaaaaaaaattcttttttggggaaaatgggggggacccccgggggggaattttcttttttaggggaagggaatttggaatccgggttatcaagaaaaagggaaaaaaaaaagaagggaaatttttttaaaaaacccctctccccttttcacaaaaaaacgattggggggagggggg

SEQ ID NO: 3179 - DNA, 973 bp, Diabrotica virgifera
ccctctttcccgcgtccgaaatttgcttgtaatcttgcacaaaaatattttacgaacaatatttttcatagatttagttttaaataaagacaattaagatgccggaccatttaggagatgatatgcgaaaaataaaagaacagaaagaggagcccgaaaaggaaattaaagccctggatgaaggtgatatagcacttcttaaaacctatggacaagggcaatacacaaagacaattaaaacatgtgaagaagatatccaaacgataatcaaaagagtaaatgaattaactggtataaaagaatctgatactggtttagctccaccagctttatgggatttggcagctgacaaacaaaccttacaaaatgagcaacccttacaagtggcccgttgtacgaaaattatcaacgctgatacagatgatcccaaatacattataaacgttaaacagtttgccaaattcgtagtagatttggcagactctgtggcccctacagacatagaagaaggcatgagagttggagtcgaccgaaataagtatcaaattcatattcctctacctccaaaaattgatcccactgtgactatgatgcaagttgaggagaagcctgatgttacatacagtgatgttggtggctgcaaggaacaaattgaaaagttgagagaagttgttgaaacacctttactccatcctgaaaaatttgtaaaacttggtattgaaccaccaaaaggcgttctcctttttggcccccctggaactggtaaaactctttgtgctagagcagtagccaatagaacagatgcctgctttattcgtgtaattggttctgaactggttcagaagtacgtaggagagggagcaagaatggttagagaacttttcgaaatggctaggtctaagaaaggcctgcttgatattctttgatgaaattgatgccattggctggagccagatttgatgatggcgctgga

SEQ ID NO: 3180 - DNA, 1256 bp, Diabrotica virgifera
ccttacgcgtccgatttgaagagttgataaaaatggtttttccaacgtggattttatttaagttaaattaggtagaaactaaaggcattatggcattaaggcattcctgatttaacatttactacggaaaagatataaacatctcttcatctgaatagttttcgtttagaaaaataccaagaaagatttgcaagccctattaagaaatagaagaaagattatttattgactttattaaatgacaaatgaaagaagaattgaaagttgaagagcataggttgaagagtgacagtgaccctgactgcttcaaaataaaattaaattgcgtgtttaaaatctatgtaaattatgtaaagggagagaatattaattaatgtctattatcaaacattttacaatggctaaaatggaagccgctgtgctgaaaagcaaatttaaagggtgtcttctcggagccctcgtcggagattgtactggttccccgtttgaaggagacaccatcacccatggagacaaattgatcattcagaagtatttcgatagaatgcaagatcctacgttcagcgctccatataaatcctacacagatgacacagctatgatgaagtcagtagctaaatttttgactgacaaaccagaaccggactacaaatttctcgctagactatttgttaatgaatatttcaaggaacccaaacgcggatatggacagagtattgtagatgtttttcgtaagctgaaaaataccaaatatgaagatgttttcaaaccagctaaagaacaatttttgggtgaaggatcttttggcaatggaggtgcaatgaggatagcacccgtagccctttatttccatgataattacaaagccatggttgaggctgctacaaatgccacaaaattgactcatactcatatattaggagtaaatggggccattctgcagtctatagctatccaacttgctctgaaatgtgatccagaagccaagattgatgctgagaggttttgtgctgaactgtatagaaggatgagaaaagttgagagagtagaagaggacttggatgatattgaagaagatgaaagtgccagtagaagagcttaccaagataaaataagaattgtggagtacttaattggcaaaaaggatgacgacgattagaacgaaagaagtatattaactttgggaaacgtataagtgcctatgaatctgttcctacagccatttattgcttttttgaaggccctgaaggaaatac

SEQ ID NO: 3181 - DNA, 1230 bp, Diabrotica virgifera
cggacgcgtgggcggacgcgtgggcggacgcgtgggccacattagcacacttcattttacgttctattttatactttttcattctgacactctcctttataaagtttagagtgtagtcactatttaacactacaagatgacaatagctgatctttataaaggaaagaatgttttcatcaccggagggacggggttcatgggacaggccttaattgagaagcttttaagatcatgtccagatataggaactatatatttgttgctaagacctaaaaaggacgacacagtccgccaaaggcttgaaaaacttaaacaattgccagccttcgacgtactaagacaggaaaatcctgaagttttggataaacttaaacccatcagtggagattgtggcagtgtaaatttaggactgagcgaatcagatcgacaattgttgatagacaacgtcaatattatattccactcagcagcatcagtacgttttgatgacttcttaaaatatgcaattcttttaaacgttcgaggaacgagagaagtcgcacagttagcgcttgaattaaaaaatatttcaatgttggtgcatgtatcaacaacgtactgtaactgcgaccgatctctgattgaagaaaaactgtacccttcacatggtacctgggaagaagctattagattggcagaagaatgcgacgagcaaattttaaacgttctatcacaaaaatacataagcccaatgcccaacacatacacgtacgccaaacagttgggtgaacaagtaattaacgatatgtgtaatggaaaaattcctactctaatagtacgtccttctattgttactagtgccaaagatgaaccttttcctggctggaataccaactttaacggacctgttggaatgaacgtagcgggaggcaaaggtttacttcgaactgtatatggatacaaggatgctgtaatcgatatgctcgcctgttgattataattataaaagcttatcttaaaaccaactgatgattataaataaaaaaactctccaaaaattacaggtgtacaagtttgggacaaaaatggtggtttataaggcattgaaaaaagggcgaaaatacctggactttaggaaaaaaaattttttaatatatttttccctttttttaaacaaatttttgggaccccccttttttcccccttggacaccaattgggtgggtttcctaaatttttttttgggggcaat

SEQ ID NO: 3182 - DNA, 1728 bp, Diabrotica virgifera
  misc_feature (565)..(565): n is a, c, g, or t
  misc_feature (602)..(602): n is a, c, g, or t
caggttcggtgctgttgtattattttgttttattattatttttttgttgtggtggtgacttataacttaactctaaactagataaagtacttatcggatcgaagataattatttcgccaataaaagtgacaatgttctagcttcctatttattgttttgttcattaaagctatggacgaatctttgagctctcaaattattgcttacaaaagtgtgatcgcggacatcgatgactttatagattatttaatttcgatcaatcttttaaatgaaaatgcatatttagacgtttggaaacggcgaccacaagatcgactcaatgaattgtttaataagattcctttgaatggtagttcggaggctgttttaaagtatctgaaggaaaactaccctcaccatgaaaaggaactggaaaatgagaggaattacagaatagcatctgtaaggggaagcttcccagaattgcctccttactacgtttccaggaaaaccctggtggacgaagtaaaattcaaactccaagatttaaaatgggatcaaaaattggtgatacacggcatgatgnggtacgggaaatcttgcctcattcatgacgtcctganagatgcgaaagtgagggaatatttcgacaactatttattttgggtcaatttgggcgattgtcacagcaaggaggatgtgtggcagcccatgtggagattgtatacagcagcaagttccatcatagaaacgaaaacctctcactgcctcgatgacgtagacggcttaaaaaacttactaaaaaaattatttttggaagatagactgaagaattcactaatcattttagacgatgctagtaaaacggaagtattaacatttttcgacattaaagctaagactgtaattaccacgcagaataggagcatattagtgggacgcaatgtgacttttgtagaggtcaaaacaggtttttcctccaaagaatctttggaactgttcaaaaagtcattggatgtcaaacacgatctaccggtagccgcagaagaaattcaccacatttgccgaggccatccaatgcgcatatcgctcataggatcctacctcaacgaaaatgccgaagaagccctgcacggggaccatatttggcaatacatcatagatcaattccttaacggacaatatgaactcaacgaatacacaaatccgcatgactttcatggaatcatcgataaatgcatcgaaacactactaacagacgatctcaaagaactctacaaagacttatccatcttcgagcaggacgtaaatattcctcctgaagtactacaaatcctttggaacaaaacgtcggaccaagtccgtaatattatgagcacgttggccgggaaatcgctagtagttagatttttccacacgggattaaatatatacatttatggaatccacgatgtgtatttaagttacctcaaagaagagactaaggacaataggaagtatttacataggaaattattggaaggatacgacaaaataacaaattgtgattacacaaaactacctgacgacaactacactctccagttcatcggataccacatgtaccacggagaggaattccacaaattcaaagaattcctcaatctgaactttctggaactgaaaatcaaagcagtaggcactgaagacgtcttgagagatatgtacaagtacagaaagtacatacccagaaacgaaatccatttgaaa

SEQ ID NO: 3183 - DNA, 1084 bp, Diabrotica virgifera
aacgaatacacgaataccttgaacattggatatgaaagaaatgtgattctttaatttatccttaaaacaaaaatataaaaatggctgaagcagcaaaaccaggggcgcagccccttgtgaagattggccactacgtgttgggggccaccctaggtgtaggcactttcggtaaagtaaagattggcgaacaccaacttacaggtcacaaagtcgcagtaaagattttaaacagacaaaagataaaaagtttggatgttgtgggcaaaattagaagggagattcaaaaccttaaattattcaggcatccacacattattaaattataccaagtaattagtacacctacagatatttttatgattatggaatatgtgtctggaggagaactattcgattatattgttaaacatggaaagttgcaggaacatgaagcgagaaggttttttcaacaaattatttcaggtgttgactattgccatagacatatgatcgtacatcgtgatctaaaaccagaaaatctactgttagatcacaacatgcatgtcaaaatagctgactttggtctatcaaatatgatgatggatggagaattcctaagaaccagttgtggatcacccaattatgcagctcctgaggttatatcagggaagttgtatgctggcccagaagtagatatatggtcctgtggagtcattttatatgccctcctatgtggcactctacccttcgatgatgagcatgtacctacactattcagaaagatcaaatcaggcatatttcctattcccgattatttaaataaaccagttgtgaacctactctgtcagatgttgcaaatagatccaatgaagcgtgccagcattgaggatatcaaaaaacatgaatggtttcagaaggattgtcctgcctatctatttccttctcctgttgaacaggattcatcggttatcgatattgatgcaattagagaagtttgtgacaaatttggcgtccaggaagcagaagtccacagtgctctattgagtggtgatcctcacgaccagcttgctatagcctaccaccttatcatcgacaataaacgtat

SEQ ID NO: 3184 - DNA, 1257 bp, Diabrotica virgifera
gcatctcatagcctcatttgttcttctagttgggttaaccctttcgggggtccatgccgagttaatagctgttatacagatttttaggcatggacaacgtacacccataaatttttaccctaacgacccttataaagacccgtcatactggggaggactagctggtggacaactaacaaatgaaggaaaaagaatgcatatgaaattaggtcaatacacaagaagtagatatgcaaactttataccccaaaagtacgacccatcttttttctatgcacaaacaacagacgtagatcgtactcacatgtccgcacagagtaacgtttatggtttattccctgtaacaacaaatgaccaacggtgggaaaataaaatcaattggcagcctatacctattcatcctgcaaataatattgttttgtctaatttcgtgtatccaccaaactgtccagcattcacgacggaaatgcaagcggtactggctagccaagagtttacaacgtacgactcagaaaatgctggcctatatgcctacttaaccaaacacagtggaatgaatataacggatgttacaaccgcatttgacatatgggattgtgtaaaaactgaagacaatgttggattcagtttaccagcttggaccaaatctatatatcccgagcctcttcggaccacgattggaaaattttttgaagtttttacatacacgactaacatgaaacgaattataattgggccatttttaaatgaagttgttgaatacttagaatcaatggctgcaaattctagctcttctcacaaatacaaaatgtatagtgcgcacgaatcaaatatgggagcaattttaaatgcatttggtgcctttaaccctagctctcctccagcgtttgcatcgacagtttatatagaactacataaggaaaactgaaagtacacagtaaaactgtttaatgggtaaatgaaaaatatcagacagatcagcgaaaggggccggggtaaagggggggggggtctttaaattttgccttttaaaaaattttttaaaaaaaaatttaaaaggattttttttttttttttttgtttattaatagagaaaccacgaaaaaaaaaaaaaggagaaagaaaaaaaaaaaaaatctgtggggggaagagggcgggcggcccccaaacttgagaaaaaaaattttttgtcctcccaaaaaaaaaacaaaaaaaaaaaaaaaaattttctcgtggttttttttttttcttaccaat

SEQ ID NO: 3185 - DNA, 1473 bp, Diabrotica virgifera
aaaacaaacacagaagagtaggtgtttgtattgtgttaattattataaattattgtccagtttataaaaaatgtgaatgtcctgttaccaaaatgaccagacacgggcgttttcaagattactgtttggtccatgataatgatgcagatgagattgatctactgccagatttccgcaaaccaagatgccgttacaagagatgcatctgtataacaattacgctatgtgttgtcttggccctcattgcgtttatgctggtgttcatcgtatttcctttcgtttttatgaactcgattccactgcaaacaagccttatatttacacgctttaacttacccagaaatcccgaatactttgaaaatcagcatttcccagcctacaggaacagatatgtcagttttaattatacaaaggatgaaggcagtaagcttcttggagtctggcacattcttcccgtaaatctagcatatgaagatctatatgacaatgcgactgacattaactatgatgaaatcttactcaacagtaattacagtgttctgctttatttccacggaactggggaagtgagatcgtacagcgaaagaaaatatgagttgctgagttataacttccaaattatagcttttgattataggggatatggtgactcttcagatggaaaacttactgaagatacagttgtggaagattgtgttgaactatacaaatgggtcagaaatcgaacaaaatctgatatttatgtttggggccattctctgggggctgccctagctactaggacagtggctgagatggaaaattactacaatgtgcataccaaggcattagttttggagtcgggatttaccagcatgagggatgagctgtatgttcatccatatggaaagttatttgcctggttgccgtggttcgatacagtcgtagtggaaccattaatgcacaacggatttgtatttaacactactaagcatctgaagacaataacttgccctgtgatgattttgcatgcgcaagacgataatgaaataccgtactattttggaaggaggctggctgacatagcagaaagcagaaacatcactacagtttatcatgaatttgatgcgatgtttggttacaagcattattatctgtatcaagatccatttatgaagttttatatcatgaattttatcgaacaagtaaacagtaagaggattatcgaaggtaacaatacgacgatggtaccgtctatgggtacaaccgtatgaacaaaaagacgtaaagaaaatgacaaatagctcctatcaaagaagtaaaaaggctgtgatcatataaacaccacacataatctttaacaatagttattgtgatgtgtagataagtttattttcttttactgtgcaaataatattttaggaagaaagtgttctttgaatatccatacaaatatattttagagactaaaaaaaaaaaaaaaaggggggcccc

SEQ ID NO: 3186 - DNA, 1349 bp, Diabrotica virgifera
  misc_feature (1194)..(1194): n is a, c, g, or t
  misc_feature (1253)..(1257): n is a, c, g, or t
  misc_feature (1259)..(1259): n is a, c, g, or t
  misc_feature (1263)..(1271): n is a, c, g, or t
  misc_feature (1274)..(1280): n is a, c, g, or t
  misc_feature (1287)..(1287): n is a, c, g, or t
cggacgcgtgggaggatgttcacggtgctgttgaaaatgtttttggtggacatggtggtggtcacgatagtgttagcgtacataaggaagtagtagaaaccactggatatggcggacatcgtggcggacatgcttcaaccataggatctggccacaacagtgggcaccaagatagttacgtcgaggaaacagtagaaactgtacgcagacaaccatcacacactgtatacaccagtggccaacaccaaactggtcaagaagctttcgaagacgtcgatgaagtaactggaggaaaatctaaaatcatcaaaacaacacaatatgtaagacaaccaaatcaacaaggactacacggatatggcgaagatgacttagaaggtgttgttggaggacataacagtcaacgtaccgtaaaagtagtaaaaaccacacacaccagtggcagctatggatctggccaacaacaaactggtcaagaagcttttgaagacgctgatgaagtgacaggaggaaaatctagaatcatcaaatatacacaatatggacaacaatcaaatcaacaaggactacacggttatggcgaagatgacttaggaggtgttgttggaggacataacagtcaacgtaccgtaaaagtagtaaaaaccacacacaccagtggcagttatggatctggccaacaacaaactggtcacgaagcttttgaagacgctgatgaagtgacaggaggaaaatctagaatcatcaaatatacacaatatggacaacaatcaaatcaacaaggactacacggttatggcgaagatgacttaggaggtgttgttggaggacataacagtcaacgtaacgtaaaagtagtaaaaaccacacacaccagtggcagctacggatctggccaacaacaaactggtcaagaagctttcgaagacgctgatgaagttgttggaggacatagtgggcgtatcgttaaagtagttaaaaccactcataccagtggtggctatggatctggtggacaggaacaactcggtcaaataaaatcatatctgaggagagaaccactacaaacaggacaacaagcttttgacgaagaaagatttaggtgaatcagtgcattctggaagttcttctcgcatcgttaaaactaccgacaccaaacacaccagctcatatggcagaaacgataaccagctntagatgtaatacagaaaatcaaaaatattatttgtgaataaattataaaaaatagcccnnnnnanaaannnnnnnnnaannnnnnnaaaaaanaaaaaaaaaaaaaaaaaaaaaaaaggggggggggggcccccccccccccccccctttggggg

SEQ ID NO: 3187 - DNA, 1390 bp, Diabrotica virgifera
atgatgctcatattgtcgaaagtggtcacggatatggtggacatcatgattctcatattttagaaactagtcatggttatggtgggcaccatgatagtcatgttgtcgaaactggtcatggttatggtggccatcatgatactcaggttgtcgaaactgttcacggttatggtgggcatcatgatgtcgatactggtcacggatttggcagagttgatacccataatgttcatgaagttgtagaatctagccacggacatgatgatgttcacggtgctgttgaaaatgtttcgggtggacatggtggtggtcacggtagtgttagcgtacataaggaagtagtagaaaccactggatatggcggacatcgtggtggacatgcttcaaccataggatctggccacaacagtggacaccaagatagttacgtcgaggaaacagtagaaactgtacgcaggcaaccatcacacactgtatacaccagtggcaaacaccaaactggtcaagaagctttcgaagacgtcgatgaagtaactggaggaaaatctaaaatcatcaaaacaacacaatatgtaagacaaccaaatcaacaaggactacacggatatggcgaagatgacttagaaggtgttgttggaggacataacagtcaacgtaccgtaaaagtagtaaaaaccacacacaccagtggcagctatggatctggccaacaacaaactggtcaagaagcttttgaagacgctgatgaagtgacaggaggaaaatctagaatcatcaaatatacacaatatggacaacaatcaaatcaacaaggactacacggttatggcgaagatgacttaggaggtgttgttggaggacataacagtcaacgtacctaaagtagaaaaaccacacactcgggagagtttactttaaatttagcattgatgataatattagtattaaaaaattgtatatgtagtaataatatataggattaataaagtaatccggcaacttttttttcacctgtttattaaaaacatgtctttttgtattaaatataaagtctcgcctgcccactgattaatttgaatggccgcggtattttgaccgtgctaaggtagcataatcattattttttttattgaaagctggaatgaagggttgtatgaaaaacaaactgtcttttatttaatttataaagaattttattttttagttaaaaagctttaaattttttttacagacgaaaaaccctaataagtttaataaataattaaataagttttttttagtattaaaatttttttatataaaagtttttttttaattggggggggttaaaaaataaactttactttttttattttattatataaataaaaaattttttgccacccccctt

SEQ ID NO: 3188 - DNA, 1970 bp, Diabrotica virgifera
ccttacgcgtccggaataacaaatcacataagaagagtacgtgttggccttgatgaccttagtgtcttatataaaatcacatttttacgcaattcaactgcaattcgtgaaaaaagttgaatgagaacgtgaagagatgaagtcattagtatgtctctcaattattatcgccactgtgtatgcccacggtggtggaggctatggtcacggaggttttagtagcggaggctatggtcatggaggatacagccaccacacagaacaacatgtagattcgtatggaggtagacatcatggtgggtatggttctctccatgaagatgaccatcaggttgttgaaactgtccatggatatggcggacatcacgatgttcacggttatggtgggcatcatgatgctcatattgtcgaaagtggtcacggatatggtggacatcatgattctcatattttagaaactagtcatggttatggtgggcaccatgatagtcatgttgtcgaaactggtcatggttatggtggccatcatgatactcaggttgtcgaaactgttcacggttatggtgggcatcatgatgtcgatactggtcacggatttggcagagttgatacccataatgttcatgaagttgtagaatctagccacggacatgatgatgttcacggtgctgttgaaaatgtttttggtggacatggtggtggtcacggtagtgttagcgtacataaggaagtagtagaaaccactggatatggcggacatcgtggtggacatgcttcaaccataggatctggccacaacagtggacaccaagatagttacgtcgaggaaacagtagaaactgtacgcaggcaaccatcacacactgtatacaccagtggcaaacaccaaactggtcaagaagctttcgaagacgtcgatgaagtaactggaggaaaatctaaaatcatcaaaacaacacaatatgtaagacaaccaaatcaacaaggactacacggatatggcgaagatgacttagaaggtgttgttggaggacataacagtcaacgtaccgtaaaagtagtaaaaacacacagtcagctatatcttttgtgggcgtatcgttacagtagttaaaaccactcataccagtggtggctacggatctggtggacaggaacaactcggtcaaataaaatcatatctgaggagagaaccactacaaacaggacaacacgcttttgacgaagaagatttaggtgaatcagtgcattctggaagttcttctcgcatcgttaaaactaccgtcaccaaacacaccagcgcatatggcagaaacgataaccagctttaaatgtaatacagaaaatcaaaaatattttttgtaaataaattataaaaaatagcaaaaattattttttaaattattaaagtaaagccttcttaccagaccaaacttctgctgaaataagaaagttgataaattccgcaaaaaaaacaacaataatacaataaataataaaaaagaaaatatacacaacacagggggaaaataaaaaaagggggggggccccctaaaaggaaacccaatttttaccaccggggggtggcgcctttaattttttttttttttgggccccccaaattttttttcttgggccgcctttttaaacacggggggggtgggaaaaaccctggggttttcccacatatttattccccttctccaccaccccccctttttcccccctggggggggaaaaaaaaaaaaaggcccgcccccccccacccccccttcccccaaaaattgggcaccaccctttaagaggggagaggggggcgcccccctctggtggggggctcatttattagggcgggggggggggggggggggggggtaattctcctctacaccggactccccccttacatttttttcttctcccgccccccccacttacacccccccccccctccttcttttttttttttt

SEQ ID NO: 3189 - DNA, 1000 bp, Diabrotica virgifera
cgatagtgttctctctttattcttttaatggattacttgctagagagtccatctaaaggaaaatattaaacacatcttgaatagttgatgaaaagaatagtgcgtaaaaacttattatgtttttattaaatttgtggtttgtaatcatcttgaaatactacattcagaatttttaccttgtcctagtaggttctaggtattcgattctaagcccatgtatgggattcttcaagtgaaagtagaattttcatttcaataaattgtactaaaatgtaggcgttagagtaacgattagatttaagtttagactctgacatgcggtacgtcataccgttgcctattctcctttgttttcaatgtgaattagtcttatatcactgtatttcttgtttacatcaactacggaatgattctttacactgctgaaaataaaatactgctccaaataaaatagactttattcatagactttataaagaaaaaaaaattatttataaaataaactttaggtagctcaaagactaaaccatactaaaactcaggggcgtgcggtgaaatttgaaacagggaaagcacctaactggaccgtcaagactaacggttatatctgatagtattatagactataatagtcggcggtagcactattggacatctccaacattatcagtgcgtatgcgtttccttttaggctcttcttgccatcatattatttcaacatttttcaaatctctttttgttaataacatctttaaattcgctaattttttttacacagaaaccaatctcgtttatcttgcattgcaatatgtacattaaataaattatctgagaatgtaaatatttctgaaaaaaacaaagttaaaaactccaaaaatcctctcgagctatttatggtttctttatcccacttttcacattttcgccattctccaaaaccctaatacatatatttatataaatattttagtatttataatataaataattctattatatt

SEQ ID NO: 3190 - DNA, 786 bp, Diabrotica virgifera
gacccaagcgtccacccacgcgtccgcccacgcgtccgcggacgcgtggggaaagaaggaagacgtgagaccgaaaagcctcattttctttttgttcctttgcggaatttactataaatagtatttaaaaaatggctcctaaacaaagaatgcgtctggctaacgagaaagccatgaagaatgtcactttgagaggaaatgtaccaaaatcaacaaaacaaagtcaagaatcatcacctgtaggaccatggctattggcactttttgtgtttgtagtatgtggatccgccgttttccaaatcatccaatcaatccgcatggcttaatcttgtaaatcttatattttatttaaaaatatatgtttaatttggatttttaatatatttccgtttatttcgtattgtgcaatcctttaaatataaattatgtgtatataattctcatacgttaaagtcttctaaaggctttagaaataatatacagttatttgcatttgacaactcaattttataattgtaggtacttttttgagattttttaccattccaatgttagttcatttgcatttatgtaactgagtctattttttcaatataaaataattttcaaaacagaaaaaaaaaaaaaaaaaaaaaaaaaaaaaaaaaaaaaaaaaaaaaaaaaaaaaaaaaaaaaaaaaaaaaaaaaaaaaaaaaagggaaaaaaaaaaaaagggggggcccgttttaaagaacccaattttactaccgggggatggggaggcataactttttttatagggccccc

SEQ ID NO: 3191 - DNA, 989 bp, Diabrotica virgifera
ttcctttaaaaatatttatcggttcattattttgtatattgtacattttatacattaattagcgaattccttgtaaaacacgggaaattaggaaaactttttgagaaacagtgaatttttttaagttactttattttcgaggactattgttatcaaaggtagtcatttttatggtaatggtagaatttattccaactcctgaatggaacatgtaggtattaaaaattgacataacatgataagttggtcaacaacttcaagagtttttcaagttctgaagagaaactgttcgtacctgctggcagacacgatcatacacgttaaaccatcatctattcacaggcctcgattgaagcaacttgtttatgtgccttgatttcagtcttcaaacgctccaataaaccagtatactcgttgttgatattttctccatgtttcaaatagtcaatgaaaataattccttgcacgtcccaaaatacagaagccataacctttctggttgttggttgcgtctttgtagctttcttcgggtgctgttcactcggatgactgtcgatttgattccggactgaagtgattgatccatgtttcattcattgtaacataccggcaaaaactccaattaaacatgtccaaaccgcttgtcctggtgtgagaaaacggaggacccatttggaaaacagctttctcatactcaaatgttcatgtatagtagtcaaaatgctaccctttgataaatgtagagtgtcagttatctcttgcaactttacttaacaaatttcagcattttttctatgttttcgggaataattgcatcatttggccttccggagtactcggcattattggtgtctttactatcacgtttgaatacaacaaaccattgtttaatggttgtaatcgatggagcacagtcccggtaacactttttgatccattgctcaatttgggcgatattttttcccatcaaaatgcatatcaacagtgat

SEQ ID NO: 3192 - DNA, 1714 bp, Diabrotica virgifera
attaattagcgaattccttgtaaaacacgggaaattacgaaaactttttgagaaacagtgaatttttttaagttactttattttcgaggactattgttatcaaaggtagtcatttttatggtaatgctagaatttattccaactcctgaagggaacatgtaggtactaaaaattgacataacatgataagttggtcaacaacttcaagggtttttcaagttctgatgagaaactgttcgtacctggtggcagacacgatcacacacgttaaaccatcatctattcacaggcctcgattgaagcaacgtgtttatgtgccttgatttcagtcttcaaacgctccaataaagcagtgtactcgttgttgattttttctccatgtttcaaatagtcaataaaaataattccttgggcgtctcaaaatacagaggccataacctttctggttgttggttgcgtctttgtagctttctccgggtgctgtttactcggatgactgtcgatttgattccggactgaagtgattgatccatgtttcattcattgtaacataccggcaaaaactccaattaaacatgtccaaaccgctccgagattcatcaatttgttgctgtttttgtcctggtgtgagaaaacggaggacccatttggaaaacagctttctcatactcaaatgttcatgtgtagtagtcaaaatgctaccctttgataaatgtagagtgtcagttatctcttgcaactttacttaacaaatttcagcattttttctatgttttcgggaataattgcatcatttggccttccggagtactcggcattattggtgtctttactatcacgtttgaattcagcaaaccattgtttaatggttgtaatcgatatagcacagtcccggtaacactttttgatccattgctcaatttgggcgatattttttcccatcaaaatgcatatcaacagtgataagtcaacacccgaagttgttttgaatccattgtttataaaaatcacaaaaaagtgctttgcagaatccacctactagtacagtttgctgcacattctagaattagatgtcattgtttgtgcattcgacttcataactataagagcacgaatgtgcacctttattttacgtagtctttgtagagtttttttttgatacctttaagaatagtcttatgatggagtaacaaacatttgcattccagctcaaacaatcgctgtaaaagcacatcggcttctaaatgtatacccatacatatcttcaaatttaacttccctgcgctaagttgtagtccaattagaagagaagcaaggcgaatactcaaatatttataataaaattttattattacttgatttatattatggatttgcttatttctgatctgccgacttttagtgacaattataaatcaactcaaaaagttttcgtacattcccgctcatcttgttcataaaggatccatgaattatcaatttattgatttaatttatgtatagtattgtttaatttaggtatttatatagaattttcgcaaatctacaagggttttggtgtcagtaatttatctggttcctttattcacaagcgaagttcatccgattttttcaattaatataaattaaattatgaattctagcctaaagcctgtttatattctaatattactatgtattttatttagttatataaaaaaattttaatccaaaa

SEQ ID NO: 3193 - DNA, 1856 bp, Diabrotica virgifera
  misc_feature (117)..(117): n is a, c, g, or t
aaatgcaggttcataatgtcttgtcctgttcacaattttttttactgatagcacatgcacaattttgagatacctgcaatttttaaacgtaagggaatagttcttccgaacaatttngacgtataaaaagcacacgcgcactggtcggcatttaagacgcgtgtcattaatgtgtcaatgtcacaaaatataaaagctatgctgtgacctaaggaaccaagcttataaggttgttataccagaaaaagcgcgattttagttaggatattaaaaaatataaatgtctttcaaataaataatatattgtgaattattaattttaatcttacaaattggaactaaagcaaaacttgcccaagaatatacaagtaatgaaaaagtattcaatacaaaagttagtcgtatgttacaatggtcttctgtaagaatggaaattattgtacctattagcttgacctcatctgctctaattacggcgacgatatcagtaattagaacatttttatcatttgtgaaataattacgtagtaagatcatcatttttatacattatttatctgagcagtgtttcatttagatcattttacctagtcgttctatgtagttttttgttgtcaaattattgcaaacgtagtttttgaatagatttttaaaacgattgtagtgcctacgcttttaagcatctgtgattaatcccaacaatgctcaactacaaatttttcattgaagaatatatagaaaataaatcttttatgtactataaaaagattttatccttctctgtatatctttcgaacagattttttttatcaaatgaattcttcacattttttctacttgtagtacttgtagagtctagaaactggcgtaaagtaaaaaaatatgcaaaaaaattattggtgcttagatttccgtattagctttgtttttgcaaattaaaaagaggtgtcgatctctaagaactgcaatatgtgtaggatcagtactgccataggccgagagatacttcctttaaaaatatttatcggttcattattttgtatattgtacattttatacattaattagcgaattccttgtaaaacacgggaaattacgaaaactttttgagaaacagtgaatttttttaagttactttattttcgaggactattgttatcaaaggtagtcatttttatggtaatgctagaatttattccaactcctgaagggaacatgtaggtactaaaaattgacataacatgataagttggtcaacaacttcaagggtttttcaagttctgatgagaaactgttcgtacctggtggcagacacgatcacacacgttaaaccatcatctattcacaggcctcgattgaagcaacgtgtttatgtgccttgatttcagtcttcaaacgctccaataaagcagtgtactcgttgttgattttttctccatgtttcaaatagtcaataaaaataattccttgggcgtctcaaaatacagaggccataacctttctggttgttggttgcgtcttttgtagcttttctccgggtgctgtttactcggatgactgtcgatttgattcccggactgaagtgattgatccatgtttcattcattggaacttaccgccaaaaactcccaattaaacatggccaaaacccgctccaagattcctcaattttgttgctgtttttgccctcgtggtgagaaaaacggacgcacccattttggaaaaacagctttcctcatacctcacatggctctggggaaaaaaacccaacatggccacccccttttgaaaaatggaaaagccgcccgttcttctccttgccaccttttccttatcaactatttcccacatttttt

SEQ ID NO: 3194 - DNA, 1443 bp, Diabrotica virgifera
  misc_feature (1401)..(1401): n is a, c, g, or t
aaactttgtcgtggaagtacaaaaccatgtttggaaacacgcttttcaccggcttctttttcggcgcacttttcgccatcgcatcttgcacagatgacttaaaagttgaagtgttattcaaaccagaaatgtgtgatgttaagtccaagcagggagatacgttgaccatgcactacactggtactttgaccgatggtagtaaatttgactcaagtctggacagagaccaggccttctccttccaactcggcgtcggccaagtcatcaaaggatgggaccaaggtctagtagacatgtgcgtaggagagaaacgtaagctgaccattccaccacacctcggatatggcgacaaaggggccggtaatgttattcccggaaaagccacactcatcttcgaagtagaattaatcaacatcagtgatgccaaacctgcaacggctaatgtcttcaaagaaatcgacagcaacaaagacaatcagctaagtcgtgaggaattgagtgactacctcaaaaaacaaatggcagccgctgacgacggagacgtcccaagtgaggaaatgaagaacatgttagcagatcacgacaaactagtagaagaaatcttccaacacgaagatcaagacaagaacggatacatttcgcatgcagaattctccggccctaaacacgacgaattataaaacaagataatatagatttaacacctagtgaattgtcattccataacgatgcattttttaccatgctccatatttttatacatcgagtcaacaaatttaactgtgtatttaagtcgtagttacagttattagtgcgttaattgttggaaaagggaaagtgtcttaggtacagattgacagaaatatctaaaaccgtcaaggtcaaaacgatcggaaactttgattacgcaacgttgtcaggatttcaaggctcttcatcgtatttagtacttaatattccagttatgtttaatatttcaaattgtaacgtaataaactttacatcggagcccacgttgggcgccattgtgtagcgattaactatcatagttgattgaaataatatttttcaagagtatttcaattatctgtggtagtttatcgctacaaaattaataatagataatgaatatctggatcaaagaatgttcacttgtatgtttcttaatgtaacctagtgcaaacctctgacgtaaataccaaagtcgtacaacgtcgtcactttacagatacctaccttatccaacacaaacgcatttcaattaattttgttatataatgtacatagtgactgaatcttttcggcaattttatagtgtaccgggcatttgtttacaagaatatttttaattttgttctatttttattttttgtaatactaagctagtttatgtatatctanaagattcagtctcaataaaataattcttttagaagaatatag

SEQ ID NO: 3195 - DNA, 588 bp, Diabrotica virgifera
accaacggaaccaactcaacttaagacaacatgaactgcttggcctttgtagctttcttcgctgctgtagcagctacctatgctgccccatcagctaccatcgtgcaaggaccaagtgccagatctaccttggtaggtgctgacggtagcgttatctcctctgtacaaccaggagcttcaatcgttgccgaagaacacccaggagtaattgcccataccgccccagtagtctcagcttactcttcataccatgctccattgacctattccgctcccctagtatcagcttactctcaccccgtccacgcagcttactctgctccagtattgtcagcttactctgctccagtagtatcagcttactccgctccagtagtatctgcctattcagctccagttgttggacacggttccgttgataccgttgtagctggaccctctggaaccattgccacctccaggcatggtgccggtcttgtttcagctcacggactttatctttaaatttttgtaaatatttgtatgattattgtaaattattacatatacatacaaatacatatattgagaattaaaagaactctacca

SEQ ID NO: 3196 - DNA, 598 bp, Diabrotica virgifera
cccacgcgtcccaccaacggaaccaactcaacttaagacaacatgaactgcttggcctttgtagctttcttcgctgctatagcagctacctatgctgccccatcagccaccatcgtgcaaggaccaagtgccagatctaccttggtaggtgctgacggtagcgttatctcctctgtacaaccaggagcttcaatcgttgccgaagaacacccaggagtaattgcccataccgccccagtagttgctgccgccccagtagtctcagcttactcttcataccatgctccattgacctattccgctcccctagtatcagcttactctcaccccgtccacgcagcttactctgctccagtattgtcagcttactctgctccagtagtatcagcttactccgctccagtagtatctgcctattcagctccagttgttggacacggttccgttgataccgttgtagctggaccctctggaaccattgccacctccaggcatggtgccggtcttgtttcagctcacggactttatctttaagtttttgtaaatatttgtatgattattgtaaaatagtaaatatacataaaaataaatatataag

SEQ ID NO: 3197 - DNA, 968 bp, Diabrotica virgifera
attacagataaatacaaaaaatccagtgccaaatatttaagcggtgtccctcacttatttactaagtttccatcatatttctaagcgataaaatttagggaagaatttatgaaatgtcatcttaaaacgtgagagcaaattggcacaaacttgagcgttgaatcagtagtggataaacatcattcgaatgatgaatttgttttattctcacctgtaaaaaaaaaacaaagtgtaaatagtataagattaagtgtatattgatattagcaataaatggcggcgtaccaattttctaaaagaaggagttcttcaatcaaaaaggaattcaacgagagtgagctagaaggtctgaaaattgcttttgagctgctggatcggaaccaagatggacaggtcacaccgggagagttcaagatcatgctgaataatttaggaattgacattaagtattaaaaaagctgaagagataattaggattgccagtcattcaggctcagacttaatagaccaaaacgacttcctttctttcgttaaacagattcaaaaagcatgtccaggagacgtagacgaggatatagctagtgacctaaaggcagcctttcaagtttttgatttggacggagatggttatattacaaaagaggaattaaaaactgccatggaaatgattggggaagctgttacagatcaacaattggaacaggttattcgactggctgatactgataaggatggaaggataaactatgaagaatttgttaagttattaacatcgtaaagagagtaagaagaacaaagcttaaaatggttccaatgttctatggtaaatatttggttttaagtaaaagccaggctgtgatccatgtttacaattaaatatcattaagcaaacatattttgactgaattgagaaatatttaatggatatttttgtttcctaagtagatacctaggtaattattgtaaag

SEQ ID NO: 3198 - DNA, 1071 bp, Diabrotica virgifera
  misc_feature (1037)..(1037): n is a, c, g, or t
atacctgagccagtgccagtctcaatcatcacaaagagaaaaatcaaataagcatccccatcttacgtaataaagaaaaatgtataggaatctcttcgccaatactaaaagaaatcagcaacaagaacatatcaacattaattaataaatagaagttcagagagacatcatctacaattatacataaacaccaaaacaaaaaccagaatttgatatcaacccgggggtgaaattaccgcccctagaatttttaactcaaaacagggcttttttgtctacaagatcgaggccaagtaagacacctgtcaaattggtttaacaaatggtttcagaacctctttataaattatgttttattgttcagaaaataaagtagtgaaagagtttgtcttttatcaatcacagaattatattatcattgatcttctttatcagacatgttaaaggataaagtagtatattttctatattcagtattaaaagtaaaataaccccaaagaatctctcgaattaaacccacatatttatttattaaaccctttagtataaaaatgacaataaaaaataaatcacgaaaagatattattaaaaactatctattttaacacatatccctaaaaaaccaaaaaattaaaattcttatttcctgcatggaaagatgcacaaaaggaagaagacctttcatttctgctgcttgatgatgtatagaatgttgcatagatacattgttcctcgtgaaggtgatagtgtagaagctttagcaataaatatcttacagatattttttcgataagtagcatttttcatacctctacactaactacttagaactgcgtccaataccaggagagtttttttatatttttaaatataagtgtaagaacacacgagccactctgcagcgccacaaagtggcttaggcaggtgattttgtagcgaagtgttcgtgtggaagggttttgcgtttaatggtatcagtgagaaaaatcagtcagttcaacgatggattcagacgaggaaagtcttcttctatactnaaagccacagttagtatgcagtgcgggtagcatg

SEQ ID NO: 3199 - DNA, 475 bp, Diabrotica virgifera
aacggagcacaaacttggcggataaccgaaaacaacagaagaaaactggaggcagtagaaatggacgcttttagaagataagtaggagtgtcacgccagagagagaatacgtaatgatgagataagacagcgaatgggggttgacggctctctaacaacagacatagaaagaaaacagctgatatggtacggacacgtccagaggatggataactcaagactccctaaaataattatgcaatgggtaccaccaaaccgcagaaagagaggaagacccaagaaatcttggagagagggagtaacgaaggcgatgagcgcaagagatcttagagagggccaatgggatgatagagtgtcatggaaattaggcatcggacaacgtcgcaagacgttttaaaaccgattgatatatatatacatatatatatatatatatatatatacacatatacatatatatataacaggtatataa

SEQ ID NO: 3200 - DNA, 991 bp, Diabrotica virgifera
  misc_feature (945)..(945): n is a, c, g, or t
atgttatgtaaagtacttgtagtgttgttcactttatttgtttgtttgaaatgtagtaatatttctgttgaactgcacataaacaaattttttaaaggagttaatataacaattaactcaatttttgagttgaagcaaaatgtagtcaacagaagtgaagtacatttaattcaaattaaggaccaaaatgttccagtaataccgaaaaatttcttgaatggaaccagtgttagtgatttcggcattagtagatcccaagtacgagaagttgaacctggtgcgttagatggggtttctttggatttcctaaatttgaatgccaacaacattgcacgaattaaaaaaggtatatttaacaaaaaatcactttatatagttgacttccagaataacgttgtatctaatatagaagatgacgcctttgcaggtgcaaccatcacattactggatctatcgcataataagatggccaaattgacttcaaaaatgttcgctggttcaaatataacatatattttcctacattcgaacgtaataagtaatatagaagatggtacctttgataaaatcgataatatgcaaagattagtcctaagcaacaaccaacttgaagcgcttggaaacgtttttaagaacttgacaaatttaaagcaattgctcttagcggaaaacagaataaaaacacttgaacctggatgcttcagcggttctgggatctccttagagatttttctttcaggtaaccaactgactcatattgcaaaaggagtgttttataaagtaccagtcttttcactggatttcagaaataacagcatttcaaaaattgataaaggagccttagctggtctttcactctaagaaatgtctgctaggtaatacagtcttggagatttgagctgtccattttgacttccctcataatactttaaatttgctatcttngagtgataacggcatttcaatattccgatattggtgtcttcaaaaa

SEQ ID NO: 3201 - DNA, 1079 bp, Diabrotica virgifera
  misc_feature (1014)..(1014): n is a, c, g, or t
  misc_feature (1023)..(1023): n is a, c, g, or t
aaaaggtagcaataatagatccaacaaaaagtttttatcgttagaacaattacaaaaagacgacaaaagggttgtagaatcgttttacacaagaattaaagacgaaaagtacaagaagatgttgaatgttaggaaaaatctgcctgcgtggagtttacaaaaagatattttgaatagtattaatcaatcaccagtgatcgtagttagtggagaaacgggatgtggaaaaagtactcaggtaccccaatttattcttgacgaatggataaagaattatggcaacgacaatagacatgtagagatcgtttgtactcagcccagaaggatatctgcaataggcgtggcggaaagagtggccgatgaaagagttgacaaaataggaaacactgtcggttatcaaataaggttagaaagcaaaatgtcttccagtaccaggctaagtttttgtaccacaggaatattgctaaggagattagaaggtgaaccgacattaccgaatgttacccatataatagttgatgaagttcacgaacgtagtgaagaaagcgattttctccttttgatcttgaaagaacttcttcaaattcgtccagatctaaaagttatcttaatgagtgcaactgtaaacgcttccttattctcccagtactttggtgatattccggtgattgatatccctggaagaacttttccagtagagcaatactttctagaagacattttggaaacgactggatatgtcatggaagatggttcggagtattgcagaaagttgaaaaaagacgaagactatttggaaataatgatgagcgccaatgaagttggttatagtaatcagaagcccagggataacgttaaggatgaaagtttaaacgcaattcaggttatggctaggtatcaagattatagtataacaacgtgtaaaaatatattcataatggatccggataagataaactacgatctcatcgagcatgtcttggaatggattgtagcaggtgatcatgactatcncgaaagtangaactatttctggtatttctggcaaggaattggtgagataacgactctgtatgatc

SEQ ID NO: 3202 - DNA, 1312 bp, Diabrotica virgifera
  misc_feature (1200)..(1200): n is a, c, g, or t
ctctaaacagacgtcctggcaaaatcaacaaagtgttaaaaaacatatgtttaactgattaattgccaataacatgatggatgaacaaaatataccaattgatattaatactaccaaattactagagtggttaataagtcgtagacatgttaaaacagattggcagaactctatattaaaaattcgagagaaaattaacaatgctattcaagacatgccagctcatgaaggtataataaaattactttccggacaacatatcaattatttccattgtttgaaaattgttgaaatcctcaaagaaacagaagcagattctaaaaacctatttggtagatatggttcccagagaatgaaagattggcaagatatagtcacatcttaccaaaaagacaatgtatatgtcgcggaggtatctcaaatgttgatccgaaacgtaagttttgaaatacccagtttgcgaaaacaagtctcaaaattagagcaaagtcaattggaatgcgagaagaaaattaaggattattccagagcagagtccactgctcaaaaggaatttaagaattcttgtgatcaattaggaatttcaggaaagaagattaaaagtgaaataatagatttacttaaagatctaccaggtacatataaaactatttcggaaaagataaaaatcgtcgctccagctgtggaattgtataatgcatttaataagtatttatctggtaaaaaaattgacgaaagtgctcttccactcctagaataccttataaaacatggtaacactactacatatgaatacatttatggagaaaagcctgtctcaatagaagaaagtactcccgatatttcagaagacaaaagttcgtctgatagtgataaaattgactttggcgacatcgattttggggataacggaggtgaaattaacttcgacattaacactgataatggtactattgattttggagatgtgatcgaagaaagtcaaaatattgattggggagcaagtaatccagaagaaggttttgaaatagtaacgcatgcagatttagatatcaatttggaggaatcaggtatagtagttgaaaaaactggcattgatggaggagtagccaaaggagaagaagctctgactatcctcgataatcccaagactcaggaacaggttattaatagtcttatggaattgagtgccttcattanaatgagactatacgaaatgatgaatgatactgatatgctctccacttcacaatgcaagatgctccaactataatcaaatgcaaactgtagaatcgattacaatgctaaacga

SEQ ID NO: 3203 - DNA, 1158 bp, Diabrotica virgifera
caaaaggtggtctgaaaagtattttgttgtgaaaacactctgtattttagtaaataataatcttttagctaatttatgtattaagtatagtataatatagttgaatagacgttttagtgaatatttccaaaattattaatggtccattttggagtatccagtgtttggtaacaactgggtcctaccctacgacaacacaaaaagttaagaaggctggactataccagagatggtcggttactacagcgaagcgactttgcccatagctcaagttcgtacgtccaacgaagaacccctctcagtgaagaaactcgtttgcagtcctgatctaacaatttcctctgatcatttcgccaacaaatcagccgattccgaagccatccagtgtcaagtttgtaacaagatgtacacttccaaagtagcgttcacgaaccacgctcgcacccacgccaaagagactgaggatccctaccgatgcaacatttgctccaagactttcgcagtgcctgcaagactgacaagacattacagaacgcatacaggggagaagccatttagatgtgaattctgcagcaagcctttcagcgtcaaagaaaacctctcagttcatcgacgaatccacacgaaggagcgcccttacaagtgtgaagtctgttcccgcgcgtttgaacattctggcaagctacatcgacacatgcgaatccataccggtgagcgacctcacaaatgctcggtgtgtgccaagaccttcatccagtccggccaactcgttatccacatgcgtacacacacgggggaaaagccatacgtgtgcactgtgtgccaaaaagggttcacgtgcagcaagcagctgaaggttcattccaggacacatactggagaaaaaccttattcctgtgaaatgaatgggaagagttttggatattttcatgtgctgaaagtacaccaggttgcccattacggagaaaaagtatacaaattgtactattctgcaacgacacatttcacctcaaagaaaaagaattggagggaccataattaaaaagccatttcagagaagaataccttcaacagccaacccaacttccccccgggcatcctctaactttcgaaatcgtccgggttccaggggggaagtgatctaaaaaaaccccaaag

SEQ ID NO: 3204 - DNA, 1045 bp, Diabrotica virgifera
  misc_feature (1014)..(1014): n is a, c, g, or t
cgataaaggtcaatcatacttatttacattctgtcacaataaggttcaatgataagaacgaaaatcttaaacaattctcattttcaaacattaattagttaagagttaaacaatatacttacaggttatatcactgtaatgcttttaacaaaaattttaattaacggagaaggaatagttaatattttttccaaacagtattatggcattcgacggaaaagtacactgagaaaaatagacaagttactaatagccaatcgaggagagattgcttgtcgaattgtgaggacggctaaacgattaggtgtcaggactgttgctgtatacagtgatgccgatgagaaatctttgcatgtgtctttggctgacgaagcttatagaattggcccagctacagcctctcaaagttacttaagaggagataagttgctagaagttgccaaaaaatctggaagtcaagcaattcatcctggatatgggtttctttcagaaaatgttgaattcgccgaacgttgccaaaaagaaggtattattttcataggaccaccatcatctgccataaaagatatgggaattaaaagtacgtccaaagctattatgtctgcagctggtgttcctatagtcgaaggatatcatggtgaggatcaaagtatagagactctaaagaaggaagctaaaagaattggctttcctgtcatgattaaagctgttagaggtggaggaggaaaaggaatgagaatagccctcacagaagaagattttgaagaagcgttggagtctgccaaaactgaatctcaaaaagcatttgctgattctgtagtattattagaaaagtttgttactgagccgagacacgttgaagttcaagtttttgcggacactcatggaaatgctgtacatttatttgaaagggattgttctgtacagagaaggcatcaaaaaattatagaagaagccccagcgcctggtctttcttcaaaattacggaacgaaacttggaatggctgctgttanggcaggcaaagctgttggttacgtgggagct

SEQ ID NO: 3205 - DNA, 1270 bp, Diabrotica virgifera
ttttcgttccgatatccgatctgtaaacatgtgttttgaaaatatttcccaaatcacacttacttttaactctcatggtttataaaaggaaaaagtaccactacggtgatacccacctgaagaaaaagtggagaaccaagcgaagaactaaagatttagatcagattgatgaagacatcaaaccagagaacacagaaaaattgcttaaccaagacatagattttgacaaaccaggctcagctcagcactactgtattcattgtgccaggtactttattagtgatagtgctctacaggatcattttaaaacaaaagttcataaaagaagacttaaggcattggaaactgaaccctacaccattgaagactcagaacgggcagcaggattgggaaactggaagacaccgagcaagaggaagatagaaacacaaccaaacaaagaagattcagaaggttctagcaagaaaatgaaaattgacgaagatgaataactgtaggttttcttttttaaaaattaaacattttactagcagatattactcatctgcgctatacataactggtgataaagctcaaaaaacatttgtggttttaactccagttatagattttgaaaaacatttgattaacaaaaataaagtagttaagaatattagagttagaggtttaaaaattgactttgatgatattgtgaaacaatggacatttttccaagaagtttcaaagcgaaagcatcttttggagcttactagacaagacattgctcaaaaaataactaacttattaaaaaaatcagataccgatccatcagaagtggaaaaatataaagtacatgctaagattgtaaaggatgacctcaaaaacctcaagatctctttttatgatatagaggaagcaactatgcttgaaaattcttagtttacctaatgacctacacagtcaaacgctttctcatgaaaaaactgtctgtatacacacctcaatcagccaaaaatgattctttaaacattttaaaataggaactggacaaaatttttgcaaagaacttgaacccatacgcttggtattttaaaagaaaaaaggtggtttggttccaagcccatctggggggaaatttttaaaaaaaagggtttttaaaatcgggggttttttcccaattttttaaccccccaaccttttttgaaaaaaaaggggaattttagaaagggcgtgtaataaaaaaaaataatacaaccacacaaaaaaaaaaggtcttttgtgggggcctttt

SEQ ID NO: 3206 - DNA, 1558 bp, Diabrotica virgifera
ccttatggaacttggtatttccccaattgtaacttcaggtctgattatgcagctgttggccggtgccaaaattatcgaggttggtgacactccaaaagacagagccttattcaatggtgcccaaaaattgtttggtatggttattactgtcggtcaagccatcgtgtatgtaatgacaggcatgtatggtgatccggctgaaattggagctggagtgtgccttctcatcatcatccaactgttcgtcgccggtctcattgtattgcttctcgatgaacttctccagaaaggatatggtttaggttctggtatttccctcttcattgcaacaaacatttgtgaaactattatttggaaagccttctcaccagcaacagtaaacactggaagaggaacagaatttgaaggagctgtcattgccttattccacttgttgaccaccagacaagacaaaatcagaggattacgtgaagctttctacaggcaaaatcttcccaatttgatgaacttgttggcgacagtactcgtttttgctatagtaatatacttccaaggattcagagtagatctacccatcaagagtgcaagataccgtggacaatattccagctatccaatcaaattgttctacacttcgaacatccctattattctacaatctgctcttgtatctaacttgtatgtcatctcacagatgttggctgttaaattccaagggaacttcttaattaatctattaggagtctgggctgacgttggaggcggtggcccagctaggtcttaccccattggaggattatgttactacttatctccacctgaaagtgtaagtcacattctagaagatccaatccacgcaatgctctacatcgtcttcatgttgggatcttgtgctttcttctccaaaacatggatcgaagtatctggaagctcagccaaagatgtcgctaagcaattgaaagaacaacagatggtaatgagaggacacagagataactccatgattcacgaattgaacaggtacattcccaccgccgcagcttttggaggtctctgtattggagccttgtcagtactcgctgatttcatgggagccattggttcaggtactggtatcttgttagctgtcaccatcatctaccaatacttcgaaatcttcgtcaaagaacaaagcgagatgggtggaatgggagcgttactcttctagataaattgaagatatcacaaagctatagcttgactgatattgtgattttgtttggtaaatagtaactattgtggttattatttgtttagtttttgtacctcagtgtctccactatagttattatttatgtggaacaacttatatgtcactttgtataaagtgtgaaacatttttttgtactaaaagattgaaaatagacaaatatatttcattgtacatttacatgattttgtgtttaagaagcgagttatttataatgtgcggatgtcccatactattagtttattttttacattttttcattctcgttcatgcaggacggtggcgtattgatcatttattattagttgt

SEQ ID NO: 3207 - DNA, 1113 bp, Diabrotica virgifera
ccgatctctctctttgagttgtcgcttttcgaggtatttagttgcaggcgtggtgtatacgttgaaatagtgatttttgttaaaagtgagtaaatatggcatcgaaatcaaaaaaagggtcaacaccgttagcttcacagcggccggcgagccccttaagtcctaccagacattctagattacaggagaagcatgaacttcagaatcttaacgaccgtttggcgggatatatagatcgagtaaggtatttagaaggtgaaaacaacagattaacgagggaaatacaaagtacccaggaaacagtaacaagggaagtttcaaacattaaatctatgtatgaccatgaattatcagatgctagaaaactattagacgagacccaccgtgaaaaagcacgtttagagatagatgttaaacgtcttttagaagagaatgacgaactcaagtctgagttagcaaagaagaacaaggatttggctctagctgagaattctgccaggatatacgagaccagatgtaacgagttacagctcaaagcaaatcaagcggctgctgatgctaagaaagctattgcagatgctaaggaacttgagaaagaacgtgataagctacgcaaacttcttgataatcatcgtaaacagttagaagaagaatcattagcgagagtggaagtcgaaaatgccaaccaaagtcttcgagaagagctgtcctttaaggatcagatccatcaacaacagttgacagaaactcgtactcgtcgtcaagtagaaatcagcgaaatcgacggtcgcctggcagaaaaatatgaggctaagcttcaagaggctctacaagaactcagagatcaatatgaaagtcaaatggccaacaaccgtggcgaaatcgagttgctttacgaacagaagattaagaacttgcaatcagctaatgacagacatgctgcctctgcctccggtgctcttgacgaattgagacaagttagaaccagaatcgatactttgaattcccgaattagcgatttatagaaccacaaagcaggcttaccatttttttgttcccacacttgcagaacgtgatagagaatgagcgcatgcgccatggggcagacctccc

SEQ ID NO: 3208 - DNA, 1330 bp, Diabrotica virgifera
cgacgctgcgcgcccatgtctctgttacgaagcttttgcctgtaatatcgaccgcggaagaacatattacatccataaatcatgctctcaaatcgctttttaagttgtttaagccggtgccaggtgagaagtcagtttgagcaatggatatcaattcatactattcgtatgtcaggttttcacacaaaccgcaaaaaaaatgatattgatcaaacacgggctattattaacagacaaagaaggcaatactcatttatccatgatacgagttatttatgctatggctcagactacgagacggacgtggcgctcttcgaaatgttcaaaaaccaggacactggattgctgcacattggaaagttcttgtcggcagtcaaggctacaggtctcagaaaaacagatctgcggttgcaggatatgatggagaacttaaaaaagttgtcgaaaacaaagtctgatgggaatgatgtcgatactcagaagctaacactagaacaatttagaagcatagtacaaccaaatgtgggactattgtcatacgcctttagacatcaatttattatacccgaatttcaagaatttagtaaagagttagaactaatttattggaagtgcaaagaaaacacaagcggaacggtggcgtcgtacattccacagctaaaacgcatgaacccgaattattggggagtcagtattgtaactatagacggacaacgatattcaataggagatgttaatataccgttcacaatccagtcatgtagcaaacctttgtcttacgggatagctttagacttgcttggagcaaacgttgttcatcagtatgttggtcaagaacctagtggtagaaacttcaacgaactcatcctccaccccaataagaaacctcctaaccctatgattaatgcttggggctataattatttgctcgttgttgaaaacaatgaattctcaaaaatggactcaccaaaaaattttgcttttcctatgaatttctttaaaaggttggccggaaaggaaaaaatttaaggttttaaaaaggcagatttttttgcccaaaacgggaaaggggcttgatcctaaaatttgcccctcaggtttttcactttgaggggaaaaaaaaagggttttccccaaaaagaaaaaaaaaattttaaaaaaaaaagggtttgggatattttcttttttttttacggggggttttttccccccaaaaaaacaaataattgtggggaatttttattaaaaacccccgacaaaaaggcggggccccccgcccccccctgtgtgggggccccccaggggggtggggggggggaatatttttttt

SEQ ID NO: 3209 - DNA, 964 bp, Diabrotica virgifera
cgcattagtgcgcgaaaaccatgattttgttaatagcgattttaatacctttgataatatatatttatgtaaaaaaaagacaaaggtaccaagatatttggcagtatgttgatgttatccctggacctaaaagttatccagtgcttggaacgacttatgagttacatacacaagcctcattatttacgagagatcgaatcagagcaaaggaattttttcctatctacaaagagtggtctttaggagttcctgtcgttaacattatacatcctgacgatatcgagttggtaaccacaaatccaaaaagtataactaaaagttttatttaccattttctgcatccatggctgggtaatggtattttaaccagtacaggatctccatggcacaagaggaggaagattctaactccagcattccacatggatattctgcatcagtttgtagaagtattcaacaaagaaactacgtttttagttgaaagattaaagaaagtatgtaacgcaccttatctaaatctttcggagcatatcacagattatacattattttcagttgcagaaacatctcttggtatttctttgcgagaagataaaagttgtgccagttacaaaaaggccctttatgacttcggtgctgattttgcttattggctaatccgtccatggctatacgttcccattatctataagtacagttcactatgcgagaaaaatacaaaatcaattgaagtaatgcataatttttcaaaaaacgtcattactgaaagaaagaaaacctttaaactggaagatactccgacttattcgaagacaaaatatcgagcattactagatgtgttgctgactacacaacataatggaaacccgattactgtggatgaaatcagggaagaattagatacttttatatttgagggtcatgacaccacttccgtttctattatgtatacattgatggcatt

SEQ ID NO: 3210 - DNA, 450 bp, Diabrotica virgifera
ttactaaatgaaatattaaaattttacgttggaataaagtatttttagatcaattcgccaacaccaaagtaaccttgcacattgtattatccgtcattttgtgttgtgttagtcacaatcaaccagcaaagcaataatgtcggggttatcacttgaagaacaatggaaaaattttaaattcgcacacaacaaggaatataccgatgaagaggaaccacgtaggttggaaatcttcaaagaaaaccttcagaaaatagaagaacacaacaaaaagtttgaagctggcgaagttacctaccagatgggagttaataaatttgctgaccttacctctgaagaaatgagtcaatttaggggttttaaacctagagaaaaataaatagtagtatcataagtcagttttgtatttttatttaagtaatttttatattaataaatatgttgtgtcgg

SEQ ID NO: 3211 - DNA, 937 bp, Diabrotica virgifera
aaattttcattcaggcagtcatctaatttttcggaggaggttaagattatcgaagagagaaaaattaattcagtgaaattattctttttattattgaatttgtggaaataagtgatagattttttttttttttagtgcaaaaattattggtagacgtataaactaaatctacaatgagtgaaaaatgtgaaatatgtgaagaaccatccgaactaaaatgctcggcttgtaaacttgtctcctattgttgcaaagaccaccaaaaacaaggatggaaagcacacaaaccgttatgcagaccgtttgaaatacaagaagatcctgtaattggtaaatgtttggtagctactagagacattaagcctggagatctaattttgtccgaatgtcctctggtctatggaccaagaccacacatggtggaagagggacctgttccgtgtccaggatgttgtaagttgatcattggagaacaatcagccaggtgtgagggatgtgactttcctatctgccatccagcttgtccaggtttaaaagacatggaaaagcacggacacgaatgtatgatccttggattgagagatgtcaaggctataaatggactgcatgatttttacagacaagatgctctgttggttttaagatgtctcttgcttcagaataagcatccgaagaagtttgcgcagttaatggaaatggaggggcatctgaaaaagcgtggtgcagatgtaactagtcaagttcaagagagaattgtcgactatctacacagcaacttcttccaccccatgaccatactaaaaggaagatccggtagaaaagtgctagaagacctctcccccaaaaaccattcaaaagctgtgtggggttattgacgtgaacgctttagaaatcaatcaaaccccaaaggatctcctctattccaacctatttaccc

SEQ ID NO: 3212 - DNA, 1033 bp, Diabrotica virgifera
  misc_feature (15)..(15): n is a, c, g, or t
  misc_feature (30)..(31): n is a, c, g, or t
ccttccagggtccgnagagttggtagttanngggaaagtatccccttgaagaaggatttgacatctccaattggagagtaaagagttggagcaaacacggtctcatctcactaccacctctaagggaagctccagttaccgaattggaacgtttgtgggcctatttaaccatcaagcaaaaactggaacaacgagagttagcagaaaataaaacacagctaaccaaggaagctctggatctggcgctgaaatattcctttgttactgatgttagttccttggtagttgtcaaaccgaatcaaaccagtgctgttaatactgaagatgcttcaaaaccaagatctgaaacgcttccattaagaacgtacagtagtgggtcagtttcatatggtatgccaggcttgccaggaccaccagcacaatcttttggtgcacgttcatattttgatcctcagccaagatcgggtggaggtggagcatatcaacctctttcgctatcaggtcaacgaagttacagcacattttctcaatcatcagcttttgctgatcttgatgatgacttagattccagattcttagttcaacctcatgccacatggagagctacatggagacctacacatataatatccactacatttgcacctacaagcactacgtcaaaacctgcaataaaagatctgcttccctggttaaaaaatatcgttcaccaaaatggaactttaagtattttaggaggagcatatgatttgggcgagggtcaagttgtcctttctaatggggaatgtacgaggacacccaataagaatgtccctaagggaacttgcagtctactgtcaaactgtccacatgttcattcatatctgacagatttcctgacctacgaacagtttgcctgcatccttgataacaaatatgctggagtttgctgcccagaggtagcgccagtgccataattatcgatttatagggtttatagaatattaaaataaagtgttttttatactttaaaaaaaaaaaagaaaaaaagaaa

SEQ ID NO: 3213 - DNA, 2623 bp, Diabrotica virgifera
aaaaatagtatagaacagtcaaaatgaatggtatattgtttgccttggtggcgagtgtgtgcctgggaggggcattttgcatccctggtttagttgtaaggggtattcgtagtgcaaaagagggtctcgatggccaggaagcacaaaaccaagatccaattatctcggaattcaacatacattccaacatctcgaacagatttgccaagactttggtcactagtaaagttaaaaatgcagaaaagaatccaaaagaagccacgtttaccgtggttttaccagaaaaagcatttatttccaaatttgtaatggaaataggtggcaagagctacgaggcttatgttaaagaaaaagaagaagctaaaaatatctacgattcggctgttcggcaaggaataagtgctggtcacgtctcagttagtgctcgagactccaacagattcacagtatctatcaacgttgaaccagaaagtaaagcaactttccatcttacctatgaagaacttttggaaagaaaaaataaccagtacgagctggtactgaatattcaccctggccaagtagttaaagatatgaatattgaggtctttgtgaatgaaagtcgtcctttgaaatttgtaaaaactccttcgctgaggtcgggaaacgaaattagcaaaaacgatgccaaccttgacccagctgcagacatccaaataatcaactctaccagtgctgtcgttaaattcaaaccaaactccgacaaacagagggagtttgcaaaagaactggggcagaaagaaaatgagggtatagctggacaatttgttgtacagtatgatgtagatagagattctcaaaaaggagagattcttctcaaagatggatacttcgtacatttctttgctcctgaagacgtcgaaccacttccaaaacatgtagttttcatcttggacaccagcggaagtatgtatggaagaaaactcaggcaaatgaaggaagccatgggtagtattttagatcagctcaaagatacagatgccttccatatagtggaatttaatagtgatatcttagtttggaatatagattcagaatcaaaaaccagtttgagggttcacaatgaaagagagccttttgaagaactttctaaacttgaattgccaaacgccttagcagctaccaaagaagctatttctaaaggaaaagcagtaatagagaagcttcaagacactggattgacgaacatgttaggtagtatcgaaactggtctgcatttagtccacaaagaactgaaaagtgggtcaaaacgtcaaccactcattatctttttgacagacggagacccgaccatgggaatttcaaatactgaagagattaccaagattgtaaccaaaatcaacggcgatagagaccacgtaccaatcttttctctatcatttggagacggagcagacaaaaagttcttaagaaaactatcattgaagaacctaggatttgccagacacatttatgaaggagctgacgctgctattcaactccaggagttttacaagcaaatctcttctccacttttatcaaacatcgaatttgagtacactgacgacgtcactgaagtatccaaaaagacgttccctatttactttaagggatcagagttggtagttaccggaaagtatccaatcgacgaaggatttgacatctccaattggagagtaaagagttggagcaaacacggtctcatctcactaccaccagtaagggaagctccagttaccgaattggaacgtttgtgggcctatttaaccatcaagcaaaaactggaacaacgagagttagcagaaaataaaacacagctaaccaaggaagctctggatctggcgctgaaatattcctttgttactgatgttagttccttggtagttgtcaaaccgaatcaaaccagtgctgttaatactgaagatgcttcaaaaccaagatctgaaacggttccattaagaacgtacagtagtgggtcagtttcatatggtatgccaggcttgccaggacctccagcacaagcttttggtgcacgttcatattttgatcttcagccaagattggggggaggtggagcatatcaacctctttcgctatcaggtcacagacttgctgatcttgatgatgacttagattccagattcttagttcaacctcatgtcacatggagagctacatggagacctacacatataatatccactacatttgcacctacaagcactacgtcaaaacctgcaataaaagatctgcttccctgggtaaaaaatatcgttcaccaaaatggaactttaagtattttaggaggagcatatgatttgggcgagggtcaagttgtcctttctaacggggaatgtacgaagacaccaaataagaatgtccctaagggaactttgcagtctactgtcaaactgtccacatggtcattcatatctgacagatttccggacctacaaacagttttgcctggattcctggataaaaaaaaatctgggagtttgctggcccagaaggtagcggccaggggccataaatttaaagaatttaaaatggggtttaaaaaaaaaattaaaaaaaaaaaggggtttttttttttaactttttt

SEQ ID NO: 3214 - DNA, 984 bp, Diabrotica virgifera
caaagtgacaatttgcatgacgtaaaatcaaaaagttaatttatttcgctagtgtttatagaattcattctaaaatatgttttaattataaaactataacttagttaactatatataaaatatattctcagcatcatggcgcgacacagagatattagaaatatggactattcagatgactacgacggctacgacgatgtttatggacattctgtggatgatgatttttttgaatccccgagcaataaacagttcatttataacagagacatgtcacagagaagttccgagggggacattaaagaagaagatgagcaagaggctgaattatcagatagtgatagagccaaattaacatcttgtattgctcagattaatacaaccctggagtctgttaacatttctaggaatgatttagtcaatattataataaaatcgaagtttgatgtagagaggtctataaacacgatcttagaagactcacaatatagaacagctactattgaaaaagattcaaactcctcagatcgaacagacgaaggtgatctcctccactccgaaaaccgttaccaacatcacgaagggttttgatctgccacaaaaaggtagcttcactcccagatctcaatctccagcatctgggaaagccttcacgcccagatctcaatcccctgcgtctgggaaaatcttcactcctagatcccagtcgcctgcttctgggaaagttacgccagtcaataaccatactttggactttgccgaggaagtgaagcaatccaaaggcagagataacaagtttgatccacagcagctgtaccaaaaggaaaggggagatgagaaggagcacctgtatatggttgtgattgggcatgtcgatgctgggaagagtacgttgatgggcagacttctctgtgaatgggggaaggttaatcaaaaaggattgcacaaatatgaaacaaaaaaggaaaaaattaggaaaacaaa

SEQ ID NO: 3215 - DNA, 1253 bp, Diabrotica virgifera
ggatgtgttaggtcaagcccacaaaggtttgcagatgtggcagtttctaggattgttggaatggtgaatcagttgacctcacttgagcctttttaaatattgatctaagatcttgattgatttgggaagccgtaaattgtatctcatgttgtagataatcccaaggccctcatctgttcggtaaccattcaaagcaatgtagtttttgacagttttcttagtccttttgctacctaattcagggttgtgatgaaatgtgttactgaaaagagctaaagttactttatacctgtatcattttgccacctttcacattggacttatcactgcccaacattatacacaataatatagtatagcaatgtattaaatgttatacattttgtagaggtaaactttttctgtgaaaaaatactaaatgtactggtcaacttatgtaatctttaatttttgaaagttgaaatatgaacgtctagaatgaaataggtacagaaagtattaaagataaattggtgcaatactggttagttgttcttgagaatagtttgaccaacagcacttttttatactggagatatagtccttttagatagaagtaattattccccgcctagatgattagttgagttttatcactatttttgtttgtttgctcctgtttggtactacgagcatttagggaatggaagaaggctcaccaagcctgggtgtcgcctggtacccggaattgagccgtttttaccttccactcgatcgtgtccatctcccagaagtagcatctgtgactgagcacgaggtgcgctctttcaccacgacaagagttcacgatttttggcgaagatcagtcaaactaacccatatggtaaattggattatttcttatggttatatctaacccttcctaagcttcatctgatttacatcatcagcagtattttctgttcattacagaaatgttaatttcttccggtaccgtcagttatgttcgtcactttgatcaacatagtttggtaaggttatattgtatcaagagtgtttaagacatcaagggtactatttttgctgggagtactagtagaatactagtgcaacatgtttaaagttgaaagcttggaaacaaaacaaaaggaaccgaactgaatcatctctaaatccataccgggaccaagcttttttggagcgccattttgcaactacctatttgtaccgtttatctactacatttaataagaattaaccgattttcaatcaaa

SEQ ID NO: 3216 - DNA, 1272 bp, Diabrotica virgifera
agccgtaccagttttggtttttctgaatagatgtgttctggaggtatttcaaaaaaaaactaattgaaagacaccatgttcaaagagctctagctcccttaggaagccttttcgggggcgatttgtgttaaaccgtaatattttgagcccaggaatctaataatatttccaattattaattaaacaccctgtattgttttgttttatttcattatcttttattttgtaataataatgacgatttgtgtaatttcagtaaactgtatttgttgttgtttttttttcctactctttgtacctacgctttgtctataaaattgtaaaattttcagtgacaataaagtatggtgtattccacgaatacgcgactgttttggattgtcgggacagcgaatattttactgtgcaatatgagaagtacgaaagtattttgctctaataataactccagtaaacaacaatataatttgcaatttactgtcgttcttcatattttgcacagtggaatgttcgttgtcgcgataatccgggagggtcgtgtattcgtggaataggttatatatttctattctattctatacacgcgtttttgctgcttttgttgaacattttttggcactatcccatatcagtcgtggaaaagggccccgcgataaactttgatagggggcccctgtggggctagctacgccactgcaaacgatactaatacatgtgcctacaacctggtgcaagaatcttgaaaatcggagtacaaatggtaaagttatggattgtcaagcttagtcagagattttgggtggcggaattttgtgccggtgagtgtattttccaggcaataacttaagataataaaaactggataagcatgggtcaaattaacctttttcatcactgtatttgcagtataaaacagaagtaacaacatataaattccaaaagtacccgatatttccccaaagaactttcagtttttattgtgttttaatcacatatcaccactaaggacctctacgttttttattgtttttaaatctttggtaccccgaatccaaatccttttccctacatttaaaaataactttttataaccttaattccttaaatccctttttaaaaactttcttaaaataaacccctatatttggaaaatttttctctccccaaggggaactttcttattgaacacccctccctcctctctcttaattccgccccccgagtgtgccccttgggtgagaattctccccccccccccaaatatttcccccc

SEQ ID NO: 3217 - DNA, 1185 bp, Diabrotica virgifera
ggtgtattggcgcttcgtagcagccaatttgacttttgacttacttggcctcgatcttgtagacaaatggtagtgtgcgagttgaaattttgggggtgatgtgccgccctcgtgtcaaattctgatttttgtgggcttgtgtagtcgattgtagatggtgtgtctttgcccgtctccattaatccattaatgttggtatatttttattgctgaattcttcttttggtattggtaaccagagcctgctacattctgttgataggtgtgccatacatttttcttcattaagtgggatgagggctgctctttgatttgctctctgttttgtcagcattttgctgtatgtttctttttgattagtggtgtatctttccattgtactctgtgcttgttgttccagacatgtttgcatatctggtatctctctgtttttgatgtaggaaatctgattcatgctcatttaacagtggttttatcatatgtttctcccacataaaaattggtggattcacaagttgttttatatatgcaattctttgatctctcctgtgttttttggtttcgttttggagagaatagatttttgtgttggttgttttaaatggtgtgatgttatatttacgagaaattaaacaaaaataaatacaattaaaacaacacacagatctattgtgtccaaaaccaaaccaaacaacacatgacagatcaaagaactccgtctgtaccttatgaaacaatttttatgcgggagaaacctcgaatcacacatatgtaaggataaatcatacatgaaaaatctgagactttgacagatcctaaatgcgcaagcatgccggggatgattcccacatgcagtggaaagatgcatccatgatcaaaaaagaaactgaaagcaaaaaatagtaacagaaaccacgtctaatctttaccctaccgaagaaaaatccattctccgggcttagcggggtcctggttacccatatggttaaagtccgcaataccgatattattgctcccacattttttgattacacagggtctgagaacccgcccttcttaccggttggcttacattatggccccaccaaaactccccaatttgataaatacccaggggtgccatcccccctccacaatttccaactcaaaaaacatgggctaatttacccttaccaaaaattaatt

SEQ ID NO: 3218 - DNA, 1715 bp, Diabrotica virgifera
cggttttgttaatgctgcttttggtcaagataagctcttaatggaagatgggaataaatggctttacaaaaacaaagaacatggaatgcttagtgctactgcttctttgggactaattcttttatgggatgtagacggtggtcttactcctatcgataaatacttgtactcttctgaagaccatatcaagtctggcgctttattagcttgtggcattgtaaactgcggtgtcaggaatgaatgtgatcccgcacttgcacttttaagtgattatgttcttcacaacacaaacataatgagaataggagctattgtaggtctaggtttagcgtatgttggttcaaatagggaagcagtattatctctaatcacgcctgtgctatctgaccctaaatcaaatatggaggtcattggaatggcggctctagcatgcggaatgatttctgcaggatctggtaactcacatgtgacaacatcaataatgcaagttcttatggaaaagtccgaaatagaattaaaggacacttacgccagatttttgcctctgggtcttggattgtgtcatttaggtaaacaagaaagcattgacacaattatagcagcattagaagttatacctgaccctttcagatccatggcgactactatggtcgatatttgcgcttatgcaggcacaggaaatgttttaaaagtacaacatttgttacatatatgttcagaacattacgatgctcctgaaactcctgacaaaacttcaaaggacaaagataaaaaagaagcagagaaagaaaaagataaggatctttcagctagacaagctattgcggttttgggtatagctttaattagcatgggagaagacattggtagcgagatggctttccggacatttggtcatttactaagatactgcgaaccagcgatcagacgtgctgttcccttagccctaggcttaatctcagtttcaaatccaaaattaagtattctcgatactttgagtaaattttcacatgatagcgatgctgaagtggctcataatgccatctttgcgatgggtctggtgggagctggtactaacaatgcaaggttagcagctatgctaagacagttagcacagtaccatgccaaagatccccataatttatttatggttcgcatcccccagggtctcactcctcttggcaaaggaattttacttcccatccattccacagtgataggcagctgatgagtccagtagttgaagttgggctaatggggacactcctccgtttcttgatgttaaaaacttatattggggaaatccccctattactgtcaccttaacacttggaatggaaccaaggtggtaagcacatttgccgaagagttaaatcctctacccccggcccggcaaaatgggattgggaagggaggttgttggccaccccaaaaaaacaaaaaaaaaaaaaagggtttcaaacccctaccacccccccgggcttctgggtttggggagggcgccgcggactcgccaccgtaaaaaaaaaattgtctttttgtcccccttttagggagagggattttttttttttttacaaaaaaaaaaccccggaaaaattatttcaaaaaaaaattatattattttcccccccctgtgtgttttatatcagctgccccccccaccttttttctttttattatatatattaaatacttctttttttttgtttttt

SEQ ID NO: 3219 - DNA, 1318 bp, Diabrotica virgifera
actgtttcatattttatttatattataaggaacacagtgcattttagaacatatttatgctttgatatacctacttgagtgtataattcgtgttaacagtatatcattaaaacttttattaacaaacataaatctgctgagttattcttattttcttgcaaatggatattctggtgtctcatcaatcttagcataaaccctccagtccacaattcgagcttcttctccaatatctagagcttcaattttcttcatatccgcattatcgagactaaaatcgtagagctcaaagttgctctttatccttgcagggttgacacttttcggaatgacgacgcagtttttctgtattaagaatcttagagcgacctgcgcattacttctgttgtgttttttggctatttctgtgatgactgggttggtgagtacattgactaaatctgttcgctcctctgctccaacgcgtttcaaaaatttgttgtaaccgggatttccaagcggtgaatatgccgtcactacaacgttgttcttctggcagaactgaaccagctctggttgttgtaggaacacgtgaagttcgatctgattgcaagctggcttgattctggcgaatttcaaaaatttatcgatttgttttacgttgaaattggagaccccaatcgtctttgttcggccagcatcaacctgtttttccatgttctgccataatgccttgtgctcttctttttcgaactgtggagccccttctccttcttttatcccgacaggaaagtgtataagataaagatccaggtaatccaactgcagatcagccaacgattttgtcagatatttttcaaccctatcgggatgtatacctggagctgggagtttggtgacaatgaagagatcgtctctggtcagtttgccagaatcgaaccattttttcaagacttttccgatgacgtgttcatttccgtatgcggcagctgtgtcgatgtggcggtagcctagttctaaagcagcgtctagggctgtctctatctcgctgtcgtctctagcttcccatgtgcccaatccaaccgtgggcatactcaatccaccacaagaaattgttttagccatattttatttataaatgatctccacaataaaaaaatcttgccggtattcgatatttgttcaccggaactgtctgcagcagccgcccttggatgtcagacaacgactgaaactaaaactgaattgaattagaattgcataaaataccaccacaaactgattattcctgcgttaaaagccagcaggaagttgaattttgttatattcgtttcactcg

SEQ ID NO: 3220 - DNA, 975 bp, Diabrotica virgifera
ccgtttgcgtgggacatccaagggcggctgctgcagacagttccggtgaacaaatatcgaataccggcaagatttttttattgtggagatcatttataaataaaatatggctaaaacaatttcttgtggtggattgagtatgcccacggttggattgggcacatgggaagctagagacgacagcgagatagagacagccctagacgctgctttagaactaggctaccgccacatcgacacagctgccgcatacggaaatgaacacgtcatcggaaaagtcttgaaaaaatggttcgattctggcaaactgaccagagacgatctcttcattgtcaccaaactcccagctccaggtatacatcccgatagggttgaaaaatatctgacaaaatcgttggctgatctgcagttggattacctggatctttatcttatacactttcctgtcgggataaaagaaggagaaggggctccacagttcgaaaaagaagagcacaaggcattatggcagaacatggaaaaacaggttgatgctggccgaacaaagacgattggggtctccaatttcaacgtaaaacaaatcgataaatttttgaaattcgccagaatcaagccagcttgcaatcagatcgaacttcacgtgttcctacaacaaccagagctggttcagttctgccagaagaacaacgttgtagtgacggcatattcaccgcttggaaatcccggttacaacaaatttttgaaacgcgttggagcagaggagcgaacagatttagtcaatgtactcaccaacccagtcatcacagaaatagccaaaaaacacaacagaagtaatgcgcaggtcgctctaagattcttaatacagaaaaactgcgtcgtcattccgaaaagtgtcaaccctgcaaaggataagagcaactttgagctctacgattttagtctcgataaatgcgatatgaagaaaattgaagctct

SEQ ID NO: 3221 - DNA, 559 bp, Diabrotica virgifera
actctagaatgtgtcagcataatattagaagtgttacacttaaacaattttttcatcaaaactttgtaaatatactttttttttcgacatgaaggtttttgttttaatttttttggttactgctgcagttcacgcattaacagacaaagaagaatgggtgaagtttaagattagacataacaaaagttatagaaattacattgaagaacaaaagcgatttacaatttttcaagataatctaaggaaaatcgcaaatcacaatgaccaatttgataagggactgtctacttttaagttgggtgtaaccaaatttgcagatttgactgaaaaagaatttttcgatatgttaggactttccaaaagtaacaaatcgactagaactcgtgttattcactcacttgctccagtaaaagatcttccatccaagtttgattggagagaaaaaggagcagtaactgaggtcaaggatcaaggatcttgtggatcttgttggagttttagtacgactggaacagtagaaggagcttattttcttaaaacaggaaaactggtctcttta

SEQ ID NO: 3222 - DNA, 1206 bp, Diabrotica virgifera
tctcgtgcgaaacgaagacgctccagtatagcaaaaagtgtcgcctagacgataacggtgcctgaactaggtggagctgttaatcctgctgctgtgttggacgacgacttgggagagatttctggggaattcggagacagtgtttcggttactagtaggacaggaagaagagtgtctattgctcctgaacccacggcagaacacattattccagaactaccaccagacgaggaaccggaagtgtccttcaaagattattttaaatttgtccaatcgcatcacatgcgcgccttgatatggaaaaatttcctgtggatgtggagaaatattcccatgatgatgttcattatcggtttaccaataagtcagaccattttgttctgttggactatcggacacgaccctcaaggaataaaagtatcagttgtcaataacgagattaatttccctgatgagacttgtcatcagcaacctctaaattgtaatggtacaaaaataagttgtaattacttgaacgaagtggctaagagttattctataacgtgggaatttatgaaaacggaagaagaagcgagacatagagtggaacgaggaaagtcctggggtgttgtagtcgttccacacaatttcaccgacgcgctttggagtagaattgaaaattcgagagatactcctccagaagatataatggcttctactatcagtgtctatgaagataaatcaaatgaaaacatcgcaactttccttacacgagatatgctgtatggattcctcacctttatatctgaatttgtgaaaagttgtggatataatgaaaaaagtgttggcgttcctattcgatacaatgaaccaatttatggataccaagacccagattttaccgattttgcagcacctggagtagtcttgactatcatcttcttcatggctgttgccctcacgtccggttcaatgatcatggaaaggaacgaaggaatcttggaaagatctttggtcaacggcatcagcggaacggagctgtggtttcgcaaattatcccccagttcgtcgtcatgttgggacagtccatcgcagtacttcttgtcgctttcattctctttggtttaccgcaacgaggaaattggacgacggtgacaaccttgactggaacgggccggtatatggggaaggggttttggtttccgggggggccggcagtttgggaaa

SEQ ID NO: 3223 - DNA, 940 bp, Diabrotica virgifera
atttttatcttgatacttaataattttgcagtgaattgcatcattaattcctatccaaggagccaagagcaagtctgaagatggttgacggaaaaccaaacgagagtaccactagcaaagcagccttgaaaaaggaagcaaaaaaggcagagaaggcagcaaagaaagcagaacacaaacaagctgctggtgaaactcaacagaacgttgtagaagaagttgacatatcagttggaaaatatggaaatcttccccttataaaatcagaaactaagcacaacgagaggactttcacctcagtaagtgacctaaataaatccgtgtctggaaaaactgtatggataagagcaaggttacatacttcaagatcaagaggaaaacaatgctttattgttctgagacaaaaagaatttactgtgcaagccattttaaatgtctcagacgtcgtttcaaaatctatggttaaattttcaagtggggtacctaaagaaagtatcctcgatgtcgaagccaaagtatcagtagtgcccaataacatagcaagttgtagtcaacaggacgtggaactagttgtttcacagttatgggtagtgtccttgtctgctccacagcttcctttgcaaatagaggatgcatccagacctgaaaaaccagaggaagaagaaggtttaaatatccgggtaaatcaagacacaaggctggacaatagaattttagacttgagaacaccaactaaccaagcaatttaccgattggaaggaggcgtctgtcggctgtttagggaagcgcttactaagaaagggttcgtagaaatacatacgccaaagatcatatctgctgcttcggaaggaggtgctaacgtatttactgtaagttattttaaagcatccgcatatttggctcagagccctcaggtttctgaacaaatggcgatagcagc

SEQ ID NO: 3224 - DNA, 1722 bp, Diabrotica virgifera
  misc_feature (1565)..(1565): n is a, c, g, or t
  misc_feature (1578)..(1578): n is a, c, g, or t
  misc_feature (1586)..(1586): n is a, c, g, or t
  misc_feature (1649)..(1649): n is a, c, g, or t
ccctttcccgcgtccggaccataaaaagtatgcggacgcgtgggcggacgcgtgatgatgaaattacccatagttttattgatattaacaatagtgtcgtctttaaaaggacttaacatagatgataatgatgattttccaggatacaattatatgaatctaagttcagacccatgtgaagacttttttgaatacacctgtggaaattttaaaaaattatatccactaagtgaaggagtattaaccatcgaccaatttacacttttagatgaaaaacttacagaaactgtaagattaatcctctcagagaatgaacgtgacgaggatccagtagctttgagaaaagcaaaagctgcttacagcgcatgtatagatgaagactatctagcgaaaaggaaaaatcctgaaacaataattgtagccaacgaacaagggtttccgttaacgcagctaccatgtcaacaacaagccacaaactacagttttctagatattgctgatgctgtaagcaagtatggtatcccgatgctgtttaacgtgataactacatcaaatccaggaaacgcttccagtaatatactctttatatctaaggtagatagtttgaccgctgcacaaattcgacacaaccatggtacgtcatacgaaaatataattgaagaaggttttgtaacaacagatggatctgatagaaaaagttcacagagtttaaaaccatttgacattttcctgaggcaaatgtctttaaaattgaggaatgccactgaaagttttctaactgataccgaggtttttactaacttggacgatgtcgtccagtttacaagagctgtgtttagcgtcgctaacgtggattatagtaacgctgcaatattgcctatattgggagatgacgtatatacagtaactcttgaggatataaatacttggactgaaaaacaatttaatgatactgttaaactaaattggattgaattcttccaacattactttgcaaacgctggtatagacataacagcagacaccaggctgctgaattattcagggttggacaaaattttatacggaatattgaacctggtgaaatcaactcaagatcatgtggttaaaagttatgtaatgatgcgaatctttacacatttggcacttgacggtgatgcacattcaagaaaactcatggaggattatttcgctggaataaatgttcaaatttaccctagaaaagaatactgtgcaagaaaaataatggactctacgggaacagcaggtttggcttttgcagtagcatatggatatcaactaaatcattttaatgttaataattatcaagaggtgatccagttgatagaagacctaacagattcatttagagaattaatacaaaatactacctggatggatacacaatcaaaggaagatgctgttgctaaattacaacgcatgataatgatattgggacatccagacatttcttacgacaaggagaacttggataaattttacgagaatctgaaaatctgcaaatggaatcattacgggaattcaataagaataaaagcttttanaaacgcttatcanatatcacnaatatctaaaaaggggaagaagatttttgggataaatcaccatttgaagtaaatgcttattantataaagccaataacaaaatgatttttcccatagctatgctgaatccacctgtttttttggtagcggtagcag

SEQ ID NO: 3225 - DNA, 2640 bp, Diabrotica virgifera
cattacgcgtccggtcaaatttctaacccttatagtggatatcatgtcattttcttcctaatattgaatatttgtttaaattttaaacactaaggtatgctgcgtttcacggtttcaaaagtccttagcggggctaaagctagcccaaaacatttatttgttgccacaagatgtcaaagtggcgaagtaaaaaaacctgaaaaaatagaagtattcatagatgataaaccagtgatggttgaaccaggtacaacagtcctgcaagctgcagctatgattggaattgaaattcctaggttttgctatcacgaacgattagcagttgcagggaactgtaggatgtgtctggttgaagttgaaaaatctcctaaaccagtagcagcctgtgccatgcctgtgatgaaagggtggagaattaaaacagactctgaaatgaccaaaaaagccagagaaggtattatggaattcctattagtgaaccaccctcttgattgcccaatttgtgaccagggtggtgaatgtgatttacaagatcagagtatggcatttggttcagaccgttcaagatttactgatatagacttttctgggaaaagggctgtagaagacaaagatattggaccattggtcaaaactattatgacaagatgtattcactgtaccagatgtattagatttgcttctgaaattgcaggcgttgacgatttgggtacaactggcagaggcaacgatatgcaagttggtacttatgttgagaaattatttatgtctgagctatctggtaatgtcatcgatttatgcccagtgggtgctttaactagtaaaccatacagtttcacagctagaccttgggaaattagaaaagtcgattcaattgatgttttggatgccgttggttctaatattattgtatcaaccagaactggagaagtaatgagaattgtacctagagtgaacgaagagattaatgaagaatggttggctgataaatcaagattctcctatgatggtttaaaaagacaaaggctagtaacaccaatggttaaaaacaatcaaggtgaactgaaaccagttgattgggaagtagctttgttgactgtttgtaaagctattaaacaagcaggtaacaagattggagcaattgctggaggattagcagatgctgaagctcttgttgctcttaaagatcttttaaatagacttggttcagaaaacctctgtaccgaacatacttttccattggacggttctggtaccgaccttcgatccagctacttgctgaataacaaaatcgctggtgttgaagaagccgatttggtattattggttggaagtaacccaaggtttgaagctcctcttctgaatgccagattaaggaaaggatttattcacaacgatttaaatgtagcttcgatcggaccgaaaatcgacctaacctatgaacacgaagatcttggcgacgatcctaaaatcctacaactaattgtttctggacaacatcctttcagcaaaaagttgcaagctgccaaaagacccctaatcattattggatcagaaactttggaaagaaaagatggcgctgctattctttctgcagcacaaatattggctgctggtacagccagtggaaacaaagattggaaagttttgaatgttttgcataaagttgcaagtcaggttgctgctttagatattggttacacccccggtgttgataagattcgagaagcagacgtcaaagtactgtttcttttaggagcagataacggcgccattgataagtcagacttaccaaacgattgcttcgtaatttatcaaggccaccacggtgatcaaggagccggcatagctgacgctatcttgcctggtgctgcttataccgaaaaacaagccacttacgtaaacacggaaggtagagctcaacaaactttggtagctgttaccccacctggtagggcaagagaagactggaagataataagagctttgtcagaaattttgggagttaaaatgccatacgataacttaagtgaaattagggatagactagatgaagttgcaccacaccttacccgttacgggcatgcagaagaagctaattactttttacatgctgcagattaagctaagagtagataatgagacgtagatcataattatatggtatattttaatataatagagtatgaagagtactacatgactgatgctttcagtacagattcatgttaatttaattaagtgtgtgcaggctgtatttgaaacaaaaacagtccaaataaatagtggtgtaaaagtaaaataatttaattttaaagaaattttatttaagaaaattcttccaaaacgtcattcatttttatattttctcagctaaactgtttcaaaaaagcatattattaataaaaaaagaaactaatttaaattttaccatttttatcaaaatttacccttggttttttttttttcttttaagcaaattttaaaaaaaaattggaaccccttttgtaaaaaaacgctttttttataaaaaagggaaaaaaactctcttttaaaataaagccataaaataccacaaaaatttttttccccccttttgaaaatattttttttatttttggaaaaaaaatagaaaaaaaa

SEQ ID NO: 3226 - DNA, 2086 bp, Diabrotica virgifera
attcagtattccggctattgctttttaatcattattcaattttggaaagtttaaaactctgaataacactgttattaaatatcagagttgtatgccttgtggatatagcaatgaattgtaggataagaactctcatcctggtggttttattaataggtggagtaataggtgataatgctgatgatgatgacataacagttgaaacagtagatgaatcagttcctgatgttgcttatgaaagcccagtcccattagatcccaagaaagtgtacttcgcagaacattttgatgatcctgcactatttcaaaagcgatggattaaatctcaagctaaaaaagaaggaatagaagaagacatagcaaaatatgatggacagtgggaagtagaagctgcaacaaaagatagcttacccaatgacagtggtttggtactcaaaactaaagccaaacatgcagcgatttcagcgcatctatcaaagccgtttgtgtttgcggataagccattgatcttacagtatgaagtactgttacaagaaggccaagaatgtggaggatcttacttaaaattactaagtgagggtccagaatccaagaatctcaataatttccatgataaaactccctacactattatgtttgggcctgataagtgtggaaacgatcataaattgcattttatcttcaggcatagaaatccattgaatggtagcatcgaagaaaaacattgtcagaagccaaaggaacgcctagaggagtacttttccgataaacttcctcatttatacaccttaattctaaatccagacaatacttttgaaatttccgtagataagaaagtagtaaactctggaagtctacttgaagatttcgtacctccagtaaatcctccagccgaaatcgatgaccctaatgataaaaaaccagaagattgggatgagagggagaaaattccagatcctgacgatagaaaaccagctgattgggatgaagatgctccaccacaaatatttgacgaatcagagtcgataccagaaggttggttagaaaacgagccaactcacgttccagatccagatgctataaaaccagcagactgggacagcgatatggatggtgaatgggaaccaccattgatagaaaatccagcatgcaaagctgccgcaggatgtggacattgggaacccccattgatcaataatccaagttataaaggtaaatggagaccacgtctcattaccaatcccaactataagggaaaatggaggcctaagaagattccaaatccagattattttgatgatcaacatccattcaagatgaccactgtgtctgccgttggtttagagctttggtcgatgtctcaagatattctttttgataatttactcataacagaagatataactatagccaataaatgggcttctgatacctttgacaagaaacgtcaaaaaattgccaaggattcggaaagctttgttcaaaggttagctagccttactaacgaatatccattcctatgggcggtttacattcttgtccttgctgtacctgtaatatttattttgtacctttgctgtaaacccagttcctctgctagtcagaaacaggaaagagaggaactcaataaagcggcagaaacaaaaaagactgatgaattgactgagggagtcgaggaagagaatgaagcacctgaagctgaagaggaggaaggcgatgacgaagaacaagagaaaaattctgaacctgattcagataatgaaactgcggagccggaagagggcgaaaagagccagccttcaggagatggtaccagaaagaggaaagtcagaaaagaataaaaagcgattggattgaatcgcattatgttcgtgtatattttcgtcaacacccaaaaaagaaaaaatcgaactttttctaaattattgatgtgtacgattgtagctgaattctcattacgttttattttaaactatcgtcactaagtatcaccttgtatatggtcctttccgtcccagacttggatatactacacctaaaaaagatgggaggaatttgcgtttattttatatttatttcctaagcc

SEQ ID NO: 3227 - DNA, 950 bp, Diabrotica virgifera
  misc_feature (944)..(944): n is a, c, g, or t
gctaatgtgcaaggtggtggcatgcaagctcttggtaagggtgttaagacaagggacacatacaagagaagtcaagtcaagagatgggggcaaggtcgtcctcaaataaaaataagggatgcatcagttactgtaagaccagactggagtactattgaagaaatggacttccccagacttggaaaattgtctctgccaggaattaaggatggtgacgatgttttgtgctgtggtgaactggaatattacgataagtcttacgatcgtgtcaatgttaaaaatgagaaagccctacaaagtgtcaacagaattttccatactgttactactacagacgatccagttatcagaaaattgacaaaaactgaaggcaatgtatatgctacagatgcaattttggctaccattatgtgttgtactcgttccaattattcttgggatattgttattgaaaaaataggcgacaaactatttttcgacaagagagacaacacagaatttgatttactgactgtaaatgagacatcggttgagccccctcaagatgatggcaactccttaaattcaccaagaaatttggctctggaagctacattcattaaccacaatttcagccaacaagtactgaaaataggtgcaaatgaaccacggtacaagtttgatgatccaaacccattcatatcagaagaagaggagggagaaattgctagtgttgcttatagataccgcaagtgggatcttggaggaggaattacattggttgcccgttgtgaacatgatgccgtagtccaatctcccaacggtgaactccaattccttaccattaaggccctaaacgaatgggattcaaactggccaacggcgtcgaatggcgccaaaaactggataccccacgaggtgccgtctagctaacgagctccgcaccacgcttgcaaactggctanatggac

SEQ ID NO: 3228 - DNA, 2044 bp, Diabrotica virgifera
cggacgcgtgggcgtccgggcagtttaggtttaacgctttgaaatattttaggtggttgtttttaattaattaggtgaagtaatgactatgaccgattatagctcaggaggagaggctccgcactttgtggcgcctgtaattcaagacaatcaagccggatggggaccttgtgaagtgccagatcagtttaaggatatgccttaccaaccctttagtaaaggtgatcggctaggcaaaattagtgattggactggagctgcatttcaagataaaaaatatgctaataaatatgcttcccaatttggctcaggtagccagtatgcgtattaccatgatgaagatgaaagcactttccatttggtggacactaccagagttcagaaacctccataccagcgaggtagattccgtgctaatcaacgtaatatgcgcggaaggggtggtagagctaatgtgcaaggtggtggcatgcaagctcttggtaagggtgttaagacaagggacacatacaagagaagtcaagtcaagagatgggggcaaggtcgtcctcaaataaaaataagggatgcatcagttactgtaagaccagactggagtactattgaagaaatggacttccccagacttggaaaattgtctctgccaggaattaaggatggtgacgatgttttgtgctgtggtgaactggaatattacgataagtcttacgatcgtgtcaatgttaaaaatgagaaagccctacaaagtgtcaacagaattttccatactgttactactacagacgatccagttatcagaaaattgacaaaaactgaaggcaatgtatatgctacagatgcaattttggctaccattatgtgttgtactcgttccaattattcttgggatattgttattgaaaaaataggcgacaaactatttttcgacaagagagacaacacagaatttgatttactgactgtaaatgagacatcggttgagccccctcaagatgatggcaactccttaaattcaccaagaaattttttgcttttagctacattcattaaccactaattcacaatacaagtcccccaaatagatgaaattgaaaaaaaaggggagtttaatgatccaacccccatcatatcagggtttttgatatgagaaattgctagcgcgcttatagataccgcaagtgggatcaaaaaaaaagaattacattggtgcccgtgtgaacagatgccgtgtccatctcccaacgtgactccaattccttaccattaaggccctaaacgaatgggattccaaactggccaacggcgtcgaatggcgccaaaaactggatacccaacgaggtgccgttctagctaacgagctccgcaacaacgcttgcaaactggctaaatggaccgtccaggcacttctggctggaagcgatcaaattaagttcggttatgtatctcgtgcccacgtcagagataacagcaaacatgttattctaggaacgcaacaatataaaccacacgaattcgctacacagattaacttgaacatggataacgcttggggtattttgaggtgcatcgtggatattgtcatgaagcagaaagatggaaaatatttgatcatgaaggatccaaataagcccatgatccgtctctatgatattcccgataacacttttgaatccgacggggaaactgaatctgacgacgatgtcccagaaagctctacagcatttccattgtattcctacagttctagttccaaacgttaagaaaattgcagtgttaggtattaattcgataaaaagagataaaccataaaccaagcatataaatcatacataaataaccaatttggggaaacgaagaatggtacatacacaaataacaacaaaaatcaaaaggtttatctgtttttatggaatttctgctgtggtatctgtatttggttatattggaatttttaatgaaaatgaaattaaatattagatacgcaataggcacatgtagtgctatatatgtgctatttgataaataaaacttgcatatacgttgg

SEQ ID NO: 3229 - DNA, 1669 bp, Diabrotica virgifera
  misc_feature (1623)..(1623): n is a, c, g, or t
taacctctcacctgatcacaaccttgtgctaattccgagcaaggatgacatacatccacatgtgatacatttttaatcttaagacatcgacttattgtcgattactatacagctcataatgtagcaataatgttattttgaggttttacacctattcaagtggctagtttcaattacttgtacactggacgtttacactgaggatggtcagtttgaccgaaaacgttttgtacaaccactcccttgtggatgaattttaaaattttttaataaatttataatatacctatatacaacagaagtgtttacttcattctacgttgtcttaacaaaggtatacagccaactacagggtttacccttttaatgttttatttaatgacgatatggtcaacttggctcttaagtacttgcggctagctacaaagaggaacaacactaaattggatatatggttcatatctcaatgccttaatcacaaagtcattccaaatttttgcagagtaaaaacatcaaaaaatgtacctccaaacatcaggagctcactacaagttaaattaatgaagaaggagatatgtaaccactatggaaaattaaactacctcaactgtcaacttaagttgatatgatccaggtcgaatccaatagcatgggctctccgatatcggacttcacggatgacaacttcgaagaagaactagcagaagcttgcgaggagaacttggacagtctgatgttttgttcgacttcatatccagaagtcggagatactgctcccgaaaagttttctgagatttcgagatacgggatcgtcgatgtcaaaggagatgatgcagatgggagaaaaattattgtcgtttacgcttgtaagttgcctcaaattaaggagattgatcatggattgttgttaagttatttgaaatataccttagaaagttatgtaaagcaagactacagtttaatttattttcaccacggactgacgagtaaaaacaaaccctcgatagggtggttggtccaagcttataaagcattcgacagaaattacaaaaagaatctgaaagcgttatatctagtccatccaacgagctttcttaaattcgtttcgcaactgtttaggccccttatcagtgccaagtttggaaagaaattgaactatattcacaggctgaaggagttaaatgactttataccgatagaaaaattggatattcccaatgaagtgatagaacatgataagaaactcgggggagaggttccagtttcaagaacgtctcccgactctgtttatgagccgacgtgccctacccaacaattcggagttactctgcagtacattagggatcagtacaatgtaatcattccgcctattgtgaaacaatgtatagaatacttagaccagcctgacgcattagaaacggagggtatatttagaaggtccgccaacgctaacaaagttaaaagtctgaaagaaatcgcaaatactggccaaaaggtaccttttgaggatccccatgaagctgctgtattactgaagaagtttttgagggaacttaaagaacctctgttgacttatgaactgtacgatgaaattgtacaatttcaaagttggaataatgatgnaaggctgaggctggtgtccatacttgtaatggggaaactaccagaa

SEQ ID NO: 3230 - DNA, 930 bp, Diabrotica virgifera
actttggaaaattgtgataaacaatttggaagtgtaactttaattactacacagttgattttatttcgacgattacagtaaataccgcgatgtgctaaacatacgagatgtcaatgcctacgcatttggtcaatacaaataaaccaccgaaaaatctaaattagaatggccgagggtcacagcagtgacgattctgatctggaaaacctaaatgagtttgctggggtgttgagtaaatggacgaattatatacatggctggcaagacagatacatcgtattaaaaaacggagcattatcatattacaagagtgaacaggaatgcgattatggatgtagaggagccctgtcacttgcaaaggctgttataaagccccatgaatttgatgagtgcagatttgatgtttcagtcaatgattgtgtctggtatctcagggcgatctccgtagagagcaagcagagttgggttgatgctttagaatcatttaaggttgaatcaggatatggtactggttctgaaaatagtttaaaacgtcatggatcgacagtcagtctacagtccaacacatacagtacagcttctggtagcagttttaagaggtcatccagaaacatcacggagaaattatcacagatcggtacattccaggatatttttatgcacacagatccataccttgccaaggatactttgatcatttgcgtggacccgaatgcgacaaacggaattacaaaaaaaagaaaactttccggtggtggattttaaaggagagggaaataaactttaaacccacccccaccgctggggaaaaaaaatgggaaatattgttcaaaatttggtgcctcaaagaaaaaaaacctaggcgccacacccctccaaaaaaaaaattgaaaaacgtaaaagggcccaaacccttgccccaatcctttt

SEQ ID NO: 3231 - DNA, 1133 bp, Diabrotica virgifera
ccgaacagtacctagttggtaccacattttagttgtcatgttgaaatagctttatttaccagcctaaaatgagagctatttttattagaaaaaaacactttttctccttcgtggccgttgtgcttgtgatttggttgttaggatttgtttaccttctagcagatagcgatttcttcaagtatttcagcaatgaagaatcaaaccagaggcaaatagacagatttaacaaaatatttcgagacggcagggaaaatgttcctggtcctattgcccctgacatcaaaatgcagaaaccgtccgtacaaaaaatagaaatagaggaagaaccaacaccacctaaagtaaaatatggagatatgggtaaaggtgtaagtcttccagattacttgccaccagaattacaagctaaaatagatgaaggctggaagaatcatagttttaaccaatatgtaagtgatttgattggtgttcgaagagagttgcctgactacagggatgaatggtgcaccatcccttataggtacgaaattaagcttcctagaacttctattataatttgtttctttaacgaagcctggtcaacattaattcgatctgtaaattcagtgttagataggactcctccgaatttgttggaagagattattcttgtcgatgacttttccgatatggatcatttgaagagtccactagaagagtactgggaaagcgagccaaaagttaaaatcataagaaacacccaaagagaaggtctgatcaggtctaggttgataggtatgtcacacgccaacgctgagatactaacattcttggactcgcatattgaagctactcctggatggctagagccattgctagaacaaattcgtgtcaattatactacagtagtatccccagtgatagatagtattaactatacaactttttgaatatggtccgctcaaaaacacatttttgttgggggattttgaattggaatttggggttttacgggggccatggacccaccccgaaaaaaatgaaaaaaggcatgatccccgcagaaaccccgggaccctccccctaaaagggggttggggggggcccggtttaagttaacacacaaaaaagtctttttcttaaaaaaaaaaaca

SEQ ID NO: 3232 - DNA, 884 bp, Diabrotica virgifera
aataaaaaaaaagggcggccgctcgcgatctaaaactactcggacgcgtgggcggacgcgtggggtcgattaagtcagcggaatcgtggaagtgcatgtatgcggatagaatgtgaaatacttattacatacttgtattgtgtgcttggcctgattctacaaccttcccctgtttaagttgtgttcaagaatttgaactttttgatttgtgtcttggaatacattgtttttaagaactgataagtttttgttcatgtttcgttttattgtgattgtttattaggtaactggctatgaggggggggttcgatgcatttccaaatgatggtgggcctaccctgcactactttaactacagaacctcagtgactggggatgtcacctttatcacatttttagctgtattctctacgttatatgtggcctttctcattatctattttggcatcaaaaaaaaaagatgttctactttttgtgctgtgacgttaagtctgtttataggggcaactattttaataacattatatggatcagcgtggcatatatcaaaatctcaactatgtcagcacttatcaagctttttcccattaaaagcttaaagctgacatcggagtgtatgtaggattaaatcatgtaaatataactttacaagcaaattctcccaaaaactggagtgatatagattttggggggggttttttattgttcgatgagcaccatttttcaacgttggggaaaggggcccccattttgggactcaaacttccatattgactgtagcttgttacgttactacaggactttccccatttttcgctggtgggcggaacagatctgctggatattttgaaaaaaaaaagctttggacgtgggggggggggggg

SEQ ID NO: 3233 - DNA, 2574 bp, Diabrotica virgifera
cgtgaatattcgataattttgcagttactaattttttactgtctttgatagacgtctcctgtacacgtaaaaatggcttcgacgatatcggcaagacaggctaacagagaacatgttttggccgtatccagagacttcatatcccaaccaagactcacttacaaaactgtatctggtgtcaacggtccactagtaatcctcgaagatgtcaaatttcctaagttcaacgaaattgtccaactcagattatctgacggaagtttaagatcaggtcaagtacttgaagtcagcggttccaaggctgtagtacaagtattcgaaggtacatcaggtatcgatgccaaacacactgtctgtgagttcacaggagatattctcagaactccagtctctgaggatatgttgggaagagtattcaacggctctggaaaacctattgacaaaggtcccccaattctggctgaagactacctagatattcaaggacaacccatcaacccatggtcccgtatctacccagaggaaatgatccaaactggtatcactgccatcgatgtgatgaactcgattgcccgtggtcagaagattcccattttctcagctgctggtctgccacataacgatattgctgcccaaatttgtaggcaagccggtcttgtcaaaatcccaggcaaatcagttttggatgaccacgaagacaactttgccatcgtgttcgctgctatgggtgttaacatggagactgctagattcttcaaacaagatttcgaagaaaatggttctatggaaaacgtatgtttgttcttgaacttggctaacgatccaaccatcgaaagaatcatcaccccacgtcttgctctaacagccgctgaattcttggcttaccagtgcgaaaaacacgtgttagtcattttaactgacatgtcttcatacgctgaagctttgcgtgaggtatctgccgccagagaggaagtacccggtcgtcgtggtttccccggttacatgtacaccgatttggccaccatctacgaacgtgccggtcgtgtcgaaggccgtaacggttccatcactcaaatccccatcttgactatgcctaacgacgatattactcaccctattcccgatttgacaggttatattaccgaaggacagatctacgtcgaccgtcaattgcacaacaggcagatctacccaccaattaacgtactgccatctctctcacgtttgatgaagtctgctatcggcgaaggtatgaccaggaaggaccactctgacgtttctaaccaattgtatgcttgttatgctatcggtaaggacgtccaggccatgaaagccgtagtaggtgaagaagctctaacacccgacgatcttctctacctcgagttcctaacgaaattcgaaaagaacttcatcacccaaggaaactacgaaaaccgcaccgtcttcgagtctttggacatcggctggcaactactccgtatcttccctaaggaaatgttgaaacgtatccctgcaagcacattggcggaattctatccaagagactctcgtcactagttggtttatgtataaaatttatatatatttaggaagtttgttaggtttgttacaaatatgtccacttattgtatcgattattttcaattgagagatattttaccaaaacaatttgagccgatgagattctacggtgtaatttttgtaaatacttaaagagcgtgtttcaaaaatgcgcttaatataatatattatcaatacagagcaacctttttttctttattattttttcttgttgaacaatatataaagttcttgaactccctaagtggaacatagagcttcagtgaaaatgcaccatcacctcattccaagactttccttgacttcttaccaattgttggacaattataactcagattaattttactaggtgacagttccataagtaaaaatatgcaatggctatatattgcgtactaaacttaagaagaaaaattgtgtcgctctggaagaaagattacttgcataagaatgaaaatcagtgtcatattttgcgtttatgacatccctagacgatactattttttcgttactatattttttttaaagagatcaagagcaacaatttggagactgatattcttatgcgagttgttttcttaactttgtcctattttgaagagtctacaattatttacttaccatttgattaaattagatgaacataagacaatactatatttttatcatgtaagttgatattccctatgtaaattattggcacaatgtaacctccaacttgatttatacatttattttacttttgtttgtctattttttctgtaatagagtggaagaattaacattccattaaatgtcattgcccaatgtataaagcaatatacctcttaccattcgatgctttttcagtattttaattctagatggtgaacggagatttttcttgatgtaggttttgacattttcgatgttactgtaaaaatctaattttatgttaaatagattagtgtacaaaaatgtgaataaacactatacatatgtttgttaaaaaaa

SEQ ID NO: 3234 - DNA, 1039 bp, Diabrotica virgifera
acgagtacgaggacaaatacaaattcagcgttgtgtttgctttgaatcaaaacacattcttgtgagtcagacgaaggcgttgtgtgaaaactttgtagaatcaatatttgaatttgctcgtttaaaaatcagtgtgaattacatttaaaaatggcaattagtcggttatctatcatcaaatttttggaattggccattgccatcgcatgtattggtcttcactacaaaagcaaaaccaatgacttagacaccgacacattatcctcagcagcttttggaggatatgttattattttgataggaggatttgcaggttacctcatgagtactccattcaacaaaaggatcgacatcttcttctccctggtcggttgcgccctcttcgttgccgccggtgcattgaacattaaaatttatgacaaatacggaaaatcagaatggagagacttcggcctggctaaagcttcattggctattgtcaacggagccctattcctgttggactccctcttaacgtggagaggcgatttctaaactattttaagttgtttttaaatataaacgaacataccaacagataagttagcgatttgttaaagctacctcgattattgactaaatgtgaagcagattgttaaatattttataggtactcccttagtccataaatatggcaaacattttggccttttatctcattttttcggaaatatgtacaaatcaacaaaaatatctgaaaccgccaaggtcagacaaggtcagaaaattttaactacgcgacgttgtcagatcaataggtttaaaaggtttttagattttttatttattatctattttacagtaaaatctccttctgctttctcctgtgtaaattttaaaacattgtatataatttcgcgagattttgcgcttagtgtcctatttttcacggaaccttacatagtcatgtataatgaaaaaatattaaatggacaataaataacaactattcgactattttatgtggccatgttgcgaaaccactggtttcgtgccccat

SEQ ID NO: 3235 - DNA, 1890 bp, Diabrotica virgifera
  misc_feature (523)..(523): n is a, c, g, or t
  misc_feature (687)..(687): n is a, c, g, or t
  misc_feature (786)..(787): n is a, c, g, or t
  misc_feature (814)..(814): n is a, c, g, or t
gatatgaaatggggcaataagaactctttatggtaccgaaaaaaggatttgacaatgttcccttacggaaacattggctggtattagtcttcagtggtgacactgtagagacttgtcttgtaccctattcacaattaaatcaagaactacttcatcatatgtttgaaaacattcgagaaattcgaaatgttatgcagttttatctgtaaaattaatgcactttttaaagctgagcactaggttttgatatactttcgtcgtatttgaagctaatctgtctaagtagatatgaaatcgaccaatagtagctctttctgcttcctaaaaaggaatttaacaatgttatcgtacggaaacattggctggtattagtattcagtgtggtgatactgtagagacgtgtgttgtatcctatccacaattaaatcaagtgcgaatttatcatcattttgaaaatgttcgagcaatatgttacgcaaattggcgcaatttgtgaaaaatcaatgcactttttatacctgangcactaggtttgtatatacttttatcctattagaatccaatttttcgatctggatatgaaatggactaaaagaaatctttctggtcccaaaaagggatttgacgatgttgccttatggaaatattgattgatattaatatccaatgtggtgacactgtacatangagacttgtcgtgtaccctgttcataattaaatctagtacgaattcgtcatttgtttgaaaacgtttaagaaatttgaaatttttacgaagtgtcttannatctgcgaaaatcaatgcatgtattanagctgagcactaacttttttcttcgtatttgaaagaatatctcgatctagatatgaaatcgtccaatgtcaactctttctgatccagaaataagaatttgagaatgttcccgattggaaacattagtttctattgaaatttagtatggcatttatggcatactaaatacatacggcatatttatggcaacgaattcaccatctgtttgaaaacttttatgaaattccaatcgctacgcagtttaatacgcaattcgaaatatgagtatcgtctgatactagttgggttctgcttagcttgccttcggtccagaccagaccaaggtttcttgggtcttcggtcacgttttcctccctcaaataaacgaccacaaacgagacgtgatagccccctcactataaaaagatttctttatcctcagacagtcttgccttgacggctttttgacatctgaacaattttgagaagagtaatttatgtgactgatttttttctttcgtgtgtatcacacttttgttgacaacagttaattcggtatttaaaagagtgtaacataacaataaaaaacatttttgatcaaaaggtagtattagattagcgctcaaatcgttttcgatttttaaaattttattaagaagtagcagaatggcagtttaaatgctgttgctgtagtttttagtgacctttttttactttagtgtaaatcattgaatataaaatgaaatggttataagaaacacttagatagataaaataacaactactgttattacagagataacttgtacgagatatgcatcatcagttatcttaggtttatttgtacattacttatgcaagactttggagaaacttcttatgacaagtttcccattttgtttttgtcaatatgatgtaattatcacattgtatatgtctatttcgttttatgttcaaagatataataatctttgatctataaattttggaattcattattacacaatcatttttgtgaatctgatatatttgctgtactgttagttattttacggtatatttaccttacacaaacaaaaatgtatgagatctactta

SEQ ID NO: 3236 - DNA, 1094 bp, Diabrotica virgifera
agtgtcttgaatcgagtccgcgcttcgatattccctgtgtctgtgtctgttcgctcgcgctcgcgttcgcgttaatccagttaccataacaccggccacgtgcgtgatgcaataacctccaactaaaaatcattcagaaaatgtgccataaataccactaaatatatttaaaacttctctaggaataattagagctatccaatacataaaatggggggtaaaagctccccgttatccaacgggaattcaaaaataaatgaaagtaatgatgccgacacggtgaaacttcagcgtaaaattacgctgatgaacggggttgctattatagtgggtacaataataggaagtgggatcttcgtttcaccccaaggggtttatgtagggacaaaatctgtcggtgcgtcgataatcatatggtgcttttcaggaatgttttctatgttaggagcgttatgttatgctgagttaggaacgtctgtgacaagatcaggaggagactacgcttacatatacgttgcatttggccccctaggagcgtttcttatgttatggatatcgttgcttatcataagaccaacaacacaagccattgttgccataacatttgcagaatatgctgccaaaccatttttcccggaatgcaagccacctgaaaacgctattaggttattagcagctgtttgtctatgtctgttaactgctgtcaactgtttgagtattagatgggccatgagaatccagggtgtatttacttatgctaaaattttggctctagtgggcattataataatgggagtatatcacttagcgagtggacacacagaaaacttcaataatgctttcgatggaaaatatgatctctcacatatagctttaagtttctactcaggcctattcgcatttggaggatggaatttccttaattttgtaacggaagaactgcaagacccttaccggaatttaccagagcaatatggattgcacttcctacagtaaccggtatttatgtactagcaaatgtagcatattttgctgttcttacgggagtggaaatagaaagttccactgcagttgctttgtcatttggaatgaaa

SEQ ID NO: 3237 - DNA, 925 bp, Diabrotica virgifera
agcctaacctctcttgtgacccaaagatttgggtgtaaaaaaataagtacaaaaaaataatttgtacttttaattgacaataaaccatttatatttaataacctacaataaatatggctgtaacaacaagaaatgtaccgcgattactagtgcaggcactacaaatcttaccaagaacaagtacgagaggcctatcatctggaatggctgaacgacctgatgcaagaacaacatgtaccttgatccctggagatggtgtgggtccagaattaatgtattcagtcacagaagtgtttaaggctgcaggaatacccgtggattttgacacatatttcttttcagaagtaaatcccacccttagtgctccattagaaaaagtagctgatagtatttcgagaaacagagtttgcttgaaaggaattttggctacaccagattacagtcatacaggggaattgcaaactcttaacatgaagctcagaaatgcccttgatttatacgccaatgttgttcatgtaagatctttacctggggtcaaatcacgacacagcaatattgactgtgttattataagagaacagacagaaggagaatactctgctcttgaacatgaaggcgtaaaaggcgtagtagaatgtttaaaaattgttactgccaagaagtcccaaagaattgctaaatttgcatttgactatgccactaaaaacaacaggaagaaggttacagctgtccataaagctaatattatgaaattgggagacgggttattcttaagaagttgtgaggagatggctaaattatatccaaaaatagaatttgaaagaatgattgtcgataactgtaccatgcagatggtatccaatcctcagcaaattcgacgtaatgggtactcccaatctctatggtaacattgttgataatttgg

SEQ ID NO: 3238 - DNA, 1605 bp, Diabrotica virgifera
gatgtaagtacatgtgtctttcagaaaaccgcatttaaaaagtgatagtgcatttgaataccagtgaaatagtgaattaaaaaaatgagtgacaataaagaaaaaccagaaagcaaaaatgaaaaatccaaatcaaagaaaaacaagcaaccggctcaaaatggaggtgattcaactgcagccaaagaacttaagcctcgtccagaatttatcgataacaggttagcaatatgggataaattaaaagcccagtatgaagctgaattggcacaaaaaccagaagaatctatcaaagttactttaccagatggcaaaataattgagggtgtcagctggaaaactacaccatatgacattgctaaaggaatcagccaaggtttggctgataatacagttattgcaaaagttaatgacgtcttatgggatttggacaggcccttagaagtagattgtactttgcagttgttaaaattcgacgatgaagaggcacaagcggttttctggcattcatcggcccatgtacttggagaagctctggagagaatatatggtggttgtctttgttatggacctcccattgattctggttattattatgatatgttcttagacagtaaaggtatatctcagactgattttcctgtagttgaaagcttaatgaagaacattgtcaaagaaaagcagccatttgaaagacttgaaatgaaaaaagaagatctgatagaaatgttcaaatataacgagttcaagcaaagaattctcaaagaaaaagtgaccactccaaccactactgtttacagatgtggccctctgatagacttatgtagaggacctcacatcagacatactggaaaaatcaaagcactcaaagttaccaaaaactcttctacctattgggagggaaaagctgatgctgagactcttcagagggtgtatggtataagttttccagatccaaagaaacttaaagaatgggaacatctacaagaagaagcagcaaagagagaccatagaaaaattggaagagaacaagaattgtttttcttccatgagttatcaccaggttcgtgtttcttccaacccaaaggagctcatatttacaacactttaatgagcttcattaaagaacaatacagaaaaagaggttttgaagaagtaatttctccgaatatgtacaatgtgaaactatggcagacttctgggcattggagccattatgaagaaaatatgttttcttttgatatagaaaaagagaagtttgcgttaaagcctatgaactgtccaggtcattgtctaatgtttgataatcgtgtaagatcctggcgagaacttcctcttcgtttggcagattttggagtacttcatagaaatgagctttcaggagccctaactggtcttactagagtacgaagattccaacaggatgatgcccacattttctgtacttcggaacatattagggatgaaatacacaaatgcttagattttgtaagttttgtgtattctgcttttggatttacttttgagctttgcctgtcaactagaccagaaaagtttattggtgaagcagaattatgggattctgcagaaaaagctttagctgat

SEQ ID NO: 3239 - DNA, 1259 bp, Diabrotica virgifera
aatttttaatgacactgccacatccataccaaatttctagttaatattttaattcgttataaccaaaccctctacactttatcaaaaaaggtattatagggtcgtatataaatataggtgtattcttatcactttatctgtattattgttgaatccatcggtgcttcgtttattcgttagactgtgaaaaagtagataacagaaactagcgactagcgtcaatatgtgcggaacagcgatgggttgtgccgaagggattgtgaaattgtttgtgtttggggcgaatatcatttttgctctcggtggtcttgctttaatcgtcgtaggagtactatacaaactaaacataaatgattttactgaagctataccagaagaatacagctcaataggcgtagctcccatactgaccattgtagtaggctcaataatatttgtcatcgcattctttggatgctgtggagccattagagaaagcccatgtttgcttacaacgtacggtgtaatattgttggtaatatttttgcttcaaatcgccgttggagtctttgcttttatagaaataaaggataaagataatttcaaaacccaagtgaacaagcaactggatactttgtttaatagagctaaggaccagaataaacacgaattaacagatttaattcaaaaagaatttgaatgctgtggtcctgacggtccatcattttggggagctagtataccaaaatcatgtttggattcaaataacaaacaatatacggatggatgcaaaacagagttttacgattttcttaataaagccatgaacgttattggaataactcttctggcactgtcagccctcgaggttattggttgtgtattttcactctgcttgtccagcagtataaagaacagggaaagaagattcaggtactgaggtttctcaaagaaatattcagccttaaggaaaataaaagtcttacttatttaagtgaactaattagtatgttaacatgtttctctaataaacatccttccgtttttctaaaaaaaaaaaaaaaaaaggggggccccccctcaaaaaaaccaaacttttcatacccggggggtgggaaccccataaattcttcttttaagggcccctaaaataatttttcgcggggcggcgttttaaacaccggggggggggggaaaaaaccgcggggtacccccccttattcccccccccgcccacacccccccccctccccccccggggggaaaaaaaaaaaaaaaaa

SEQ ID NO: 3240 - DNA, 354 bp, Diabrotica virgifera
ttttagttttgtgtcgtacccgtatagcacgtacaaattcgtttttattaaaagaatcatctagctttttgaagctagacctcttttaatagaaccaaaatgcgagcgaagtggcgtaagaagcgtatgcgaaggctaaagcgtaagcgcaggaagatgcgtgcaagatctaagtaaatcattggaacttcatctctactagtattttctttgaagatttagaagatgtgaagttgcattctattgaaaaaacggaaaattggatcatcaatcgcatttttttttataaattgacctgttggtgtgaaaaaaccaaaaaaatatataaaatattaatatacatcaaactaaaga

SEQ ID NO: 3241 - DNA, 1413 bp, Diabrotica virgifera
cagactttaaatactaaaaagtagtcaaaacttagatggactatttctacgtcctttcttctccatttgaatggcttcaatttgcttaattgctaccaggctccatgcttacactccatacaataatcttgtataaatgtatctacgttttctcaaatcggtatcaaagatccagtgatgggtgaattttgtttgccttcccggactgctttgagtttcaatattcaattttcaatttcaagtttcaaatttggttgatcaagataggctgttgtccaacagttttcgcgtagtgcatacaaagatgatattcctgtgatttagattccgtatgaagactcttatttctgttgatatctatagatcctcctcctctttagtcctaatttcttacagaagtataatgactccatcaatttttttttacaatttccctatatccttctctatcctgagctagctgtttagcttcttgtaaacctatgttaatcagtatttgttattgatccatccaacgaattgaagagcttcccctaggtttttttccttcaactctgccctcgagtatcagttttccatcatacctattcttctggcaatgcgtctaaaatactgtaaatattacaaaaacatgtaagtactagcaaatgttataataaatggatattaaaaaatgttctaataaacatcttttctaattccattttttattaaccacggatttaaatgcagagttgccaaaaggtttcaagaattcggagatttatttttcaaatatattaggacctataaattttaatatagtataaaagttttgatgactctgtaacgcagactattaagcacaaagattgtgttgaaccaggttctaaaggtctttaaccaggatgttcttctctttggacctcgctttaaaaatattttttctttcagggttgcttataaaaaggcatattttggatttattttcccataatctggcccgaaatattggcccaaactttcgagaattaataatgggtcaaaccctaccattcctttgggggacctttgtcattttgtgactcatccataaaaccgggatcttggcccaggagggacatctccaatgctttccaatcttttggataaatttgaagggccccgaattaaaaccaaaaaaaaaaaatttataaaaattttaataacccggtggaacactttttaaaaaaaaaaaaaagggcccgggggataaaaaaatcaatttttttttttcaacccctttcaatcctcccaactatttttttttgaacaaaactcccctattccaaaacgaccgcgcccccatttattacatacctaacactagacactacagtcttttattttttgttataaaaaaaaaaatgaaaaaaaaaaaaacctgtcttcttt

SEQ ID NO: 3242 - DNA, 935 bp, Diabrotica virgifera
cccacgcgtccgagtatctaaccaatctttttttttttaagtttttgataatataaattttctttcagtaatcttagaggatgtacatttctataactttcgacaaattatattttctttaaccttgtgtaattctggccagctggcctgagaaacggttaacgtggtcttgtcactggagaagacctcaccaaaccaataagagctctttgctccgcagcaagcaaaatagcttatagaactatatttgtgttttgattgctaaacagtgtgacttaataaaaaatagttgtgtaatatgaaagatttcttgatttaatcatcaaaattgaatactaagttctaagtttgtgacatgacacgagatgagtggagatatgaacatttgatatgaaaatatagtcttaagtctaaatcttaagccttacaatcaatagatctaaaattgtgtttcaatcttattcagtttttgttataaatactagtattgatattctggttcctaaatattaatttaaactaaacttcagttagatataatctaactgacgataattataatcttaatcgctgatacaaaagtagccttaaaaaccatgctagaagaattaaacgatgaagccgaaaatagaggactgagggtgaattacaataaaaaaaagattatgacaaacccggacgaaaactccttgatcacgttaggtcaaaatataatagaacaagttaagaaatatatacttcggacatatcttaacactcagcaaggaaaaccaaacggcagaaataaaaaggcgaatcagactggcttggatagcattcggtacattaagctacattttgaaaaacaaaaaatacccgaaatatctttagaacgcgaatttttaaccagtgtatacttcctgttttcacatatggctcccaagtttggtcactta

SEQ ID NO: 3243 - DNA, 1710 bp, Diabrotica virgifera
  misc_feature (1656)..(1656): n is a, c, g, or t
tgatcttaaagtaggcgtcgaagagttacttagaataaggggatctgttttaagcgaattgagagatattgaaaggaaaaggcagcagtataagatggaaattcaaacttatgttaaaaatatagatgagttaaaacaagaattaacacatcaacaaacaaatttaaatagattaaaaatatccgtagaacaggcacaagtagcacaaagggaagctctacaacagaacactccagaccttgccttgcccaagaaattatcagctgatgtactgccagaagttctaccacctgtttcaagatatgtatcaaaaagatgcagaatgttcagttgtttcgaccactcaagatgttccttaacttcaggatttccagtgtacttgtacgatcctgaccaattcccagtgatgcatgatggttgggatgtagatggatttttaaaaaccacccttaaacaaacccttggatataaccctcatttgacaaacgatcctaaacaggcttgtatatttttagttttagttggagaagccttaaaagatactgacgatgtcagtgagaatgttggcaatcatttaaatttgccgccattggattctgatgctttaaaaagattgccatactggggaggggatggaagaaatcatattttgttaaatttagcaagaagagatctcatgtctgtttctggagatgtattttctggtgtagatacaggccgtgcaattctagtccaatccactttcacttatgacctatatcgctcagggtttgatctcattatatcaccagttttgggaccaccaggaggtgatgtatggcaagaatgcaatccaatgttacctgctcgccgacattacttgctcaccttccaaggagagatcaagaaacagaagtcaccctcgcctcgaccaagttttgatgattctgaggatagtaacgtggaactaaataggtttatactggatcatctagtgcagctatctaaaactacaacatctgacaaatttttgtttgaattcgaatgtaatcctgctagtgataataacttaaatgttgccaatcaagattgggcgctttgtggaactgacagtagcagacgggcggtgttaaaagattctacttttgtcttgatatttgccccaggacaagaagatttgatctcgaccacccttctgcaagccagaatttatgaagcccttagatcaggtgccgtcccagtgattctaggtggagatcaaatcaaactcgcctatgatgaagtcatccaatggaagcgtgctgccgtatttttgccacgtccccgtattaccgaactccatttccttttacgagccattccagacgaagacgttttgttattgcgtcgacaaggccgtcttatctgggaacgatatcttgcctctgtgcaaagtactttggatactatagtagccgttttacgagataggttgaatattccagccgcagctgcagatactgttttagcccttagtgttttcaatgaaacattccagccaatacaagtttcggttgccagcgaagtggaacaggaagaaagtttaggccctcttgagccgcccttcgatagtcccacatatcgcagaaactacagtatatcattagtgcaaggtccagaaatctggaacgaattggngtgatcccgtttcggttatatcctgcgttacctatggaccctctactatcttca

SEQ ID NO: 3244 - DNA, 2891 bp, Diabrotica virgifera
cgcacgcctgcaccgtaccggaaactcgtccataatcgcgatagttgagtgggtgaggttccaagagaaacataacatccatccacaaatatgtcgaaagtaaggatcggagatgaagagaaggaagggcagtatggttatgtccatgctgtctcaggtccagtcgttactgctgagaaaatgtctggttctgctatgtacgaactggtacgtgtcggatactatgagctggtaggagaaatcattagattggaaggtgacatggctactattcaggtatacgaagaaacatcaggtgtaactgttggtgatccagtattaagaactggtaaaccactttcagtagaacttggacctggtattatgggttccatttttgatggtatccaacgtccattgaaagacatttgtgacgctactgatagtatttacatccccaagggtattaacgtaccttctttatcgagaacagcaaaatgggacttcaacccaatcaacatcaagttgggatctcacttaactggaggtgatatatatggtctagttcatgaaaacacccttgtcaaacacaaaatgattctgcctcctagagctaagggtactgtaacctacattgcagaaccaggaaactacactgttgatgaagtagtattggaaactgaatttgatggtgatcgtaccaaatatactatgttgcaagtatggcctgtacgtcaagcaaggccagtcagtgaaaaattacctgccaaccatcctctgcttacaggacagcgtgtacttgatgctcttttcccatgtgtacagggtggtactactgccattcccggagctttcggttgtggaaaaactgtaatttcacaatctctttccaaatattccaactctgatgtcattatctacgtcggttgcggagaaagaggtaacgaaatgtctgaagtattgagagatttccctgaattgactgttgaaattgacgggcacactgaatctattatgaaacgtaccgcattggtcgccaacacatctaacatgcctgtagctgctcgtgaagcttctatctatactggtattactctttctgaatacttccgtgatatgggttacaacgtatctatgatggctgactcgacatcacgttgggccgaagctttgagagaaatttcaggtcgtttggctgaaatgcctgccgattccggttatccggcttacttaggtgcccgtttggcttccttctacgaacgtgctggtcgcgttaaatgtttaggtaatccagacagagaaggatccgtttcaattgtaggagccgtatcacctcctggtggtgatttctcagatcctgttaccactgctactcttggtattgtacaggtgttctggggtttggacaagaaacttgcccaacgtaagcacttcccttcagtagactggcttggatcatattccaaatatttaagagcattggacgacttttatgacaaaaacttccaagagtttattcctcttagaaccaaagttaaggaaattcttcaggaagaagatgatctagccgaaattgtgcagctggtaggtaaagcatctctggcagaaacggacaaaatcaccttggaaattgccaggcttcttaaagaagatttcttgcaacaaaactcatactcttcttatgacagattctgtccattctataaaactgtcggtatgttgagaaacatgatcggtttgtacgacatggcgagacacgctgtagaatcaaccgcacaatcagaaaataagatcacttggaacgtaataagagattcaatgagtggaattttatatcaacttagcagtatgaaatttaaggatcccgtaaaagatggtgaagctaaaatcaaggcagattttgatcaattatatgaagatattcagcaggccttcagaaacttagaagattaaatctttttaaggaaattttcctattttgttcatcagtgtaagtttaaaaatatagcgatatttatcaaaaagaataataaggcctctatccctcacttctgtgaatattaatatggccgtactaaagatagtaactaaagataggttttctcttttttgatattatcctgtacaaaataaattatgtaaattgttgaatatgtgtatagtttttttgggtgagggtacagtgcttattaaatactttttaaacatttttcccgccattccaattactattaagttttttcgttttaatacttttttaaatatacaggtgcttaatatcgtttatattttcagtattacttggttttcttcatgtaaattgttttaaatttttcttttacccttttaatcttgtatattacattacccaattaaagttaattgtacagattaagataaacgagtatcttataacatctattagattgttagaatcaataaatgtagtgtaattgttctgttttgaacaaataaatgcatcattattgttgaaaaaaaaaaaaaaagggcggccgctcgcgatctagaactagtttttttttttttaccataaaaatttaatattttaaatactccatcacataaacatcataaaaacataaaatcactcattaagacgatgagacaagctgaacttcctttccagtttttttgataatctccaagacatcattagcaggcaaagttgatttcactttaacactctgactttccagacttatagaaacttcttccacaccttttccaacgtgtttatttagagctctttccacagcaccactgcatcctccacaggtcatttttacgttgaattcgtgtatttgggacatctttgatttgttgttgatcgaataagtgatgttttagacagcacggacgcagatgggtcggaccccggggaattcccggga

SEQ ID NO: 3245 - DNA, 1350 bp, Diabrotica virgifera
  misc_feature (1100)..(1100): n is a, c, g, or t
  misc_feature (1146)..(1146): n is a, c, g, or t
  misc_feature (1255)..(1255): n is a, c, g, or t
cgagtcagacaaaccgagttccatatcaaaaatttataagttcatcctaaaagtgaggttaaaatggccggtaccctaacaaaattctgcaaaaatttaaaagatgtgtctgccgttaaaaatggtgttctagcgcctgctgtctacgttcaaaatcgcaactatgctagtggaaaaagggttgaagtggcgaaacccgtcgtcgagatggacggtgatgaaatgaccagaatcatttggcacaagattaaggaatcgctcatttttccttacgttaaactcgaatgtctttacttcgatttggggctaccatacagggaccaaactaatgatcaggtgaccattgatgctgcacatgccatcttaaaacataatgtcggaattaaatgtgcaacgattacaccagacgaacagaagtagaagaataataatatacaacctccaaatagtggtgaatggaattaaattaattaaaaaaataagtctgaattgctttaaatgttgattaattagtttttacataaaattaaaaatgagtttaaacaaattaaacttaatatggaggcaaaattcgtccaagaataatttattatttacagtttgttatcaaaagtattcatatgcctacaaaagcacggggcctaataaaaaagacagtagttcgagcagtagcagtagcagctctagttcagatagtgatctgggtttaccatctaaacaagacacagaaaataaaaataaagaaactatcaccaaacttaacagtcttttacaacaattaattcaaaatgatgaggttgctaagagttctaacttagtgttggctagaccaaaaagtaaaagggttccaaaggaagagagacaggcaaaaaaagtagaaagtgttgaaaccaaattggtaaatgcagtgtcagacgtggcaaaggatataggtggtgatacaaaacaaactgaatcagaattactatctaaactcttgggccccggtgatagcacaccatcttctaaaagtttaaatgatattgtcaaaggcatgaaaattgacagagaggtaaaatcagctgaaaaatctagggctgaacaaattaggaatatcctgncaaatatgcaagcaaaacaacggcaagatcctaggaaacctatgtncccagggaggaaaacacagcaacaatttaaaccccaacaagaaatggtggtacaaaaaatcgacctctttggtagtaagcctctaagtatctttacccacaagacatgncagagaaaatgaacaatacttgccaaaagtatatgaacgggattaaaactagccacacacatcccccatcaaattatttcagcaaatgattttgt

SEQ ID NO: 3246 - DNA, 1588 bp, Diabrotica virgifera
  misc_feature (1537)..(1537): n is a, c, g, or t
cggtatccgcctccccacgctgcacaaaatcgtaccttttccactgcgtatcgagtcagacaaaccgagttccatatcaaaaatttataagttcatcctaaaagtgaggttaaaatggccggtaccctaacaaaattctgcaaaaatttaaaagatgtgtctgccgttaaaaatggtgttctagcgcctgctgtctacgttcaaaatcgcaactatgctagtggaaaaagggttgaagtggcgaaacccgtcgtcgagatggacggtgatgaaatgaccagaatcatttggcacaagattaaggaatcgctcatttttccttacgttaaactcgaatgtctttacttcgatttggggctaccatacagggaccaaactaatgatcaggtgaccattgatgctgcacatgccatcttaaaacataatgtcggaattaaatgtgcaacgattacaccagacgaacagagagtagaagaatttaaactaaaatcgatgtggaaatctccaaatggaaccataagaaatattcttggaggaacagtattcagagaacctattttatgtaaaaacattccaagactagtacctggttggactcaatccatggtaattggtcgtcatgcacacggtgatcaatacaaggctgtggatattgttgtagagaaacctggaaagctagaattagtcttaacaactgatgacggcaaagaacagaggacagaagtgttcagatacaaaggcgcaggtgtggggatggctatgtacaacacagacgaaagtattgaatcatttgctcactcttcattccaagttggtcttcaaaagggctggccagtatacttatccacgaaaaataccattttgaaaaaatatgatggtagattcaaggatatattccaggaaatcttcgataaacactacaaagcccagtttgacgccaaaaagatctggtacgagcatcgtcttatcgacgacatggtagcccaagctattaagtcttcaggaggattcgtatggtcttgcaagaactacgatggagacgtccaatcagatgtagttgcccagggttatggatctttgggtatgatgacttcagtattgatgtgtcccgatggaaagacaatcgaatcggaagctgctcacggaacagtaactagacattataggatgcaccaaaaaggccagcaaacctcaaccaatcccatcgcgtccatcttcgcgtggaccagaggcctaatccaccgtggaaacctcgatggtaacaaagatctcgtcaatttcggcaacaagttggaacaagcttgcatagacacagttgaaagcggaaaaatgaccaaagatttggcagcttccatccatggactccccaacgttaaggagggaatgttcttgagtacccaagactttttagaagctatttctgaacaattaaaaagatcagtttgatgatcgttttaatgtaaatcagttttttattacgagaagtcccagaattttttcgataaaaaattttaacaaattttttatttttttattngttacttggtcgaagcagacaagtttagcacagcagactgataaaaacgct

SEQ ID NO: 3247 - DNA, 1238 bp, Diabrotica virgifera
cggacgcgtgggatttcttgaaaatgagactgttattgcttcttggattcatactcacagtcagggcggcgtctcgtccgttgcagacctattttagaagcttacccaaccattggttccgaggcttcggatcaactaccgctgcacctccaactccatttgtggaaataaatggacaaccatcttcaactcctgcgccctatttagcagataactttcaatcgataaataatagattatcatccgatattaggtctgattttggatcaacgacaagttccccgccaacttcttttattgaactaaaccaagaatcagtttcaacgccatctccacttgaaaatgagggcttacaggctagtagcacaccatttaatctaaacagtggcctagtatatggacaaaatctacaaaattatggacaaaacctacaaagttatggccaaaatctacaaagttatggacaaaacctactaagttatggacaaaatctacatggtaatttgttcaacgggtttggatctacgacgagtgcaccacccacttcattggttgaactaaatagtgagtctgtttcgactccagctcctcttgaaagtggaggcttacaatctggaaacataccatttaacctaaacaatggcctattatctggacaaaatataaatggtaatttgttgttcaacgggtttcaatcaaccacaagtgcaccaccaacttcatttgttgagctaaatggacaatctgtttcaacaccagctccattccaaaatgaagcaatacaatctagtagcataccatttaacgtaaataatggtttactatctggttttgggtctgatgtttcaaataacctacaaagttatggacaatgttaacagcaatttgttattcgatggttttggatcatcaacaaccagtgcaccaccagcaaataatgaaattttatcccgttttggatcagatatttcaaatatccaacaagcaggagataataatgctttctactcaactgaaggtcctgtatccagcacatctgcgccgtttgacatgcgtcggttgtttttacaagacagttcacttttccaaagctccccacggctagttccggaaataagtccaatcaaaattcaaggtagaacaactggaggttctatatatgatacatttggaagtactgatgaagtgattgaaagcccaagagaaaaaaccactgattaccaagaacgtattacttc

SEQ ID NO: 3248 - DNA, 1061 bp, Diabrotica virgifera
tattcgtccggacgcgtgggcggacgcgtgggccggtggtgcaagtgtgaggttaacaatagtgttttcaaaaaattttgatttaacactcttatattaatatataaaagtatgccacccaaaaaagcgcaagagccggaaagaaaaccgcttatcggaagagtcggtaccaacttgagggtcggtatagtcggagtaccgaacgtcggaaaatctacattcttcaatgtgttgaccaagagctcagcagctgcagagaactttcccttctgtaccatagatccaaatgaaagtagggtgccagttccagacgagagattcgattttctttgtgaatattttaaacctcttagcaaagtgccagcttttctcaatattgtcgatatcgcaggtttagtaaaaggagcgtcggaaggtcagggactcggaaatgcatttctttcacacatcagtgcctgcgattccatatttcacttgtgcagagccttcgaggatgacgatgttactcacgttgaaggagaagttgatcctgtgagagatctggatattatctgtgaagagttgcgattgaaagatgaagatatgttaatgaagaatttggaaaaactcgagagaaccgttggtaggggtggagacaagaaactaaagccagaatatgacactctacttaaaataaaacaagtcttagttgacgacaagaaacatattaggtttgcagattggaatgccaacgacattgagatattgaacaaatatctgtttttaacatcaaaaccagcaatgtacctagtgaacctctctgaaaaggactacatcaagaaaaagaacaaatggttggttaaaatcaaggaatgggttgacaaacacgatcccggttctctcatagtacccttttccggcgtcttcgaacataaactggtagaagaatacgaagatcccgtgcggaggaagacctttttggaagaaaaaggtaccaccagcgcgttagataaaatcattgttcaagggtacaagactctacagttagaatatttcttcactgctggagctgacgaagtaaa

SEQ ID NO: 3249 - DNA, 880 bp, Diabrotica virgifera
  misc_feature (770)..(770): n is a, c, g, or t
  misc_feature (798)..(798): n is a, c, g, or t
  misc_feature (832)..(832): n is a, c, g, or t
  misc_feature (855)..(855): n is a, c, g, or t
  misc_feature (865)..(865): n is a, c, g, or t
gttagtccaatgtgaaatgacttcagtctgttgttagagagtgtgtaatgcaggagaagcatagcaagctgtgttgtagataatatcggcttgattgtgttctttttcatgttttctttcataatttttccggccagtttcttttgaagatacgtacgtgttaagttaataaatatgtaaaactgtgtgctgtctcgccccatttatcgttgaaatctttcaaaatcttgaaagtattcgaccaaacaacataaccttaacagccagctgtttaaaatcgtggttgttcaggtagaaagtttgtttaacgtttttcgggacttgaataatattgacgtattgtgacgttgtttagttttgaaaagtgaattatttttactgcaaaatgttgggatttactccttctcgagatggactgttgcagatcgaagacgatcttctttcgacccttgtccttaaggaacctattacaggagtatatgacttggacaaaacaccacttggcaggggaaaatatgcaacagtgtggcgagcagttcacaagaagactggcacggcgtacgctgcaaaatttgtgaagaagaggcgaagaaatcaagaccagatgaaagaaatcatccacgaaatagccgtattgatgcagtgcaaaatgaccaacagggtgatacggttacacgaggtctacgaatcaatcaccgagatggttctagtactggaattagccgcaggcggcgaactacagcacatcctcgatggcggacatgtcttgnggagaggtggaagccccgtaagcatganacaaatattagaaggcgttgcttacttacacgancagaacattgctcatttggaccntgaacctcanaatttactgctatct

SEQ ID NO: 3250 - DNA, 1448 bp, Diabrotica virgifera
gtaaattcaaaattaaaggtagtgttttgtaaagttttttaaaagtgccaataccgtgtatactttaatagcattagcttgtgtttcttttgcgtaccttcataaaaaatagatacaggcacacacggattgtttgacagcccatgatttggctatattcgcgccatgttgcattagattattaacaaatttcgaatagttcagtacatatctttaaacagtttaatacagaatatagttgtttggtttgtgcacagttttgagttaagtgagtgactcagaaattagacccttgttgagtagtttccatcttgatcacatcttgcaaggttgaaacaataactagtagtaaaaatggcagataatctcgatgactcacattttgaaactggagactctggagcctctgcaacataccctatgcaatgctcagccctacgtaaaaacggtttcgtaatgttgaagtctagaccatgcaagattgttgaaatgtccacatccaaaactggtaaacatggtcacgctaaagtccacttggttggtattgatatcttcacaggtaaaaaatatgaagatatttgtccttctacacacaacatggatgtaccccatgttaaacgtgaagattatcagttgacagatatttctgatgatgactacttatcccttatgtctgataatggtgaattacgtgaagatttaaaagttccagatggtgaagttggtggtacagtacgtgcagaacatgctgccggcaaggatatattatgtaccgtactgaagtcttgtggtgaagaagtcgttattgcagtaaaaacaaatactgctcttgataaataataatagccggttgtaagacagcggggtcgagaacgcaggcgtcatcctttgtctactggggatccccgcttttatattttatgaatatatttatcatattggaccatcagttatcaaacaaataaagcttatctaatgcccgacgccctgtcaaccggcatccgacgttgatgtggtgtaattttacatctatctgtaatttgttggcaaaattacttgcaaagctacattttcgttcaataaatcgtaatttaattttaattctctgtaaattttcttttttaacagtgattaccagctatttttagaaccacctttttctgtgaaacccagctttactggtccctgtatgatatttgtgagtttttgtttttttttactactaaataagtaagaattaggtgattctagactcttgttgacattttttttgaagtgaataaacatagcatttttttataaaaattttttttttttttagtttaaattaaaaatgaattttttaaatataaaaaaaaaaaagctttggggggatcaggggaacctggcctttttggggttttttttgctttactcattgttttttttggggggagaaatggggggtt

SEQ ID NO: 3251 - DNA, 1192 bp, Diabrotica virgifera
  misc_feature (1116)..(1117): n is a, c, g, or t
  misc_feature (1127)..(1127): n is a, c, g, or t
  misc_feature (1138)..(1138): n is a, c, g, or t
  misc_feature (1147)..(1147): n is a, c, g, or t
  misc_feature (1169)..(1169): n is a, c, g, or t
cttcgtccgacggaggtgcggttcagagcttaaacattgcgttttacatcgccttgctaaggatcgaaaaagccgagcagttagatccgctggtgcacgtctacaatacggacaaatacagctcttcggctgtggatacgatgaccattttttatctggcaaaagttttctgtgaacagcctgaattggtctgacttaaaaaattgtcatactttcatagccgaaataatcgatgatatatgaagatgatccgcgatctacgcggacaagatgaaagatcgcgtggacggcttgagagacacccaacacatctacgagaagaggttcgaagtgaccaacgaatggtgtttggccatcaacaacatcgactacgttcgggaaacgctggagccgtttacgagagacctcggaatgactgaagttattgaaaaaatctgtgatttgaaaagtccgttggacggacagaggtgcgaacaaaccttggagaacgtcatcgctaatgccatagataccgtcaggaataaaatcatagagttgctggaaacagtagtaaacaagatggcgccatctatgaaacggcttctgatagaaggagcagagctatgcgatcaggactctaatagtatggacaggctaatgatgtacgtggacaataatttgtgtactttacaccgagaactgaacgacgaaaatttcaataggacgttggagatcgtttggaatatgctggccgacactttggaggacatcatacaaactaatgtagacaaacgacgaccaccttcatttttcgccaacctccataaaaccttaaacctaatgttgggttcgttcaagaatcccaatgactgtgatagctgtgatgctctgaccagaactgaacaaacgttaagggtacacggactagaaactactgatttaattcacgaagtacacaaaaatttaaccgccaaattcaaaaacacaaaagattctccattcggagagatctcagttagagccaaattccaagacaacgatctcatcgttgaagtaatgaacgccagaaacctgatggccatggattcgaacggatcctgtgattccttcgtacgggttcacctgggtaccgagcanncagtcattgnaatagagaaancctagactnaaacccacaccggatgcagttnccattgtacgacgaacaattcac

SEQ ID NO: 3252 - DNA, 2638 bp, Diabrotica virgifera
  misc_feature (2579)..(2579): n is a, c, g, or t
cccacgcgtccgatcaactaaatgcagcatgtgggtaatacttctcttatccatacttgcttcagcaacggcttcaaatccagatctggcttcttcagatacagatccagatctatttcccgtacaaagagcgactgaagaagcagaaatctccagtaacaagtacttgttatcatcaccagttattcccacacactatgatgtcggcttaacagttcccttggaggctttatctggaggtagtacaaattatgacggaactgttgatataactttgagtgttattaacgcaacgaatgttgttcaattgcactcacttgtaaacatcgttagcataacctttactgattcgtctattgtgatacacaattatacactcaacccaaacctggaaacgatctctatatttttaaacagtaccctaaatgctaatgcgatctacaagctcaatattaagtttaatgcaagtttagaaaaagttaacatgaggggattttatagaagtgactatattattaacggtactaaagagtatctggctacaacgcaatttcaggcaacttctgctagaagagcatttccttgttttgacgaaccaggattgaaagcaacttttcagttgactctaacccatccctcggaattcaatgctaagtcaaatacaccatcccagtcgcaggcagtagtacaagcaacaaatactacgacaactgtttttgaaaaaaccccggtgatgtctatatacttgatagccatcgtaatttcaaaatttaattgcacgtcaagtacaaatttaggtacaaattttggggtatgttcaagaaccgatttatctaacgacagaaatgaagccttaaaatatggtatgaaaattttagaagcgtttgatacgtacactgctagtccatacaatttaaccaacttaaagaaattggatcagttcgccattcccgattttagtgctggagccatggaaaactggggtatagttacttacagggaatactcacttatctggaacaatgaacaaacatcaagagctttaaggcaaagtttactttccatagtcgctcatgaatttgcacataactggttcggaaatctggttactacaaaatggtgggataccactttcttgaacgaaggattcgcgaggtatttccaatacttcattttgacaaaaattactgatttaagtgactttcaaatggataaacaatttatagttgaacaacaacaaacagcatttatagaagatgcgtcccctctttctcgctcacttacgtccgaagcatggacaccggctgaaataagcaacaaatttaatacaatatcttataacaaaggtgcatgtgtctttagaatgatagagaacttgattggttctgttgcttttcagacagctttgcaaaaatatctaaatgctactgcttatggttcaggaaccacggaaaaattatgggccaattttcctaacagtattgcattacctccaaatgtaaattttaccgattttgtagataattggacaaataaacctggattcccagtcgtgaatgcagttttcaatggaaaaaatgttacattttcacagaaaagattcttgtacactggaaataataacactcagtggtacataccgattacctacagattgtcaaatagctcttcatatgaaacattttggttggcacccaatagttctgtaacaatactaaataatttaactgacaaagactggttaattgtaaatgatgattctagaggttattacagagttaagtattgcaaaaggctaacgcaaagaatacaatctctattaaatcaaaatcacactcaaatttcggagttaaacagagctcaaatactagacgactctcttaatcttgctagggctggatacattaaatactccgaagctttcgagcttctggaatatttaaaaaatgaaactagctacttcccttggttcactacgattaaaaatatggattatttagtaacaagattaggagccaataccgagttgggaaaaagaacaaatgctatgatattagaccttataagtcagatttcagccaacatttcaactactaaatgggaagaaattgatcaagttactactttgaaattgcaaagggtgtgggcagatgcttgtaaaagaggccaggcaagttgtatttctgagacaaagagactgtttcaggcattaagattaaacaaaactagcgtaaatccaaatataagagacgtagtatactgtaatgccttgagaaatagtaacaatattgccgctgattgggagttcctgtggaacagactattgatctctattcatcctcaggaagatctttacatattactgagtttgggatgcacaacacacaagccctacttaacaagattattggatgcaaccataaactctacatcagtaataaaacttcaaaacctatataccgtatggaattcagttggttctgccagtaaagaaggtttagatcttgcttttgaatatttcgttaacaactacaaaaaaattattgaatattatcccgatggtatatcattattatctncattggccacagatttacaactaatgctgaggtcacaaagttgcaacaattcgctgatc

SEQ ID NO: 3253 - DNA, 838 bp, Diabrotica virgifera
ctacggacgaatggggtagcttgtcctagttacatattgttgttaaatatatatttttttgatattttctagtgttgagttgaaataaggcaaaaaaatacaaaatgacagcccacgatcagatgagggctatgttagatcagcttatgggaacaggaagaaatggtgaaagtaacaaattccatgttaagttcaatgataccagagtgtgcaaatcatttttgctcagttgctgtccccacgagattttatcttccacacgaatggatctgggtgaatgcccaaaaatacacgatttggcgctgcgagcagattttgacaaggcccagcaatccaaggactacttctatgatttagatgcaatggaacatttgcaagcgttcataggcgattgcgacagacgtaccgagtcagctaagcaacgtttggcggaaacccaagaagaactgtcagccgaggtggccgtcaaggctaacagcgttcacgaactagcagagcaaattggtcaaaaattagctaaagccgaacagttgggagaagaaggatttgtcgatgagagcatgaagcttatgggagaggtggaagaactaaggaaaaagaagctagacgccgaacaggagtaccgcaactcgatgccggccagcagctaccaacaacaaaaattgcgagtatgtgaagtgtgttcagcctacctcggtattcacgataatgaccgacggttagcggatcattttcgaggtaaaactcatctagggttcatcaaaatcagagaaaaactggcagatttagaggaaaattcagaaaaacgtaaaagagaaaaagaaaaaatctggcaggg

SEQ ID NO: 3254 - DNA, 1098 bp, Diabrotica virgifera
gagcttgtcgattatattagggttgtaatcattgttgactgctcatccggaaaagagaatccaatcgtcttcagcaactagcttacaattcaaacccagtcatcacaccaatctataggtccctaccttttcataatactgtcatatctgagaagatcaaacacattctctgttcttcggacaatgtccacatatcatttaaagtcaataacactctcaacaaaacattatctaacactaaagatccaatcaactttatgaatcgtagtggtgtttacagattatcttgttccgattgtgatgcctcttatgtaggaagaacctatagatcactgtctactagagcagcagagcacactaaacgtgacaatacatcagctttctctcaccatctcaaagtcaacaaacaccaccttaacatcccagatggtgtgactttgattcataacatccaagataagaatacccttcgtttagacctatatgaggatttagagattgtcagggacgcaaggacaagtccaaactgtgttaaccgtcaactttctcttaaccgtgatttcacccccattcatagacaattatttccataattctatatttttattcaccttcacattggccttctttcctatacataccacgacaaacccaaaataaacaaaaaacccaaacattatacctaatcaaatattcttttagtacttccagtttctttcactctgtgctcctgtcaagactctatctcttccatctcattctttaattattttcacttaacaaaatcattttctcattatatcaaaatcacacccatggaacccttgatcttttctgatatgaccttctaatatagacaataaccaaaattttgttgaatttccaacattttattggattcactcctatttttcctttagattaaaaataaaaaataatcctcagctatccaactttaaataaatttactttatatccactttgggccaaaccaatattcaatctaaagatttccaaaagtttaatatgggaaatatttcttttttacatttaaacgctaaaaatccaaaattaaattttctctccttggatccaaaa

SEQ ID NO: 3255 - DNA, 1032 bp, Diabrotica virgifera
agcccacgcgtccggttttaattatcagagttccgaacattcagtcagctttattttatttagtcattttgaataaacggtaggagtctgacgtctgactgtgacctagacctagagaccactctcgaaacatcactatcactggtctggtttacattttacattcagctgtctgatgcttgtctaatcctcaattttggaaatatttctagaaaacataacccataaccatgaaaatttggacaagtgaacacacatttaaccatccatgggaaaaagttgccactgcagcttggaggaaatatccaaatccacacaacacagctgttattggcactgatgttgtagaaagaaaagtggtggatggagtattgcacacacatagactggttagctcgatttggtattttcctagatgggcacaagcactcataggttctgcaaagatctgctacgccagcgaacagtcagaagtaaacccctctctccgtcacatggtcttaaaaacaataaatcttaccttttgccgccatatagccgtcaacgaaacccttaaatatactccacatccttcagactcaaccaaaactcttcttaaacaagaggcagtcgtgacagtaaagggagtacctctaacaaactacatggaggatcttttaaccactaaaatatcaaataacgcaggcaaaggtaggcaagctatggaatgggtgatcaacaaattaaacgatgaagtcaaagacttaacgaggagtacggatgaaatttttagccataccaaaaggtcgctagacgatatagcgaccagtgcaaagaagtcgatgggggacatctcacagaaagcaaaaaagagcctggacgacatgcaaacgatgactctgagctaatttcttctgtactgtttcttttcgatagttagcacaatttttttgaattgctactagaggaaatcgctaggttatctaattacgcctaaagtctgattattttgtacggtatggttgtcaaactataaaactgtgactggtgggc

SEQ ID NO: 3256 - DNA, 1115 bp, Diabrotica virgifera
taacgctgcgtccgggtaaaatgtttcgaagtgtattttttttctgtatatttatttcagtaagttcaaaggattattatactaaagaggatgttgacgattacgtgaaactattagaagatgcagttgaatccagcaaaacctatcaaccggcaactagtgcacatgaatataaagctttgaaatctggacctccacaagatgctggcgattacgactttattgtagttggatcaggatcaactggatccttagtagctagtcgtctctccgaaaatccagactggaatgttttagtgctagaagcaggcaactttggcaataatataaccgacgtgacagcaatgagttacaaggctatgattatgagtgactacaattggggctattacagtgtaccacagaataatacttgtttagggtttgaagaaaacaggtgtccccatattagaggaaaaggagtcggtggcacatctcttctaaacgcattaattgacattagaggcaacagattagattttgacaattggtgtgcgatgggtaacaaaggttggtgttataacgagacattgccatttttcttaaagactgaacatcttcattggacagatccaaatgccccgattgatcctgcttatcacaattcaacagggttgttgtgggtggagcaacctatgcctagaacggaacatactaagatatttttagaagcaaatgaacaaatgggctataaaatccgtgacgtaaatggcgcagaacaaattggtgtaatgcctttccagataaatactagatatggcagaagacaggacagtggtactgcgtttataaaaccatttttaaaccgaaaaaatctcaaagtactgactaaagctttggctacaaaaattattattaaaaataaaacagcaactggagttcaatacttgcaaaatggtgtattgtatgaagcaagatctaataaggaagttattgtaagtgctggggcaattaacagtccacaattattgatgttatcaggaataggaccaaaagcacacttacagaaattcaatataccagtaattcaagattttggaagttggaagtagtctctccgatcatttaccagttta

SEQ ID NO: 3257 - DNA, 963 bp, Diabrotica virgifera
aatcaattggtgatgaaatagccgagatatatcaaaaagcacgagataacggatggaaacatcttggattatacaatatggtttctccagtatacatgccattggatttagatattattaaacttattttaactaaagatttcaatcatttcgtcgatagaggaatttatgtgaatgaaaaagatgaaccaatcagtgcacatctttttgctattggaggaaagaagtggagaaacctacgaacaaaatttacgccaactttcacctctggtaaaatgagagccatgttccaaactatagctcagtgcggaactcaacttaacaaatatttagttgaagagatatcccaccatgagcctattgatataaaaaatatattaggtaattttgcaactgacgtcattggttcctgtgcgtttggattagaatgtaatagtttcaaggatccaaacaacccattcagagtaaatggaagacaaatcttccaaagaactaacttcgaaaatttgaaatttatgacagctactatcttcccaaatttagcacgtcggtttggtgtgaagatgttgcgtaaagaagtttctgatttctttagcaaagttgttacggatacagttaattatagagaaaagaatcaagttcatcgcaatgattttatgcaactgttgattgatattaagaataataaagaaggagaacatactccaggcgatggaacttcacttactctggacgaaatgatagctcaaagcttcgtattctttattgctggttttgaaaccagttcaactaccatgactttcgctttgtacgaacttggcaaaaatcaatctgtccaggatacactcagggacgaaattaatcacgtacttaaaaaatataatggacaattacttacgatgccataaatgagatgaaatatatgaatcaagttattgatgagacactaaggatgtatccacc

SEQ ID NO: 3258 - DNA, 1293 bp, Diabrotica virgifera
cctgttcgtgttcacctgatgccgaaggttatttttataaataatgatgcgaatctctcatcaaaacagttatctacctactatgataaaagttgtcctccggtgatgtgtgtttacttgaattaatacggtgtttttgtggaattaaattctaatttgattagataataaattcgccgttatattataaattgtggttgctgttacaataggactataggtgaaaagccatcaaaatgtccatcataaccggcgtaatattgtatgatgtaataggcgttgccattggtcttgtgactcttgcttggatttattctaaatgggccttgcagtactggaagaacaaaggagtaccttatttcgaaccagcagttttctggggaaatttacgtccaccccacagaagagacagatcaattggtgatgaaatagccgagatatatcaaaaagcacgagataacggatggaaacatcttggattatacaatatggtttctccagtatacatgccattggatttagatattattaaacttattttaactaaagatttcaatcatttcgtcgatagaggaatttatgtgaacgaaaaagatgaaccaatcagtgcacatctttttgctattggaggaaagaagtggagaaacctacgaacaaaatttacgccaactttcacctctggtaaaatgagagccatgttccaaactatagctcagtgcggaactcaacttaacaaatatttagttgaagagatatcccaccatgagcctattgatataaaaaatatattaggtaattttgcaactgacgtcattggttcctgtgcgtttggattagaatgtaatatttcaaggatccaaacaacccattcagagtaaatggaagaaaaatcttccaaagaactaacttcgaaaatttgaaatttatgacagctactatcttcccaaattaaacatgtcggtttgtggtcatcatgatgtaaaaagaaaatcctgatttctttaacaaagttgtacggctacattaaattttaaaaaaaaaaaaaaagtaaattttaatgaaattaatttttttttgattgttagttgtaaagtttgaaacaaaaaaaaaaactgaaaaaaagattcccaaaaatagtaaatattccttttttcttgggcgaaaaatttataacgctaaccccctctgaaacttttcttaccttttggctggcggcttttttatttgggtttcttccgacaaaaaaaatgaaacagggtttgtcccctgggaacaaaatctttatcacatcac

SEQ ID NO: 3259 - DNA, 899 bp, Diabrotica virgifera
  misc_feature (18)..(18): n is a, c, g, or t
  misc_feature (72)..(72): n is a, c, g, or t
ttcaccttcctccagctntatacagaaattttttattataatattgtaaaaatacaattttatgggggttgnaaatgcacatattgagtatactctccctgaacatcaatgcactggttgcaatgagattccaatttatgaattccctccctgaattgataatcttgaagacctgcaaaatacacttccacatctgttatgacttcattatttgatgatgaaaaaggctttccacccacgaattttttagttagtggtcgctagggacaaaatctggtgaatagggtggatgttctcccaaaataaagtcagcatgaattttatgtatagacaaagtcgcgaaaatattcctcatacgtatgacgcaatactgttatttatgtggttgacgaaaaatatttcctaaactagatgtccttaaagcagaaacattacaacacttgttaaagagtcatctttgaccaagcaataaaatgctcaaatcaatcgattttatttattcaatgttatacattgactgtatttaaataggcagatgtgttatacagaatgctagatttacgacatttttgtttaggtataacattattaagttggcaaagatattatttatatttggtattttcgttaatttcgcttttaatatcaaacagtatggccaactgcaggtttcgcaaacataaatacaccgtcatttaataaaacccagttaaaaaattatctacaggttgttattattaatcatcgtcagaatatagcattttgtatgatcaatactataattataaatttatgtgatttattgttattccgttaacgttaatgttttatgtataaaaaataaaaaaacaataataaaaaaaaaaaaaaagggcggccgctcgcgatctagaactagt

SEQ ID NO: 3260 - DNA, 2487 bp, Diabrotica virgifera
ggtataactcgctatttgctgaatgctgacaaacttcgttgaaaaagatataatgtttatcaaaatatgctgccgttgtggtgattgatttgtgttgttttagttttagattaatcagttgatagtgtcgagaaatcaagatgttatttggaagtgggaataagtttcgtattagaagaagccagtcgaaggcatcttatttaactacccgccacgaaaaggatcggattttatcagaatcagacacaggtagatataaaagaaccatgtctcccaatggacatgaacttccttcagaaccgataagtgagcctcagaaaataaaagaaacgttttgttcatctcatacgactcgataaaacaataacagagcaaactgtaacaaagaataataaaaagaacttctaaaattgaaaataaattatacttggaaatcaatgtcagaatgatacattttgtatcctttggattatgctcaactaacgataaaaggaaagatcgagggaaagagtaaactagaagaggaaggagggaagaaatatccgacatgggccaaattttggacagtcaataagaacagctggagacagagaacagtttgcaattgtagcaactaatctccatagagaggatactttaagaagaaaatcctttggaggcttttttagtgtctggatgtataaagaaaactgtttttttttctctaaaggtcagctctaaattctttggtttgatgtcattagctttattctttattttgtagacgctattcttcaccgattttataaaaaaaatgtcttcctgtgctcttaccacatgacctatccatattatccggttagcttttatataatgtctgacgatgtttttagtaccatacagtcaccaatacagtattttggagccttctccacactcctgtcaattcgtctctttgagggccaaatatcattctgagaaccttccattcaaataccctcagcctatttattggccgaatattttagatgtggtcttaatttagattgtcattttggcagcttaaaatgatgacaaggagtataacgctttattccccgcagatatccttgctaagacttctttgtctatatgtttgtcatctgtgattaccggattcagatatttaaactcttttgctacttctaagttgcggtcattaataattatgttttgcctaactcttggtcttggatttttggttactaacgtgtacatatttcgtcttctcttcgtttattcgaagacccagactacctgtttcctcatcgagtttgtaaaaacacctcgcacgtctcttgttgaatggacgacgctgcatctagatcatcagcaaaggccaacaataattttgatcctcagctcagacgatattttacttattgcacattctaaggccagattgaatagcaacggtgataaggggtctccttgtctgagtcctaatattatactaaatggcatcgatgttctgtttcccatatttaactgttcatatgagtatgtcacgcaggacagaacaacatataagtgttaattaattataaattaaatgatcctggatactacactgaacaattgaattttataataattcatgttatatcaatgacattatatattatgcattttagtcccctgtgtattcgtattcgcctttacttttatcaataaatatttttttacatacatgtgatatttacacttttatatgtacctactttttgtcattcgctgttattttctctctagctctttagattcttagtaattttaatgttttactaatatgagccatgtttttttactatgttttgcaccaaggaatgtagcattgcttcgatttggaatgcacacattgtttagtctattattattattattgttatcagtacctttatgcaattacctactagttttttagcacagctttatctaacttaatgtatattagtacttaaatcctgagaaatttatatgctatattaaaaatggtggatttttcgtcaatttgtcatatgtagaagagcataactttgttgacatataaaaatgttgcattttcttgtaatttgctgatattttatgaattataatactaaataacaatggaaaatataaattctaaatattttcaccttcctccagcttatacagaaattttttattataatattgtaaaaatacaattttatgggggtttgaaatgcacatattgagtatactctccctgaacatcaatgcactggttgcaatgagattccaatttatgaattccctccctgaattgataatcttgaagccccccccaatacacgaaaacatcttgtatgacttcattattagatgatgaaaacccccttcacccacgaatttttctgtagttgtcgctagggacaaatctggtgatttgggcccccccccccccatatttttttttttttttgggggggtcgcctgatggggagg

SEQ ID NO: 3261 - DNA, 1753 bp, Diabrotica virgifera
gctgacactgaaaagttaacaaccttagttttatgcagtgcgtttttttttgtgagttgaggtagacacacgcattctgtttttgcagaatgtttctcaagacagtagtcctcgttttccttgcaagcttccaaacaatagacgcaaccccagccaaagtagtgtgttactttagcaattgggctatatacagaccaggaagtggaagatatgctttggacgatgtcccagttgacctatgtacgcatttaatttattcatttattggagttgacgataaatcatggagtattttggttatagatccagagctggatattgaacaaaatggattcagaaactttagtgatattaagaaaactcatccccacgttaaattagaaatagcagtaggagggtgggccgaaggtggatccaagtattccgcactggtagctcaacaggcaagaagggattcttttatcagcagtgtagttgcttttatgaaggaatacaatttggacggttttgacctggactgggaatatcctggagcagcagaccgtggtggtagcttttctgacaaggataaattcttttattttgttgaagaacttcgtagagcctttgacaatgaaggaaaaggatgggaaattacaatggctgtaccggtagctaaatttaggcttcaagaaggttattacgtacccgagttatgcgacttagttgatgctatccatgttatgtcttacgatctaagaggaaactgggctggttttgcagatacccacagtccactgtataagagacctcatgatcaatgggcttatgagaaactgaatgtaaacgatggtgcacaactatgggtagatgccggctgttctccaaaaaactggtaattggcatacccttctatggaagaacattcactttaagtgctggaaatacgaactataacttggggacttatattaataaagaagcaggaggtggagctcctggaccatacaccaatgctactggatttttagcttactatgaaatttgcactgaactgttgaaagaaaataatggatggacaaagaaatgggacgaacatggaaaagtaccatacgcttataaaggaacacaatgggtcggctacgaagatccagaatctgtacaaataaaaatgaactggataaaatcaaagggatacgcaggtgctatgacttgggctatagatatggatgacttccacggtttgtgtggtcccacaaacgttttgatgcatatattacatgccaacatggactcttatagtgtcccagaacctcatgtatcaacaacagcaaggcccgaatgggatcgaccaaaaagtacaacttcttcaggcagtgcaacagtagtaacttcatctacacctaaaccacctaaaccaacgtactccagtacggttcccacttcacagcaaaccacaaatggagctcccactcaacctactgcaccttcgtcatcgtcatattatcccgaagatgcagataatttaacagaatgtgatgcagatttcatgccacatagagactgtgataaatactaccgctgtgatcatggcaaacccaccttgtttaactgcgaacctggaactgttttccatactggtctcaatgtatgcgactggccagcaaactccgacagagaagagtgcaggccatagagttttagttgtactactagttttagttgtgtatttataagacttatattaagactttttaataaacattttatatat

SEQ ID NO: 3262 - DNA, 912 bp, Diabrotica virgifera
tggcatcttgaggtattgtgttcgttacgaccacagcctcaaaaacaggcattatttatctggaaatggccggacctgagaaaataccgtgcgttagaatggcatacactttggtggctccagcttccattaacttttcagctgcatgacatatggttccacaagtatcagccatgtcatctaccaaaatggcaactctgtctttgacatctccaactaataccatagaagcaacctcattagccttcttcctctctttgtggataagagcgaactcaacattaagcctatcagcgatcgaagtcactctcttagctcctcctgcatcaggagatactattatactgtttcgccattctgctatgttttctttgatccatttcaacacagcgggctcggcatacaaattatctactggaatgtcaaagaagccttgaatttgacatgcgtggagatccatggtgattatatggtcggctcccgcaacagacagcatgtttgcgacgagtttggcggaaattggtgccctgctcttatcctttttatcttgacgtgcataagggaaacagggtatgactgccgttactcgacttgcagaagcgattttacaggcattgatcataattaacaactccataaggttgtcatttacttcaccacaacctgactggacaatgtaaacatcctcacctctcacagactctccaatctccacacatgtttccaagttgctgaacttctttgtgaccacttttcccaaatcgataccaagtcggtctacaattctttgggccaaatctggatgggacgttccactaaatactttaatgttcggcattttttttctttaacagtggtgtctctttaaccaactcccggactacgtttttctgtactattgcgccagcctcc

SEQ ID NO: 3263 - DNA, 1407 bp, Diabrotica virgifera
caaaacaaacattatttattcaacaatattcacatgctttaccaaattttaaaatatatacctaaatgtaggctgcatacaaaatcaaactgataggtaactttctgctaaactaactggacataattttttttatttaaatcaatgtatcacattctcaacgtttactactatgatcataatattaaaaagtcaaaaaaattactacacgtcatacctaaattctattttttttgtaaaaaatcaatatattatattgtataaggaactagtgcactaatatggaacattggaaaataaatacgacactgattcgccgttgtgtgtacgcctcactgcttcggcaaacatcattgaaacatcgatgcactgtactttagaacagtctttcatatggccatcttgaggtattgtgttcgttacgaccacagcctcaaaacaggcattatttattctggaaatggccggacctgagaaaataccgtgcgttagaatggcatacactttggtggctccagcttccattaacttttcagctgcatgacatatggttccacaagtatcagccatgtcatctaccaaaatggcaactctgtctttgacatctccaactaataccatagaagcaacctcattagccttcttcctctctttgtggataagagcgaactcaacattaagcctatcagcgatcgaagtcactctcttagctcctcctgcatcaggagatactattatactgtttcgccattctgctatgttttctttgatccatttcaacacagcgggctcggcatacaaattatctactggaatgtcaaagaagccttgaatttgagatgcgtggagatccatggtgattatgtggtcggctcccgcaacagacagcatgtttgcgacgagcttggcggaaattggtgccctgctcctaaatttccattcaattgatttccacttctcaacatggagttctttctcactcgagatgttcttatcctttttatcttgacgtgcataagggaaacagggtatgactgccgttactcgacttgcagaagcgattttacaggcattgatcataattaacaactccataaggttgtcatttacttcaccacaacctgactggacaatgtaaacatcctcacctctcacagactctccaatctccacacatgtttccaagttgctgaacttctttgtgaccacttttcccaaatcgataccaagtcggtctacaattctttgggccaaatctggatgggacgttccactaaatactttaatgttcggcatttttttctttaacagtggtgtctctttaaccaactcccggactacgtttttctgtactattgcgccagcctccacttcaagttcaagcgggtcttgtaatgataaaacagg

SEQ ID NO: 3264 - DNA, 1881 bp, Diabrotica virgifera
  misc_feature (819)..(819): n is a, c, g, or t
caagaactgagggatgaaataaaggtaaaggtattgtcctatgtacccggcgatttggtactttttgcctttcctcttcggaaactggcaagcaaactatcagtctttgtctttgcttcttcagatatacatcctacttcttcagctatcaatatgaatgcatcattttttttatttcgttataatattgcccgtgtcttggattccataacacaggaaagcgttcatataaatcaatcggatctaaagatttttctctgttccatttcatttttttaagtgcaaaacgaatcaaagttcttttttaattaaatatttgagcgaacacaacgaatatactaaacgcccgtacccactgagcataaacgaacaaatgctcgcttttgatctttccatcgtaaccgtatgatggttcctgtttatctgaaccatctcagataattgaggggtggttaccccctaccataagggttgatgaagtaacaatactcactgtagattcatttattggtacgttgaagtaactacggtaaagagctggtggtatattatttagtaactgtgatgtttactcgttgggatctcaaataccaatgactaatcttctcgccatgaaagtagaactcaaagtggattccactgtttactatttggtataaataaaagtgagagtgtttagtaaaagtgctgaatcgactagattataaataacgaatactaattgttatttcaaactgaccttgtatcgaaaatcgacacattgatgtggtaatataggtcaatcgtatttattataaacaaacgtatttgttttaccanagacatttaattattaaaagaatttgtcttagtaagatgattactgagatgcagtgtatcccaatacaaccgacactcctccgaaaatgatcggctcgttcggttcggcagaattttgctcgcgaacacgtactgagtagagcagttggctacagcgcgctctgctcgttcgcgttcggttcgttcggagaaaattgctcaagtcagtacgcacctttaaatcaagagattacaatcaaaaaagttgtcctaatttgttgtatttcaggacgtctacaaaatcggcggcattggaactgttccagtaggaagagtcgaaactggaatccttaaacccggtatggtggtcacttttgctccagtaggcctcaccaccgaagtcaaatccgtagaaatgcaccacgaagcgctccaggaagcagttccaggagataacgtcggtttcaacgtcaagaacgtgtctgtgaaagaactgagacgtggatacgtcgccggagattccaagaacaatccaccaagaggtgcttctgattttatggcgcaggtcatcgtactgaaccatccaggacagatagcaaacggttacactcccgtcctggattgccacacggcccacatcgcctgcaaattcgccgagatcaaagaaaagtgcgatcgtcgtaccggcaaaaccacagaggagaacccgaaggcgatcaagagcggcgacgccgccatcgtcaatctggttccctccaagccgatgtgcgtcgagtcattccaggagttcccgcctttgggccgcttcgccgtgcgcgacatgcgtcagaccgtcgccgtgggtgtgatcaaatccgtcactttcaaagacactgctggcaaagttacgaaggccgccgagaaagcccaaaagaagaaataactaggcttagtgctgcctcgttccgccataagcaacaaggaaatcttcatcatttactattactattatttgttgtttaggtggttgcagcggaatattttcatcggaaagaagttagaagggaaagatgtggttctgactatttttaagtcttttttttc

SEQ ID NO: 3265 - DNA, 1625 bp, Diabrotica virgifera
atttgggcagaaaaaaaatagacattcaaaatgggcaaagaaaagattcatattaacatcgtcgtcatcggtcacgtagattctggcaagtccacgtctaccggtcacttgatctacaaatgtggtggtatcgataaacgtaccatcgaaaaattcgaaaaggaagcccaggaaatgggcaaaggttctttcaaatacgcctgggtgttggacaaactgaaagccgaacgtgaacgtggtatcaccattgacatcgccctctggaaattcgaaactgccaagtattacgttactattatcgatgcacccggacacagagatttcatcaagaacatgatcaccggtacttcccaggccgattgcgctgtcctcatcgtagccgctggcacgggcgaattcgaagcaggaatctcgaagaacggccaaactcgcgaacatgccttgcttgccttcacgcttggagtgaaacagctgatcgtaggagtcaacaaaatggactccactgaaccaccctattcggaaacccgatttgaagagattaagaaggaggtgtcgtcgtacattaagaagatcggctacaatccagctgctgtagcgttcgtacctatctctggttggcacggggataacatgcttgaaagttccgataagatgccttggttcaaaggatgggccgtcgaacgcaaagaaggaaaagccgagggaaaaactttgattgaagccttagacgccatcttgcctccttccagacccaccgagaagcctttgagacttcctcttcaggacgtctacaaaatcggcggcattggaaccgttccagtaggaagagtcgaaactggaatccttaaacccggtatggtggtcacttttgctccagtaggcctcaccaccgaagtcaaatccgtagaaatgcaccacgaagcgctccaggaagcagttccaggagataacgtcggtttcaacgtcaagaacgtgtctgtgaaagaactgagacgtggatacgtcgccggagattccaagaacaatccaccaagaggtgcttctgattttatggcgcaggtcatcgtactgaaccatccaggacagatagcaaacggttacactcccgtcctggattgccacacggcccacatcgcctgcaaattcgccgagatcaaagaaaagtgcgatcgtcgtaccggcaaaaccacagaggagaacccgaaggcgatcaagagcggcgacgccgccatcgtcaacctggttccctccaagccgatgtgcgtcgagtcgttccaggagttcccgcctttgggccgcttcgccgtgcgcgacatgcgtcagaccgtcgccgtgggtgtgatcaaatccgtcactttcaaagacactgctggcaaagttacgaaggccgccgagaaagcccaaaagaagaaataactaggcttagtggtggctccttccgccataggcaaccagggaatcctcatcatttactattattattatttggtggttaagggggtggcgcggaattattttcttcgaaaagagttaaaaagggaagaaggtcgtttggatattttaagtcctttttttcattttattttaaggttaattcccttaaataataataataatattgttgg

SEQ ID NO: 3266 - DNA, 1551 bp, Diabrotica virgifera
ggggaggagaaccccccccaccaggggggtttttttttcccccatttctcaaaggggggttggggtttaaaacaaatttcccgggcccaagggggaatttaaaattttttgggggggcccctattttggaaaaaaagttaatggaggggcccccatgcccccggggcccgttaagtcttggtatcccttttgggccgggcccccccctttttttttttttttttttggtcaaaaaaaaattttccggaaaaaaaaaatattaaattatttacgttgcggatccctttctttttcaatcaacattttgaataaaaatcccaactttctcttagcgaatgggatgtatatcatgcattgttaaatttttgacctcttcaaagcgccctttttttttttttttaccaaatattactaatatgttcattaaaattatgtggaaaaactcagaaggagctgtttgcttcagattatttataaacaaggcatatttaaaaggagctatgtcacagttcaaagcttctaaagttttaatgaaatgtttatggtacatcatcagaagatcatcaaaatgttcttctaatacctctatctctacactactcataagaaagaaaattagatcagcggtgatctcttgtacagagtacacttgaaagtccaggaatttattttttattatctctccatcttcattcttcagctgcatggtgttatttaaccataaatctttatgtacaaacccagaaaatgcagacttgttaggtttaggcctaaaggaatccccagttttaaaaccttcctcttcaatactcatcaaaccatccaatttatttacgtgctggctgcaaaaactgtcttgtgtgagaatttgtttcagtactgttcttggtatctgtggtggaccatgatcaccatcaggacctttagctgtggggttatccacccatttcggcataaaagatttgtcgacaaatgtctttttaaacaattccgggtctttctgtttgattgctaaaggaattgcgtggaagacagctaggtcagtcagcagtaatttggcaccgtctaagtcgaatcctttgtgcctgtctgcgttggaatatcctgcagcttgaagattttccaaaatcatgactgcatctccgtcaggttcttcgttaccatcaagatcgtatctggcagcaatcaattttggaaaaaattccacctccttcaatccatgttcctttaaaaacttctgcattgtcggtattatttccttatagaaggcaatttctggtttaaacattcgatagatatcatcagcaataccttttggcaacttttcgtcaatgacaggacatttagcgacaaaatattcggtgtttgtagtcttggtgtccttatttctagtcgctatttgcaatctgagcatgtcactaaggtaattctcacctggttgagtgaggtttgttattgtcttgtctactatctcaacattttctccaagtgctggtttcaataaattatttaggttttttattctctcgccttccatttttcgtagaaaat

SEQ ID NO: 3267 - DNA, 998 bp, Diabrotica virgifera
  misc_feature (3)..(3): n is a, c, g, or t
  misc_feature (14)..(14): n is a, c, g, or t
aanataaaaagagntttatcggacgcgtgggcccccccgggcctcaatcctctgttacaaaatgaataagttagcagtgttcactttattgtttgctattggtttccaatcatcagccggattccgggcggggttcagatacaatagagatgtgcaagtaatggtgcctgctggaccagtaactctagaagctcaacctgcagttcaaactctagaagctaaactaccagcagttcaaactttagaagcccgaccactatcaattcaaactctagaagcccacctaccagaaattcaaactttagaagcaagacctgaagttcaaactctagaagccagaccagcaattgcaacacttgaagctagacccgaagtttcaactcttgaattgagaccagaagtttcaacccttgaattaagtccagaagtttcaacacctgaacataaactaaccgtaaatgacaagttggctatgatcaaacaatgggttgaagaacaagctaacaagccaatctcccgtctaagactaaaagaaaatttggctattattagaggatggctggatgatagagcaaacaaagtacgtcaaagtgttgttgacttagagaacaaggtcctcccagccatccaaaagttgaaggctgatgcatcccatgctattgacaccatcaaacaaaaagttaaaggtcaagaagcacaggctgaaagaacaaaaagagcgatgaagcagttaaatagacaaacaagagcgatcaaaaaacattgatgatgtcttagccccaaagacaaagattgatgtaatttttgaaacttactattatctataactgattccaattattataatataaagttaatgcattttaccacaattgtctcatattcttaaaataaacacagtttatcactaaaaaaaaaaaaaaaagggggggccaaatcctaaaggatccaaaaaattaaaacaaaaaaaaaaatagtccaacaatggatgggggggg

SEQ ID NO: 3268 - DNA, 504 bp, Diabrotica virgifera
cacgcgtcagcacaaatatcggcgtgtttgtttatactaattactggttagtagtgaagttgatcctaggattactagacgaacgcatctgccgaccacgcgtccgcccacgcgtccgcaaaacactagcgggagttgttgttgttgtttaacctagaaaattttagaatgggtaacgagtttagagatttggctgacgatttagaaaattggatgtcgcggttaccacaaaatgtgcgacaaataccaattactaatatttctatcccaggttctcatgacagctttacagccaacattacgaaagactctgatatatcccctgatgccgaagatatagttaaagaactctcaattttgggccccttatttaaagaggtcatagcaaggtggtcacgaactcaaagctttttagccaatgatcaacttattagaggtattagatattttgatattagaacttctacaaaagaaggaactgacgaactttatatagtacatagt

SEQ ID NO: 3269 - DNA, 1210 bp, Diabrotica virgifera
  misc_feature (1076)..(1076): n is a, c, g, or t
tttcgtccgattagtgtcataggtaaaaataaaataataaaaacgtaatacttacacaagaaaatttattcagtttaaatagaatatcgcccttcggggtgtaaaacttgattgatagtgcaaaatgtcgttaagagccttaggtagtcgtttatttaaacatggtagtgtacttattcgtaacacacgaaacaaaagagaattcaacaccaaaactattgccgacaaaattaatgctgctgcttcacatactcctcccagtaacttcaccagcaatcaggtagtacctcgaagcttcgctttacgaaatgtcggcgtgcaaattggtcttcaagctcgaagaatattaattgacaatgttctaaatcgagtaactaatagcttagctgcggatcttagaaaacgggcagctagaaggatcctgtttggagattctggaccattttttgctttagttggagttagcttagcttctggaacaggcattcttaccaaagaggaagaactggaaggggtatgctgggaaataagagaagctgtttcaaaattaaaatggcaccatcaagatatcgacctcgatgaaacccgattcgaaacttctcccgttaacctagacgatctttctttcggcaaacccttggccaagggggcaaatgctgtcgtgtatgctgcaaatctgaaaagctgcgattcgaacgtttctgaacagagtactgctgtaattgatattaaagacacagaaagcgatgatacgaataaatttccactcgctctgaagatgatgtttaactatgacattcaatccaatgcgatggccatattaaatgctatgtaccgagagactgtaccagctagactgtattacagtaacattggtatatcagattgggaaattgatttatcaaaaaggaatagacatttaccaccccacccaaacgtagtcgccatttttttcggtattcaccgactatgtacctgaattgcaggactgcccgtggtctgtaccctgcggcacttccaagacggattcatccagatggagaaggaagaaatatgtcactgtttctgctgatganaagatacagcaccaatctagaaaacttcctacgaacatctccaccggtccgtgagatcatctgtacttatctttactcaactcctttgaagtatagctcatataaatgcgcacggaatagcacatcgcgacttg

SEQ ID NO: 3270 - DNA, 1001 bp, Diabrotica virgifera
  misc_feature (919)..(919): n is a, c, g, or t
  misc_feature (931)..(931): n is a, c, g, or t
tttgtcgtccgggctcaaatcaccagggtatataatgaaagttagctgatcgataacattttgtagttgatctcgtgtcttgaatgaattcacgataaacaacaatgaaattcatatatttcttattttctattgtcgctttgatggcattcgtatacgccaacgaccaagaagtcttctattcttcagattgcttcagacctgtcgaataccacccgaatggaattgcttgtatggccctcattcctgtctggagatgggacgtcggagctcaagcttgtgtacgtgacacctatggtggatgcaaccccaccaacaacaatttccccaccttggaagaatgtaacgaagttgctagacccatttgtcaatatctaagagcttcggtcttctaagatttagacattttctttaataaaaattataaaaaagcttaaaattttgattgtttcattttttcaatttttccggacctttttgagagggaggatgactcaaatattattatttgatttgtttttaggcagtttctgcagaaaaatttgagtcacctctcaacgtctaaatgtactaatatttttacagatgcgtcctggtctatatgggatggcactacaaacgatgtaaagttagttaaacaaatatagaggtagtttctctagactccggctaatctgtagatttaatgttgctgcttttgttgatatattaatctaaaaatgctcactttgtggcttaggccactgttgctctgagccctaatttgtcgtcacaataacttctttgttctacgattttacccgtcataatcaactgtaataactcgtatttaacatttctatttctgtgtgtcccaaatatgctgttttatctcttattaatgctggtaaaaagttctctgtctcttctcattctgtgncacatcatttcngtcgtaatatgatcagtccaccttatttcaaaattcacataaaaagccatatgtcaaaagcttctagctt

SEQ ID NO: 3271 - DNA, 874 bp, Diabrotica virgifera
gttatggtggtttttgttattttgtagaaaataaagatataaagatgggagattatattaattcaaaccaacaggactattattggtcccaacagaatcccccaaacaaccaagggtattatgaacaggactacacccagttccaaaatcaaactttagaattcaacacaaatattgaatacaatgatcaggcattttccaatacacctcaaatgcttattcctgagcaatatgacaatataggaaaaggtgaagatgaatttgatgagccacccttactagaagagttagaaatctatccagatcgtatattagaaaaaatattggcggttttgaaccctctacgaggccacagcctagccgatgatgctgaataccttacaaaagactctgatgtagttggacccatattattttgtcttctattagctgccaatttattcttagctggaaagagtggttacatatatggtatctcaatgatatcgtgcatactaatgtatgctctgttgtcgttgatgtcaccagacaacggaacatttagcctttctatcgtaggaagcattttaggatactgtctcattccaatagttgcattatcgagcttaggaatattttttaggctcaatggtcctactggattattcctggctattctgactattgcttggtcaagtttatctgcatctagattatttattgctgtttctggagataaggagcagcaacctctcattgcttacccctgcatgctggtatatggtgtcattactttgttagtactattttaaattatttcttcttgtttcagagtatttatgtatattttctagaattttttaacaatgtaataaaaaatttataatactgccag

SEQ ID NO: 3272 - DNA, 996 bp, Diabrotica virgifera
  misc_feature (730)..(730): n is a, c, g, or t
  misc_feature (930)..(930): n is a, c, g, or t
ttctataaactacatttttagtttactcttgtgactttcaaatattagttaaaaactatgatttccttaagatttacaaaaggcgttattctttacttccttgggtggtggtttattggttttacattaaatgcaggagcagtcagcatgaatacaggaacagatgccaatttaaggtgcggtcaaagaaataagcgaggtgcaggcaatcaattatcgggcgcccaagatggagaagctcaatttggagagtttccttggatgttggctattatgaaaaatctgcctggcaaggatccagcctataaatgcggaggatctcttattaatcccaatgttgccctaacagcagcccattgcgtcaccgacaacaatactgaaagcaaatacatcgtaagagctggtttatgggacatggaacttttagttgaaatccttccccatcaggaccgagaggtaaagaagataatagttcatccagagtttataccacaagctttatacaacgacattgcccttttagttttaacaacaccattaactttagccgaacatattcgtacagtgtgtttgccaccacaaggttttcccctggattctagcatgggaagagcgttcgtttctggttggggtaaaactaaattagctaatgaaattcttgattccgctactattctaaagaaaaccgacgtaccaatagttgagaaaacaaaatgtgaagagaacttanaaaagacccgattaggacctaagtacaggatgcacgacagtttcatgtgcgcaggtggcgaggctaacaaagatgcatgcaagggagatggaggcagtccattggtacttccagtaggagaagataatactacatattttcaggctggtatttgcatggggaataggctgctgggaagagtctcgccccggagtgtatgntaatgtggggaaatcagaaactggatagatgagcaaatgaaaaataataactttgatgcaacaacg

SEQ ID NO: 3273 - DNA, 1558 bp, Diabrotica virgifera
  misc_feature (825)..(825): n is a, c, g, or t
ctagaaaagtcaccaaatacatcttcttttttggttgatcatatctcatgtcggccctcaacggtaatccataaatatattatattaatacgtcgctaaagagttctaaaaacaatcactcctcctggtttaaaaacaaataacgtatagtccgtccgctgtaacttttcccatgcggtgcgattcattttcaatcgaattgagtcaaaacataaattgaaacgaacgtcgatgggtatatacattttgtatactgtatactatatactacacacatcggcgtgcgtttcactttctgttttgacttggtttgattgaggatgagtcgtgccgcatgggaggagttatagcggacggactatagtagtcattgtaaataaagatattaaacacagtttaacacagtgcataacagacagtcttcttcatgatgtgcctgttcgtgacagatgttggcaaccaatcgacgaatcatggcaatctttttattatctgcagtagcgcggaaaagctgcagagatgttgtgttgaaccatgttctgaggttctttaaccaggaatgccttcgtcttcctggacctcgtgttcgaaatatttttccttgcaggatggcttgtagaagggcatatctggattcatttcgcataatgtgtgcgaagtattgtatctttcgagatttgatggtggttaatacctttcggttcttcttcattcttcattattccaaagccctccttttgtgacttgggatccacaggatcttaagtattctccgatataaccttctgctcggatcttcgttcaaggtccacgattcaacaccanaggacagagaagatgtagcttcacatcattcttacttttataccaagaaagagattgtagctcttgaagaagaccctcacccgattaaagagtggatctagcttgaccttctactatctttttgttgctaattatcaagagcttggattatcagaaaactttttaccttcttgttaagttaatctaatgacaatcttaatagttttcttttcaatgcaggtaattacatgtagagagataggtcaaaaatcggacaagaactgtttaatataggtaggtatatatgtatatcaaaattaaaaaaaaaaaccttattgattttaactatacatataagaaaatggtcttgatgaccacccttgcaacccttgcaaccaactagactttaataaagtgtctctgatagcgacttttgtcttggattatgactatcaagaaattattctatgcttcttttggttctaatgacactcatcaagatttaaaagaagtattgtgtaaaaaaatttgttgttgttgcaaatatacttttgaaatacttaataataaaatttctacaacagaaaaatggcctaaatcagatacgtaatagatatgtcccctgttaatttttaagtatttaatttaattataaaaattaagaaagtacgaatacaaatttatacaaatttgtataatattgtgatataacaaaatgttaataatgtaattttaaataaagtttaattttttt

SEQ ID NO: 3274 - DNA, 945 bp, Diabrotica virgifera
taaaaagatgattacaatttaatcaaatttactgtgggacctgtaaatttagttttattgttaagtcacacaaaactttcaaattcccacactgaccctttcatttttatactcattttatgctttgaattcaatgagtcctctggaagtaatcttttatcctttatgctaatctttcgaaaaatgtgatgtttgtgtttcctccaaacgtgatttttgtggtgttacgactcagataaatcctttgtaattttgggaaactttgttttcgtcacgttaaaataccaaatttttttcgacacatgcgacagcctgtaagccctgcgatatccatatataattgatatgcctatccgtgatgaacgttggcaatcatcatggctatcttattcgcagcagtgcggaaaagcttcacagatgttgaaccaggttctgaggttatttaaccatgatcttgttcctggacctcgcttttcaaatatttttccttgcaggatggcatatctggattcatttcgcataatgtgtccgaagtattataactttcgagattttatagtggtcagtatttctcggttctccttcattcttctgaagacctcagcccataggagtttgaatattctcctatacagccgcatctcaaatgcttctaattttctgcacacatcttggctcaaggtccgcgactcaacattataaaaaacggcagagaagatgtagcatcgcagcattcttacttatatcaagagagaggtagtggctcttgaacacggtccccatcaggttgaaggtggatctagctttcggatgcgcactctcacacatccctcatccatatattacacagcccttttatttttactttctgaacagacctcatattttatacctaagaagctttgtatggctttgaacaaaaaaaataaagaacttaatttttgc

SEQ ID NO: 3275 - DNA, 815 bp, Diabrotica virgifera
atttagtataattaaatattgcaccttgctcaaaaaaatatgagataaataccgcggttttttatatgaaaatgcaaagcaaaatatacaatttgcagagtaagttcttgttttttttttttaataagataatacaaattgtatgagagtacctacctatagttcgtccgctgtaacttttcccatgcggtgcgattcgttttcaatcggattaagtcaaaacataaattgaaacgaacgtcgatgtgtatatacattttgtatactgtatactatatactaaacacatcggcgtgcgtttcattttctgtttcgacttaatttgattgagagtggattgtaccgcgtgggaagagttatagcggacggactatatagtagctacgccacctgagacacgaaaaggatgaaattaattctattttttttatggagagttttttaaaataggtaacatcattacaaaatattttgatattaatacaagtaattgtttgttattatttactgagcctttataattttgactaaccaattttataaactactacatatttggaaaatagcatttaaaaaaatactgtatttttttatttataatacaaaatattattattcattttctacttaagtacacaaaaaaactatgaaactataacaagagtttaaaatataaacacaaaactaaatacataatttcccacaacagtcgataaccacacttaaaattttttaataattcacaccacagaatatcagttacgccaaatattcaaacagaatcaacaaccaaacaccctaaacgtagtcacaag

SEQ ID NO: 3276 - DNA, 1087 bp, Diabrotica virgifera
ataatatataaaaacctatcgtaagtgatcatcggatctgaacttaatacagttgtggaaaatttgtataagcacaaatattccacaccgttaataatatcccgattaatattaaaacaagcagtgtcttaaacactgcaattataatgtagagttaatgtattacaagctatatttacttaagattgaaaactaaataattgatacgtccatttttatgattgaatatagataaaagtaaaaagaattaccaataggactataattttaaatatgttttaataatactagagtaggagaaatgaaggaatatccatgagcgaacatatggagcgcgctgtattttcctgtcaccgtgtcacacaaaaggttggcaagcgcaagtgcatgtaataataattgttacatgtgcttgcactggacaattttctttgtgacacggtgacgggggaatgcagcgtgttttatatgttcgttcatgggtatcctttcatttttccgactgtatacatttttcatgcaaatataatactataacaattaaaattacattatttagataaaattgattctacacaggcagcgttgtaactcttgaaaatgattttgttatatatgggctccgtgcgtgaccatggtggggatacacgaaactatgccagcgcccgtagcggcgaaatatgagaactttggcgaattcttcttcttgatgtgcctatccgtgacgaatgttggcgatcatcatagcaatcttcactttatctgcagcaacgcggaaaagctgcacagatgttgtgttgaaccaggttctgaggttctttaaccaggatgttcctcttcttcctggacctcgctttccaaatatttttccttgcaggatggcttgtaggagggcatatctggattcatttcgcataatgtgtccaaagtattccaactttcgagatttgatgatggttagtacttcacgtttctcactctatattataggaaccttataatatgtgaaccgtacagtagcagggaattatatcaactgtacgataccccatagctatctactgtctacagatgccaatcccagatc

SEQ ID NO: 3277 - DNA, 1009 bp, Diabrotica virgifera
cccatattatcctttatgttatttcatcccagatttggaatatgtataggtatatcgtccgtgcgctataccttttcccagccggtacaattcattttcaatcaacccaagtcaaaacataaattgaaacgaacgtcgatgtgtatatacatcttgtatactgtatactatatactacgcacatcggcgtacgtttcacttcctgttttgacttaatttgattgaaaatgaatcgtaccgcaggggaaaagttataaagctgctaaaaaagacaatctaaattaaggctgtgtatgtcaattatttgcccagttgttacatatggaagcgaaacatggactttacattagcgggaaataaatgaggtgctggtatttgaaagaaaggttctcagaatgatatttggcccattaaagagacgaattaacagaagaatggataagccgtcgcaaggctgaattggcgactgtatcgtactgaaaacatataaaagctaaccggataagttggacaggtagatgtcatgtggcaagatcagaagaaaatagagtgtttttgagagaccagacggtagatcagtaggccgtcccagaaaaagatgagaggatgatgttgaagccgatttatctaggattgtggtacaacaaagaagacaatagtatttgtcgcgtaagagaaagcactttattaaaaaaacatacagatacaaatcaatgttttgggaatattacttcatcacagacacacaaatgtaccttagcaaggattagggtagacctgccaaccctagttctgatactagcttcatgatagtatacacatgaagcagagttacctataagtgtctacatacaactatatagtcaatattttcagtttttaacgttttatactaaattaatttgatctgatgaaaaaagttgatgtagcaactgatttaagctacaaagactgtacgtaactatctgctatcaaataaaagagactaaaaaactgtataagtattgtc

SEQ ID NO: 3278 - DNA, 1165 bp, Diabrotica virgifera
ctgagtggcaatttccttctatagacgtggactataatttcagtgtttttctagataagcttctccacatcttcaataaggcatttcctttaattcctattaagccaaaacatcggaaaccttgggttacgaaaggtattcgcatatcagctaagaatatgcgttcactactatacatcaagaaatttactaccaatgttgctgtcactgaatatatcatgaagtacaggacaacatatctaaaacttgtcaggtcagctaaaaaagactattatcaaaatcgtctgggaagctctaaaagtgctgcaaaagtgcaaaaaaaacttggtctatcctgaaagtctaaacgactacttcgttaatgtgagtaaaaatataacatcaacaattttgccgcaacaagatcccatttcctatctttctaattcaagacaggtctcgaattcattctttttacgaccagtcgataactctgaactgatccaaacaatcaatagtatcaaaagcaaatcatcctgtagtactgatgaactatctataaaatttttctctaatcttacagaaaatgtgttggaaatcctcctctcactaattaatgattccttcgaaaaaggtaaatttccagagtgcctaaagacagccattattattcctcttcataagggtggcgaaaaatctgatgcctgcaactatagacctattgccttactaccggtactctccaaaattattgagagactcattaaaactcgacttatgtcctttatcgttgataacaacattttatcacaaaatcagttcggctttttaacaaataaatgtaccactgatgccatgttttctgtactacatgaggtttaccaagcactaaacaataatctttatactgccactgttttctgcgactatgccaaagcttttgattgtgtaaatcacgacatcttgattacaaaactaaatttctatggaattcgaggtatttctttgaattggttccaatcctacttgaataatcggaaacaactagttagagcaaatgatactgactctagtctcaaaaacatcgtctgtggagtacacaaggttcagtattgggtcctatactgttccttatctttataaatgacattactatttttaaaatcaatgagaaaatttttctttt

SEQ ID NO: 3279 - DNA, 1435 bp, Diabrotica virgifera
ctagttctagatcgcgagcggccgctcgccccacgcgtccgaaaaatgttcattatgaagcagttgttgttaatttttgcgcttctgtatagtaccaatgccggtattagcctggacggagtggccaaagctattaaagacaaggcttcgtcaggtgtgaccaatttagtagatggaataaagactgacgctagtgctattcaaattggagctaactctgctcttgatctcggcaaagagacaacaggagatatttctaagactttattggatttgaaattggaaaaccttgggacacaaaaacgtactccagtaccagaactagttaaaaatgaaggatatcccgtagaaagttattatttgactacatccgatggatatattttaaacatattcagaataccatatggaaaaagtggcaaaaaacttaataaagtggcatatttacaacatggtctttttgagtcttccgatgattgggtactgatgggttccaaaagaggtttggcatatatccttgccgatgaaggttatgatgtttggttaggtaattgcagaggaagctattattcaaggaaccatactcaatggaatccagataaagactcggagttttggcaattcagttggcatcaaataggtactactgatataccagcaatgattgattttattcttgagaaaaccggagcgactaaattgtatcatgtaggacactcccaaggtactacctctttttatgtaatggcttcaatgagaccagaatataatgccaaaatagcacaccatatcagtttagcacccgtagcctacatgaatcatttatttagtcctttaatgagagctatggcactaggtactcttcctataggcttgactttggagtctttgggtaagaacgaattcttacctggttcgggattcctcaatatgctcacagatagcgtctgttctgaaggtgtaggacaagtattatgtaaaaatactctttttgcaatgaccggattcagtccaaaacaaatgaacgtttctgatttaccactgctcatggctcattatccagctggtgcgtccacaaaacaagtcgaacactatggccaattgatcaattccggtcgattctgccagtacgactttacgatattaaaaaacaaagaacattatggccagatcattcctccagattatgacttatctaaaattacagcccctattactttgatgtatagttccaatgattggttggctgccgtagtagatgtggaaaaattggcgaagcaattaccaaacctgaaggagagttataggataccactagtgacttggaaccacatcgattatattttaggaaaagacgccccaacgctagtttacgagaaagttgtaagtgttctctcacaaaattaataaaacaagttgctaataaattcataat

SEQ ID NO: 3280 - DNA, 1046 bp, Diabrotica virgifera
caaggtcgcacagcttagaatttggattattttagtttaggggatcataaaaatgttttggcttttggtcggggggggctattgtggcactggtggctcttatctattttaaccagaagaaaaatgaggagttttggaaacaggttatggctattcctggtcctgaaggatttccgttagtgggaacggaatatcatttagattctacagaggaagcttttgtcagggacaggacctatgttaaattatatggtacaatatttagaagatgggcatcaggtttggcttatataagtttatcaaatccagaggatattgagttgttattaaataatactaaacatcttgaaaaagatgtattctacgatcttcttcaaaattggcttggacaaggacttttaactagcaaaggagttgaatggcacaagaggaggaagattttgacccctgcttttcattttagcattttgcaggaattcgcagaagtatttaataaagaagtcagccttcttgttgaagatataaaaaaatcttgcagcaaaccatacattgacgtggttaaaccaatatcagaatttacgttgtattcgattggagaaacttcattggggaaagatttacgtgacgacccaaaatgtgacgaatataagcaagcagtgtacgactacggcgaccattacatgtacaggatgattcgaccctggcttcacggctcattccttttcaacttaacggaagtcggtaaaaaagcacaaaaaacctgtgaagttctacacgatttttccaataatattattagagaaagatatgaaacgttacagaagggtgctgatgcccagttcgccaaaaagagattggctttgttggacttgatgattaaagcaaaatataatggagccagtattgatgatctggggattagggaagaagtagatacctttattttggctgaagacgctaccactgctgtcgccttaatgcacattctaatgctcttagctaatgaacaggaagctcaggaagaaatctaccaagaaatacaagca

SEQ ID NO: 3281 - DNA, 866 bp, Diabrotica virgifera
  misc_feature (814)..(814): n is a, c, g, or t
caatgatttcgtctatagttctcctcttatgtgtttgcatgagtgaatttgttgtgtcagaaaaaatatctgctgctgcccctgctgatgtaaaattcacaaaactattggacgttaagtttgaaagtagaaccagctctctaagaaatgatattggaagatttctctatcctcaaactgaagatatcgacataggaacaagagaagactatttgcaagttcctgtaaagttgttatttgggatagatagacaaaatgggattcaagaatatgaaaaaaccatttcaagtatgtttgaacaatgtaaatatttggtaggaaggagtcaaacaccgttttgtcgcttgaatctcgttgagaaaaatctagaaaataatcatccaagaagttgcagagaaatactagaaactggaaacaataaatctggtgtataccaaatcaaaccacgtaccagcagaaaaccattcgctgtactgtgtgatatggaaactaagggtggtggctggactcatattcaaaagagatttgacggatcacaggatttttatctaccttggagagattacaaattcggttttggtgatctaatgggtgaattttggcttggactggaaaatatttatcacatgacagcattcgatagaaacgaacttcttatagaattaacagagacggacaaaaatattagttatgcacaatactcaacgttctcaattggctgcgaaaaagatggctatccgcttaaggaacttacaggatattcaggcaatgcaggagatggtttaaaataccatctcaatgcaaagtttacaancattggatgtagatcaagacaaagaatggtgggaaattgtgcacaaaaatat

SEQ ID NO: 3282 - DNA, 1994 bp, Diabrotica virgifera
aagaggagattttggtttgatgggattcccaggattacctggatccgaaggaagacccggtgtcataggaaaaagaggtcgacctggagcacctggagttagaggtgaacctggctattctgcttatagtgctaagggagaacaaggtgatgttggatttagaggtgcgccaggattcaacggaacgaaaggagagcgcggtactgctggacaatggtttatctggacctacaggtccttctggacttaaaggaatgatgggcatgtttggattcgaaggccagaacggatttcccggattaagaggacaaaagggagaaccaggtgactatgctattgatgcacaaccaggtgaactgggtgacattggtttaccaggaatggacggttctagaggattacaaggattaccaggccggggtggggcaccaggaatacgtggtgcgatgggtgatagaggtgacactggtcttgctggtcttcctggtttaaacggtcctaaaggaatgagaggaatgccaggtttcaatggtcgtgtcggtgttaaaggttacagaggtgctaagggagaacgtggtgaacccgctccacaatatttaggacctcagagcagaggattccacttcacaaggcattctcaatcagaaatcgtacccgtttgtccaaaaaatactgtcaaaatgtgggacggttattcgttattgcatattatggggaacgaaagatctcatggccaagatttaggggccccaggaagttgcctaagaaaattcaataccatgcctttcctgttctgtaacattaacgatgtctgcgattatgcccagagcaacgaatacagttactggttgtccaccactgaacctgtaccaatgacgatgacacccattgccgctcaaaatgtccaaagatacatttcaaggtgttctgtttgtgaagcgcctaccagagtagttgcagttcatagtcaagctacggaaattcctcagtgtcctcaaggttgggaagaattgtgggtcggatacagttttctgatgcacacagacgctggagcagaaggttcaggccaatctctagtgtccccaggttcatgtctggaagaattcagacctaaacccttcctcgagtgtcacggccatggaacctgcaactactacacaacagccgtttcgtattggctcgccacgatcgagaactactcaatgttccgcaaacccagaccggagactctgaaggctggttcactgacacagaaaatcagtaggtgctcagtttgtattaaacgcaggatcgactcaagacgacccaaccaacctgtacctgaagtacctagcgaaattaaccacccttataggtcccctggtaacagaccaaaagatcagccatcatatccatcatcatctggatcctcatcaggttcatacactggctcacaatacagatcgtcttctggatcacaatatggcggttctggatcacaatatggtggttcttctggatcacaatatggtggttcttctggatcacaatatggcggttcttctggatcacaatatggcggttctggatcacaatatggcggttcttctggatcacaatatggcggttcttctggatcacaatatggcggttctggatcacaatatggcggttcttctggatcacaatatggcggttcctctggatcacaatatggaggctcttctggataccaatcatcaccgggatcaccgtacggaacatcttccgcaagttccccgtacggaccttcatacggatcttcttcagcgggatcgtcatcaagttcaggcaggcaataccctccgtactaccaaccggacaccgggcgttcagctgctggaaattcaacgagtacttcgcaacgtagagcgcatagaccacccggctacagacctcataatcctccacccggctttataaatcctactggtaccgccaatccaaatcttagaaatctcaacaacccccccccc

SEQ ID NO: 3283 - DNA, 900 bp, Diabrotica virgifera
  misc_feature (735)..(736): n is a, c, g, or t
  misc_feature (793)..(793): n is a, c, g, or t
caggatgagtagaagaatgcttcgaccccaaagtgccacgtcaagacaagaaacagaaatggcttcaaaaagtatgcgagaacttcaagcgcttggcaacggaggagatcccgtccaacgtcttaggctgatatgtttatctagaggagctaccggaatcttaggacttggaaggttatttagaataatggatgatgacggcaataaaaacttaaataaagaagagtttttacatggccttaaagaagtaggattagatttaagtggagaagaagcccaggagatgtttcagaaatttgatacgaatggagatggtagcgtgaatatagatgaatttttagttcatataagaccaccactaagcgaaacccgcaaaaaagtcatagacgaagcattccagaaactggacaagactggagacggcgaaataacaatcgacgatttaaaaaatgtctacaacgtgaaagcgcacccccgctacatctcaggagaagaaacagaagaatccatcctcactagatttttaggaaatttcgaaaccgactcgaccagagatggaaaggtcacacgcgaagaatttttgaattactattctggaataagtgcctcgatcgacaatgattgttatttcgatttaatgatgcgacaagcttataagttataaattgtttgttttgaagtatttgacatcgaaatgtatttgcttgttctctttaactatatttttaagaatannatgtatatggccaacgttataaaagactatataaaatgttagatccaatatttttanatcttactttattttaagtcctaaaaataaattatattaaagttgtgggaaaaaggtctaactaaaccaaggccagaaaacaaaacaaaaagaactaaatataaaaa

SEQ ID NO: 3284 - DNA, 1648 bp, Diabrotica virgifera
  misc_feature (1527)..(1527): n is a, c, g, or t
agaaaataacaaatacattaggaaattattttcaaacagttacaaatatcgcaaaagtataatggcacaggtgaggcttcagaatgctgtggagccaatgcaagttgatgcaccacctgaagataatgataacaacgaagaagacatctatgtagttgaaaatccaactctagatttagaagtatatgcaaatagttatgttggattagcaaaattatataggctgatttacataatagatcactgtccgtctcttaaactagaagctctaaaaacagctatatcctacgccatgacaacatataacgtaaatttgtatcaagtgttacaccaaaaattagctgaagttacaacagctatgaacgtgcctgacgtagctgctcaatccacctctcaagatataccaacgattgacaatatgtggatggaaacaaggtcaaaaagagcagccctaaagttagaaaaacttgacaacgatctaaaaaattacaaatcaaattcaatcaaagaaagtatcagaagaggtcatgatgatttgggcgatcactatttggactgtggagatctttctaatgcattaaaatgttactcacgagctagagactattgcacaagtgggaaacatgtggtaaatatgtgcttaaatgttataaaagtatcggtttatttgcagaactggtcacacgtattaagctatgtttcaaaagctgaaagcactccagacgtttcagaaacacaaacaaaagactccaatcaagcaatagtcactaaattaaagtgtgcagctggtcttgcagaactggcaacaaagaaatataaatccgcagcaaaacatttcttgcaagcaaatttggaccattgcgattttccagaattgctttcaccaaataacgttgccatgtatggaggtctttgcgctcttgctacatttgatagacatgagttgcagaagaatgttattggtagtggatcgtttaagttatttttggagctagaaccacaattacgcgacataattttcaaattctatgaatcaaaatatgcttcttgtttaaaactattagatgaggtcaaggataatttgcttcttgacatgtatattgctcctcatgttaacaccttgtacactcagattagaaatagagccttgattcaatactttagcccatacttatctgctgatatgcacaagatggctgtagcttttaatcgaactgtacctgcgttagaagatgagctgatgcagcttattctagatggacagatccaagctagaatagattctcacaataaaattctatttgcgaaggatgttgatcaacgaagtaccactttcgagaagggtttgttgatggggaaagaatatcagagaagaactagaatgctgatattaagagcagcaattttaaagaataaaattcatgtaaagagccctcagaggggattcagtcagggcagagaaataactgtggtaccattttgaaaatcgactacctatttttctttcttgtgtattcatagcagttncattatattcagtgtaacagcgaatttcttttgttttaatattacttacataacaaaaaattgtctgaagcttgaaaaattttaaaatttttttccttttaaaaaactttaatttttggtg

SEQ ID NO: 3285 - DNA, 1130 bp, Diabrotica virgifera
ctaactaaggggaagaaaaactttcctgggcgaatttttacttaccttttaggtcaggatacaacagacgccagagaattggaatggatcgcatgttcaaatatgggttattggggcaatataacagatatgggggacatacgtgagaaaatgctccaatatcttaatgttatgtcccgtcccataaatttaaaagctgacaagaatcgaacatttatatggagttaccttcacgtggaccttgcagatagaagactgtcaaactggctgtggaaaaaatttgagggcatacgacaaagagatgtcttcttagattacatcaaaaggggtatttttcgacagaatttgatgttaaccagcgaaaaacatatgcttttaaaagaggaatacacttatcaaacttacctctcctaccaaagagataattctgcatacgattatatgaccacagtttctttacctgtgtttgcaagaagaccacatgagtatcaactgttgggcgtagcaggcatagatgttcctttaagtttatttaaacagctcatcccttacgaaaggttaggggtaaatggttacgcctttattgttactaataacggctatattcttacacatccggatcatcatacagagtttcagtatattttaaaacctacgttcaatcgagtagacatcttagaagtagagattctaaatgatgataaggagcccagaatgtttggagactccgtagttaagtttcgaaaaaaactagttaaccaggaaagcagtgtcaacgtaaccctaaaagtcaaatatgctttgaatgacaataaacggttgatgtttgctcatagacactactattttgctgcaattggacctttcacactctgcgttgtactgccgcataaatacggatttgacattgttaacaaaacattgttagagcgtcccagtgtcaaaagcagtgcttcttctttagcttcgtcctatttggaaagtacatccagattggatctattgtaaaaaatgtgtaggtgataccccagaagataaagtaaggtccgcattcagcttgaatgaaaactcatccccttctgacttcgctcctatacgatatggaagccacaaaatggtttgacgaatat

SEQ ID NO: 3286 - DNA, 1251 bp, Diabrotica virgifera
tccccacgaaggtgaatgtttttagacgcgtaattttcaattgaataaaataaagcaccgcgtgttctgctttattgctgttgtttttttcagtgcgttgatattcgaatcatgtgggcgaagtctctaaccacagtagttcaaaatgcagctaaaacaagtggtgttcgggcggcttctacaattttacctggggagcctaaagaaccaattgtagtcaccttggaaatacctggaccaaaatcgaagcagctcatttcagaactagatactgtgacacaaagtggaactatacaattttttgccgattaccaaaattccattggaaattacatagcagatgtggatggaaataaatatttagatatatttatgcaaatttcatcgatgcctctaggatacaaccacccagaaatgttaaatgttttcaaagatgaggagagtttgaaagttttagtcaaccggccagcacttggtgctttccctacagaatattggccgaaaaaactgaaagaagttctgatgtcagtgtcaccaggtctaccaaatgtaatgacgatgatgtgcggctcgtgttccaatgaaaatgcctacaaatgcttgtttatggcttacagaaagcatcagaggggagaagatgtagatttttctgagttggaaaaatcttcatgtatggtcaatcaacctcctggtgctccaaacctatcactactttcctttcacggcgggtttcacggcagaaccataggcactttatctactacacattccaaggctatacacaaactggatattcccgcatttgactggccagtggcgcctttcccaaagtataagtatccattagaaaaaaacgagagggaaaatcgacttgtaaaaagataaaatggtttacttgcccgtaaaaaaaactgtatttgaaaaaaataaaacaaaaaaaagggttgcccccgtttggttggtaataatccttcaaaaccgatacccaccgggaaaggaagggggaaaaaagaaaaaaattttccctgaaatttttttccccacacaaacaacaaaaaaaatatgaaaaaaaaaaaaatgggccggctgggttttttttttgcttgttaaaaaaacccaaacaggggggggggggggggcaaactcgcgcaaaaaatgggggggtggccccccaaccatttttttatcttttataacaaacaaccccccccccccaaaaaaaatattttcttcttttttttttctaacccc

SEQ ID NO: 3287 - DNA, 2351 bp, Diabrotica virgifera
tgccgtccgcacaaatatagatacaggtttcatccctgctccattgagagaactattaaagcttaagaaagtatcacctctacaatggcaagaatggctgcttgaccaaaaacaaaggaacaaatacattgatataacgcttattgaaaactgggttaaccagcaacatcaactattgaaggtagatattggaattatagaggcatggatcattcagcaacaaaacctgaaccccagctttttgtataactggataattctaaaactggttcctaatattttgggcaatacaagtgacccagcttgggatggacaaataagaccaccagcaaaagatcaaatttggcaacaatggctaatccagcaaagacaaaagaccaatcttgatttaactcctatcgaatactggatcaacgagcaacataaaacattgaatttggatatcgactttttgaggggatggatcatgcagcaacaacagttaaatcctaacttcttatacaactggataattaagaaccaagtacccaatatttcaaatggaagagaaccaatagtaccaacaaaagagcaaatttggcaacaatggcttatccagcaaaggcaaaagacaaatcttgatttaactcctatcgaatactggatcaacgagcaacgtaaaacatggaatttagatgtcgactttttgagggaatggattatgcagcaacaacagttaaatcctaactttttatacaactggataattaagaaccaagtacccaatatttcaaatggaaaagaaccagtagtaccaacaaaagagcaaatttggcaacagtggctaatccagcaaaggcaaaagacaaatcttgatttaactcctatcgaatactggatcaacgagcaacgtaaaacatggaatttagatgtcgactttttgagggaatggattatgcatcaacaacagttaaatcctaactttttatacaactggataattaagaaccaagtacccaatatttcaaatggaaaagaaccagtagtaccaacaaaagagcaaatttggcaacagtggctaatccagcaaaggcaaaagacaaatcttgatttaactcctatcgaatactggatcaacgagcaacgtaaaacatggaatttagatgtcgactttttgagggaatggattatgcagcaacaacagttaaatcctaactttttatacaactggataattaagaaccaagtacccaatatttcaaatggaaaagaaccagtagtaccaacaaaagagcaaatttggcaacagtggctaatccagcaaaggcaaaagacaaatcttgatttaactcctatcgaatactggatcaaccagcaacataaaacatggaatttggatgtcgactttttgagggaatggatcatgcagcaacaacagttaaatcctacctttttatacaactggattattaagaaccaagttcccaaaatttcaaatggaaaagaaccaataatagaaccatcagtagaaccaacttggaatatcgatagagtatccccagaagtttggcaacaatggttaatacaacaaaagcaaagaaacaacattgatataactgttattgaagactggattaatgagcaacataaagtattcaagctagatgtcggattattagagggatggattatctaccaacaaagcttaaaccccagctttttgtacaactggatagttaagaaacaagtaccccatattatagatggaaaagaaccaatagtagaaccaagtgagaaagaaaaagaaccaacctggaatggaaaagtggagaaagtaactcctgaagtatggcaacaatggttaatacaacaaaaacaaaagtacaacattgatattactgatattgaaaattggattaatcagcaacataaagcattaaagctagatatcgcattctaagatggattatttaccaacaaagaaccctctttttacaactggggaaaaaaaggaggtacccaatatttcagccgaaaaagtaaccccagaagagtggcaacaatggataattcaacaaaaacaagaaaaacacattgattttagtgtaatcaaaaatggatctaccagcaacaccagctattaaaccaggacgaaagagatttgggagggtggatccttaaaacaacaaaagttgaaccctagtttttttgtaaaactggatccatttgaaggagggttcccccaattccctccccaagggattttcccccccaaaggaacacccagtttgaaaaaaaacaaaattttcccctctaattggctaaaagggaaacgggtgttgtaaacaaggaaccccccagggggtttgggc

SEQ ID NO: 3288 - DNA, 2713 bp, Diabrotica virgifera
attgttttttgtttgtcatatttctttttatattaaaaataaataaaaatcatcggtatcaccaaactcattcgattcaatttttataaattatcgtattttcttttaatccaagataagtgaattaaaaacataataaatactccggatgcttcatagaagtctttatggtatatgtacgcattcatcgtgttgggcataacttcattcatgacggcgtcctgatccaagggtcctccatggtaacctttcgtaaaaacggcagtattcaacatcttttggtcatgtgcagatgttttgtgtttcgtttaggtagatcttatctatgtttcatagagagtgttagttcgaacaagactgcgtatgcatctaatggtgggatagcacgttttataatccatctacataaatttttattttgctacgagttccatgcgttttctcattagacctagatcacatattatatcataggaaagagcaaggtggtcgtgttcactaatcaatagttaaatttcaagttttgtattaaaaaaaagcaattgttagcatcatggaaggagaagcagcggccgagactaaagttgaatcaaccaacgaaaatacacaagaaaaaccaaataatttcaatcggggcgaacgccgtggaggcggtcatcaaagaggtggaagattcggacgaggtggccagaaccatggtggaaaccagcattttgaaaatagacgaggtagaggcaattatggaggtgttaatagaaaccacgcaaacaaagatgaaaacaatggtaatgacaatcgccaagaaggcgacggaaatcgccctggtggaagggatcgtgagggccgtgatgatcaaagaggagataatatgggacgaggacgaatgggaggacgcatgggacgcggtgctgaggacaaatttatggagaaggttcagcagatggctggcccctcctttgatgtaccgcctgtagatgtgacagaacgcaagtttagcggcagaaacagattgtatatagggaacataggatctgaagttacagaagaggacatcactgaactatttaaaccttacggggaaaccgcagaggtgtttataaacaaggataaaaattttggattcatcaaggtagattaccacgccaatgcagaaaaggctaagagagagctcgatggaactgtcttgaagtctcgcagtctcaaaataagatatgctccaaataatgctacagttaaagtaaagaatctcacgggctatgtaaccaacgaattattgcactacgcattttctatatttggagaaattgaaaaggcaacagtccgtgttgacgaaagaggaaaacccacaggtgaagctatcgtcgattttgtgcgcaaaggatcagctttacacgcgatcagaaaatgttcagatggctgctttttcctaacaggttccgtcagaccttgcattgtagaagcctacgaagttgtaaatgacaacgatggcttttcagaaaagaatatcaacaagaaacacccaggttttatgaaagaaagagaaaatgggccggcgttggcggatcttttgagaatgattatggaatgagatggaagcaactctacgatcttcatgatcagaaaatcgatcaggtcaagaaagatttagaacttggaatagctaaacttgaggcccaaatggaatttgaaagatatgaacacgaaaccgatatgctgagagatcaattggcagctcgtgaattagacaaagaacgtcaaaagagagaatgggaaatgaagcaaaggcaggtcgaggaagaacggatgaggtcagaagaacaaatgaagcggacaacagctgatatggaggcaagaataatggcccaacatgatgatctacgcagaagacagcaagaaaataatttatttgtacaagcacacaacttggactccatgcttgatcagcaagagcaagcctacgattcaaatcccggttatagtcatcatggaggagatggacaagaagaaactaacatgatggatcccaaatcattcatgagctcttacgagcgtggaacatctcgctttgatcggggcaatgcacgtgaacctcaaggagccagaggtggtggtcattgggtcaacgattctcgacgtggcggtggaggtgatgattttccaaataaacgtcgccgtttttaaggagaagcaagagatttactttgaataattgactttatactatcatacattgatttgagagctaaattaatagaaaatagcacatgtttagatgtccaaaggctgtcttagatcacaacttctgagtaagtgcgggttgatggctttggacatttgattatgggaatttcggaaattgtggatacgataaagtggtggtggtgcattccagttatttgtgaaaaccattaaacctttttcctttctgacattttctgttccctttaatgagatatctgtaccaatggataaagcccgcctgcccccattttggtcaaaatgttgggactttggcacccctaatatttttacttttagaatggataatacttaatggtagggaggatctaatttactcccaaagtgtggtcgcaccccaatttttttggcttaggacttgctttttttactctcttctacaaaaaaaacataaattatctatcttaaactctctgccatatctcacggcccacccccctcacccccccccact

SEQ ID NO: 3289 - DNA, 2109 bp, Diabrotica virgifera
attagatgtgaattaaaatgaaaaatgtgctttttattaattttgtgtttcattcaaaggttaatggtcatagttattatgaatgcaacaacaacttttgatccctatccctactcatcactttttatgggaccaaaggtcgtacagtttatcttataagattacaattaaaacaagtattcaaccttttaactatccattatcagagatattatattacattgtttataagtaacggtgttatcttttaatttcgttaagtaaagagttagtttcgagcttaaacctgagtgtgcgcgccagattttttaacaccatgtctcatctcatagaggattttaaaccaggacctctggatttctatcgtaagaaaacgtcttttgactggaaaaagttgaaggtgttccttgaaactgaagatggaatcgagtatcagaatgaaatgtacaaaatgctggaaagtaatcctgtgcacaataaggaaaacctcactagcctacctagagatgaacagcgcagactagcatttttaggatcatgtgatcaagcccaaaacgatattctgagatgggcttacttgctgcaaaacttacgaagaccttcatcccttgctagggtgttaacatcatcggtagcatcagcctacgtaaagcacacggtcggtaacagtttgtttgtcagctcaataataaatatgggtacagagagacaccaagaattcatcaatgacgctgaagctggaaagattttcgggtgctactgtttgactgaaatcgcacacggaagtaacacaagaggcatgcgcacaacagccacctacgacaaaaagaagcaggttttcgtattcaactcgcccgattttgaagcagctaaatgctgggctggtggattgggccagaccgccatgttcggaaccgtttacgcacagttaattttagacaaccagaattacggtctgcacgcattcatagtaccgttccgtgatcccaagacgctgctaccatatccaggattagagattggagatatgggaggaaagattggtttgaacggtatcgataatggttttgttcaatttaaaaactacgaaattccaagagtcaatctactcaacaaaatagccgacgtgtctgaagacggtcgttatataactccgatcaaagaccctaatagaagacacggagctgccttaggatctctatcagcaggaagagtaaatattgcagctatggttgactcattgggttcaaaagctcttgttatagcaatccggtatgcagcagtaagaaaacagtttggaccgaatggaaaagaagagttgccaattttagaatatcagagtcatcaacttcgactgataccctacttagcagcagcgtacgtactaagaaacttcaacacgtacttctcagaaaagttctacgaattcaccatgaacaacatcttgggcaactcctcaccgaatgcacctgaattgggaatagaaatccacggtgtttcttcagcgtcaaaaccaatggctggctggataatgaaggacgccgtgcaggaatgcagagagtgctgtggtggacacgggtatcttcatgcggctggtttgggcgatgttaggaacgaacttgatcccaatttgacgtacgaaggagaaaaccacgtgcttattcaacagaccgttaattggcttcttaaaatagctccgcaaatgcttgaaggtagacaaatatccactccattgcaatcaattgatttcttatcgaacggtttgaacattttgaagaatagtagattcagtgctagaggaaccgatgaagttagtcatccagaaagtattatcaaaatattccaatggttagttgtatatctattgaaagcaactcacgagaaagtagaagatgagttgaaggctgagaaagatttgttcgaagccaaaaacaacagccaagtttactacgggaagagtttaggcatagcatttattcagcatttcttctttgcaagatttttggtgaccatctccgaagcagaagatcctgctataaaagctgtgcttacgagaatattttcactctttggattgtggtcgatagaaaatggcacattgcgactcta

SEQ ID NO: 3290 - DNA, 1153 bp, Diabrotica virgifera
  misc_feature (822)..(822): n is a, c, g, or t
gtctccctcagcatccatctccaagtatctctgtccctggctgtgatcctccaccctcgatatttctttagcatcagttctcacttcttttattcgccttttcattgatcttcctatttctattctacttggtctgcatattatagtcgcttgtattctcttccctactatttcttgattaagccagaaaattctataaaataatgaaagaaagcacagtcatttataccaaaattgatatgcaaagagaaggaccgacaactactaacagagaagcaaaacattataaatagatggaaacgatacttagaaaaaaaccttaacgcagataatgaacatgaacaaaatgaaatatatacaccggagcaacacatcgagttaggaagaagtggttcagataataaagaaactaaaaaacaataaaacgccaagggcggaccgaattttggcagaattattacaacaaggaggatccgaactctggggaagaatccattatctaataatattaatatggaccaggaagcaaatggaggaatgggcagttggcattatgcaaccattataatataagaaaggagataagagggaatatcagaattataggccaattacattgctaaatgtagtatataaaattatttttggtatcatctataataaattgatagaatatcccgaaaatataataatgagtgattattaaaatgaactcagaccaaatagagctaccacagacaatatattcatactaagaacgattcaggaaaaagcttataaatacaacatataactacatatataatatgtatgtacctttanacaaacttttgataatgtgaaaagaaacaaaatgctggaaggtattcgttatctagatatgtatacctaacaaaaaatattttagcctcataaaaatggcgttcaaaagccgcagttgaatagatatagaactgtgggacataatttgacataaatgtgggagtgagacagggagacgtactatcaaccatgctgttcaatctggttcttgaggcactcactatacagcagtattggcagcctgattagttactcttttgattaaaactcttttatcatcttcttcgtcttgactcatttttcaatgaatcagtttgaaagttctttgatt

SEQ ID NO: 3291 - DNA, 1256 bp, Diabrotica virgifera
  misc_feature (1166)..(1166): n is a, c, g, or t
  misc_feature (1182)..(1182): n is a, c, g, or t
acactttcctggttagtttggaatatgtttgtcctagctaatcatgaaacatattaaattaatcagcatacagcttacacataataaatttatacttagcataagtagtaaaggttctctctctaaacctcaataaattgacatattgcatttcttttaaaacagtacaacctccgttaaccgaaataagtggggggggggggataacacaaataatattattttttctattcttgtatcaaattgcatagtattcttggtcaaagttggtattaataaatgctatgaggtgatatcgtaatgtgttgtatataatagcgttatttagttgtatgaaagcaaagttgagaatgttgacaaattaacatcggattggtttcattttccattaaaactttactttttattgacgaatttattgaaactgtcagccgttttggttgaacgatgtttgggttaaaaaggtttcagttaacagaggttttactgtatttacaatgtttttaaaaacgacatatatccactgaagtacttttgagaaaaaccattttgaatggttaatatttagaattaatattttttgaggtggcaattattgtagcttggtacttacttatatgcaacgccttcgggggtcgcagtagtgtgacttttgtttacaaaatagtagaggctggtaccaactcagtcaaaatgttataaagttatttttgacaaaatgtggatatatgtatgttgcttttaaaatgaccgtttcttatatattatatgtttatgtatgtccagactgtttagatttaaataatatatacaccctatgattcgcagtaaacactgacataaacattagcaactgtattagttgctgacagcataatagagatggttattttgtttagtttttgaatattctcgtacaatcgttacttgcataatcgcttaaattattcattaatttaattaataggattatttttcactatttattacatgatttcaataatttactatgcaataaaaactaattatcgagaaagagaacaattgataaagtaattttaataacatactgttactattggaacgaatagatacattttgaacatctttaataataaaactatctttatagtatacagcaatggtgctgattttagcgcttcttncagtgtcatatctaantcaaaactaaacagtctgtatgtacctacatataatctgtatgtagtattttgtgtcataattataaaatcatt

SEQ ID NO: 3292 - DNA, 1365 bp, Diabrotica virgifera
cccacgcgtccgattatcattatccttccgctcgacatctatttaccttgcaccttgcacaactactaagcacatcatcttcttgtgtatctgtatctgtagcaaataagtctatagacttatttggcacgtttttctttaattttatattacacaaactgaaatggatatccccggttttttgtatgctggtttagttgcagctggtggagtgtttggttattataaagcaggttctgtaccttctttagcagcaggtgtactttttggtggtgcattagcctatggagctgtagaaacaagccgtgatccttccaattacacacttcaattagctactagttcaattctggctggtgttatgggatatagattctacaattctggaaaaattatgcctgcaggtgtcgtatgtttaatgtctatagcaatgatcgttaggattgcgggaagagctagtggaattacaggacctagacatacataaatttagtggatatgctaaaaaggtaattgactattggctatatttgttttaagttgtacaaatagacaatattcagttaacaaaaccataatcataattatggtaatatataaatattatgttattagtaggtaccataatattttatgatttagttatttaaaggtgattgtaaaagtgctagcggtagttaaatagttatttgttaaaagatgtttggaaagatttgtgaagtgtttggaaaaattgaataaataaaaagaacatacattaacattttgatacgttattagagctgcagctaatttacttgttaaagttttacagtcacaatttcttctttctacattacttttactattttgagtatactttggtatacactttcctggttagtttggaatatgtttgtcctagctaatcatgaaacatattaaattaatcagcatacagcttacacataataaatttatacttagcataagtagtaaaggttctctctctaaacctcataaattgacatattgcatttcttttaaaacagtacaacctccgttaaccgaaataaagggggggggggggggggataacacaaaaaatattattttttctattcttgtatcaaattgcatgtattcttggtcaaagttggtattaataaatgctatgaggggatatcgtaatgtatataatagtttagttgtatgaaagcaaagttggacaattaacatgattggtttcatttttccatctttacttttttattgacgaattttgaaaaccaaaaaaaaaaaaaaaaaaaaaaaaaaaaaaaaaaaaaaaaaaaaaataacaaaaaggacagacataaaaataaaacaaaaaaaaaaaataataag

SEQ ID NO: 3293 - DNA, 1004 bp, Diabrotica virgifera
aaatattgcctgcggaaaatggaatgtggctgtgcgaacaactttttggggccatcgttggaccaaacatgcggaggttcgatattcctatttatgaccctgctagacacttttatacgaaatgcttgcgatatatcggaagcatgtgaaagagtaatacctcgcagaaggccggatcatgagtacgattttgtagtgatcgggggtggtagcggtggtgctactgctgcgggaaaattgacacaggtaccgggttggaaagtgttgttaatagaggctggaaatgacgagccgccgggttcacaggttccatcgatggtagtgagttaccatggaaataagtatgtagattggaaatacaaaacagaaccggaaaaagtagcatgtcaaggatatcctgaaaaaagatgcagttggcctaggggtaaagtccttggtggatgcagtgtgattaatggcatgatgtatactagaggcacaccgaaagattacgactcatgggctgcagccggtaacgagggttggagttacagagacgtccttccggtgttcaaaagattcgaagacaacaaagaaatcggaacactcgtcgaagccgaatatcacggaactggcggacctttgacgacttcacgcttcaacgaccaacctgaattggcctacgatatcttgacagccgctaaacaaagcggccagaaagttaataaagacctcaatggcagagaccctagcgggatttgcgatcgcccagtctaatacgagaaacggtgttagattaagcagtgctcgtgcttatataaggcctcagagatataacaccaatctgcatgtaatgcttaactcaacagtgacaaaaattaaatttgagaaaagacggaaaacaaaaaattgtagacacggctagaattttgtttacgaagacaaaaatataccctgaagaataagagcgagggcggggccggccttggacgcaggagcctttaatttctccccaaattctttct

SEQ ID NO: 3294 - DNA, 1133 bp, Diabrotica virgifera
ggtaaatatgcgtgtattacctttagaacaatgttgtacgtattagttgttaaaatttgtgttggtaaaattagaacttcgttcttcgaccactagtagacatgacagttttaaagcacctgcgctgatttaacaaccttctacaaaaagatatttgtttcagggctattctgtgttgtcttggtgtataccaggttatttagtatatgaaaatagatttgtataaatttaccaaactaatatacttaaattctacaaaaattcccggctataaatgtaagtaggtccagtaggtttgctgcttggggtgttagacttgcgcactgttcttgtctttcgttttgagttgaattaacagaatagcccttattatttcaacactggttgaaagttgcacctatctactcttttaacattttattttacactacaacactgttttactgtaatgctttgtacagctttttaacatttttttgtttgtacaaattttgttgggtatacgattttagatattccatgaaaagaccttcaaggaaaagtaaatttcatgaagtaatcacattatgactgtaaataagataatggataaatattatgtaatcatattaatgtatttaaaacaagaaactgtaatgtatcatgcacagttcattataacaccgcatatcaatgtaaccattattcatagcacaaaactcacacaggtatagctttcctaatctagcttgtctggtcagatgcgcagacgtaatgtgcactacctttgtagacttattcgtttaaagtgcaactgaaaacgcttgcagagaagtagaaacacaagcattcttctaatgcgtttcaaataactgatatccctgagtaaatgccgagggtaaattaaaacacttaatttttgttttctacatgctacatacatgctttcatacagcatacctgcaaaaacaaggaataaacaaagcaacagagaaagtgattggcaaaatgcaagatgaaataattggtttgatgataagtgcaaaatagcagtggtagaaaagaaataaacaagatgaaatgattaagcacaagcaaaaaagggaaacgagaaaataataaaaatcaaagaaaaggcagataaattgttaaat

SEQ ID NO: 3295 - DNA, 1463 bp, Diabrotica virgifera
  misc_feature (1450)..(1450): n is a, c, g, or t
actagttcttgtaataggttaggttagtaacacttttctgatgaaattttataatacagtattaaaaatataaatgcaataattccttcgtacttaagtgattattatttatttatctgcatatacaactatttttgacgtagtgaaaattaacttaacaagaaaatgtctggagatataacaaataatattgaagcattaaaagttaatgcaactgaacaggatgatgatgtggtggatccatggacagtaacaagtactaaggacactggagttgattatgataaattaataaaaagatttgggtgctcgaaaatagatcaggaactgttagatagatttgaaagaataactggaaagaagatgcaccatctcttgagaagaggtatatttttttcgcatcgagatatgcatttaatcttaacaaattatgaagctggaaaacctttttacctttatactggaagaggtccttcatcctcatcgatgcatgtaggacatttaattccatttcagatctgtaaatggttgcaagaagtttttaatgttcctttagtagttcagcttacggacgatgaaaagtctttatggaagaatcttactatagacgaagcaaatcgattagcttatgaaaatgctaaagatataattgctataggatttgatccagaaaaaacttttattttctcagattttgactatattggacaacgaccgcagttctatagaaatttagtggacatacaaaaacatgttaccttcaaccaagttaaaggtatttttggttttgatgacagcacaataattggaaaaattgcatttccagccgttcaagccacgccatgtctctcgagcacttttccagatattttcggcaacaagaaaatccagtgctttataccctgtgctatagatcaagatccgtatttcagaatgatgagagacgtagccccaaaactaggatatccaaaaccagcattaatattatcaaagtttttccctgctttgcaaggagcacaaacaaaaatgtcagcttctgacgctaacagcactatatattgcagtgacacaccgaagcaagttaaaaataagataaacaaatatgccttctcgggtggtcaagccactatcgaagaacatcggaaacttggagggaactgtgatgtcgacatttcatatcaatatttaaggttctttatagaagatgatgaaaggctagaacaaattagaaaagattattccagtggagcgatgttgacgggagaactaaagaaaatacttattgacacgttaacacctctagttcaagaaaaaaaaaaaaaaagggcggccgtcacagacgagattctaaaacaatttataacacctaggaagttgaattttgattattagatgttgttgtttacaatttttaatttattttttacccaaaatgctttaaagaaaatanaagatataagatc

SEQ ID NO: 3296 - DNA, 785 bp, Diabrotica virgifera
agcttctcatcgaaacgaagacatggctactttaagacccaaatctcctcgccctgtgccattaaaaggggagaaagaagaaactatatgggataaacttggtactttaggtcgcaaaaaacgaattaaggaagtccaagaagtacaagcagagggaaaacatgctattgattctccaggttgtcctactgctcctattatacccccagaagactataaccttgaagataatgaagaaagatgtatgatagaacctcgagcatatgaagatcctaaattttatgacttacttaatgttttaaaagaatggataaatgatgagcttgcttcccaaagaattattgtgcaggatctatctgaagacttgtatgatggacaagtactacaaaaattactcgaaaagcttacaggagataaatttgatgtccctgaagtcacccaatctgaagaaggacaaaagcaaaaactaatggtagttttggatcattttaataaggttttgggaatccaaaggttatctcataataaatggaatgtagaatcaattcactcgaagaatatagtagctataacacatctattggtagctctagcaaggcattttagacctccagtaaggcttccggaacatgtttcagttgaagttgtggtagttcagaaggctggcggtagattagtacacaagactgtcagagaaagtttgacaaaagcttatgatgatgttggtatgagatgcgagagagatgctcttgataaactctttgatcatgctcctgataaactgc

SEQ ID NO: 3297 - DNA, 620 bp, Diabrotica virgifera
cttctcgcgtccgggtgattatgtgcatataaatttttttgctttcattggatttaagactttatttacacgaaacatggctctcaaagttacgtcaactcttctacgcagcatgagcgtacctgcaaggctttctgttgcctgttaccacaaaaacgttatagaacattatgagaaccccagaaatgttggatctttggacaagaacgataaaaacgttggaaccggcttagttggagcacccgcttgtggtgacgtaatgaaactgcagattaaagttgacgacaatggcaaaatcgttgaagcgaaattcaaaacatttggttgtggttctgctatagctagcagttcgtatacaacagaatgggtgaaaggcaaaactgtagaccaggcgcttaaattgagaaatactgacatcgcaaaggagctgtccttgcctccagtgaagttacattgttctatgttggcagaagatgccattaaggctgctttatcagactacaagattaaaaatcagaagaaggaagcttaaggggacagaactggaaacaatgtgataagttggtactagttatattattatgtaaatagttttaaatgaaataaatactctcaacgat

SEQ ID NO: 3298 - DNA, 956 bp, Diabrotica virgifera
  misc_feature (909)..(909): n is a, c, g, or t
cagcctgtggtgatatctaagtgcaattttaataaaaaataatatttttaagttcttctagaccgtaagaaacataaaaatgacttccaaacgtaccgtccttagtagacccagaaccaaattatatgatgccaactacaatattggagaaagttactacaagggtgccttagacagactagacaggaaatattcaggcagatcactgtctccaccacgtcagccatcaccagttgcagaatccattgccgaacgccatgccagaatcttcgctgacgaagacctagaatattcaaggagaagagccgaaaaacacatcagagaagaaaatgcgttcgatgcaaggactgcccgtttcaatagagccagcgcccttctggcagattctatggacaatgacatcagcgatgagaccgccacatcaatcagacgtctaagagctaacaaaaaagtatctatcatagacgacgctgatctagaaaacacctcaaacaacctcaaatcgatgcgcttactcgacagatcagacaagatcctcgattcagtcggcataaacgactcgttaccaagaaagatggccgaaaaagatgtagcccaacgacgcagcgctttaaaaatgagttacagaccagaggaagacagcttgaccaaatggacgccattggagaataacattacttcctacagagccagaagggaggaagttacagcgtctatcgagtctgacagtggagcttcccgtagagcaaaactctcaaaggacagacttaacgatttggaagaagaaatggtagccatgcaagagaaacaagctgccagagaagccagagttgctagactaaggaagttagtagctgaaacagaacaggactcagctagtttcgatttatctcagctaaagctgaacgngcagaatccaggaaagaacgactggcagttgaatattgaaacaggtc

SEQ ID NO: 3299 - DNA, 999 bp, Diabrotica virgifera
cccggacggttaggtgttagactttaaaaatttcatatgtttggaaagtttttcatcattcaaataataagctatggataaggcacagaaggaaaataaaaaggaaaaagttgctccagatggtttaacaaaaaaagaaagaagagcacaaaaagtaggtgctagacagactcaagaacctggtgaagcaacacaaagccctaatttacccaaatgtaatagtacttcccatccgaacaataaaccaaaagtcgaaagtggtggtgtaaataaaaaagaaaataaatccaatgaacacaatgtagcttctaaaacactttcagaaaaagaactgcgaagacttgaatgggccaaaaaactggaagaagagaaagctaaagataataaagaaaatgagcagttaagtaaggcagaactaaaagctaaaagaagggaactacaagaagctcagaggcaacaaaaagacgctgagaaaaaacaaaaacctgaacaagtaccaaaatctccttctgagctaaaagagaaagaaaatacaaataataaaaaagtagtaaacgataataaacagaaaacagaaaagaaaccaattaccaagaaagaagttaaaaaggttactgattctcataaagtgcagctggtacagcatttatataatgaagacctattaaaactagaaacacataccatagctgtacatcctgatattcatcctgtgtttattaggctaggagttcaatacaacaaaaaagttatcctaggatcaaatgcgagatgtttagcacttttggtagccctgaaatatctagtgcaagatctcaattccccaccaaaacaagaattctgtagatacttagaaactgtgttacaaacctgtacacaatatttacattcttgtaggcctttagctgtttcgatgacaaatgcccttagacattttaaattacaattaaacccatattgatactaatataaaaagatactgaaaaaaaaaattaaact

SEQ ID NO: 3300 - DNA, 1284 bp, Diabrotica virgifera
catgattgccatattcacttttaaatacacaccaaaattgtgttattaaaataaattggtgacatatggtcaactcattaattcagagagtttttaaaacaatattgtagttcgctagtctctatttgattgaaaactactacaaaatatgctataagcaatggacggatttctaagagtagataacccaaatttgccatcgtctccaaccaattcttttatggctgatgaagttgcttctatatgcccattaataactccatcaccgccaacaaacgatctgattaattctttgccagaaccagaaccggacttctcgattggacttgaattggcaaataagcttcagcatgtcggtggtgatggaacatcagatgaagataaagcagaatcagcttcctcgagttcatcagctttagctgagtctcagctgctaaatcacagaaatgtctacctcaaccataacggaaataacgaacaaaaagatgaagaggatggtcttggaaaaagtcaaactttcggagttcaactaactttccgaaatcctccagacaattatttcttcatgtcctggaattggccactgattaggaaaatatcagcatggatttatctgtcggcattagtggcaatgctagccttggtcataacaatgatctctactctaccaaaaacctgtaatcctccaacatactggtatcaaggaaatctactatacgaaatctttcctgctagcttctacagcggaaagaaaaacatggaaggtgattttaaaggaataactcagaaagctgattatatacagaagttaggtgttcgaggagtaagattgaattctatatttccaaatccaaattatccccacgactttgataatattacaagtttaacggacatagctcctgttttgggaagtctaagtgagtttaatgttatggtcaaacaactaaaagcaagaaatatttcggtaatattagatctaccattatatccttatatttaaagcttagctccccaaaaagtgaaaaacagaaatgaaactttcccttgaacctcaccgggaggttttttataaaaaaaaaaaccccagaaaaaaatgggggaaacagggcatttcttcttggtttttttttttttctggggagggattttttttaaaagggggggaaaaaaaacaaaaaaaaataaaaattattttaaatcttataaacgggcgggaaaaaaaaactttagggaaaaaaaaagactctttaaaaaaaacaaaaacctttttttttttccttt

SEQ ID NO: 3301 - DNA, 882 bp, Diabrotica virgifera
  misc_feature (198)..(198): n is a, c, g, or t
caaccaatgagccaaaacttcaacgaactggtcaacgaatttggaacccttggaatccaacaaggtcctggctcctaaggaaaccagaaaacccgaattatccattacggaaatcactaaattaggagaatcgtctcaaatgttgaatggccttttagcaagtttgaatttacctgctgcaatcgaggttaccggtantggagatgaagtacctccgtccattttggaaaaatctaactccattattactttaggaggtctaggtgagctagaacgcatggtcaccgagctaccagaactgttgaagagaaaccaagacattttagatgaaacagacagaatgttaaatgaagaaaagtcgtcggacgatgcacttagagctcaattcaaagaaaagtggacgagaactccatccgataatctcacggaaatgttcaagtctaattctgcaaaatatagacagataatcaataatgctgttcaggccgataagactgtgagagagaagtttgattctcacaaacaaggtatggaactgttaagtaatggcccaggggcaatacagagtgcattgcccagtggaaccggtggaagcgttggaaattcctctgccgttgaaactttaaggggattaatggaagaggtggacacaattaaggccgaaagagaagccattgaggctgagctggagagtcccacgaccgatatgaaagatgccttcctcggtgctctcgctaaagaaggcgtcatcaatgaggcagctatttcttttgataatttaagcaagatctacggtcctctacaaaagtaagtcgcagatagtatcgagaagaaaggatctttggtccaaagaataacaggaagctcactccccaattcgtc

SEQ ID NO: 3302 - DNA, 1080 bp, Diabrotica virgifera
gtgtcaagttttattaggaaaatacccttttgtttttttcaccgtttttattttctgtgagtgaggtaatacattttatcaaaaatgaacaacattagccccacagcagaagaagccatggcagcagcagaaaccccaattccggatctttcccacttgtctacagaagaaagagctgagcaggaaagattatggaaagaggaactagccacgatagaagatgaaatctcgacgttgcggacagttcttgcgtctaagatgcgcagaagtgctgaactaaaacggaatttaggcatcactgtatggaaagaagtaacagacgacattaatcaaggaattaagaatgttaaagaaagtaatgtataccaaactgtagaaactaaagttggtcaagtaactaaggctgtgacagatgctcctatatatcaaaaaacttcatcacttctaggaggcatcacgggaaacattactaataaaataggacaaatgcggcactcagaatcattcaaatctttcgaagaaaaggttggatctgcatatgaaaatgttaagaccaaggtagcatcccgttctggttctcagcacagcttggacgaagccggcaggtcgcggtcaggttccacagttacgagtccaacaattccagaagataaaccattggcgtaggacacttttctacttaaccatcaaacgatcacatcagtatagccgatatgttgataaacttgtccaaaaaatacacatgcgtttgattaatacctaactatttttatcgttctatacttatttatgttatagtgttaagggtgctgaactaaaacggaatttaggcatcactgtatggaaagaagtaacagacgacattaatcaaggaattaagaatgttaaagaaagtaatgtataccaaactgtagaaactaaagttggtccagtaactaaggctgtgacagatgctcctatatatcaaaaaacttcatcacttctaggaggcatcacgggaaacattacttataaaataggacaaatgcgggactcagaatcttccaaatcttcgaaaaaaggttggatctgcatatgaaa

SEQ ID NO: 3303 - DNA, 1217 bp, Diabrotica virgifera
gcgtccggccggagcaaaggaaggcaaaggaaaggccaagacaaattttccatgacaagattgatctcgatcgttgaagaagtcttcgaaagaaacaatgttatcctgcagtccacacagaggtcgttatggaatgagaccagctcatttttatttcagttttagttaaacactttttaatgcaataagaatttttgaatgcgctgactaaacatggctcatgttttccatatttttgaaatattttaagatttccataaaacacaaaataaaaaatccaacaaaatataaaaaaaagcaatgtgaataaaaatttatttacaaaaaacgaatttctgtacaatagtcttatatattttgatttttatgaaaattcttttttgtaaaaattattttttttatgaaagttctgtttttatcaatttgttttttaaatctcatttttggtaaatttttaaaaatgtattttataaaaacactgttttataaaaatttatttttatgaaaattgttttaacagatgtcacttttcatcaaaatttattttataaaaacgtatatttcttaaaatatttgttttataaaattttatttttattatatattttattataagaaattttataaaaaaagttgtattttttataaaatattaacctcaaaaatctaaaagggaactcaaaatttaaggaataccttttttagaattttgatgaataaaccatcgaatattttcttaaaatagttcaaaatctttcacatgctttatattccagcgcttgatcttttctttctattttattgccccacaagtttgactttttgccctaaaacaaatcaagatttttcccaattaaaaactttttgcctcaaaatttttagggaacccctttcccatattgggttatttatttactttttaggaatcttaccaataaaacataaagaaagcctttttaacttttttattgtcttaagctaaaagaaaacttggaatatttggtattttttttggttattttccgaaccttcctttccacaaaaaaaaaatggcgcttggccctcccaaaaaaaaaaaaaaattaaaaaaaccccccttttttttataaaaatggtctccaaaacaaaatttttttttttcaaattttttccctccccgggttataacgactttatttttatttggatttttaaacttgaaaaaagggtgggggggg

SEQ ID NO: 3304 - DNA, 952 bp, Diabrotica virgifera
  misc_feature (821)..(821): n is a, c, g, or t
gttcttaccggttgtagttgtagacttagcggctcgtatttccctgtgaattaataccaagtgaagtgaacagttttaaacaattacaatgtctgtacctcattggtctccacaaacacgttggaataagaataccttaaaagtattaaatgaattttcctcgaatattgcctctgtggaaaatgttaatagcattatagagaaaagtgacaagtttcctataaaatttccaaccaaatctaatagatgcaattttctgaagactatcgtaaaggaagaaagtttaacttcaaatataaactcagtttatccagtcttacacgaaagcgtgttaaagttatgttgtcactttattttgttaaaaagaagccatggaaatctaatcgaaaaagactattatcgagacttgagtcttaaagacctcataaataagatgttgtttaaaagggctgtagttttcttgaacgaagacgatagttatttgcttcttaataataaaagtggaagcggaaagtgggaaaccattggaactcctaatcaagtgatctctattaaagaatgtatgtcatacgatgaaataaaactatcagctttgctttctgtgagctcgatgacatatttcataaataaaggccatagaaccaatattggaaaatatgaggcagacaggagcattgttgaagaagagggtataataatcggactaataggaccgagattcgaaaagagtaatgttatggaataccaggagattgtgattggtaaaaagcaaaatactaccagtaatggctttggtacttcggttgaacatactactccanaattgtttacatcgttttatgacgaagaatgtctcacatacgaagaagcaatcgagagaaaaaagaaagtggatggaaaatttcacgtcatttataatgatatcttgtttgataacgatttgtactacaaa

SEQ ID NO: 3305 - DNA, 964 bp, Diabrotica virgifera
agatttcaacaggtaccgcagaattcgcagcacctgaaatcgttgaaagagaacctgtaggattctatactgatatgtgggctgtaggtgtattaggttatgtcctactaagtggattgtcgccatttgctggggaaaacgacattgaaacactaaagaatgttaaggcttgtgactgggacttcgacgaagaagcattcactaatgtttctgaagaaggaaaagattttatccgaagactattacttaaaaacaaagagaaacgtatgacagctcaagaatgtttgttacattcatggctcagtggagaccacgccgatagaactgaagttattgaccgatccagatatatccgtatgcgtgacaagatccgttctaaatatgatgcttgggattcatttgctctaccaattggaagactttcagagtactcatctctaagaaaactattaatagacaaatataaaatacacgatgcttactttgaccgcagacaggcagcacccagattcgtcattaaaccacaaagtgcgttctgctatgaaggacaaagtgttaaattctattgtagagttattggtgttgctgctgcaacagtcagttggtatcacaataacgtagaattgagacagagcgttaaatttatgaagcgatatgctggagatgactattactttgtgataaacagagcaaggctgcaagatagaggagagtatatcattagggctgaaaaccactatggagctagggaagaagtagtattcctaatgtccaaccattgcctaaagttgtacctgaatacaaatcagaagtaccaggtattagacgagcagaaccattaccatacacgttatggaggcgggaacaagaatgggctccgggtgttactttgctgctccgaccacgagatgtgcaagaacgcgagacttgaaaactgatgtgttcttttagagcctaactgttg

SEQ ID NO: 3306 - DNA, 1046 bp, Diabrotica virgifera
  misc_feature (970)..(970): n is a, c, g, or t
ttgcgtccggaaacaccatgccccaaatcgatatattaatatttatcttcgcactatgaacattctttgattcaaactctagggaaaactataacctaaaacttctaaaatggccgataacattttcagttaaatggagcctggtgtagtgaaaattgcggatgatggtgatttcgatatgttgaagagattagtcgacgaacacaccgaatggaaattggaatacgataaaggagacctaaccaaggtatggacaaagtcgactccaaacacaaactttaaaatggtaaaagtccaaacagtcttccaagatgtagctgcaaatactttatttgacgttttacatgaccccggatatcggaaagaatgggacgagcacatgcaagcgtcaatagaaataggttatttaaatccaaataatgatgtaggatattatgcactatcgtgtccaacacctgtaaaaaatagagattttgtccttcaaaggtcgtggctggatatgggtgcagaaaaactaattttaaatcattcagtcaaccataaggattatgcaattaggaaaggatatataagggcgatttcccacatgaccggattcgtcattagagaatctgcgaaaggatgtttcctgggatatatatcacaaacagaccccaggggaaaacttcctccgtggttggtaaacaaaatcactcaaaagttcgcaccaaaagtagtaaagcaactgaagaaagccgctgaagggtacgaaatgtggaaatcgtcgcaagagaatccctattttaaaccgtggatatatccggaacaaacgatgagttcgcccaggatcaatatctcagattgtgttggacatgaccttctacccgaaaatccaggagaatgtgacgaaaccgaataagggtaccaagacaacgaattttgcattttgaacggagtcagctctaagacttcgattcaatttcttgtgatnagcatttcaaattctataatataatatatacccagaatatcttggaatatagaaatttaaagctggttggaattgg

SEQ ID NO: 3307 - DNA, 1327 bp, Diabrotica virgifera
gctcgatcgctagagctttgaaatccggtgccgctttcatttgtttctttcgttgacgcgattttctgtaagtttttttcgactttttgattggacgagatggccacgtacgctacatacagacacatcgagctcgacaaagttggatatggaaagaaaagggtttccaaccaaagcagtgaaatcttcaatgtgctatgtacccctccaagtaacaaaacaaacggccatattacaccaagaagatctctacaaagtaacgattccttcaacaaattatttggctcacccgaaaacaagagacctcaccccagaagaggatccttgactaaacaagatgtaaacaaccgcaatccagtaacaggaaatggagtaatgtctttcgactgcaaaatatccaaaacttcaaaaatttacacagaacgcaatccagtaaccggagaaacctacacaatcgtctcacccgctactacccccaccaaacccatgacaaacggattcacaaacggcacatccaccccttcgctgaacggaaattcgactcccttgacgaacggaaatgcacactctctgaccaacggaaatggaatccatacacctaacggaaacgtgtaaattcgaaaaatccttcttaaaaaaacaaggaatcctttagtattcatttccgatggaaacttgagtattctttgcttcaatttctccacggcatgtactgaaaagtatcagcttttattaaaaaaatgtttaaacagggtttataatttagttcagatttaaaaaagacgattaaatataatagaaactgttttgagtaatgttagttttaaaatacttctgatcgatagttttcttggcagaaaacatttgaaagaaagatgttgttataaaggagctagattacaactaaactctcaacataaagaacgattacattcaaaactccttttttgtctatgtggaatattgtgactgaatagataataaagaattatttataaaaagaacaacaaaaacgtgaatagaacttcttaaaacaacaaaataaatctatatgccaacacatatgaaacaacagtgagtggcttaggtatatctcttaacagaatttcttgacagttgacaccaaaacttgtcacttgtcacgcaaggagctgattgttaacttgtagctgttagcaaccaacaattatctggaaggtacagtcaagtactttaatataccacctttcctttttatcgtccaattgcaactaaaaatgaaatttgaatagatgtgaaaaaatcaacaaacatgtatttacttatgcgatttcgacaatacttttca

SEQ ID NO: 3308 - DNA, 890 bp, Diabrotica virgifera
acacagcgtttaagcagagccctcttccagacattaataaaaaccaatatatgatttggaaactgaagttgtaatttagttctgacactgtttgtaaattcgaattatttataataggatattatattggttatatattgggatttattatcccatcatgcacaacgcgaaagaattataccaacagcgaatggatcaaattgaacaaatgaattatattagatttaaaacaccagatccccagcatgttttgataacagataaatgtatatcagtcttacataaacatagaagtttgcttaatgatgttaactattggcatcaattcatggttagaaatgttgatcatgcaaaacgagaacaagttcttactgcaattttggatcatgtttttccattcgatctaattccagtgtcatattgggtagaggacgactttgtcttttttcttggtcgaaattgtggctcggctatagaaaaactatgcaatggaaatttagttgtgcccaatcctaaaagtacaacaccattcaggttaagtattatgctgagatttgcaacaacatcagaatataaaatagacgtacaaaggaatttaagattcgtattgaccaagagaagtagtctgtatagtagaactctggatttaacaaaattccacgaagatgaagatctcatagaatttactcctctatttcaaccgaagattctgtattttgtactacgcatagcaaaacagctgtctgtacctatggagtcatatatactgaggaaaaatagaaatcaagtactggatcctttaaaaatttatcctcttcaccaaatagtgtcaaaagcattgatctttagcataatttgatcgatgatattgatcctctacagcatttgac

SEQ ID NO: 3309 - DNA, 525 bp, Diabrotica virgifera
agcccacgcgtccgtacaaattcaagtagcgagatgatgaaagtgattaaaggttttctatttttcatttttattaccattacttcctcagaacatgcttcgcttagggctacagaagcagacatcaaattctacttgtttacccaaaaagacctactttatggtacacatctaaacatttccgacaaaggcgaaatcaatagatctgatttctcgaaagacaaagacacggtgttctatattcatggatggctggacaacaactcctccgaaactctcataagtatcaaaaatgcatatctgtcaaaatatgacgttaatatgcttgttgtcgattggagtacgttcgcagacagtgtaatttataacgtagcctacgacaatgtagaaccgattggaaatgtacttggacattcaatagaacaccttgttcaaaatactggacaagacttaagcagaatgattatcgttggacactctttgggtgctcacgtggctggtgtagctggcagaattctaaatgga

SEQ ID NO: 3310 - DNA, 956 bp, Diabrotica virgifera
aattttggtggaaatcaacttgtgtgaatcgaacaacgctgtcctgcgcgtagcacaggaaattaatgtttatttagaagattcctggcgccgtagtggttaatggattttaagtttaaaaactgcaaaaaaaagctacagtattcttctatacgtaaaaaggttcaacttgctgactgctttattttcggtcttgcagcattttgaaaaaatgaattttttttgcgaaggctggattgcaaaatgtattttgcaaaatctatgaaaccgatcttaatgaaatttacagtgttgttttgctgtgtcatggggcttttcttggtaatatatgggggtcctgggtgtagcgtggatggttgaagaccgtggaatgcgaatacttgttttttgtagttttttcgcaattattgttattttgcgacaagggtgacaatttttaaaatttgtaaccgatcttatattgtgggaaatttgattgcgcaacttttatgttagtgcaactttcctcggaggtaaatacttttgaagttataatcaaggaacgaggaagaaagtcgaattttcccctcattttttgacattttgattatttgaacagtgttccggacctttttgagagcgaggatggctcaaatattgttatatgagtcgttttcaagcaatttctgcagaaaaatttgagtcacctctcaacgtccagatgtactagtatttttgcagatgcgccctggtctaaatttagagacagattgaaaggataaggataaggagacaggtttttagataatcaaaaacgaagaaaatagtcgaatttttccttcattttttgacattttgattatttaaacaatgttcccggacatttttgagtgggaggataaactcattattataggagttaattcccaggaatttctgcaaaaaaatatgagtcacctttcaacgtccatctcaaa

SEQ ID NO: 3311 - DNA, 988 bp, Diabrotica virgifera
gaagaagtggacgattcgagtacaaggtataccaaaaaacctcaatcaaaccttggatatccgaacacaatgtcaacttccgaagttctcgagaacgtcatattggacaatattcttgaaatagaatatagaatatttgggggagttttgggtactttacaagttaaaaatagggaacaatggcgaaaaagtctatctcttaaattgtatgatgaactagagacaaaaataaaggcatatgttaaaagaagatcggatagaaactcggagagacctgaaacaccagaaattaaggcacctttaagaaaataccacgatcctggaacacacgtgggcacaggtctggatgttgaaatgaacggagaaagcgatagtatcccatgtagtactgaacacgtaacaagatatataaaaaaatctgtaaaagctttagctatagccctagcgcaggttgctcgggggatcgatcctaaatatttaaaaaaacctttaggaagtgcaggcgccggtaaaaatgacaaattatgtgacagattagacaattgggagcaatctcttttggcttcaactagttacagtcaagtatgcttacactatgctaccttagattcatggataatgtggtccagatccgctttaaaagctagatgtaggatatggagacggccaacagattctgaaaatatgttattgtgcgacaattgtaatttaggacatcacttatactgtctgaaaccaaaattaaccaggataccaaaaggtgattggttctgtgatggatgtaaaaaggagatagaacaggaaacaaaacttttaaatcccgatcccgtgccttggaaaaagcgtagaatatttaaagatgagaatatggaggaggaggaagaatgagaatcagaagatgaagaaagtgacgaagaggacaaatcatcaagtgaagaagaatgcaatggattcgctaaattcgaactatggaaaacttgtggctccg

SEQ ID NO: 3312 - DNA, 1036 bp, Diabrotica virgifera
  misc_feature (1006)..(1006): n is a, c, g, or t
caaaaataaatgttttgacttttcatttttcttttcatgagattacaaatgtttacgtgaattttacatcttaatctttttagtgtaacttacacaactttgatgcaatgtcaagatttagcggagctttacaattaacagatttagatgattttattacaccttcacaagaatgtattaaacccgtagaaatcaagaaaaagccaggaagtaaaacaggagctaagatacaaatacaatcagatgattatttccaaattgaagaggatgggagtgcccaaaagctagaaaaagttgagataactttggctgactgtttagcatgttctggctgtataacttcggctgaaagtgtcttaatatcaaaacaaagtgaggcagagttacgggatgttctggaagcaaataaaaagttgaaaattataaatggcgatgctgtggtcactgaaatccaaatagtcattgtaagtttatccatacagcctgtattgtctttagcggtacgctacaatcttaaaccagatgaatgtgctgcaaaactttgtcagtattttaaacaactaggggcagatatggtagtagatatgactattgctgatgatttagccattttagaagcgcaaaaggaatttataagaagatatcgagcaactcatagcgatggtgttaaaaatattttgccaatgttggcatctagttgtccaggttgggtgtgttacgcagaaaaaactcatggcagctacattctaccatacatatcaacagcaaaatcaccacaacaactcatgggttcgttattgaaggaatatgtaactaaaaaactagaacctaagtatcccaaagcccacatataccatgtagctgttatgccttgctatgacaaaaagctggaagcttctagaagcgatttcttttcccaggaaactaatagacctgatgtggattgtgtaattacaccttgtgatttggagcaaatgtgatgaaagacaatatatctttagacacngtggaaaacggaaaattttcgcaaccttgg

SEQ ID NO: 3313 - DNA, 2002 bp, Diabrotica virgifera
acgataccaacgcgaaacttggagtacacggtagagaaatccacgttactaaacaaaaacaggttcaaaaagaacaaaagggagatctagaaattactagaaatatcacagctactgaaacgactgatgttgaacacaaagcaaagaccacagaaagagtagtccaaggccaagtactaccatccaatcctccagtatttaccaagaagattaagccagtaagagcgttcgaaaatgattctgccaaatttgaggttgaatttgatggtgatccgttacctaaaattacctggtttagggaagatttccccattactagttcaccagatcttaaagtttataccttcagtactaagtccatccttcaaatgagacaagtgtttatggaggattctggtgtgttcagtgtggttgctgaaaatagaggaggtactgctaaatgcagtgccaacttggtagtacaagaaagacgaagacatggtacacgtggtgctgttccacctagcttcacagccacaattcaaagtaccaaagctaacgtaggacaactagtaagattcgatgctaaaatagacggtaccaaacctattgatgtgtactggttgaaaaacggaaagaaaattgtgtctgatataagatacaaaactttggaagaagacgaaatctatactcttctcattattgaagttgttccagaagataccggtaaatatgaatgtgtcgctatcaacaactccggagaagctagatgtgaagctgaatgtgtagttacttcaccatctgctgcccagaaacccgccaaacccacaactcccggtgcggaaaaggctccagcccttctagaacctctcaaagatcagactattaaagaaggacaagctgtcgtgttcagatgtaagatttcagctaaaccaactccagttattaagtggcaaaaggctgataaggtcatcaagccatctaaatacttccaaatgaccaaagaaggggacttctgcacgttaaagatctcagaagctttccctgaagatgaaggagtctacaaatgcgtcgctgaaaatcctgcaggcgctgttagtactcaagctaagttgaaggttattgcaccagaaacgcaagaagttgcaccatcactaaccccaatgaaagacgttactgtacctgaaggtagccctgctcaattcaagactactatttctggaaaacctaagcccaccatccaatggttgagggagggattccttattccagaatcgccagatttccagatgatccaagaagggaacaacgttattctattgatttcctcaacctacgaagaagacactggcttattcacctgcagagcaacttcatcagccggtcaagttgaacaatctgcgaaactaaccgtaaaaagtaagaaatgattgctataaaaatattcttttctaattctcaaattgttaatgtccatccatgtagttattgttagttatgacagcttcaagctggttatttaacacagtataataagtgatcagttagcagaactcttgaagatagtcaatgatattggactaatggtttgagattataatccggttccttattggtggtggtttcagaactggtgaataaaatttgactttgaattggtacctgtaccaaggtaccacttcaaattcaaattttaatcatggtccttcgaaccggataagaactaaggtgtgctaaaggaaaaactgtacagcaggttagagcactggtatttattatactgtgacctttttacttgttttgttaacaatgaatcactggatcgaatccattcaagaaaagttctatacgcatagttaggttagtgatggcgatttccaaaattttgttcaagttccacagtgataatatgttttggaatgaatacagctttggctctaattcgctaaacgctggcttagttataaatttatgttaataaatctgtataaatgcataatttatttaataaaaggctattgtt

SEQ ID NO: 3314 - DNA, 957 bp, Diabrotica virgifera
  misc_feature (820)..(820): n is a, c, g, or t
  misc_feature (836)..(836): n is a, c, g, or t
  misc_feature (891)..(891): n is a, c, g, or t
  misc_feature (904)..(904): n is a, c, g, or t
  misc_feature (914)..(914): n is a, c, g, or t
  misc_feature (932)..(932): n is a, c, g, or t
gcgagcggccgctcgcgatcgcgtccgcaaagtttgcacttgctcctgtcactaaaaatgaagatatttttggcaatattgacattttgggcaattcaaaaatttggttcaacttacaatattttgggagtttttactttttgtcagcatagtcactttacgctgggatttcaattgttaaaatcgttggcagacagtggtcataatgttactatgatcagttgctttccccaacaaaaacccatcaaaaactgggtagatatatcagtaagggtaggaactaatcaggatcaagtactaggtatattggcgagaggacctgaactacaaacaatgacgcattggactaaattaaacttcatggcagccttaggagaaacatatagttcagccacattcgaagtaaaagcagttcaagccttactaaaatccaatcaaaaattcgacgttgtaattcaagaaaattttttaaacgaagcatttgcgatatttcaccacaagtttaactgcccatcaattatgtttgtgccgactccgacaacattttttagtaattacatagtagccaatccttggtcgccagcttttataccgagcattataggagaatattccgccgaaatgaatttttggcagcgtcttcgaaatacttttgagcaggttcttggagagtattttatccaccatacagagattcccatacaaaacaaagtattaaagaaatacgtaaaaggtgcccctgatctaagaagcattttatacaacaccagtttgttacttattagttcccacgttagtttcattgatccaatacctcttncacaaaatgtgatccntattggaggatttcacgtgacacctcctgagcccttacaaagaaatcaagcattntttggataccgcnccccacgggntatcttattttcgatggngtcaaataaggtatcacttttaatc

SEQ ID NO: 3315 - DNA, 841 bp, Diabrotica virgifera
cattttaggtatatagtggtagttatatacaactataaacaaaacagtggtagttccccaacaacttttgatacaaatacgaacctctgttggacggtaccgttatttgagttaattaaccatgaagtggtgcggaatcattgtgattttttgcgttgttcttggtgcagtatcatgtgcaccaacaaacttcacaagaaacgtaatatgttattacacaggcagttttggaatcaaagtagcaccacctgaatcaatagacacaaacttatgcacccacctaaattatgcatttgtaaaaataaatgaaaatggaaccttaatccacaataaatatgtagatattaagaaggaaatgtataaacgagtggtatcgcttaaaaaaatgaatcctaaactgaaaattctcataagtattggggatacacctgctgcagtattttctgaagtagctgcggatccggataaaagacaaagcttaatacaaaataccattgacttccttcgtttacatggctttgatggagtagacgttgactgggaaaagccttacagtaaggatgaggaaaattttattcatctcttgaaagaatttaagaaggcattggaaacaaaaaactacctactaagtgttgcagtatatccttatcctgatgcaggttatattgtaccaaaaataacagaaaatgttgatatgatcaatataatgtgctacaactttttatggcccttggagtatttacactggtcataatgcagccctctttgcttcgccagttgaaagtgcttatgagagaaatcatctgaatacagccatgggtcttccaaactggttaaaagc

SEQ ID NO: 3316 - DNA, 1214 bp, Diabrotica virgifera
  misc_feature (1153)..(1153): n is a, c, g, or t
  misc_feature (1174)..(1174): n is a, c, g, or t
cctttcacgcgtccgcatgatctgagtttatcacggaaagcactgctaaagcagaggactatctgatttggtagtgtatataactcaacacaatggacctgagctggtacatagtatcttggataacacttccttactacctaacagccataatatggttgtacctgttcgaaaaagtagttttctggtggctttccatgcggtacagcacacggctgatgaggttaggttgtgccgacattttctgggcagttggtgagaagtaccacaatctcatcaacgtcataatgacgctgaacctgaaagatcccaacgaagatatcgtcgctgacataagggatgttctcaacagaacgatcatggctgaaccggccaaataccaaaagttgttgtcttctttaaatacatttttaggatactcctttttgttaaaagaacaagtgaaagctgacgatattataactgtcatagacatcgagaaaacaaaatacagctccatgaaagaattgatgttctcttacagttacaaacctttaccacaaaacaataaacttatggtggaaattatcgttatcaaggctccaaaggcgtggaaagagagcaatgacttcaaggagaaccaaatacctttaatgataagaattaaccacacagttgctgatgggctctcggtgatgaacctctgtgctcacacccttggtgaaaacgacgtaaacttagaaaacagtctcaaaaatattccgaagagtccagagtggcagcttacacctgcattccagctcctacaaaaaatttatctattcttcatggttccaggctttcttatagtacgctacttccaaggtgaagccacttcggtagcaggacaagaattcgaaggtccaaagtctgcccacaggcaaaatatttcctatagaacggagaaacctggagaaaacttggtgcaaaaagtgaaagacttgaaaaaacaaatcggtgacactagttttagtgaaatcatcttgactgctgtttcggccagtttgtacaactattacgaaaaggctttatttaaaatacccaaatcagtgaaaatggcaattgtagctaccaaggatctgcaaccattgactgtgaatggagtaccaacactacgtaccaaatttggaatggntaacttttgactgcccattangaattgattcggactctatattagcgaggctgcaagtact

SEQ ID NO: 3317 - DNA, 2574 bp, Diabrotica virgifera
ggagtattgtcggtgctaaaggtgataaaggtgaccaaggaccttctggtttagatggtttagcaggaatacaaggagaaaagggtgatgccggaaccccaggtttccctggagtgaaaggagataggggttacccaggtgaaaaaggagaaccaggaatttttggattggaaggcaccaagggtgaaaaaggagaccgtggattctctggagctattggtctacgaggagagaaaggggatgtaggtttccctggtgttaaaggaaatcttggtagcccagggcgtccaggagctaaaggtgaacgaggtctttctggggtagctggattaccagggttgacaatcaagggggagaaaggtttgcctggaatacctggcaaaaacggaagagaaggtatacctggcaccccagggcaaattggtgaaccaggattgccaggtttggacggcagacaaggaccacctggtccaccaggtccactgggtcttcaagggcagaagggagatcgaggttttgatggagctccaggaccacaagggccaaccgggcccccaggacagccaggattagaaggcgcccctggacaacgaggtgataagggagaaagaggtaaccccggtgctttcggagctccgggacaaaagggagatcgtggacaaacaggattgcaaggaatctcaggctatccgggagaaaaaggagacagaggttacgatggaacgcctggaattgaaggaccaatgggaccacctggtcttaaaggagatgctggtattccaggacaatctggaagaccgggtattccaggtcaaaagggtgacaaaggagagcgtgcacttcaaggaggtccaggtccaaaaggagatagaggttttcctggaaatcctgggttaccaggagagaggggacctgcaggtctcgacggaataccaggagttcacggacaaaagggagacaaaggtgagagaggattcactggtattgccggatcgcctggattacaaggagaaaaaggtgatataggtatcgaaggagcaataggacttcaaggttctatcggtgatatcggtccaaaaggtgaacctggtgcttcttgcgttgatgtccctgattatctcactggttctttactggttagacacagtcaaagtaaagaagttccaagctgcgaacgtggtcatatccaattgtgggaaggttattccttactatacgttgagggcaatgaaaaggctcatactcaagacttaggttacgctggctcctgtataaggaagttctcaacgatgccatttgtgttctgtgatgttaataacgtctgtaactacgcaagtagaaacgataaatcctactggctctccaccagtgcagctataccaatgatgcccgtagaggaatcgcagattgaggagtatatttcaagatgtgtcgtatgtgaagcacctgccagtgtcattgccgtgcacagtcaatctctagcacttccagaatgcccatacggatggagttccttatggatcggctacagttttgtaatgcacactgcagccggagccgaaggtggaggtcaatctctttccagtcccggttcatgtttagaggacttcagggccacaccgttcatcgaatgtaacggtgctcaaggatcatgtcactattttgccaacacccttagtttctggctcgcgaccatcgacaacaaccaacaattccagaaacctcagaaacagacactcaaagcaggaaatgtcagagacagaatcagtagatgccaagtttgcataagaaacacatagtttggttcttgctcgccataggaaatcaatatttagcgatgtctctgttatctagatcatttggaaatatccaaagaccgattacattaatatatatgctttaatatttaaagacacaaaattatatatatttttttagagaaataaatggagttttcaaacatcttgtaagagagacatcatctttgtgttcctgtcagttcggtacttagccatccctcgtgataccttcaatttgatcgccaagtaccaatctgtcaaacttgtatagtaagcttttataattttcctttaatactgccgtgccatcttgtgtaacaatatagcatgtaaagattttttgtatagataatagattgtaagttgtacgtatatgaaacatttaccaaacgaaacgaagtaattcatataagtataaaataaaacattacctatctttaaaagataaaatttggtgctacattacttaaaattactttcaaaataatgtcgtgcttcaaagaacgcagaaactgttttttggcctcactgttctgttactgacattttcgttgactgaatgtggtcagttgagagatacgctctagtcaactgcgcagaaaaacccgatgttattgtaactaattgttttcattcagcactgccattgtaatatattgtaccgtgcaggattttgtattttctgcggcgtgtttcccagatatattttgtcaccaatgtactttaccaaaataatgtaaataaatttatataaatataaactttattttcaatt

SEQ ID NO: 3318 - DNA, 889 bp, Diabrotica virgifera
  misc_feature (867)..(867): n is a, c, g, or t
tttcgtcagccattgagcaccagcgagtacagtgagtcacttaaagatgcttttgacttcgtcatggatcgtagataccataatattgacagtaacactaagcttgctggtgtacaaatatctcacaaggcattttgactattggaggaaaagaaaggtcacccatgagaaacctatgctactttttggaaacttctatgaagttttcacctttaaaacaactattcaagagcacataaagaagatttacgatagaatagatgctccatattttggaattcatattcttgatgaaccaatactagttttaaaagatcccaagttggttaaagacgttctaatcaaagattctgctgtgtttgccaacagaagacctgccacacctacacatcctcttatgaaacacgcattattctttctgaactatcctcactggaaacctcttagagctaaaattactccagttttcacttctgctatgttaaaaaatgcacacaatcaatatttgactgacatcggtcaatccatgacgaaatttttgaacaaaaataaagaaaccatagatagcagacgtattggggaatactttgcatcagaaatgatcttcaaatacttttttggagctaatgctaactgcttcgaagatataccatctgtatttgaaccatacgtaaaaaagatgggtgaattcagtgttagaaacgccgttattcaaaacctgtactttatcaaaccatcgtgggtaacgttcttgaagctggatttcatctcagaaagtataatgacattttttgaacgtgtttttatagaaggaatgataaacaggaaaaagtatgatggcagccacaaacttttgtcgatatgganaataaagctgtgagagacactg

SEQ ID NO: 3319 - DNA, 1959 bp, Diabrotica virgifera
actagttctagatcgcgagcggccgccctttttttttttttttttttttgaacggacgatgtaccgcgcgaagctgctagtgatttttatgtttttattgacatgtggggcactggagttggaaccattttacgaattcgtttcagaaaaattggaacaaatcaaaaagtttgaactaccgaccaacaacgaaaaagtatttaggataaatcacaccaaaatattcgattttggccgctatgatttcattatcgttggtgctggtgctgccggatcagttttagctaaccgactgtccgaaataacttcatggaaaatattactgttagaggctggaggtgaaactgatgactttagtgatgttcctcaatttaacaattacctacaacagacggacatgaattgggggtattttacagctccacaaacaacatgttgtcaaggcatggaaaatcaccaatgtgtctatccacgaggaaaagtaatagggggctgtactactttaaacgctgccgtatacgctagaggaagtccttcagactacaacaattgggtagccatgggtaaccctggatggtcatacgaagaagttcttccgtactttaaaaaatcagaatacgtggtgatggaatcgtacgacaaatcctatcatggaacagaaggcatagtgtttgttaatcatacatcgccaaattcgacgataggtgacacagttctaaaagctcatatggaaaaaggtttgaaggaagtcgattataatggagaacaccagctgggagtttccaaagttcagtttaatcaaaaagaccacaagcatcagacaagtgagcatgctttcctcgatgatattaaaaataaaaataatgtaaaaatcgttcttaatgcagctgttaatcagatattgttaacaaaacgtaaggccaagggagttacttttgttcataatggaagaatctataaggcaacggccaagaaagaagtaatattatctgctggagctatcaacactccgcaacttttaatgctttctggaattggtcctaaaaaacatctcaaagatctagacattccggttgttgcagatctaccagcagtgggtcaacatctacaagatcatcctttgtttgttaatatttatttcagaaccaatgtatcttctcccaattattctttgaaagaacagcttcaactatatttagaaggcaaagcgccttctacaaatggtgctggtttagaacatctcgcttttattaatgttgatagtatcaccaatggtgaagctgatatagagtacctaaattttgctcctccatttggtgttccaggaaatttaaaagcagcctataatttccaagataaattcgccaaacagtatgaaagttataaccctttgactgatatcagttttataatgtcgttaatgaaacccaaatcacaaggaagtgtaactctcaagtcaaacaacattctcgattttcctttaatagacttaaattatttttctgatcccaaaggagaagatcttgaaacgatgtacaaaggtatcaaatatattttgtcactggctgatactgaagcgtttaaaagcatcggagctacttttatcagcaagcaaccaaactgtgagcagctcaaagacaatgacaaagagtattggtactgtgctcttagacatatgacttccaccgagtaccatcctgctggtaccacgagaatgggaccgtcagcagttgattctgttgtggatacaaattgtctggtgcatacttttaagaatctcagagttgttgacgctggggtcgttccagatataacgaggggccatctaatggctgcgatatatatgattgcggaaaaaatttcagatgtaattaagaaaaattatagaaaaatataagttgtacaataaatttaatattttttacaaaaaaaaaaaaaaagggcggccgctcggatcta

SEQ ID NO: 3320 - DNA, 954 bp, Diabrotica virgifera
  misc_feature (777)..(777): n is a, c, g, or t
  misc_feature (855)..(855): n is a, c, g, or t
taagccgactagatctaggcccagcccggtacaagttttgaggttaggttcataattatttattttcttacctgaactaaattcatcagaaggttggaagtcatctgatcctgagtactgaagaacgctaggctcactaggtgtatcatcgtcttccatcaccgtgaactttataaacacaacattaattggcaaaagaaagcaactgtttcaagcctcagctggtatgacaagtgaatgaacaaatcgatttcaggcaaactggtctaagtctgacttagaccactctgccggccgaatatacagctgacatcagtcaggcacagtaagcttctgcgctctagcggatttttaggcgaactacgacttgggtctctttgccataaaatgaaatcagctgctggcaatccaaatatgaccataactcaaaatgacaaaaaaagtgacttagaccactttgcctttcagccgcccatgtataacttaccttatccaattctgacgatttcgagtttttctaagtatatattttgttttcggaacccccttaacgaactcccctgttttaagagccaatatatggtagaggtaaatttgcaggtacaaggtttctccccatgtgattttctgacgcgctcgagtaactgcaaaattccccgcttgggatcccctaccattatacaaaattagatttcattaagctaaaattaaatataagaatatttaatgtattgaagagtgtgagatattagcagtatgttcatgtaattctaattngaaacacagacaaaatggacttaagaacaatagtaaacttttactggaatcaaaattgtaatagataatgaacctagntgagaatttgaatcaggagaggagttagacaggaatgcattacgtatccattactatttaatgtattatactgaatcccatttttgaataactttacta

SEQ ID NO: 3321 - DNA, 985 bp, Diabrotica virgifera
gacccacgagtcagcggacgcgtgcggcaaaaggtgacgataacatcgtcgtcatacacctaaccttcaaaatatcagattgggatcaacaggtcgtatcgccatggctgggaaaggagatattggtttaattggtctagccgtcatgggccagaaccttattctaaacatggcagatcacggattcaccgtagtagcattcaacagatccatagaaaaagtccaccattttcttgcaaatgaagctaaaggaaagagtatactcggagccgaatcaatcgctgatttgtgctcaaagctgaaaagtcccagaagagttatgttgctcgtcaaagcaggagatgctgtagatagttttatcaaccaattggtgccacatcttgaaaaaggagatattatcattgatggaggtaattcagaataccaagacagtgaaagaagaactaaagagttggctgccaaaggaatccgttttgttggttctggtgtttcaggtggtgaagaaggtgcccgttacggtccaagtttgatgcctggcggtaacaaagaagcatggccctacataaaagatatcttccaaggtatctctgccaaggttgatggccaaccatgttgtgactgggtcggtaatgatggtgctggtcatttcgtcaaaatggtacacaacggtattgaatacggagatatgcaacttattggtgaagtataccatttaatgagcgccataggagtcaatcaagaacagatgggcaacactttcgacaaatggaacaaaggagctttggacagttttcttattgaaattaccagagatattttgaggtataaggatagcgatggccaataccttcttcccaaaatccgtgatacagctggtcaaaaagaacaggaaaatggacagctatatccgcccttaactatggagtcccagtactctaatcggtgaatcagtctttcagccgttgctttcagctctcaagaccga

SEQ ID NO: 3322 - DNA, 914 bp, Diabrotica virgifera
agctttcgtaacgttcggttgtgtgacagttcagtgtggaagtgataattcaaaaagaaacgcaggcgacaaaaacaaaataggaactacataatagagagagaccgaggcgaataagatggaccacccttaaaccacccaacttagatgtatctactgcagattgggcagatatgttgaatgatagctagcgcatgtccaaaatgtggggaaacggagcgtttagtcgcggcactttggtgtgtctcgcgcttttagtttatctgaaagatagtagctgtgtgactacaaacagacgagagcacttttcgcagttaccacagcggaccggcttttcaacaaacagaaacaatcagaggaccggtgtaaaagtgatggatccttcatttgagaatgctgggcaagtggatggccttgaaatatggagaattgaagacttcaaacctgtgccttatcctaaaaatcaatacggcaaattctacacaggagactcatacattatactaaataccaaaactacaagaagtggtgccaaagtacatgatcttcatttttggttaggtgctgaaactagccaggatgaacaaggatcagctgccatatatacagttcagttggacgagcatttgaacggagaaccagtccaacatcgtgaaacccaaaaccacgaatctcaactgttcttatcttacttcaaaagcggtggtattcgataccttcctggtggtgttagctctggcttccaccatgtcgatcctaatgctttcgagaagaggctgttcccaagttaaaggctctagaaatattaaagttaagcaagttacccccatcatcgcctctatgaacactggggactgctttattttggaacgtgggaaaagaaatttattgtctatggttggtaataaggggtt

SEQ ID NO: 3323 - DNA, 1470 bp, Diabrotica virgifera
gactaggtttatatgttgattccaagtcagtaataagtggacaattacattaaaaggtgtttttcaaagctctcaaattcaatagctagcgcatgtccaaaatgtggggaaacggagcgtttagtcgcggcactttggtgtgtctcgcgcttttagtttatctgaaagatagtagctgtgtgactacaaacagacgagagcacttttcgcagttaccacagcggaccggcttttcaacaaacagaaacaatcagaggaccggtgtaaaagtgatggatccttcatttgagaatgctgggcaagtggatggccttgaaatatggagaattgaagacttcaaacctgtgccttatcctaaaaatcaatacggcaaattctacacaggagactcatacattatactaaataccaaaactacaagaagtggtgccaaagtacatgatcttcatttttggttaggtgctgaaactagccaggatgaacaaggatcagctgccatatatacagttcagttggacgagcatttgaacggagaaccagtccaacatcgtgaaacccaaaaccacgaatctcaactgttcttatcttacttcaaaagcggtggtattcgataccttcctggtggtgttagctctggcttccaccatgtcgatcctaatgctttcgagaagaggctgttccaagttaaaggctctagaaatattagagttaagcaagttaccccatcaatcgcctctatgaacactggtgactgctttattttggacgttggaagagatatttatgtctatgttggtactaaggctagaagagttgaacaactcaaggctattaatgctgccaaccaaattcgcgaccaagatcatgccggaaaggccaaagtaaccattgtcgatacctacagtccagaaagtgactatactacattctttgaagccttgggtgaaggttccagagactcagttcctgactataccaccagtgacgacgatgaatctttcgaacgcacagaggaaaatcatgcttcactttacaaggtatcagatgctactggctctgttaaagtaaccaaagttggacaaaaacctttggaagctagttcattggaccccagcgactgctttattttggataccactgatgccctattgtatgtatggatcggcagcaaatgtgatgaaagagaaaagaaggaagcgatgaataaagctgatgggttccttaatgcgcacaatcaccctaaatggacacatgttcaaagaattgttcaaggagctgagcctactgcgattacacaatatttcagaaattggcaggcctttggagaaacccacccaagattactaccgttctgtcagcacctcagcccacctttaccattgccaaatccgttcaagatctcccagacttaaagtcgaagagattacggactatgaacagtaagacctctgggaggatgacttatggttt

SEQ ID NO: 3324 - DNA, 1288 bp, Diabrotica virgifera
aatgattacatggatattgttcacaacgagaaacgaggactctggaacgttcccttcatctccaacgcctacatcatcaacgccactctcctgagaaaacacgatcgcaaagttctcaactacaccaaacccaacttggacgccgatatgaccttctgtagcaacttgcgagatctggacgtttttatgtacgtgtcgaacagactcgaattcgggcatttgatcaacgcagacacgttcgatactacgaggactgaacctgacatgtaccagatcttcgagaatgagagggattgggaggataggtatatcaatgaagagtaccctgagaacttcaatctggagaagaaagatgcacagccttgccctgacgtatactggttcccaatcgtgtccaaaagattcaacgaagccctcatccacatgatggaaagctatggtaaatggtcatcgggtaagaacgaagacgatcgtctgaatggtggatacgaggcagttcccaccagggatatacacatgaaccaagtcggatgggagcgacactggttgcacttcttgcaaaaatacgtaaggcctttgcaagaaaaggttttcactggttactatcacgatccgccaaagtctctaatgaacttcgtagtaaggtatcgcccagacgaacagccactgttgagacctcaccacgacagctccacctacaccatcaacatagcactcaacgaaaaaggtgtcgattatgaaggtggtggttgcagattcatccgatacaactgcagcgtcgtggacaccaaaccgggatggctgttaatgcatcctggaagactgacccacttccacgaaggattgctggttaccaaaggcacaagatatataatgatcgcgtttgtcgatccataaacggtgacaggagggtacagtgtgttttgtatgttcgttcatgggtgttctttcatttttccgactgtaccaacctaacaacatcaataacgtctgtagtaaaacagtaccctctatgggctagtcttagaacttttcgcattctcctcttataacacatagcatttctaatttttcaacataaacatatctgtatcaatattgcatagattaagttgtagtactagtcagttgctctctaacttttagcaaacaactacttaaaaatttctaacaaactgttgatattctactaagtttctcatgttccttcttttctctctttgtaggtcttaaagtttgaaacgaacaattttataactagttttaggaaaaaataaactattttagt

SEQ ID NO: 3325 - DNA, 868 bp, Diabrotica virgifera
aatcttcttgctttctaaacattaaaatttttatatttatttaaccaaataatacaaaaggtggctgcatgtacttttccataatctcgttaacttctttgtattgtcttggattttcttgcatactcaaagtttcattaatatttagatatcttaaagaattcggttcggatgattcccagatgacgttatccaaaaatgcatcggattcaggtgttgggttgtaaaatttgacaaaattagtccacagtttgacatacttgtgcagaacaagttggtctgattctgggaatttactaagatcagtggtacttccatcgtcccataaatagtgagtgtcttcaacatgggcaactttttctacatctggtggcaaaaatggcaaaaaccacgtttcttggcctatttctcctttgtaagcaaattgatacaaatagtttggcattttgggagacgctaattcaacttgtttacatattccattcgcaaataactggtcactggaatgccttatatacccgccaaaatcttccctaaaactagtattacgtgtatataattgtttcaataaacttccagcggttgttctatcttcgggtgacatatttattcttctatctacgagttggcctggattcctatccacggttcctagtagtattgcggctacgccttttaatatagcttgaggtgcagtttcttctgaattgaatccaataagaactggtacctttttataatttccacttaaaaatgctgcaaaaccaccatatgaaaacggtccttctggcttcggtggatactccactttgtagggtcgggcgtatagaatatctcgagcctttgcttttttgtacacttttaacaa

SEQ ID NO: 3326 - DNA, 1828 bp, Diabrotica virgifera
gtgaatccagtcgatatacacgcaaccaaacgtttattctaaagataagaagataattttccgagtattgatttccctatacaaacgacgattttttgcttttattacttgattgagcgagatagcaaaaattatagaaatatggggaagcttcgatgttttcgttctaattcagtggattcagtttatacatctgtagagaatggtcaaaacgatatgaataaaaaacagttttttaagagttggaaactgtggcagaagattgcgtttatttcgggtgtagcattttcattattctacttctcatatttttggcaatatgggtaatatttccactagtatttatgaattccatatcagtacaaaggttcttcatattctttaattttcaagatccgaagaatcccgaattcaacaatcctcaaaaatatggtatgaccggggtagtaaatttctatataaccaccaaagatctgatagacggctctctagtaagcatcggagcttggctgttgttacaagaaaatcagatacaatctacaaaaatcgcaggtcaggatgacaaaacagcgagtgaaatcattagaaatacaaagagtccaattgcaatatatctgcatggtgttgggtgtaacagaataaagccaaaagaaacgtacgaggttttgaggaagcactttttggtcatttcactggaccacagaggatatggtgattccggtccagataaaccaccaacagaactaggaattgttggtgatacatcccaggtatttcaatggatccgagctttaacagacaacgatatttacgtatggggccattcgttaggaacagctttaagcacccactcagtcaaaaggctcaaggaacaaagtatcgtaccatccggactaattttagaatctccgtttactaccatgagggaggaaattccagcaacgtcgttaggaaagatattttcttggatgccatggttcacagcgactgtactaaacccaattgaaaaaaatggcttccaatttaaaactacaacaaatatcctcgatgttgattgccccatcatggttatgcacgctcaagacgacaacgtaattccctacacccttggcgaaaaagtgtaccatgttgccagtacggaacgaaaaattccagatcaaggaaacgttaccttccacctatttggtaggctgggatatgggcatgttggtattacaagcgatccaaatgtaccaaaatatattgacgagtttatcggattttgcaaggaccagcataaaagaagaggttgatatctacaccttcaacggtaaaaatcgaattttcaacgagaaatttaatttccagttttgttattatgatgtccaaaacacaaaccatcacatagtgtgttcaaatctaaaagtcaagaagagtacctatatcaaaaatgctcaaaagtgaatatcaacaaacttggaatcttatatggtctgaagatttatggaactaatacaaaaagatagtctaatgcagtgattctcaatctttttgagtcatgtaccatgtaccacaaaaaactttttattatttttggtaccacctaactgaaatacctatctagctaggtaatctaattaactataacactggtgctgattttggctgttttttgcgttttgtgtaccaccgcaaataatgatatgtaccaccagtgatacatgtaccacagattgagaaccgctggtctatggattttcatttttgtattatttccagtagcatctgtttggaactggtcccggcgcctaattttgtattacccttatttaattaaatttttttatgg

SEQ ID NO: 3327 - DNA, 978 bp, Diabrotica virgifera
  misc_feature (25)..(25): n is a, c, g, or t
  misc_feature (38)..(39): n is a, c, g, or t
  misc_feature (74)..(74): n is a, c, g, or t
catccaaagccgccggggggggggnggggggggggggnncccttaaaaaaccacccgcagcccccgggccgggntccgcaagcgaatcttacattagagttgatgacaattctgtacatactgtacctgtttcttcaaagcctcaatgggaaaaaaacttcgagaatgggggacagtcgactctgccattagttcgtttcgaaaataaagtctattacttgggcattcacataacggagaattggctagatgctctgaaattttgcgaaaccattcagatgaagttggtatcaattaattcagcaagagaaaatgaaaaaatcggaaattacgtaagagaacaaggtatccataatcgatattggatggggggagcaaggttcatagatgacgctaaatggttgtggataccttatggaagagaaatgaactacagcaattggggccccggtcaaccactcaaaaatgctcataagtgtctgctggggtccatagtacgcgaccagttcacttgggttgtaggaaactgcaatgttgcactaaatttcatttgtgaaagatatgtggatgatgggggctctacactggggtcaatatgatttttgacattattttgaacgcaactattaatatttaaaaaaaatgtgatatttaacacaaataattttcaaatgatgaacgggggtcgccaatacgagcccattatagttactattggattataaattgagtcaatctttgcatttatatttgtcaactcttttattttatttgcatggtacaaatttgtgggaacacccggtttccagactttcctttatttgcctcctcatccgggtccagtacatatcttccataacaaaaataaaaacttccacagattccgagcatttgacttatttttaatcccctaaaaacaaggtaattttggtccaaaatagatttttttatacttaaaaaaaaaaaaaaaaagggcgg

SEQ ID NO: 3328 - DNA, 925 bp, Diabrotica virgifera
gatagtagtcaatcagccagccatgtggcagaaatcaaaatttatgctcgatctttataccacctccgcgttttcttccaaaaacaccggatgctgataaggaccagtattgtttcattaatttaaaacagatggatgggtgcactgtcaagttcagagaattcaattcgattatggtttagcgatacggtgacaataaatttgaattattgtcacatttatcaagaaagtgtacttaatttataaacagtctgtgataatatagagctgaatatctagaccagttattaacatgacgattaagaatatttgttgccttggcgctggttacgtaggtgggccaacctgcagtgtgatagctttaaaatgtaaagatattaaagtaacagttgctgatcttagcgaagaacgaatagctcaatggaactccgacagactcccaatttatgagcctggattagacaaagtagtacaagagtgcagaggtaggaatttattcttcaccactaaccttactcaagcaatattagatgctgacttgatatttatatcagtgaatacaccaacaaaactgaacggaaatggcaagggaagggcacctgatctaaaatacatagagggagcagcaagaatcatagctgatactgctcaaactaacaaaatcgttgtagaaaaaagtactgttccagtacgagcagctgaaagtatttcagatatcttaacagctaataaaaagccaaaagtgacacatcagattttgtctaatccagaatttctagcggaaggtactgcaatcaatgatctgctcatcctgatagggttttgattggtggggaaatactgaagccggtaggcaagcaatagaagcattatgttcagtttacaatacgtggatacaaaagaaaagaatgttaccatgaatacg

SEQ ID NO: 3329 - DNA, 627 bp, Diabrotica virgifera
atgaaaatggcgtttgaacaatttttgcatatgctatgcagtagtgtttaaattaaaatacactaagcaaaagacgtatataaatttataggagaaatccgttaactaattcaataaagtcttgttattagtgttaaatataaaggacaatggccgatccactaagtttgttgcgtcaatataacgtaaataaaaaggaaattatcgaaagagatggacaaatcatctttggagagttttcttggcctaaaaatgttaaaaccaactatcttatttgggggtcaggaaaagatggaacaccgaaggaatattacacattagaatgtctattgttcttcttaaaaaatattacattaagccatcctgtctatgtacgacaaacagctgcagagaccatacctgtcgtaagaagacctgatcgtaaagagctattggcttatttaaatggagaaactgctagttgccctgccattgataaaagtgctcctttggaaatacccacgcaagttaaaagatctgctgattatgacggtccggaaagtctggctaaaaaaccaagggtcgaagacacacattgtccagaaaagtcagaaaaaaaaaatggctggttaagctaaattgggcccg

SEQ ID NO: 3330 - DNA, 1416 bp, Diabrotica virgifera
gttgaatttgtttattatatagttatttagttcaattatgggtaaaccagatttttctccaggaggcggtagaggaggccgaggtggctttggcggtggccgaggaggaggaggaggatttgggggcggccgaggaggcggtggtggaagaggcggttttggaggcggtgggcgaggaggaggaggcggtcgtggtggcttcggtggaggtcgtggaggaggaggaagaggaggatttggtggtcgcggtggtggtgaccgtggcggtggtggtagaggaggatttggtggccgtgggggcggtggacgtggaggtggaagaggaggacgaggtggtggaggaggcggattcaagggaggaaagacagtagttattgagcctcacaggcacgaaggagttttcattgcgagagggaaagaagatgctctagtcacacttaatcttgttcctgggtctgaagtttatggagagaagaggatatctgttgagaatgaaggtgaaaaaacagaatacagagtttggaatccattcagaagcaaactagcagctgccatattaggaggtgtagaccaaatccacatgccaccaggcagtaaagtcctctacctaggagctgcatctggaacaacagtatcacacgtttcagatgttgttggtcctgaaggtctcgtatatgcagtagaattctcacaccgatcaggcagagatttaataaatgtcgccaagaaacgtacaaatataatcccaataattgaagatgctagacacccccacaaatacagaatgctggtaggaatggtagatactatattcgctgatgtagctcagccagatcaagctagaatcgtggctctgaatgctcagtatttccttaaaaataatggacattttgttatttctattaaagcatcttgtatagattccactgcacagcctgaggctgtgtttgcgtcagaagttaaaaaattacaagcagataaactgaaacctcaagaacagctcacgttagagccttacgaaagagaccatgctgtcgtggtgggtggttttaggccgccaccctaacaataactaaattttttacttgtttagatcgtgttcagttcatatttgtttgataagttgttatagtagctttaaaacctctaggatatcggcaaactcttaattttgggcatcggttgttttatttaattgaaataattatgaatgtctacctcatatatttgaaagtacataataaataacaaagaaaagggaatttcaggatccacaaaagaaaagcgtgatttaactatgcagaaacgttttctgcttttttaatttttattttggaaaattttattacttgtaagaaaaaattatgtttttggaaagtaaaaaaaaataaaaaatatttttctttcctccccccc

SEQ ID NO: 3331 - DNA, 997 bp, Diabrotica virgifera
  misc_feature (822)..(822): n is a, c, g, or t
  misc_feature (854)..(854): n is a, c, g, or t
  misc_feature (889)..(889): n is a, c, g, or t
  misc_feature (905)..(905): n is a, c, g, or t
  misc_feature (934)..(934): n is a, c, g, or t
  misc_feature (947)..(947): n is a, c, g, or t
  misc_feature (966)..(966): n is a, c, g, or t
  misc_feature (969)..(969): n is a, c, g, or t
ggttcgtcaacatgttaagtgtcacgcttatcttgctactgtttgagttaacatttgctaaaattggtttcggacccggagaacaagactggggttacgcaactgtaagagaaaaagggcatatattttggtggttatactacaccactgcaaatgtgagtcatccaacagaaagacccttaataatttggttacagggaggacctggagggtcatccacagcaataggaaattttgtagaaataggtcctctggatgaagacttgaatgtgagaaatacaacatgggttcagcatgctaatgtgttgttcgttgataatcccgttggaacaggttttagctatgtagatgatggtggtgtatatgctcaaaataattctgaagttgcaagggactttctggattttttaatacaattttatgacaaactaccaaattttagaacagttcccctgtatatatttggcgaatcttatggaggaaaaatgaccgtggaaatcgctgtagaattagataaagcaattaaagaaaagcagatcaaagcaaactttaaaggaatcggattaggagactcgtggattgcacctatggattatatttttacgtgggctccatacttatttaacttgggactactagacgagaaaggctttgaacagattaatagtatagccctaaaagctcagaaaagttacgaaaaaggggactataatatgtcaacagtctactgggcactaactgaagttcaaatagtaaacgagacggcaaatgttgacttttacaatatccttaataagattcatacggatcctaattttgtanataacgatttagattacagctatcttaataanatactggctaaggtaaaaaatactttaaaacttanatcagaaggagacgcnaagtcagataaagtgtttgaagctctggntacagatttcatngaacccgttacccatttgntgnagacactcttaaatttcacaaatattac

SEQ ID NO: 3332 - DNA, 1252 bp, Diabrotica virgifera
caacaacagaaacgtatagtatcacctcccttgcctcctgaaccaaatctggactccccaggcatacagacacctcctcttagagaggctcccagaccctggcagacaaagaagccccaagacgaggtgcctgcctgggcaaagagagaaaaccagatccctagtaatgtagatgaagcaaggaaaatttctcctcctgcttctcaacaacaacaacagaggtggccacaaccccaagctcagggaaatcctccaccttccttccaacagcaacagtacgagcaacccaaatataatcaacagcagttccaacaagcttatgcgggcagaccagatgctactcaacatcaacagccaataggaattcgtatagatatccgtaccaaaccacaagcaccataccaagatcagacagaaatggaaaatagacctaacgtggtttacgtcactcaaccattggtgttgcagcatcctggtgtagctccgcagaggcaacaagatccaaacaaccaaggaggggcaagggttgtgccagtacccgttttaaatagacaacaaagttggggaagcaaccccgtgcaatccaattcgttcaaaatcattcaaaaattcaccaacacagacggtgaagaagacgagtacgacaacgtacccattactgaacactcgcccaagtatacacagaacttccaacagcctaatgatcagatgagacgaatgaaagtgaacgatggggaacaaagtattgcaaatactttcaaacaagtgcctcgtggaccacaacaacagcagtctaaaggaccccaagttaggaatattcccattcaaattgaaggtgatgatactcccaggccgtatgtgcatccaagtgaacaagtggtacgggaaccaaaaaaatacactggaagctcgatacccagtagatcttttcaaattttgcaagctatgactgctcccaatgataatgatcttgcagaacataccgatttttaaagcatccactgggcggatattgaaaaaaccaaaaaaaaaaaggtttggaacagtggaaaaataaaaaaaactataaattaaagaattttttaaaaaccgcagggggggggattggtggctgctttgaaagaaccaccccattttttaaatatttttctttacccctccccccgccgagggggcttggaaaaccggtttcttttgggaaattttttttttaaaaatttctcaggtttctccagggccaggggttggtttt

SEQ ID NO: 3333 - DNA, 1020 bp, Diabrotica virgifera
  misc_feature (952)..(952): n is a, c, g, or t
  misc_feature (972)..(972): n is a, c, g, or t
  misc_feature (1010)..(1010): n is a, c, g, or t
cgcgcgtcgacccactcggccatgagtcgtattaacgcgtgggcggacgcgtggggtgacgtgtaaagaaattaaatcaaattattttaaagtttttaaattaaaatgggtacttttaaaagagatactcatgatgaggacgggggatcaagtgcttttcaaaatctggagaaaactactgttttgcaggaagctagagtttttaatgaaactagtgtaaatccaagaaaatgtacaccgatactaacaaaactgttgtacttattgaaccagggtgaaactttaagtgccaaagaggccacagatgttttctttgccatgaccaaactgttccaatcaaaagatgtaatattgagaaggatggtttatttgggaattaaagaactcagttctgttgctgatgatgtcattattgtaacatccagtcttacaaaagatatgactggtaaagaagacatgtacagagcagctgctataagagcattatgcagtattactgatgctactatgcttcaagctatagaacgttatatgaagcaagctattgtagatagaaacgcagctgtcagttcagcagcactaattagttcattacatatgagcaaattagctccagatgtagtaaaaagatgggtaaatgaagctcaggaagcagtaaatagtgataatgcaatggtacagtatcacgcattaggtcttctataccatattaggaagactgataagctagcagtgacaaaattgatttccaagctgaattcaatgggtttaaagagcccttatgctttgtgtatgttgataagaatcactgcaaaacttttagaagaagaggaccaagagtcactcctcaactccccatatacaataatatttacaatgggcttaaggaacaaatctgaaatggctggtgtatgaagctgcacatgccatggttaacctgaagttcacgagntagtaatgtgctagcaccgnctataagtgttcacaactattttttgtggatctcctanagccacactc

SEQ ID NO: 3334 - DNA, 1069 bp, Diabrotica virgifera
gatgaattgtagaattgaagataatatgtattgtataaaaaatatttttcatccagttacatcacagcgtggttgcgtattggtagtggtagattaaaattagcgaatagagtgtgccaatcgagccgaaaatacgatggagtctcccatagtcacggtgaccgaaggtcaagttagaggatgccaaagagtaaatttggatggtgaatctttttattcgtttttgggaataccgtttgctaaaccgcctcttggagatttgagatttaagtcaccgcaaccagtagaaacatggaatggtgttagagatgccacgaaagatggacagcctagttaccaatgggatgacaaaaacaataaacctgttggttctgaagactgtctacacctaggtattcacacaaaaaaacttccatccaaagaaccttcccttaaaccagtaatggtgtggatacacggcggaggattcatttttggttcaaacagttcgactgactatggaccagaatacctgatgcttgaagacatagtattagtgtctgttaattatcgtctcggattcttaggatgtctacagtttgaagatacttccttgaatgtgcccggaaatgcatcccttaaagaccaactgctagctttgaaatggatccaacagaatattcaccattttaacggtgatcctaaaaacgtaaccatttttggagaaagcgccgggggtgctagtattcattatcttatgcttagtccatcatccaaaggtttgtttcacagagccattctacagagcggatgcacttttttgtccttggtctagaatgacagaacaaaacgttggacttgagtttgcactaaattgttaatcaaaatattaaaccggaaaaagaggatctagaagtataagaaagttgtctgctacgaattactaaagaaccaaaaacgttatatgttaatatgaactaccccttaacggagccccctaacaaaaaaaaagccaattggaacagcccgttttaacattctttcctcaaaattttaaaacctaagggctttttcccccgatccctttaac

SEQ ID NO: 3335 - DNA, 1125 bp, Diabrotica virgifera
ccttacgcgtccgcgcttcgtttgtcattcgtacatgcattctgttgcatcacggtgtagttaggtgtcggtaaattacaatttattagcggatactacgcgctaatcaaataaaaaccatggagtctcccatagttacggtggtcgaaggtcaagttagaggatgccaaaaagtgaatttggatggtgaatctttttattcatttctgggaataccgtttgcgaaaccgcctcttggagatttgagatttaaggctccagtacctgctgagccatggattgaaataagggatgctacgattgatggaaactcttgctatcaacgaaatgagatgacaaaagaacttgaagggtcagaagattgcttgtatttaaatgtgtatacaaaaaaattaccatcagaatgtaatgcattaaagccagttatggtttggatacatggcggtgctttcgtaactggtagtaacaaaagtagcttctatggaccagaattcctaatcactgaggacatcgttcttgttacgataaattatcgtgtaggcttcttagggtttttacatctagatgacacatccttagacgttcctggtaatgctggcttaaaagatcaacaactagcattgaagtgggtacaaaataatatcaagagctttaacggagatccaaataatgttaccatatttggagagagtgctggaagtgcctctgttcatattcacgtagtatcaccatcatcaaaaggattgttccataaagctattttacaaagtgggtgtttgctgaatccatgggtattttctaaggattatgcgttgacgtttaccaaaacaattactgatactgtgatgactgaaaaagaggctttagaagttttaaaaaagatacccggttgaaaaatttttgggggccccgggaaaatttttatggctctttttaaagagctcctttggtaaaaccgccaatcaaaaaaccaaaaaccccacaagtttttacctcaaaccctacttaactggtaacttctggcccggacgattaatgttccttttaatacttggataccggggatatgggggggaatttctattggaaaaggatatacggtttcggaaaaaattttttttttct

SEQ ID NO: 3336 - DNA, 1314 bp, Diabrotica virgifera
  misc_feature (1140)..(1140): n is a, c, g, or t
  misc_feature (1148)..(1148): n is a, c, g, or t
  misc_feature (1263)..(1263): n is a, c, g, or t
  misc_feature (1293)..(1293): n is a, c, g, or t
  misc_feature (1298)..(1298): n is a, c, g, or t
gtattgtgtatgttttcttcttctttttggtgtagttgcaccagatgcagctgcattcaaagaaaaggttaaacgactagaacaagaatgccaaaacgataaaacaacttatgtggatgaggcggaattagagaggttcagaaatcatgagccgaccactgctaccaacttaggactacattatctttgtactaatatcaaactgggaattcaagacgaaaatggaaagatcaacacagaggccatcaaaaataatcttcgtgaaataatggttggaacaggcaaaattaatataatagcacatagatgcagccgtagattgcccgaagaatcagcagaagaaagtgctattacattatatagatgtttacataagccagcccatgtacataacaacaaccatactcatatccatgttcatagacataagcgttcaataaaaagaagcaaagctcacaaattttgccagtctgatgagtcaaccagggtaaatgaaagtgatatggagaagtttaaaaagggagaagaagtagacacatctaaaataaaaaactatattttctgtatgaataaaaaatttgagatacagaatgtggatggtaccgtcaataaagacggatttaaaaaatatctagaaaacaaggtaagcgataaaacaagggctaatgaattaacaagaaaatgttcagaaatatcggatccagtggcagaggaaacggctattaaattatacaaatgtgttcacgaaaacgatcgtcaggatgatcagaatcaaaatgctttacaacaacaggttaagcttgcctttgaacaatgccaagctgatccaaaaacttttgttgataaaaaaactcttaaaaaggcgcgcaaaggaaaaaagattgacactgctggtttaagagcacacaccttttgtatgagcctgaagttaaaccttcaatctacggacggaagtataaaaacggaaactgttaggaaaaacttagaaggcgaggaaactgaagctaaaattaatataatagttaatatatgtgggactagagatgaaaatgatccagcaaatcttactgcattaaaactattcaaatgcctatataaatatgaaaagaaacgagagcagaaaaaacgagctttccttanacgtttanagcaatttaaaaagtttcaccaagaatgcttatctgatccccgccatcaggttgatgaggaaagtctttttctagttagtcatggtgaagagatagatgatcctaatttagcttnctacactatatgccctaataaaaaatcaantaccnagacaaaaagggaaaa

SEQ ID NO: 3337 - DNA, 1082 bp, Diabrotica virgifera
  misc_feature (842)..(842): n is a, c, g, or t
  misc_feature (848)..(848): n is a, c, g, or t
  misc_feature (951)..(951): n is a, c, g, or t
  misc_feature (988)..(988): n is a, c, g, or t
ataatattttatactaaaagcaaaatttattgtaattatgaagttggtgtattgtgtatgttttcttcttctttttggtgtagttgcaccagatgcagctgcattcaaagaaaaggttaaacgactagaacaagaatgccaaaacgataaaacaacttatgtggatgaggcggaattagagaggttcagaaatcatgagccgaccactgctaccaacttaggactacattatctttgtactaatatcaaactgggaattcaagacgaaaatggaaagatcaacacagaggccatcaaaaataatcttcgtgaaataatggttggaacaggcaaaattaatataatagcacatagatgcagccgtagattgcccgaagaatcagcagaagaaagtgctattacattatatagatgtttacataagccagcccatgtacataacaacaaccatactcatatccatgttcatagacataagcgttcaataaaaagaagcaaagctcacaaattttgccagtctgatgagtcaaccagggtaaatgaaagtgatatggagaagtttaaaaagggagaagaagtagacacatctaaaataaaaaactatattttctgtatgaataaaaaatttgagatacagaatgtggatggtaccgtcaataaagacggatttaaaaaatatctagaaaacaaggtaagcgataaaacaagggctaatgaattaacaagaaaatgttcagaaatatcggatccagtggcagaagaaacggctattaaattatacaaatgtgttcatgaaaacgatcgtatgatttacaccttaacagcaaatcttactgcattanaactanttcaatgcctatataaatatgaaaagaaacgagagcagaaaaaacgagctttccttaaacgtttaaagcaatttaaaaagtttcatcaagaatgcttatctgnatccgccaatcaggttgatgaggaaagtctttctaangttagtcatggtgaagacatagaagatcctaatctagcatcgtacactacatgcctaaataaaaaaatcaaataccaagacaaaaaagggaaaa

SEQ ID NO: 3338 - DNA, 1621 bp, Diabrotica virgifera
gatagagtgatagaggtatatttatcaccaattttatcaccgataataattttgtattgtagtatgatatttgcgtagtatttgtattttcattttgtattgttgccaaatttatttatcgttttggagaggttcatttcatttcaggctagggttagagtctagaggcagttttagtttttttaggttaagcgtacagacggcggtttacatacaacttacgtcaagattttatcaaaattaatttttaattgcctgtaatcaattgtgttttgttttgttcagtggttaattcattcagttttgtccagttctgtcgtctgttatttgttctaaaagattgtaggtaaatatggcgttaacaaatggcaaggttgttggtgcagatggagataatgatggatacttgccctttcccaaaggttttgccacggccgccattcatcactctcaagaacccgaacagtgggattctatggctgttgtaacaccgttagtaacgtctactacttttaaacaacatggtccagctcaatttaagaaatacgaatatggccgatctggaaatccaactagagaagttctggaaaatgtgctagccaagttagacaatgtttcatacggtttagctttttcttctggtcttggcgctctcacggctattgctggactgtttaaaagcggagataatgttattattggggatgatatttacggaggaactttccgcttctttagcaaagttctcactaactacaatattgagattactattgtggatatggttgatataaaaaatctcgagaatgccattaaaccaaatacaaagttaatatggtgcgaaaccccaacaaaccctacattgaaagtaatggacattagagccgctgctaaaatcgccaagaaacacaatgtaattttagctgtagataatactttcctaacgccatacctacaaagacctctcgaccttggagcggatttggcagtttattcactcactaaatatatgaatggacattcagatgtaataatgggttctattgcaacaaacaacaaagaattattcgataagctaaaatttttacaaaattcaatgggaatagtacccgcacctttcgattgttatcaagtcaatagaagccttaaaaccttagctttaaggatggcgcaacataagatcagtggtcttgcagtagctaaatatttggaagcccatcctcaggtggaaaaggtgttgcatccaggtcttcagtcacatccacagtatgagctttttaagagccaaaccagcggacacagcggagtattctctttcgttctaaaaggtggtttaactgaatcacaaaagttcctatctgcacttgaagtgcttactctgggcgaaagtttaggaggttacgaaagtttggtagagttgccgtctctcatgacacatgcttcagtaccagccgaacagagagccgtgttagggatatctgacagtttaataagaatatccgtagggctagaagatgtcgaagatttgattgccgatttagaacaagcatttaaaaagattaaataagtgaaagaattttagaaattttaaaaatgtatataaatatatttttgtaaacag

SEQ ID NO: 3339 - DNA, 943 bp, Diabrotica virgifera
gggtcgacacaagactctataatgacgtctacttttggagtttgaaaaataggaagtatggtttagtgtcaacaataaaaatataatttgtgtactttctttaaatatgaaaattttaacggattttacccaaaatttacttgattttctagtcgagcaacaatatgaacatagtcagaatattattagaactcacaccaaaaaattgaatgaattgggtgatttaagttttcctacaaatactaaaaactggtaccaattcattgatgtaattaaagaagaatcagttaaaagtgtgaatatagttaaatttgaaatttcagaaacgactagagaattagttacagagcaattgctgcaaaaaagctccagttggccaattgaaataaataaaattgtttttaaaaaggctgatgctcacatacatttgaaaagaagtccagtactttataaaacagtgataaaacatgtgttaatgcaagactctcaatatggttcgtgtcccattatgtcaaataactttaatgttgggttttctgtaaatattgaagatagcaacatagtaaatttgactactttgagaatgatgattctaaaagaagtagctgaaaactttatcaaatataataccatggaatcaccaagaaacacatataatttacattttgttgctaacgcagttgataatgaaaacattaacattttatgtggtccagttttaaacgaaagatgcataaagagtaaccttactgctaaagaattgtatgaaaaaagagcatctgatatgagaatgatggcccaacacaaatatgggggttcagataaaaccaagtaaagcaggggaaacatattttaataatattggaaaaggttcagtgaccatagaaatggtaacaaacaaaccacagaaatcaataaaataactccaaatgatttacatctg

SEQ ID NO: 3340 - DNA, 1606 bp, Diabrotica virgifera
cccacttctgtcagattatgctgtcaggtaataaattctgaaaatttagggaagaaagatatttgttttataagttttcacacaccttcattgagaagtatggcttctactcttacaagaactccaattttgcgagcaatttccgcaagaagctattctcaaaccctgccagtatcaggtaatccaagtgctgaactcagaactagtactcttcccaacaaactagttgttgcagcagtagataatgacgccagtcttacaagagtttcaattgtattcagagctggaagccgtaatgaaaaagccgataatttaggtgccactcatattgtacgaacagcagcaggcttgtccactaaaaatgcatcccagtttgccataatccgaaacattcaacaagttggtgcaaatcttacagccacatctgatagagaaaccatctcctataccttagaaggaacaagaagtgccgttgaaaaggctctaccatatttagcagaagtagctacccaccaagaatttagaccttgggaagtgtcagaactctccaacagattaattttggatattttaaccagacctttacagttaagagccatcgatttgcttcacaatgctgcctaccgtagcaaaggtttaggtaactcactcttcattccaaaatcccaagtaggtaaagtttcatcagaaacgttacaacattacgtagccagcaactttgtagctggccgtgctgcagttgttggtacaggtgtaagcgagagtttgttgaatcaattcgctgctagtttgggaattgcaaatggcgaaggcagcaccaatccatctccttacaagggtggtgaactcagatcaaacaaaggtggaccacttgcttttgttgcagtaggaggagaaggagctccattgaagaacaccaaagaagctcttgcgtttgcagttctacagaaagctgtatgtgctggccctcagatcaaatatggcgtacttgataatggagtctacagcaaagctcttggtggctcatcagatgtatctgcgtgcgctgttaatgtgagctattcagacagcggtttgtttggtattttgctcgctgcacctgctggatctgtaggcaaagcagttcaatcagctgttaatgtcttgaaatcaggctccgttacagatgctgatgttcaacgaggcaaaaatcaattgaagacagccatccttcttaacgctgaaagtggagctgacgttgtaagggaacttggaacccaagcagttttggctggtgctccacaaagcgccaatgctttagccgctgccgtagactccgtcagcaccagtgatgtacaaagtgctctaaggaaagcaggaggaaaattaaccttagcagcaattggtaacattaacgatgtaccatatttagatgaattgaaataattttgtaaattttattataatttattgtataatgtaaaagaaacacgtgcatacctattgtaacatctgttaattaaagtattaaaccctttttaaacctacctcacccattcccacccaaaaaccaaaattcaaaaaatactcccaccccaccccccaactcccatcccacccaccccct

SEQ ID NO: 3341 - DNA, 1779 bp, Diabrotica virgifera
cttttagaatcgacattgcttagaaccaagaaatccacgcattctttaataatttactgattttgagactgttttagacgtaaaatatgtcgaagggctacggagatgacttcgagcagggctatgactatggatatgatgattacggatctcatacaggagatccaaacttggacgaacacaatagacaacattttaaaatgcccgatagtgtgaaaaacttcttggtttactttcgtaataatgtaaacgagggattaatttttgaattgcaagcattgtatgaacacacgtggcctaagcttacagaagactactttgaaaagaggccatggcctgaagagaatgaagtagctgctattgtggacaatgatcctgtatttatgattttatataaagaactctacttccgccacatttacgcccgcatccaaggaggtccgtctttagaacaacgcttcaattccttcttcaactactgcgacttgttcaactacattctcagcgctgaagaacccgtgccactagaactacccgacctgtggctgtgggaactcatcgacgaattcgtctatcagttccagtcctttgcccaatacagagctcgtctacaaaacaagaaacctttggaattggagactttgaactctaacaataaagtgtggaatgtgttgtgcgtcctcaacgttttgcactctttggtggacaagagtaacattaagcagcagctggaggtgtatgctagtggtggtgatcctgagtctgtttccggtgaattcggcagccattctttatacaaaatgctggggtatttctcattggtgggacttctaagactccattccttattaggagattactatcaagctatcaaagtattagaaaatattgaagtacacaagaagtcgcaatatgctcacatcccctgcctgtcaaatatcaacttcgtactatgtaggtttttgcttacatgatgatgcgaagatatttccgatgctatcagaactttctcgtccatttattgtacattcaacgaacaaaacagtatttgcctctaaaacgtaccaacacgatcagattaacaaacaaactgatcaaatgtatcacttgttagcgatttgcttggtgttacatcctcagtgtgtcgatgaatcaatccaacaagtcttgagagagaaaagctaccatgaaaagatgtacaaaatgcaatatggcgacttaacggaattcgagaacagcttcgtttatgcctgtcctaaatttttgtccccttacccacctccaatcgattccgtctctggagactactcaaaggaggctattcagcaccaaactgccgtgtttatggatgaagtggctcagcagaaaatgttgccgaccatcaggagttacttgaagctatacactactttgccgctgagcaaattggctacgtttatggctcagaatagcaggaataacgaaggaagagacttggataaggagattgaatctttggtcatacatttgttgtgctttaagcataagatgaagaatgttgtttggtctaaaggtgcctccggtttggaaggaaagttccagagtgggtcagagcttgacttctacatagataatgacatgatccatattgccgacaccaaggtagcgcacagatatggagatttcttcatcaggaagatcattaagtttgaagacctcaacaggaaacttcatcaactgaaattataattttttttctaaattacaagaataccttttgtaatacagcctataaccatt

SEQ ID NO: 3342 - DNA, 826 bp, Diabrotica virgifera
gacacaagcgatctacacagacgttctgctccacgcgtccgcccacgcgtccgcccacgcgtcgcggaatttaatggcgatagtcgctaatttttaaaagttgaagaatccttcgggaaattgtccatcaaaaagtttttgccgattaattagttaaactaaacaatttttcaatatggccgataaagcagaagaactagtcaagaagaagaggactttcaaaaaattcacttttcgtggagtggatttagatcaacttttggacatgccaaatgagcaactcatggaactcatgcattgccgtgccagaaggcgttttacaaggggattgaaacgtaaaccaatggccctagtgaaaaaactacgtaaagcaaagaaagaagcccctccactagaaaaaccagaaatcgttaaaacccatttgagaaacatgatcattgttccagaaatggttggttctatcgttggcgtttacaatggtaaagctttcacacaagttgaaatcaaacctgaaatgattggacactatctaggtgaattctctttgacttacaaacctgttaaacacggtaggccaggtattggtgctacccacagttctagatttattcctctcaaataaattatttactatgtagatttatgataataaacaatttttgagagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggaaaaaaaaaaaagggggggggcccctttaaa

SEQ ID NO: 3343 - DNA, 1304 bp, Diabrotica virgifera
caaaaataaaacaagtcgtaaagtagactatagattagtgtttgatgctaaaatgttaaagaaaatctttcaacgtgatattccaaaacatgcccttaaaattatcaatagatcgtgccaaaaacgaaggctcacaagccaaactagaagacacccagctttcgaacgatctccagtatatttcaaagaagaggaagttattctaaataaacttatcccacaaattcgcgaagatgttatagatgaatcgttggtttactataataatatgcaaaaacttagaagacacttcgaaaaccttttcactcaccaggtggaaaatctaaagtcgaagtatatgccatctgctgcaataacgattaatttttacaaacattttaaaaaggactacacggaagaagagttgatgaaggtcgggattctgggatggtgctttaaactgcaagacatctctttgattatggttgatgacatcatggatgaatcagaattccgttacaataaaccagtctggtacagagaagtgggagtaaagcaagccatcatagactccctaatttttgaacattgttctagctacctacttttaaaatatttttctgatctcaagtattttcctcaaattcaaaaagaactgctccagaacatagcaactgctaattcttcacaaatactagaacttgacgattttccgttagaagactatgaaaaatatgaaaatttagtgaagtcttatccgttttttgtacattcagtcacatctgttatgtatatggttggtgttgatgaccctcatcttcactccatagcgaagaagatgtgtatggatatttctatatttggaaaaaagatatgatgatataactgcaattgtagaaacagtgagtgttgcggaaaaacacaacacagatatacatttttctagagcaaccggggatggctatccaagtgtccaaactggggaaacccccaacaaaaaaaagaacttttaaggaccctaccccaggtcccagttcctaaatcggccttggatcttttttgatttctcaaaaaaaacggaaggttagtggaaaattttcacaaaaatacacaagggaaaaatattgtggacatggtccccccaaaaaccccaaaactttgccccccccctcttgccccaaaaattttttttcttaaaaaaaatgttttttttgtggtggcgggacaaaaaaaaaaaacatttttatgtctaatacacaaaatgagaggctcccccccccaaaaaaaaaaaaaaaaaaattttttttttttcatcctctctacat

SEQ ID NO: 3344 - DNA, 1252 bp, Diabrotica virgifera
  misc_feature (195)..(195): n is a, c, g, or t
  misc_feature (206)..(207): n is a, c, g, or t
  misc_feature (225)..(225): n is a, c, g, or t
tcccgcgccgcagtgcagatggattattgtaaggatctatttaacattggctggcccaggtatggaacccgaaaaccacacacgcccacaatctctggcactgcagctaactcagctctacgctcagcagccagctagagacaagacgcctcgagcatggaaaaacagagggtaaaaagtctggggcgttggaancttctctgcgnntagtgaaccggtgaaggncgaaaccttcgatatcgagtacccacgtccgcgagatatattatagagatatttgtaattttatttaaaatatttacaagatgaaacctattgttttgtgtttgatgataatagcagcatctaaagctattccaacaaacagattaaccaatgatgatgccaacttgggagattttccatggatcgtcgcgttgaatatttacgcccgtatgccatggtacgagataacttatcacgaatgtggaggcgtacttgtaagcaaatcttgggttttaacttcagctagttgcgtcaaatctaatgcccaatggaatacagtgacagagatctacgctggtttcgtacgacaaaacgacccgtcgcgtcaatcatttacgatttcaagaattgagcgacatcctggttttaatatgaatgaatctcgcaatccatcttttgacgatattgctttggtaaaactggatcgtgatgtggaactaaacgaaaatgtaaaaatcgtcaaacttccagaagcagatgcagacattactaaaaattttacctctgctggttggccttatgcggctattactagggaaaaccaagacatcctacaattacgaagtgtaccatttttagattataaaacttgctatgatcaagtagcagcctacgtagcccttggtcgtactgaacctctcgatgaagcttgggataatatctacctaaacgaaacacaaaacatctgcacaggaccaaaagatgcggaaactgccgtttttacaaaaggttaccatggagggcccttgattcaggacggtgtcgtgtatggcgttttgtcctacacgttgaatgtgtacatataccataaggacttctatgagccatcaggagtatttattaatgttttcaattacatatcttggattaaaggaatagtcgatgatttataaaatatagaatcgatgagtttgttgatacagatgatttgtaatttatttttaattatataaaatatattgataaacaaaaaataaaggctccgccc

SEQ ID NO: 3345 - DNA, 541 bp, Diabrotica virgifera
cggacgcgtggggtttctgcctttaatatatggtttggactgatcgtttttactacaatgatactttacatagttctaacgatcgttattaccgaatggagaacaaaatttcccacgcgtccgaatttagcagataatgaaactcgaagcagaagtgtagattctcttctcaattttgaaacagttaaatattacggagctgagaattacgaagtggatgcttttagggaagctgttcttaaattccaagatgaagaatttaagtcaagtatcactcttaatatcttaaacacagtacaaaatgttataatatgcggagggctattagcgggaagtttgctctgtgtttatatggtagtagaacctaaaactctaaaggcaggcgattatgtattatttgctacatatatagtacaactttacgtgccgcttaattggtttggtacctactacagggccattcaaaagaattttgtagatatggaaaacatgtttgaccttctcagagaagaacaagaaattattgacgctccaggagcta

SEQ ID NO: 3346 - DNA, 1064 bp, Diabrotica virgifera
ttcgggcgagtaggtacaggatgtttcgtgaaagtatttttttaacgctaggcgttttacttgccggagtcgtgttctcgtccagtgataccgtcaaatcacaaaacccagaagaatgtcttgccagagactatggcaagggaagtgtcgtctgcgtttgtaacgaccagcattgcgactattccccaccagttgaacccgtgcctaaaaataaatatattgtatacacctccaaccaagctggcttaagattcaagaaagaggttaaaacctacacgaacgctaaatcgggaaaacactgtttcgtacctccaaacgatgatatctgcgaacacgactgggataccagctacagagtgtgtggagtcctggtgccatcgcatcttatacctagcgcaaacatctttgtcgaaccctctatcctttatcaagaagtaatgggttggggtggcgctgttactgattccactgttatcaatgtagctaacatgacgaaaacccttcaggaacatttgttaagatcgtactactccacagatggtcttgactacaactttgctagagttcctatgggcggaactgatttctcaacacgcttttattcatacattgacactctcgaacatgtcgtagactgtgttgatcacagcttaaaggactttaagctagcgccagaggatatcgatcttaagatcccattccttaaaagagcacgtcagctaagaaacgatttgaagctattctccagcacatgggttcttcctacagcatacaaggaaaacaacagctacatgggatttttgggattcatcagaaaagaagtataccaactgttagctgattattacataaaattcttcgatttatacaaagaacgtggattatcgttctggggtgtctcatcaactaatgagccttttatcgctatggcagaatttagtattcctggtactccaggaaacctttggacaccagaagatttgggatattggatcagggatcaccttggaccaacattaaacggtcagatcatagccatcttaaactgattactctcgatgatc

SEQ ID NO: 3347 - DNA, 1696 bp, Diabrotica virgifera
cacttagatcacttacctcggccactcttcatttatgaattatgaaaataaccagacatttaatatgttgaaattgtttaagtggtacaaaaaataaggttttgatttttctgtttcttaagctgacattttggttataaaaacgttaaattatataaataaagatttaagtttgtcttgagttcatttttcaatgatctataaattctacacaatttaatcaattaataatagtattctctataaccttgaccaagttatatttaataaaaaaaaacagtatagatgactagtattagaatcaaacacattggcaatggaagtctttttttcaatacttaaagtgttatttaatttagtttgttaattagtaggatttgggataaagttagtcggagtaaatcatcaaaagtatgatgttgccaagttatatcgtcaatataatatattggccatattatggccaatgaatgaatcagttggagtactattaagatgtcatcaagagaaaactaatatttattggttggatgtgatgtgcatcatgtacgattgacatataaattgtgacatgaaaatgacatggagcctagtatttaatgctgaatgtgaataagaaaataatagttttaattgtattacactaatcacataaaatatgataagaataaaattattcttaactgaataagtgaccttatcaatcattctataattgaaattttttatttgacgtgagcattaaaaaaacaggtgaaaaatttattttacgtttcttacaataaattgattgttagcatgaacacgaacatctctctttagctccatctcaccttggggagcattgggcggttatgcatttgttggctaaaggtgtaagattgctggctggccggttcagcgcaagattacacaaacataagtacagttaattatagaattatttcttttactagatgaagatacaagtttgattcatcattcttgatttttcaacccattgtgtcttgacatgtcccaggattaattttaattcgtttctattatttgccttagttttcctgtgttgtactcctacttttattagattgtgttccataaatttgtattgcaattatatattggcaaacgtttctacttaaagagtgtataaagaatgtttacagaatgataaaaaattcatggaattgagagatgtataatgcaagcctggtgtagaggctatttgaatccactgtcttacgtcagtttaactgataattagatgcaaaatttcactggtcattttgtgctcatattttttatgaaaattattttttaaatacttcctaagatttcagcaacactagattaattttgttttaatattaacacattgaaaaaagcaccacaatatcaatcatataatagaaattaggaaacatataaattgtatgttgcaatatttgtatcaaatgtaaaaaagtgagataacattcgtctgatactcttgtatcaactaaataaaaagtgttttcacatgaaaagctttaggtatataagttccctatgaaattttttcttttttttttttaaataacgtaatcattttacaaataggccaaaaatttgacacgtttttcatagcaattaataaaaagtaactttagatttcaggatgggcacacgttagtaaagagaaattttaaaattgatg

SEQ ID NO: 3348 - DNA, 941 bp, Diabrotica virgifera
tccccccagggcccaacttgtcttcttcacttcaattagagtgcaaacatgaagcaaatattagtcttgtcgatattgtttgtctccacatttggagcaaaattaaaccaatatctacctccaagacctgaaactgacaacgctcaataccaacctccagcacgtcccaatcaacctttctccgccgcaagtcaatcccaacaacaatttgctgctccaaactttcaacaagcaagcaggcagtatttagctccaaataaaggacccgagcaatctggtcaaggttccagtccttttggtcaaatttctggacaatttggacaacaatctaaccagttcgggaatagaaactcttttaatggcaacggaaatagtagtcctaacaaacaatatttagctcccaacaaacaagatgcttccggacaaagctctaactctttcggaaatttccaacagccaaatgctttcaatggaaacggaaatggtcctaatagacaatacttaggacccaacaaacaagacgcttccggacaaagttctaactcatttggagtccaatctcgtaacaattttaacggtaatggaccaagtcctagctcaagctttggttcaaaatctacaaatcaagcaccaaacgctggaaacgataactctttcggaccatcattcaactcttttaaccaaaaagctgcccctaatggtcaatttggacagtcaggttcatattcaaacggtttcaatcaacaatccggacaaggacaatacaatggtcaattttctggtcctcaatccgccccaatcggtttaatcagatctgaatttaatcctgatctcggagatggacactacagctattcatacgaaactgaaaatgggaattctgcccaagaagaaggtttcgttcaaaacgaaggtaaatctgcacatggggggattctctt

SEQ ID NO: 3349 - DNA, 985 bp, Diabrotica virgifera
gcaaatattagtcttgtcgatactatttacgtccgtatttggagcaaaattaaaccaatatcttcctccaagacctgaaaacaacaacgcgcagtatgaaccaccagcacttccaaatcaaccgtttactgcagccagccattcccagcagcaattcgctaatccaaattttcacatcaacggaaatggaaacggtaatgcacaaggacatgcctcaagctttggtttaaaatctaccaaccaagcaccaaactctggaaacgataacactttcggaccatcatttaactcttttaaccaaaaagcagcacctaatggtcaatttggacagtcaaacggtttcaatcaacgatccggacaaccgcaatacaacggtcaattttctggttctcaatctgcctcaatcggtttaatcagatctgaattcaatcctgatctcggagatggacattatagctattcatatgaaactgaaaatggaatttcagcccaagaagaaggatctattcaaaacaaaggtaaatcagcccaaggaggattctcttatacttctccagaaggtgaacagatcacgcttgaatacactgctgacgaaaacggttttgtaccaaaagggtctcatgttcctgaaattcctgaagcgatcttgaaatcaattgaactaaataaagctgccgaaactcgtggagaatacaatgaaggttcctatagagaggaatataaccaagaaggctcaaatggaaacaatagataccacggcaatgcaaataataaataccaagaaaattcaaatggtggatatcaaggaaatggtccacgtgaacaatctccatttgcttctcaagaaaatagacaagtagcatctttaccaggtccaaaatcctttagaacacaaaaaaatggctatcaatattcaggtccatcaaaatcaaacaactttgctgatcaaggtacatttgcgtcccagcaaagtaatcaagtatca

SEQ ID NO: 3350 - DNA, 1281 bp, Diabrotica virgifera
cctctgtgtacctagatccttgtatttaaagaagaagaagagtgaagagttggcacctgcacctggcacttttaattaaaagatagtagatatcagattttcaaagtgcttgataaaacaatcagtgctattttaaatccatttgttaaagtttgttcttaatacttttaaaatgggagacttagatggaaatacagttctagctcaagctcttaaaaagcaaggcattgaatatgtttttggaatcattggttacccagtcattgaacttagcatggcattacaaatggccgatattcactacattggtatgcgcaatgaacaagctgcttgttatgcagctcaagctataggttacttaactggcaaccctggagctgtattggtagtgtcaggtccaggactgttacatacatttggcggtttggccaatgcacaaataaattgttggccagtacttgttttaggtggatctgctccacaagatcatgaaggaattggaggatttcaggagtgtaatcaggttgaactggctagaccatattgtaaatattcggcgcgtccaccgagcataccattaatacctcttcatgtcgaaaaagcagtgagattagcaaaaacaggtcgaccaggagcagcctatcttgattttcctgcaaatattttatcaggtcgagtttctcaagaaaaaatacctgaccagtatggtccagtgcctatcccgcaagtttttcctgatccaagacaaattgaaaaggtcataactgttctttcgcaagcccagaatcccctgataattgtaggaaaaggtgcagcttattcaagagccgaaaaagaagtcagagacttgatagaatttgctaatttaccatttttagctacaccaatgggaaaaggagtcgtacctgacacttctacaaagtttgttggatcggcaagatcgaccgctttacaacaagctgacgttattctacttctgggagcacgacttaactggattttgcattttggcagacctccaagattttctccaaatgttaaagaaattcaaatcgatattactgccgaagaattgcacaatagtgtaaaatctgaagtagcgatacaaagtgacataaaaagtgcaaaaaggctaataaataccaaaaaaaaggggcagtatttcaaatataaattttttaaaaaataagagaacccaccgaagggggggggggtttttttaaaaaaaaaaaggcgggggaaaaaaaaaaaagaaagggaggaagggggggtgttgggggg

SEQ ID NO: 3351 - DNA, 1637 bp, Diabrotica virgifera
aacatctctaatatgaacctgcttaaaattgacaaatagttttcgaccccaaaccacttatcaaataatagtcaacaacgtcaaagataaaatttcttaattttttaaacaatatactggatggatataaataaagtttcaaacgctcaacctccgcgaaatttttagataaagtcacaataaagtgtaaaatattatgctcaggtgcgctttattattttcagctatattagctataagcttagttaatgcacgaggattggtagaagacaaggattggtggaaaacggctacattttaccaaatttatccaaaatcatttaaggacagtaatggagatggaataggagatttggaaggaattattcaaaaactagactatttagcagatcttggaatcacgggaatatggctatcaccgatctataaatcgccactgatcgatgaaggatacgacatcagcgattttagggatattaatccattatttggcgacttaaaaactttcgttaggcttgtagaaggagcacattctcgaggattaagggttgttttagattatgtaccaaatcacaccagcgatcagcacgaatggttcaaaaaatctgaaaacggcgaagaagggtatgaggactattttctttggatagatagcaaggatggatctaagacagaccttccaaataattggatcagtgtcttcaaaaattctgtctgggaatggagtgacaaaagaaataaattttatcttcatcagtttttcaaacagcaaccggatctcaatttctttaacgagaaagtccgaaaagaaatgagggatatactaaactactggctggaagaatacggagtagatggtgtaagaattgatgctgtgcctcatttagtggaggccaaaaacttaactaatgaaccaagaacctatgaccccaatgcatctcccaacgaatatgactacttggatcacatttttacaagaaaccaaccagagagttatgatttggtctacgaatggagaagccacatcgacggaatatccaagaatacttcacaaacaaaaatttgtatgacagaagcagctgttgatcttaaatatgtagtaccatattatggtacagccgacggatcaaaattgggagcacatttctcatttaattttgtattgcttggattggaaacgacttccactgctgctgatgttgcatcattgatacacgcttgggtggataagcttccaaaaatatacacgtctaattgggtgttgggaaaccatgataaccacagaattgctaccaaagccggaaaagaacgagtggactgtttaaatatgttatctgctttcctgccaggaatccaagttacttacaacggagaggaaatcggcatggaaaacggagaagtagactgcgaaacacaaggtctagatcacgccgaaaactgtacagattattacaaaatctccagagatttcgaaagaacgcctttccaatgggacagcagtgagtttgcaggatttaccgatggaaaaaagacatggttgcccgtcagctcaaagaaagctgagtgcaatgcgaaagatcaactaaaagacgaaaagagccattttaagtatattaccagaagcttcagagcttaag

SEQ ID NO: 3352 - DNA, 1176 bp, Diabrotica virgifera
cccatgcggccgcccatttttattgagcaaattgttcagaaagttgctgggcgtagtcgggaaaaacattgtttaaatccctttaatttcctctaagtcgaaagaaaaaggctcaaaatggctctcagcgacgcagatgtacaaaagcagatcaagcacatgatggctttcattgagcaagaagccaatgaaaaggccgaggaaattgatgcaaaggctgaagaagaattcaacatcgaaaagggccgtctggtccaacaacagaggctcaagattatggagtactacgagaaaaaagagaagcaagtagaactccagaaaaaaatccaatcatcaaacatgttgaaccaggcaagattgaaggtattgaaagtaagggaagaccatgtacgtgccgttttggaagatgctcgcaaacgtcttggtgaggtaaccagagattcaggcaaatatacacaaatcctggaaagtctcatcctccaagggctctatcagctcttcgaaaaggacatcaccattagagtacgccctcaggacagagaattggtaaaatctatcatgcctaacgtctcccaaaagtacaaggacataaccggtaaagacgtaaatctaaaaatcgacgacgagagccacctttctcaagaaaccaccggaggaatcgaactgttggccttgagaaacaagatcaaaatcaacaatactctggaagcccgtcttgagctcatctcacaacaattgattccccagatccgtaatgctctgttcggacgcaacgtcaacagaaaattcactgattaagtattttttggatactgtgtattgcctgtattttatatagtattgtaaaacattgttggttgcttagacagatcttcaaaaaccttttaaactactatgtatatacgatatatataataaaccattcctttttttgaagtattttaaacagttaagtttgttgttaccctaattgtatccttgtcaagcagatattttttaaaatccttagaaaattattaggtttcagttatactaccttattttttttctcaaatatattcatattttatgtttatatgtatataaaaaaattatttttttcttgtgagaaaatcatcgcaataaaatttattgttagtccaacaaaaaaaaaatggtggccgctttgttttttat

SEQ ID NO: 3353 - DNA, 889 bp, Diabrotica virgifera
gcatttttgatttctgcatctctggatttgcatatgatttgcatattgctttatttttggatttggttggcatttaaagtatttttatactttacttcccaacagtagtcagtagtgtatagtgcacatattcgctggtctggtatttatcatcctcggcattttcctgaatatagtttgtttgtgtgccagctatggaagttattaaagtggaaattaagaaagagttggctgaagataaccaaaattgtatagagagtcatatatcgacatcattagatattcaagacctaaagaatgaaccagaggaagatgaatcaggtcatctacagaaaaacagaatattcactgaacagacatctcacgaagaagaaaatattggtacacatgttgaagacgaaacattaaatgaaaatatgaaaatgcagactggaaaacaatcttaccaatgtgaaatttgtttgaaagagttttctaatcgatttaatttgaaaatacattcgagaaatcatacaggggaaaagcctttcaaatgcgaaatttgtttaaagcaatttacttcagccggtagtgtgaaaacacatctgaaatcacactctaaagaaaagccttacacatgtagtatttgttttatgaagttttctctagcaggtaatttgaaaaaacatttgagagtgcacactggagaaaaagattacaaatgtgacatttgccttaaagattttgctgacgcacagactctcaagtcacatttgatgacccacactggagaaaaacctcaccagtgtgaaatttgtttcaagcaatttactcatagaggcgcctttagaaatcatgtaaatacacacaccaaggagcaacagtatcaatgtgaaatatgtttgaagca

SEQ ID NO: 3354 - DNA, 1009 bp, Diabrotica virgifera
cggacgcgtgggcttccgtgtgatttttaatgttagttatagtgaattgctgggattaataatatatatattgatgtctgttttaaattcttcttggttactatatcctgtaatactttgtattgcaataatattccttggatacaaatacttcacgagacaatttgactattggaaaaaacgaggggtgtatacctcaacaccagttccgttttttggcagtctttacgatgttgctacgttcaaattaacctcacatgaattgtttaaaaaattttacgatgagaccgaagaaccatattttgggatgtttctttttgataagccgattttggtagttaaatcaccgaagttaattaaagatatattgataaaagatttcaacacgtttggtgacagaagtgttgcacatgctactcaccatgataatggatctcaatttctctttttccaaaaaagaccatcatggaagtacacaaggggaaagatgtctccaatatttagttctacaatgacaaaacagtattttgcagacattgaattaataaataagagatttattgaatatttagagaatatttctggtcccgtggatgcaaaattcatagcaggtcacttcagcacagaaatggtagctcgatgtttcttcgcaactgatccacgttgttttgaaactaaagtatccgagttcagacaacgtgttcatcgtatatttgaatttggtgtaagaaacggagtgatacagagtttctatttttttaaacccagtttggtaaagttcttcaaactgaactttgttcaaaatttcagccatgaagtattttgaaaaagtttttttgaaagccatggaatatagaaagcaatataacggaaaacctgccaacatggttgatctagtgaatgatttacaaaagaacacgatagggattttctgatcgaatctcctatatctaacgcatatttttattacagctggaacaaaacactgctactacaatttcttttgcct

SEQ ID NO: 3355 - DNA, 1193 bp, Diabrotica virgifera
acccatttgtcaacgcacggtctttggcggagtggtttatttgtgtggtaagaataagaatagaagggaatttaagttaccggtttattagcagaaatacaaagaaaagtaaaaatgcggaattatctgcttttattctttatatgcagtatttatacagttaattgcgattttgtgcgaattccacttcagaaaattcaaactataagaaactcactaagagaggtgggaaccgaattaactcgtgtatctgtgaaacaaacttcaaacaaatacggtggaccaactccagaaccgttatccaattatttagatgcacaatattatggtcctattagcattggtaacccaccacagaattttaaagtcgttttcgatactggatcatctaatttgtgggtgccatcgaagaaatgtggatttactaacatagcatgcttgctacacaacaaatatgactcatcgaaatcgtctagctataaacaaaacggaactaagtttgaaatccactatggatctggaagtcttagtggatttttgtctacggatgtcgttcagtttggaaacgttgcagttaaagatcaaacctttgccgaagctgtcagcgagcctggtttagcttttgtagcagctaagtttgacggtattttgggaatggcttatgacagaatttccgtagatggagttcctccagtatttaatcaaatgatcaaacaaggtcttgtcaatcagcctgttttctcattctacttgaacagagatcctagcggcaaagaaggtggtgagatcatcctaggaggatccgatccagagcattacaaaggagaatttacatatatacctgtcacccgtcaagcttattggcaatttaaaatggatcaagtaactgtgggttccaaaactttctgtagtgcaggctgccaggctatcgccgatactggtaccagcttgattgctggacctgtagaagagatgacagccatccaccaggctatcggaggtacaccatttccagggaggagaataacatcgttgatggtcagctgatccccaaactccccagtatcacttcgttttgggtgggaaaagttttcctttggaaggaaaaagcgaattaaattatttgaggggcgatcttaaataatggcccaaaaaccaacccggcgctggccttgggatctctgggggcaaac

SEQ ID NO: 3356 - DNA, 1339 bp, Diabrotica virgifera
gccgacccaagcgtccacccacgcgtccgcccacgcgtccgctgtctttggcggagtggtttatttgtgtgtggtaagaataagaattgaagggaattgaagttaccggtttattagcagaagtacaaagaaaagtaaaaatgcggaattatctgcttttattctttatatgcagtatttatacagttaattgcgattttgtgcgaattccacttcagaaaattcaaactacaagaaactcactaagacaggtcggtgggagcaaaattcaacggtgtgtcggattgtaaatccgtaaaatggagaggaatcctgaagtgctacacaacaaatatgactcatcgaaatcgtctagctataaacaaaacggaactaagtttgaaatccactatggatctggaagtcttagtggatttttgtctacggatgtcgttcagtttggaaacgttgcagttaaagatcaaacctttgccgaagctgtcagcgagcctggtttagcttttgtagcagctaagtttgacggtattttgggaatggcttatgacagaatttccgtagatggagttcctccagtatttaatcaaatgatcaaacaaggtcttgtcaatcagcctgttttctcattctacttgaacagagatcctagcggcaaagaaggtggtgaaatcatcctaggaggctccgatccagagcattacaaaggagaatttacatatatacctgtcacccgtcaagcttattggcaatttaaaatggatcaagtaactgtgggttccaaaactttctgtagtgcaggctgccaggctatcgccgatactggtaccagcttgattgctggacctgtagaagagatgacagccatcaaccaggctatcggaggtacaccaattccaggaggagaatacatcgttgattgtcagctgatcccgaaactcccagttatgaacttcgttttggctggtaaaagttttcctttggaaggaaaagattacatattgagggtatctcagatgggcaaaacaatctgcttgtctggattcatgggaatcgatattcccccaccaaacggtccactatggattttgggagacgtctttattggtaaatactacactgaggtttgaaatgggcaacaacccgaagttggatttgctgagacgggttgaaaaatttttcctaaaatcaaaagtttatatactattagcttaaaaaaaccttgggcacactttgtcctagtggccaaaaaaagacttttttttggggcccccctaaaagtattttggtgaaagatggccccctcattctggtatcctcaaacaacacctctaccgcgcttgac

SEQ ID NO: 3357 - DNA, 1537 bp, Diabrotica virgifera
gtgctaaggtagcataatcattagtttttttattgaaagctggaatgaagggttggatgaaaaaaaaactgtctttatttaatttataaagaattttatttttaagttaaaaagcttaaatttttttaaaagacgagaagaccctatagagttttataaaattattaataagtttttttagtattaaatttatttatataataaatttatttaattggggtgattaaaaaataaatttaactttttttatattattatattaattaataattttttgatccaatttttttgattataagaataaattaccttagggataacagcgtaattttattggagagttcaaatcgataataaagattgcgacctcgatgttggattaaagtttataattggtgtagcagctatattattaagtctgttcgacttttaaaattttacatgatctgagtttaaaccggtgtgagccaggttggtttctatctttaatttattaatatattttagtacgaaaggaccaaatatataaaataatttttatatttagataaatattaaaaaaaaaaaaaaaaaaaaaaaaagcagtgacagctcaaaaaaatcgaatgggtttctaagtccacgtattttaatattaaatattaaacatataattaatttgttttaactttttccagaaactttaattcaactatgacgtctttaagacagaaacaaatcaatgctataaagcaaatgttaaatttaaatcaaccccagactaagttatcagcctctgaacctgtatggaaagtattaatttacgacagaatagggcaagacattatatcgcccttaatttctgtgaaagaattgagagaacaaggcgttacattgtttgttcagttacattcggatagagatccaataccagaggttcctgcaatatatttttgtgctgccacagaagataatttagataggataagtcaagatttccaaagaggaacatatgacatataccacttaaattttatttctccgatatctagagataaattagaggatctagcttcagcagcaatagctgcaaacagcgtagcaaatattcataaggtttatgatcaatacataaacttcatttcattggaagatgatttatttgtcctaaaacaccaaaacagtgatattatgtcatattacagtataaacaaaggtgatataaaagattcagaaatggaggctattatgaacaacatagtggacagcttgttttcagtctttgtaactttaggaactgtgccaataattcgaagtcctaaaggaaacgcagccgaaatggtagccaaaaagctggacaagaagcttcgagaaaatatttttgatactagaaacaatttgtttgtttcggacgcacagtccggcaattttaatttccagaggcctctattgattattttagatagaaacgtagatatggcaacatcgctacatcacacatggacttatcaggcacttgctcatgatctgttagatttggctctaaaccgcgtaacta

SEQ ID NO: 3358 - DNA, 1038 bp, Diabrotica virgifera
  misc_feature (986)..(986): n is a, c, g, or t
attgattgttatatataatgtagtgatagtacttagtgaaataaaagtatgtaaatacggttcggattttatcttcgtgtgatttttctgcaccgatatttttacagcacttaaatatcgagcatttactcagttgtgacatgtgtatctagtaaattcaaaggagtttaagcagatactttaaagaataagtgttgaaaagtgttgtgtttgtgactggtgacaaaatggtgtgcctaaatgttaataaggtcgccattctcacaataattgtgttaggtgttgtcgcattaacacaacaaaggagtattaaagaaatagagcaacagccatttgaattagatgactacttaaatcacacatattcagcacttgcgttcaatggatcatggatctcagattctgctttcatgtacaaaacattcgaaaatgacattttgttttttaatatgtcaacaaagagcgttgatctatttctggacaacaaagtactggaggaatatccaacagcagaattaagattgtctccggaccggtcatatgttttactaaagtacaatgtctctgctgtatttcgacattcgataacagccgtctacacaatatacgatgtggctcaacaaaaattttaccaccttgccaatcagcaaccattgcagttagttgagttttctccagaggggcatgggttagtatatgttcttgagaacaacatttactacattgatgacttttcaaagaacattgaaactcctgtagctgtgactgttgtagggattccaggtgttctttattgcggtgttcctgattgggtttatgaagaggaagtattagcctcaggttcagccttatggttttcaccagatggagcttacttggcttatgcagtattcaatgacgaacaagtctataatttgtcctacactatttacggagaaccaggatcacctggaaagtcatatcctcatgaagcagtcatcaggtancccaaatctggaactccgaatccatagccagaatttacttgtacgacatagc

SEQ ID NO: 3359 - DNA, 928 bp, Diabrotica virgifera
cgtaaagtgctgtttcttcttggtcaaggcggaaaaatgaatgtcgccattctcaccataattgtattaggtgttgtcgcattatcacaacaaaggagtattaaagaaatagagcaacagccatttgaattagatgactacttaaatcacacgtattcagcacttgcgttcaatggatcatggatctcagattctgctttcatgtacaaaacattcgaaaatgacattttgttttttaatatgtcatcaaagagcgttgatctattcctggacaacaaagtactggcggaatatccaactgcagaattgagattatccccggaccggtcatgtgtcttactaaaatacaacgtctctgctgtatttcggcattcgataactgccatctacgcaatatacgatgtcgctcaacaaaaattttatcaccttgccaatcagcaaccattgcagttagttgagttttctccagagggacatggcttagtatatgttcttgaaaacaacatctactacattgatgatttttccaagcacattgaaactcctgtagctgtgactgttgtagggattccaggtgttctttattgcggtgtacctgattgggtttatgaagaggaagtattggcatcaggttcagccttatggttttcaccagatggagcttacttagcttatgcagtattcaatgacgaacaagtctataatttgtcctacactatttacggagaaccaggatcacctggaagtcaatatccccatgaagcagtcatcaggtacccaaaatctggaactccgaatccaatcgccagaatttacttgtacgacatagcaaacaagaaaacgaaggaaattcaaatacctcttcacataagcaacgtggaaccccacgacttcatcttttaccgactgacctggatctctgctgacg

SEQ ID NO: 3360 - DNA, 718 bp, Diabrotica virgifera
gtttatcgaaatcacatttttgaagtccataaaactgttattcagaaatactattagtctagtggctattgaaaacgcttcccagcgtgagctaagccgattagaggaactatatacttttacgactgatcaaataatatctactttattatttataagataagagtaagcctttgcctatataacaccggagtgagtcccaccggggaatgggaggtaagggatcggacttaacaacaatacatcaatcgatccaaaagtcaacctcacctgcacgagtggtagtctaaaattacccggtgcctcctgctacataacagacgaggctctggcgaccgagtatgagcgggatagtcatacaacagttacaggggatcaaggaaaggtgattcctacaactcaccaacccgcctggccaacgtggtgttttaaagctattttccccaaactaacaatgtcgaacttacaacaaagcggaaatggaccccatgtgggtaggagaaatccggagtcccacatcgggaaaccgatcagcctcaagggttctgggggaggcaaaagctcgacaagaacaaataagagaaaacggaaaaagaaggaatgcaacagaatacacatagcgacatataatatcagatccatggctcaagatgaaaagctgtacaaactcgaaaaggaattaactaaaatcaaatgggacattgtaggattgtcagag

SEQ ID NO: 3361 - DNA, 836 bp, Diabrotica virgifera
gcaggcctgcaggcagaggtgattcaagtcaagtcaagttgactgtccaagtgaagtgtccagcaatattttatgagctttctgttacttcaccggctcataagggataagattggttacaaagcagcgatgaaagttttattagttactttggcttttgtagccgttttagcctatgtaagaagcgatgattcgtcgaagaaaggcccaaaagtcaccgataaggtttggtttgatatcaccatcggtggagagcccttaggtcgtattgaaattggattgtttggaaaaacagtgccaaggacagtaaagaatttcagagaattagcaactaaaccagccggtgaaggatacaaaggcagtaaattccacagggttattagagatttcatgattcaaggtggtgacttcactaaaggagatggtactggaggtcgcagtatttacggagaacgcttcgccgacgaaaacttcaaactgaaacatttcggtgctggttggctgtcaatggctaatgctggaaaggacactaacggttcacaatttttcatcaccacgaaacaaacctcatggctcgacggacgtcacgtcgtgttcggtaaaattttgaagggaatggatgtcattaagaagatcgaagcgacggaaactgatagtcgtgataaaccaaaacaagatgttgttatcgctgattgcggtgctgtagacgtagatgaaccttttagtgtggagaaggccgatgctagagattaaatcttgtaaataattccagtaattttagctttgtatgtacctaatgtccttttttttaaataaattagggtaattttgtcgag

SEQ ID NO: 3362 - DNA, 1287 bp, Diabrotica virgifera
gctaaatcaaataaacacagagaatctttcattcaagtaatttttaatttcaattgttgtgaattttgcttatcttacgatcttatcttacgatttaatttgaataactatttaaattttaatatcttccttctgtatgaaactgagaagtttcagatgttgaagtattccgatatggaatctctggaaattgatgacttcctggaagaactttaattaattaattgagtttaagtgcttatcaattatgattcacaagatttaacaaaatatgaaattgtaccaaatcataaacaatacaaaagatgtctgcatttaatataaaaccatctggtggctggattcattctgaaaagcttcttgcaactgaaggggctacttatactgtcaagtatgtggggtgtctggaggttaaagtttccatgaagaaattgaatttcaaaacaagatctggtgttgcaaaggaatgtatcaacagagtttgtgaatactcaaagttaaagaatatagataagaaacgaaaagtggataaaaaggttttaaaagcaatagtagaagtgcctaatttgaattatgctggcatgtatgttaacttaaacgtgtctagtataaagttaacacttacatgtatagaaactaatcaaataatagcttgtcatgaaatgcctagaatatcatttgcatctggaggagaaaaagatgcgctagactttgtaggatatatagccaaagatccaaatgaggtgagagcttgttatgtattggaatgtggaggaggtctagcaaaagatgttatatcaactattggtgaagcttttgagttgaggttccaacaatttgcgaataaaactcctttaggtttaggtgctacaatgggccactactcaggttctacaggtggagatgccgacaaagattattacaacgatttacccggaaaaggttcctccagatgtgtgtgaacctccaccagttccccctttaccctctctgggtaccgccgttcacacactaccacccggttccagagtccaaatctcatattaaatttaataatgctgacatcatttccaaagggatccccccccttgattatggtctaagaaaatgggttttgggttgttttaaaaaaaggggaaggtttttttttatttcacccccttttcccccccaccattccggttccccccctcaaaaaaaaaaacccacaaacaaattttttttcacacataaaaaaaagaaaaaaaattggtttttctcccggaaacaaaatttaacccccgggac

SEQ ID NO: 3363 - DNA, 2342 bp, Diabrotica virgifera
  misc_feature (1980)..(1980): n is a, c, g, or t
aacaatcagacaaaatgatggaagttgtataaaaccaaatcctccgccttgtccatctggtacagtaagacagcctaatggttcttgtcaaaaaacaacaatagaaccatattgtccctcaggaacaactaaacagccagatggaagctgtatccgcccaacaccgacaccatgtccttttggtaccattaggcaacccaacggcaactgtgttaaacctactccatctccttgccctataggatttagaagactacctaatggagattgtgcaaaaccaacaccagaaccctgtccagaaggtacgagaagagagtctgatggaaggtgtgtccaaccaacgccatattgtccttctggtacagttagacaaactgacggtagctgtagaaaacctacacctgaaccgtgtcccccaggtaccatccgacaaccagacggattttgtgaacggccaacacctgctccatgtccatttggtactataaggcagcccgatggcagctgtgaaagacctacacctaaaccttgtccttcaggtaccattcgacaaccagatggatcttgtgaacgtccagcacctgcaccatgtccatttggaaccataagacaaccagatggcagctgtgagaaaccaactccttctccatgtccttcgggcaccgttcgacaacctgatggctcatgttcacgtccaacaccagctccatgtccatttggcactataagacaaccccgatggcagctgtggaaggcctacaccaagaccttgtccttcaggcactattcgtcaaccagatggatcatgtgaacgtccaacacctgcaccatgtccgtttggaaccataagacaaccagacggcagctgtgagagacctactccttctccatgtccttcgggcaccgttcgacaacctgacggctcatgttcacgtccaaccccagctccttgtccatttggcactatacgacagcccgatggcagctgtgaaaagcctacaccaagaccttgtccttcaggtactatccgtcaaccagatgggtcgtgtgaacgtccaacaccggcaccatgtccgtttggaaccataagacaaccagatggcagctgtgagagacctactcctgctccatgcccttcaggcactgttcgacaacctgatggctcatgttcacgtccaaccccaactccttgtccatttggcactataagacagccagatggcagctgtgaaaggcctactccaagaccttgtccttcaggaactatccgtcaaccagatggaacatgtgaacgcccaacacctgcaccatgtccgtttggaaccataagacaaccagatggcagctgtgagaggcctactcctgctccatgtccttcgggtactatccgtcaaccagatggatcatgtgaacgtccaacacctgcaccatgtccgtttggaaccataagacaaccagacggcagctgtgaaagacctacccctcctccgggtccttcgggcaccgttcggcaacctgatggctcatgttcacgtccaaccccagctccttgtccatttggcactataagacagcccgatggcagctgtgaaaggcctacaccaagaccttgtccttcgggcactatccgtcaaccagatggatcatgtgaacgtcccacacccgctccatgtccgtttggaaccataagacaaccagatggcagctgtgagagacctactcctgctccatgtccttcgggcaccgttcgacaacctgatggctcatgttcacgtccaaccccagctccttgtccatttggcactataagacagcccgatggcacctgtgagagacctacacctaaaccttgtgcttcaggtactattcgtcaaccagatggatcatgccaacgtccaacacctgctccatgtccatttggtaccatcagacaacccgacggaagctgcgaaaaacctaccccccagacttgtcctaagnagtactattcgccaaccaaatgggatcttgtcaacgaccaactcccggccccctggcccttcggaacagggagacaaccttgacggtagcttgcacaaagccaaccggaatatttaccccctgaaccaacgcacccccccccacccaatgatggttaccactatgaaagaaccttcccccccctttggattaactgggcctggaaagttttgtaacttatttcccggaccaaaaacccgaaaattaaaagggtagggatttccaaaaataaaaaaaaacaaatttcgggttacccccaaataaccaaaaaaaaaaaaaaacgcttaaaaattttccccaaaaaaaaaaaaaaccccctcttt

SEQ ID NO: 3364 - DNA, 1188 bp, Diabrotica virgifera
gtgagttcctttgttgtgttgcgcataaccacaaaaaatcatctgatatttgattacgtgcgtaaaataatttattacaaaaccaaaggttgaagttgatgagctataaatagaaaaagtgtatatttaatgtttaatgtcaatgtcaagaatacttaattattataattattaaccaaaaccaagatactgtactatgatgtgctgtactcagctgtagaatattccagtattacttcgtttttgtttctatggcggtgtcatatcaatcgagttttcgagacagcagtattggccaaaacaattaccataataacctacaggttagagttttagagaaccctgtgataaaagccttcctgtccggatcatgttcgggtgttatcagcacagttttattgcaacctttagatgtggtaaagacccgcctacaaaatcctccagctgcacttagaaatcagccaaatggactacacatcatccctatagtttctaatgtaataaaacacgagcagatatcaggactatggaagggaactacaccgtcattaatgagagcagtgcccggaataggattgtatttctgctgcttagaatacgtaaagacacatttcttcaagaagaaggcaccaacagcctcagaatcgatactgataggtatttgtgcaagaggcatggctggagccactctcatgccgatgacagttgtcaaaacgagaatcgagagcggagtgtaccagtacagcggcgttatggtggcactccaagacatatttccccccccaagtattaaaggtttaacgaggggattggaaccgaccttttttcgggaacgcccccctacccgaatttatttcttggttctaaaaccaatcaaaaaccctccctaccaaaaaattttttttccccataacaccccccccgccaattttcccttgggctggggaaatcccaccaaatgggcttcccgggggggcccccccccccggcgccgtttttaaaaaaaaagttctactctccctcccaaaaaaatttccggcggtatttgtggctcggggtgtaccccccctttttgtttaaaacacacaattttttaaggattttttctgggaatttttctccctgaaaattttgtagggggtcctttttgtggggggtttttatttttcggggtctttttttcacaat

SEQ ID NO: 3365 - DNA, 1505 bp, Diabrotica virgifera
cggacgcgtgggccatggtatcagtgaaatacaacaatatcctgatgcagcagattctacattaccaactgttggtaaaaggaagagatcagaatcggagggatttggtctcgatgatgcatctactccaggttcatcaaagaaagcaaagaagattaagagtgaagtagaagcagagcctgaggaagcggaagaaactcccaaaaagaagaaaaagaaggcaaaacaggaaaaagtggatgaaagtgttaaagaggaaattgaggaagaggtagcagatgaatccataagtaaaaagaagaaaaaaaaagtaaaacaagaagaacaacaagaagaagcagtaaatgatgaagcgccaacttcagagaaaaagaaaaagaagaagaaaaagaagcagtcagaaagcgaataactttacaaattgttttacaaatacatacctgtaataaatttacaaattattttatgtttgtaaatatggtataaaagtcaaaactgcctagcattcaagttttttaataataatagaattacaaacttagccttcgtttacaacacctacactgagtaaaaaactgttccacaagcaagtcttctgtcattgaacagtaagataaacctgtagaatatatcagtgtttcagaaaaatatgtagaaaatgttttatgcgttttacataactcagttcatgataacgttataatactttttaaattcataaaaatgcttgtatcatctaaatctaatgcttacttcagattttctatggattttaggtacaagtcgtacattgaaatcagtgatgtattgttttctggaattattttttccttgtcttaagtctgcagctgcggctgctatcaaaggtaatatatcagctgtcagagttgttttccagaaggtggctaatcccaaattatatcatcacgaaatagcagctgtgaaaagttcattgttcattttgaacaaaataattaaccaattttataaattggaactggactaatacaatgttcatctctgttggagaacatgaatacttcatgactcaactacatttaaaaaggttttcttgcggcatgattaactcagaattgttttatatgggattaaaccacaattgtatgagaattacacgttttctttgacattttgatttccagtccggaaatcgttttcaaaaaatcattaatgatcacccgtaaatacttataattgacggtgggtggtgatactatttgacggttatttatttggcctcgatcttaaaggcgttaaccatgttttgatgtggaattttgagagatgtttttgtacgctcagattaatttcaaattctgatcattctttggtaaaccatgctattttatttggggaacataaaatggggagttaattttaattgtgtttttccttttcatcacagtttgctacagttacttcatatttagtgattatttggttttgtaaggtttgcttgctggttactatgggatatcgtgcct

SEQ ID NO: 3366 - DNA, 828 bp, Diabrotica virgifera
gttctatctgttcgattagtaccgtgacaaggcagtgttgttcaattcacacccacatttaacaatatgagttcagctgctaccgaaccaaaagtttgccacaagtgcaaagagcaggtcaaaggaggagtgctaacagctttaggtaagacatggcatcctgaccatttctgctgcaatgaatgcaaaaatccgataactgagaattcattccacactaaagatgattttccttactgtacgccttgccatactaagctttttgcgtctatttgccatgcctgtgaccaaccaattttggacaaatgcgttcaagcgatgggagtcaactggcacgaagaccatttcttgtgcgaagactgcaaaaccaaattaattggacaacaattcatggacgtcgcaggacttcctcgttgccagaaatgctacattgccaaacatgcagataagtgtaaaggttgtggcaaaccaatccctgataaggctatcgtagctttggatgctaaatggcatcaaatgtgcttcagatgttcaaaatgctccgaaacctatcatgaaaggaccagtcattccccaagtaaatagcgccaggcccccactgcgcaagggttattttccgcagctaatttaattcattggataagttccagctaaggaatgaccaatcaaaatggcctgattttcacaccaaaacaaaccaaaacctctccgcaaacgtatttaaatttacactttgaccaaggtattattataccaaaattcttggaatattgattattttttaaaaattgaccttttttaaccatggtaaaaaaaaggttttccgcc

SEQ ID NO: 3367 - DNA, 903 bp, Diabrotica virgifera
ccattcgtgaaactgtgttatttgtgaaaaggtattaaaaattttacgtttttatagacagcttgtttattgattattctttatttgtgtagagattatccaacagcgtcagaactaataatgggtgcatcgtgctgtaaaggtgaggataagagttcagctgctaccgaaccaaaagtttgccacaagtgcaaagagcaggtcaaaggaggagtgctaacagctttaggtaagacatggcatcctgaccatttctgctgcaatgaatgcaaaaatccgataactgagaattcattccacactaaagatgattttccttactgtacgccttgccatactaagctttttgcgtctatttgccatgcctgtgaccaaccaattttggacaaatgcgttcaagcgatgggagtcaactggcacgaagaccatttcttgtgcgaagactgcaaaaccaaattaattggacaacaattcatggacgtcgcaggacttcctcgttgccagaaatgctacattgccaaacatgcagataagtgtaaaggttgtggcaaaccaatccctgataaggctatcgtagctttggatgctaaatggcatcaaatgtgcttcagatgttcaaaatgctcgaaacctatcatgaaggaccagtcattccaagtagatagcggcaggccccactgcgtcaagtgttaatttcagcagctatttatttcattggttatgttctagctaatgtatgatctatcgaacatggcctgtattttctacacaaacaatacaacacactctcgcaaaacgtattaaatttacacattgacaagttattattatacaaatattctatgtattatgtttattttataaaatttgagctttttatcatgttaaaataaagttttcgcc

SEQ ID NO: 3368 - DNA, 991 bp, Diabrotica virgifera
ctatttcagttcagatcagaaatatggtgttcgttacgaaatttgacgaggacgttctcaagaatgtcaataattcgatggctcaaaatgttttgccattccaactccaagctttggagaagaaaaaccacttggaccatttgtgtgcccttgatatcaattccagagcctcgtttatccgtctttctggaataatatgtaccattggacccgcttcaagggacccagagatcttggtccaaatgatggaatctggtatgaactgtgcccgtttgaacttctctcacggttctcacgaatatcacgctgagaccatcgccaacatcagaaaggccgtcgaaatgtacagcaagaaaatcggcatgccctacccattggccattgccctagacaccaaaggtcctgaaattcgtactggacttttagaagggggtggctctgctgaagtcgaactagtcaaaggacaaacaatcaaattgaccacagataaggcttatgaatccaaaggcacaaaagactgcatatacgtcgactatgacaatatccagaaagtagtcaaagcaggaaaccgtgtttacgttgatgatggtctaatttctctagtagtagacagtattcaaggatctttcctcacttgcacagtcgaaaatggtggtactctcggcagccgcaaaggttgcaatcttcccggagttcctgtagacttaccagccgtctcagaaaaggataaatcagatttgagatttggtgtagaacaaaaagtagacatcgttttcgcctctttcatccgtgatggcggcgctttgactgaaatcagaaacattctaggggaagaaggaaaaagaattattatattttcgaagatgaaaaccaacaaggtatgaccaatttggacgaaattattgaagcttccgacggattaatggtagctcgtgggagatcttggtatcgaaatcccaaccgaaaaagtatcatcgctcaaagggcatga

SEQ ID NO: 3369 - DNA, 1159 bp, Diabrotica virgifera
tttctttctactggagtactgggtcagtcaggtggtacataattaagaatttttgcagaatttgtgccggctctcacgtgtaaaagtaactgatttccatcgttttcctttctaagattcttcaagtgtatcagtaataatctcctaagatggctcaaaatgttttgccattccaactccaagctttggagaagaaaaaccacttggaccatttgtgtgcccttgatatcaattccagagcctcgtttatccgtctttctggaataatatgtaccattggacccgcttcaagggacccagagatcttggtccaaatgatggaatctggtatgaactgtgcccgtttgaacttctctcacggttctcacgaatatcacgctgagaccatcgccaacatcagaaaggccgtcgaaatgtacagcaagaaaatcggcatgccctacccattggccattgccctagacaccaaaggtcctgaaattcgtactggacttttagaagggggtggctctgctgaagtcgaactagtcaaaggacaaacaatcaaattgaccacagataaggcttatgaatccaaaggcacaaaagactgcatatacgtcgactatgacaatatccagaaagtagtcaaagcaggaaaccgtgtttacgttgatgatggtctaatttctctagtagtagacagtattcaaggatctttcctcacttgcacagtcgaaaatggtggtactctcggcagccgcaaaggttgcaatcttcccggagttcctgtagacttaccagccgtctcagaaaaggataaatcagatttgagatttggtgtagaacaaaaagtagacatcgttttcgcctctttcatccgtgatggcggcgctttgactgaaatcagaaacattctaggggaagaaggaaaaagaattattataatttcgaagatgaaaaccaacaaggtatgaccaatttgggacaaaattatttgaaagtttccgaagggaatctgggtagcttcggggaaaactttggaatcgaaaatcccacaccaaaaaaagtattctttccctctaaaaaggccaaggatttggcccaatggacaacaggggccgggacataccccgtaatttgtggtccccccccaatatgtgggaaaaatctatgtatc

SEQ ID NO: 3370 - DNA, 2159 bp, Diabrotica virgifera
cttggtagacttcagttcagtgggtaaggttctaggaaagaaaattcaaacatgaaggctattgtcaggaccggaaggatggctcaaaatgttttgccattccaactccaagctttggagaagaaaaaccacttggaccatttgtgtgcccttgatatcaattccagagcctcgtttatccgtctttctggaataatatgtaccattggacccgcttcaagggacccagagatcttggtccaaatgatggaatctggtatgaactgtgcccgtttgaacttctctcacggttctcacgaatatcacgctgagaccatcgccaacatcagaaaggccgtcgaaatgtacagcaagaaaatcggcatgccctacccattggccattgccctagacaccaaaggtcctgaaattcgtactggacttttagaagggggtggctctgctgaagtcgaactagtcaaaggacaaacaatcaaattgaccacagataaggcttatgaatccaaaggcacaaaagactgcatatacgtcgactatgacaatatccagaaagtagtcaaagcaggaaaccgtgtttacgttgatgatggtctaatttctctagtagtagacagtattcaaggatctttcctcacttgcacagtcgaaaatggtggtactctcggcagccgcaaaggttgcaatcttcccggagttcctgtagacttaccagccgtctcagaaaaggataaatcagatttgagatttggtgtagaacaaaaagtagacatcgttttcgcctctttcatccgtgatggcggcgctttgactgaaatcagaaacattctaggggaagaaggaaaaagaattattataatttcgaagattgaaaaccaacaaggtatgaccaatttggacgaaattattgaagcttccgacggtatcatggtagctcgtggagatcttggtatcgaaatcccaaccgaaaaagtattcatcgctcaaaaggccatgattgcccgatgcaacaaggccggcaaacccgtcatctgcgccacccagatgttggaatctatgaccaaaaaaccaagacctactcgtgccgagagctcagacgttgctaatgccgttatcgacggtgctgactgtgtgatgttgtcaggagagaccgccaaaggagactatcctttggactgtgtccgaaccatggctaatatctgcaaggaagctgaagctgctatctggagcggcgaattcttcggtgacttgacctcaatgattcctgttccattagatatggcacaagctatcgctatttccgctgtcgaatctgccaataaaacaatggcagctgccatagttgtaataactacatcaggaaaatcagctcatctgatagccaaattcaagcccagatgccctatcatcgctgttacgcgtattccacaaactgcacgtcaatgccaaatgtacagagccatcctacctttgatctacgaagctgaacgtaaagaagactggctccaagacgtagacgccagattacactatggtatcacattcggcaaatcccgaggattcgttagaaccggagatccagtcgtcgtagtaacaggatggaaacaaggatctggttacaccaacaccctcagaattatctacgcatccgatgaagtagagggcatatgtcttggctcatgcgcaaagtaaacgtctagaagttaattcaatatcagtgttatctcagaaagtctaaatattttttgaaaagttaccggccaacaacttctacaacatcagtcagaattccttaattacgtatattttaatttatttttagtcgccttagtactagttcacatcattaaatgaatttttctagatgaaacaccaacacacattactaacaggtgtctaaattacaaaacaattttttttagcgcggacgcgtgggatatcagtgttatctcagaaagtctaaatattttttgaaatagtaccggccaacaacttctacaacatcagtcagaattccttaattacgtatattttaatttatttttagtcgccttagtactagttcacatcataaaatgaatttttctagatgaaacaccaacacacattactaacaggtgtctaaattacaaaacattttttttaacaatttgttgtttttt

SEQ ID NO: 3371 - DNA, 956 bp, Diabrotica virgifera
aatttgtacgatttgctggcattaacatttattttccatcgcttgagccagttttgtaattggtctaaatgattttgaactttttgtgatgctacattagggtcgacatccactagtaagattcccgtatcatcggcaaaagtagctaagaaggtatcatttctggttggaacgtctgctgtaaatatccgatatagaaatgggccgagaacgctaccctgtggtacgccagattggatgatgtggtaatttgagaagttgtcttcaattttgacttggaaatatcggtcagtaagatatgattttagaataaagtatagttggtccgttaggtgtaatttcagtttacagaggagaacttgttgccatactctatcaaatgcctgttgtatatcgagaaacactccagcgcgaaactttttctcttcaagagttgttttaattataattactattctgtggcattgttgtatggttgagtgttcacgtctaaatccgaattggtgttgtggtataatttcgtttatggggacaacttgctcgattttatgtagtagtagcctttctaatactttcgacattattgggagtaggcttatcgggcgatatgaatttgcttgggttgcgggtttaccaggtttcggaatcatagtaacttgagctaatttccattgtattggaaaatagcgaagacgtagtatgctgttgtatattactgttaataacgccactgcttttctcggtagcttctgaagtaattctcctgttatcaaatcatagccaggagctttctgaggatttagcatttttatttgttgtcgaacctctgtcggagtaaatgttgtcagaggaaaagatagttgacatggagtttcgaggtacatttgtgcgggcccaggtcatatctgtttttcttaaaggtgactttgttattgtcggccgtttaaatttttttg

SEQ ID NO: 3372 - DNA, 947 bp, Diabrotica virgifera
gtatacgagaagaaagatgatacctcctacatcggttttattattggcgtgcttgatcattggaattgagggtgggatcctctacccaagagcatcaaaaacgagagaccttcaatatttggatggattgtggcacttttctttaaatgccagtgcctctagccaggaactttcaggcaatcctaatgacaaagacattcatttaatgccagtaccatcgagttataatgatattctcaccagtagtgaaggcagagatcacctaggaccagtagtgtaccaaaaaaagtttttttcgccaagtacttggacaaaagagggacgaaaaatttggttaaggtttggttctgtatgttattctgcaaaagtttatattaatgataagttcgcatttgctcacgcaattggccatctcccgtttgctggggaaataaccagtttggttaatgatgatgaaaacactatcaaagttattgtggacaatacacttacaccaacaacgattcctcaaggatcagttactacattgccaggtggaagagtagctcaaacatacacctttgatttttttaactatgcaggaattgatagacccatagctttgtatactacacccgaagtatacatcgatgacgtaaccatacacacttcagttcggggaacaacaggtattgtctcttacaaaataaacctaaattcgaacgaaaatagtaaaaataagttaataagttacaaagtcacagtcctagataaaaataataataaagttggtgaaaatgtggaagctagtggaaatatatcgattccagatgcacatctttggtggccgtatctaatgcatgatgatcctggttattgctataggttaaaagtggaaatttttgttgcttagatacaacactaatagacagctatactcagcattttggcatacgagaactattttg

SEQ ID NO: 3373 - DNA, 762 bp, Diabrotica virgifera
aattttcccaatacttctatcagaataatttgatcaaaaatgccaaattataagcttacctacttcaatgtcaccggaagagcagaacctgcgagagttatgcttcattatggtggaattccttttgaagacgttcgaatagagcatgctgattggccaagcataaaaccaacaaccccatttggacaattaccagttttggaagttgatggtaagaagtatacacaaggaacccctttggctagatatgtggccaatgttgttggtttggtaggaaaaactaatgaggaaaacttggaaatcgaaattgcagttaatattgtgtccgagctcttaataactgcttatgaattcaagtacgaccctgatgaagaaaagaagaagcagcacttaaaaaagcttaatgaattgatggctaaatacttaccagttcttgatgaagctgcaaggaaaaatggaggtcatcttgttgagaacaggctcacctgggcagatatcttctttgtaacatcttatgaagatataagaaatatactcaagaataaggatattgtggaagatttttctggattacaacatttgaagaagaacgtactctcagaaaaaaatataaggcaatatatccagaaccgaccaaaaattccaacctttgtttacgatctaagaagcgaagtgtaattttttaaacattataaaaaaatatttattttcattttgtaaaagttaaacacctaaaacatttttaatacatataccttagac

SEQ ID NO: 3374 - DNA, 2108 bp, Diabrotica virgifera
catgctccatactccattgtggtagatcttttattccttgtggggaaagatggcagacaacacactttatgatattttaggtgtgcccagaaacgcaccagcaaacgacattaaaaagcaatataggaagctagcgaaagaatttcatccagacaaaaacccagctgccggcgacaaattcaaagaaattagctatgcctacgaagtcttgtcagatccaaaaaagaggtccctgtatgacagagtgggcctcaaaggtatgcaagagggtgctcacgatggatttggtggagacgatctactttcacacttattcggcggtggtttatttggaggattcggtggaggggggccgcggaggagactaagaggtgaagacacagtgcatcccctaaaagtatccctggaagacatgtataatggaaaaacatcaaaactacagttaagtaagaacgtgatctgtaatacttgcagtggtaaaggtagtaaaagcggaaacaccgagaagtgcagcacttgtaatggttgtggattaaaagtaacgtatagacaagttgttccaggaatggcacaacaaactcaaacacgctgtccagactgtcatggtgaaggtgaaataatcaaggaaaaagatagatgctctagttgcaagggcaaaaaagtatgtaacgagactaaaatactagaggttcatgttgataaaggcatgaaagaaaaccaaaaaattttcttcagaggtgaaggcgaccaacagccagatgtagaacctggagatgtagtgattattttgcagcagaaaccccacgaaagattccaaagaaatggtgatgatctacatgttaaacataatatttccttaacagaagcactttgtggcttttcctttgtgattcatcatctagatggaagagatattcttgtaagacaacctccaggagaagttattaaaccaggtggtgtaaagtgtgtaagaggtgaaggtatgccccattacaaaaacccattcgaaaaaggtaacatgtatatatcattcgatgttaagtttcccgaaaatcatttcactagtgagaataatctaaaagcattagaaactcttttaccccctagatctttattcacaatgcctgtaggagaacatgtagaagaagttgatttacaagaagttgatccaactgataaaggccattcgtctcgaggtgaagcttacgctagtgatgatgaagaacaatcacatgggccaggtttacaatgtgcacatcaatagaatattactttttagttattgcaaatctgtatgttgttctgcgcttctttctgacaaaggatattgtattgaaattgattccgtagaaaaatgagtttttatttaatattattttgtaatttacataaagatggcaacttcagactgtagtgtagaaggtaccattattgtttttcatcatttgctcttatttattgcattgtatacttctgttactcatatttctacatagatgaaatattacaaataattttatcatatagcaaaaaaaaataggggtcgatgcataaaaaagcctgcacaccatctatctttattgtatgtagtcaatatcataatattacttcatcagatagagtgttatgagctgttaattactgtatagatttttacgaggtacacaagatttctctatagtcaatataattacaactagacattttcatttttataccacgtatcatgatagagcaatttgcttaaatataaaattttaataaaatttacttcttatatgataattatctataagaactatcatatttaaatataagtgattattccttttcataatttattattaaaattttatataacaatattataaaaacataaatctaaattactattatttaccaatgatgatcatattaatatttacaggatgtgtatttagacatgatgtatccgtatattacaagtattcgaaatcctttgttttaatttgtcaattagtaatatgtctatatgggatcaagtataatatttcgtctgtccactgattactttgaatgtacacgttattttgaccgcactaccgtagcataatcattagtttttttat

SEQ ID NO: 3375 - DNA, 1290 bp, Diabrotica virgifera
cggacgcgttaattccaattgatatagttagtttttaaatttaaaaaatgtcagaggataaaaaaccctgcggatttgaacacaaggacgaagaagatgatttggcgtgcgcattggaaagtgtaggaatgagtaaaagaaagggaagaggacgtgtaacttctggattaactcacgaatgcggagtttttggtgccataggatgtggggagtggcctacgaatctagagatttcgcaaatcatttgctggggattggttgcattacaacacagaggccaagagtccgccggtatagtcacaagcgaagggcgctgctcaaaatacttcaacgtcgtcaaaggtatgggcatgatcagtaacattttcaacgacgaagccataagaaaattgaagggaagcgtaggcatcggccacaccagatattcgacctctgcagcttcagaggaagtcaactgccaaccttttgtagtccatactgcgcacggagcacttgccgtagcacacaatggagaattagtcaactgtgatagtttaagaagacaagtattggaacatggtgttggtttatccacccactcagacagcgaactgattacgcaagctctatgcttgaacccaccagagggtgagcccaatggtgaaccagactggccagctaggataaagcatttgatggatttagcacctttaagttattctctagtaattatgttgaaaaataagatttatgctatcagagatccgtatggaaacaggcctctgtgcttgggaaagattttaccttttaatgaacctcttgatggagaatgtgatgacagccgagaggcagagggatgggtggtatcctcagaatcttgtggattcttgtccattggagcacaatacgtacgtgaagtattccctggagaaataatagaaatgaccagacacggtatccgcaccatcgatgtggttgcaaggcctgaagacaaaacccaagctttctgtattttcgaatatgtatattttgccagagccgacagtatttttgaaggtcagatggtgtatgccgtcagaatgcaatgcggtagacaattggctatagaacaccccgtagaagcagacattgttagtgctgttccagaatctggtaatgcagcagctcatggtttttcacgacagagtggaataacgttcgcagaaagtttaatgaaagaatagatatggaaggaagatcttttcttccagccaagaaatcgcctcagaaaactcagaattggaaagaaatttcggggccttgggaaggaaa

SEQ ID NO: 3376 - DNA, 1331 bp, Diabrotica virgifera
ctttttgttgtattgtcagtttaaagtttaaagtggtttaaattaaacattttaactttacatagattttaggtaaataaaatgactatatataatatttatatattcgacaagtcaggaatattgctttactatcaagaatggaatagagtaaaacaatcagggatgacaaaggaagaggaagccaaacttatgtatggaatgttgttttcgatcaagtcttttgtcagcaaaatatcaccaacagatcccaaagaaggttttctcttttacaaaacttcaaaatacacacttcatttctttgaaactccttctggattaaagtttgtgcttaatacagatacccagtcccaaggagtcagggagattttacaacagttgtatagtcaaatatatgtagaatatgtaatcaagaatccattatgcaggttatcacagccaattgattccgatttgtttaaaacaaaattggatgcatacattaaacagttgtctatatatccatccaaagtcgcttaaatagatattactgctataatttttttttgtatattttgtatctatttattatattgtaatgtgaattatctaggtagaaataataaatatattctttgtatatatggtacaatatattagtattaaaggtaataaagatatttttataattgcattgtttttgttgaggttattgtattcttcataatgttttatgttaacttttttttagaagccatctgttatgtatgtggaagattagttgcccgctcttctgctacggcttcatatttcttgttaatggggatgttctttctacctaatgagggtaaaaagagatattaaattaaaactaagccctttttaaacaataccaggagccaacccatttccttaatgctacccccctgcccttttcccacgtcctcttattgttttttcttttttgtttccaaatttattccacttaactaattggtattcttgttttaataccaaattttccttaccccttgtttcccgggggggcctcttataatggttcttttggttctacccaacttccggcattggaaatttactggctataatttttccaaataaaaactttaggaaattctttttttggtttccccccccccggttactttcctttgttaaccctttggggccctcccccggtgggggcggggaacatttaaaaggaattttggaaaaggggacctcttttaaggaggaaaaagaaatttttttttcccccataaaagtggtttttttttttttcccccccccttccttaatatctctttttcttttttttttttggtgcttct

SEQ ID NO: 3377 - DNA, 633 bp, Diabrotica virgifera
cccagaaacctgcccacatttttagcctgtacgtccggtttactgttgttgcccttttattgtgtgttgctttaaatgaagtacatagcggagttatactaggcaaaggattaggtagaagttttacagcatgtcctgatccccttaacccaggaatattggtatccgacaacgacatttcaggaggtctcttcgaatctatcaacttaagaattccagaaataggattgttagaaacgcctatttcatgcatattgatcgttgataaaaagaagagttcaactgacccaattgttagtgcaggaggtgtaggttctccatatgttgaaataagtatcaaaccaggattcttcgaatctcttcattataggattgaagtgtacaggaaagcacctgataccacgcctgcctcaacagcaacaactccttagttaatataaatatcaaaccaggattcttcgaatctcttcattataggattgaagtgtacaggaaagcacctgataccacgcctgcctcaacagcaacaactccttagttaatataaatacatattttttaaatatttttcaatgtccaataaatttttgaaatagaaaaaaaaaaaaaaaaaaaaaaaaaaataaaaaaaaa

SEQ ID NO: 3378 - DNA, 671 bp, Diabrotica virgifera
aggacgcgtgggcggacgcgtgggcggacgcgtgctgaaacctatcaaatttttaaaatgtacactaagtttactgttgttgcccttttattgtgtgttgctttaaatgaagtacatagcggagttatactcggcaaaggattaggtagaagttttacagcatgtcctgatccccttaacccaggaatattggtatccgacaacgacatttcaggaggtctcttcgaatctatcaacttaagagttccagaaataggattgttagaaacgcctatttcatgcatattgatcgttgataaaaagaagagttcaactgacccaattattggtgcaggaggtgtaggttctccatatgttgaaataagtatcaaaccaggattcttcgaatctcttcattataggattgaagtgtacaggaaagcacctgataccacgcctgcctcaacagcaacaactatttagttaatataaatacatattttttaaatatttttttaatgtccaataaatttttgaaatagaataaaaaaaaaaaaaagaaatggcaggggggccacaaaaagaaccaaacgaaaggattctgcttcatcacatttgaatctgaacaaataacgaatgaggtactccatttaaccgaacaaaccattaaagactaggaggtcgatgtaaat

SEQ ID NO: 3379 - DNA, 1179 bp, Diabrotica virgifera
ggcagtgacataggaaggcggccaaattaattttctattattttaaaagctactgcattaacaatgagtgacagaagaaatgctgatgaagatgatgcaccttactcaagactatttgtagtgggggcaagagatttaagggaggatgatatcaaaaatgctttcaataagtttggtgatgttaaggatgtgtgggctgtaaaagacaggaattctggcgactatagaggtatattctacgtaaaatattataaaacttcacatgcagctctggctctcgaagagatgagaggtaccaacttaggtggaagacccctaaaagtaatgattgcgcataatcgtgaagcaggtcagggccaggacttcaaaccagacatcgaggaagaggatcttaaaagattgtttattgtggtgtcaaaaactgcggacgacaacgaactccatactcacttcaaacaatttggtccactggcgtttgcctctatcgttcaggatagagaaactaaacaaaacaaaccattcgcttatgttaaatttcataagttttcagatgcagctcaggcaatagagaaatgtgataagaaatacaaagccgtttttgcgaaaccacgtaaatctagagctgagctggagagtgctaggcctgatccatatcgaaatattgcgaggcctgattttccgtcttggccaaggaacgatagagctcctcctcctccgttggatgtcaaagaggatggatattttgccttaggtgtaattgccagctactcagtgaaccaaagccaactttggaaattgtttgatattgttcctagcatggactattgccaggtacagtacgacgaaaacaggggccaatcaaataaatatgaagtggtgtataaaaacgaatattgggcggaatatgccctagaaaaattccacggttttgagtatccaccaggagaacggttgattgttaaagctatcaaatcaactgaaggtggttttagcaatggcaatagacaaaaacggtcagcatcctcggattttggcaactcatatgaaattatgagacttgcagaaacgattgctcaggctaattcgttgattcaagagaagactggaatgtcagcagacagcggaagattaggtttattgccagacccatacgaaagtggttcgatgtgcagtaaacca

SEQ ID NO: 3380 - DNA, 961 bp, Diabrotica virgifera
tgaaagcgacaataatattacaagtgctttatttttctacaatacccagagtcccagagtaaagtacttttctgattttctagcagctgttaatttttagtaataacatgtctttaaatacactagtaaagttaagcaaagtcggtgccgaaattgcagtaaaaaatgcaaataaaaatattccaataagatgcagttccaagtttgcaccattcaactggcaagacccattgaatcttgaatcgcaactaaccgatgaagaaaaattggtaagggatcaatttaggtcctattgccaggaaaaacttatgcccagagttatagaagcaaacaggaaagaagtttttcatcgggaaattatgaatgaaataggcgaattaggtgttttgggatgtacaataaaagaatatggatgtgcaggagtatccaacgttgcttatggtctgttaacacgtgaagttgagagagttgatagctcttatagatcagcggttagtgttcaatcatctttagcaatgggtgctatatattattatggaagtacagaacaaaaacagcaataccttccaaaattggccaaaggggaatatattggctgttttggattaactgagccaaatcatggaagcgatataggacaaatggagactagagccaaatacgactcatcttcaaaaacctatattttaaatggtagtaaaacctggatcacaaattctccaatatcagatatttttatcgtttgggcaagatgtgatgattcaaaaataagaggattcataatcaataaaaaagaacatggtaaaggtttagaggctcctaaaattgaaggaaaattttctttaagagcttcaactacaggtatgatactattagataaatgtaaaagtgcccgaagatcatttattaccaaatgccgttgggtatgagtggacctttttggatgtctgaataacgcgcg

SEQ ID NO: 3381 - DNA, 1145 bp, Diabrotica virgifera
ctttggttatgtttacataacacgtgaaggggtaaaaactaaaattctttcaaaaataaagaacatgtctgaagatacagacgtgaaaacagttcaattccatgagatggaattggacgaccgtcttcttaaagctatagcaaaactgggatggctacaaccaaccgtaattcaagaaaaagtaattcccttgttgttagaaggaaaagatgttttagtaagggccaggactggatcaggtaaaactgccgcttttcttttaccagtaatacaaaagctattgaacattaaacagacagctgctcaacaagaaactaaagcattgatcttagcccccagtcgagaattgtgccatcaaatatgtggtgtaataaaagatctaactacaaaatgttctagagaagtgagatatattgatatttcgttaccagtcgatttgagtatacagaaaccgttgttagttgaaaaaccagatatagttgtcggaacaccaggaaggacgttgcagcatataaaggcagataatttaaatcttaaaaagtcactagagttagtcgtaatagatgaagcagacttggtattttcttttggttatgaagaagaaatgaaggaactcattacccattttccaaaaatctatcaggccattttggcatctgctactttgagtgatgatgttaaaagtttgaagaattccattctccacaatccggtttccattaagcttgaggaaccagaattagccccttctagtcaattaacccattaccatttaaatgctgaagaaatggataaagctacaatactttacacactgttaaaactgcatttgataagaggaaagactatcatttttgttaattcagtggataaatgttacaaaattaaattgtttttggagcagtttggcattagaacttgtgttttgaattctgagttgcctgctacaataagatgccattcagttaatcaatacaaccaaggaatctatgacataatcatagcatctgatgaacatgctttggaagaaccaactatagtatcgaaaaaagaaggtggaaaagaaactaaaagaagaaaagacaaagagagtgtgtttccagaggaatagactttcagcatgtagccaatattattaattttga

SEQ ID NO: 3382 - DNA, 1327 bp, Diabrotica virgifera
  misc_feature (1306)..(1306): n is a, c, g, or t
tttcgtccgttgaaattctttaacattgtttggccgccattttaaacatacaagagttgtcgcccattttttcatattttattatctatgctacataaatgtaactttttaatcagctttaacacggttaagtctcagcgtacctccgtatcttagcttgaaaaataagagtaaggtagaattaaatcaaccatgtgtggtaagtaaggatcaatactaacataagacttgcagatgataccgcaatcatagcagagagtatagacgatttacaaattctcctagatatcattaacagaggaaacaaaaagatagaactaacactgaatataaataaaaccaaattcatggtgatctcaaaaaaccccgttgacaacatacacctgacatttgagggtaaacctatagagagggtcgacaaatataaataccacggagcaattataaactcacaattagatatcaagatgaggagatcaagatcagaatagaaataactcggaaaggatttataaaatacaaatcaatgtttacaaataagaaattgagtatggacatcagattgaggactgtcgaatgttatgtttggtcgcaactactatatggggtaaaagcttggactctaaaagcccaattaataaaaaaaatggaggcatttcaaatgtggctccataggcgtattctgaaaattccttggactgcaaaagtctcaaacaaagaaatgttaagacgaattgggcatggcagaaagccaggccccgcccaagggaatttggcgccctgagcaagatcggcgacttccgcccccccccttggtagacccaaaaactcaaaaattttcaccatggctcttaatttgatgaaatctatcacttaatgcattaacgattgtgtctataattttgtaaatagaagtcaatttaatatcatttttcacttttctctgtcttgctattactgtgcctccgattttcggattctcgatttctaactttgatgatagctcttttgcgtctgtcaaatagccctggaatcttaaatcacttctgagagatctaaaatggatttccgttttttctaataaacttacagcttgatacactcccatatcaatactctgcagtgatttgctgactacgttgatgtgaagtaaaatgtcatgttatattaccacagagcaaagaatagtaacatcacgaatttgattttccaaacagcttgcctcatgagcaccatgtttatcgttgttattattgatagtcatttctgcaagaattgtacatttctttcatttggtatcttatgngagtaatgatataattctact

SEQ ID NO: 3383 - DNA, 1325 bp, Diabrotica virgifera
gggcgagttggttttagccgcagctgaaatgtcacgttgccgttgccatttatttatttccgtggttggaccccatggtcgttggaacagacatatgtataggaatataggaagatataataactatatctttatattataaaagttacatagattagtataatatttcatcaccttgaataaaaatctttctatttataatgccgacaattggagttaatagggatttattatttaaatccttagggaaaacttacactgatgatgaattccaggtcctttgttttgaattcggtttggaactagatgaagtgacaacagaaaagcagatgataacaaaagaacaaggagaagatcgacaggttacagttaatgcttctgaagatgtaatatataggatcgatatcccggctaatcgttatgatctactttgtttagaaggattggttcaaggaattctagtatttcaaggaaaagtttctcctcctaaattccgtgctactaaaccagcagagggatcattagaaaaactaataataaagcccgatactgcaaaaatacgaccctatgccgtgtcagctatacttagaaacattacatttgataaagacagatataacagtttcatagaattgcaagataagttgcatcataacatttgccgaaaacgttcattggttgctattggtacacatgattacgatactattaaggggccttttatttatgatgctaagccaccaaaagatattcggtttgtacctcttaatcaagaaaaagaattctctgctgaagaattaatgacattgtattcgacccatgctcaattaaaacagtacctaccaataataaaggatagtccagtataccctgtaattacagacagtaacggtggtgttttgtctctaccaccaattattaacggaaatcttcaaaaattactttggacacaaaaaacgtttttttatttggggtggacagcccctgatttgacaaagggaaaaggggttcttgataccataaatttgtatggttaagccagaattgttctgattcacccaaattggggattggaagttttaaaccccggcgggaacttcaccatggtatccaaaattaaaaaaacggggggggaaaagggttcgggccaaaaaaatcccaaaaaaaaaaaactgggaaaaaaagggaaatctcccgggaaaaaaattggtttcatttttttgggtaaaaaaagggggtcccccccaacggggggggtttaaaaaaaaaaaaaacctcaaaaaaatttttggggaaaaaaaaggttttccccccccccccccccc

SEQ ID NO: 3384 - DNA, 2346 bp, Diabrotica virgifera
  misc_feature (2307)..(2307): n is a, c, g, or t
  misc_feature (2312)..(2312): n is a, c, g, or t
cggcaatccggttacgaattgcatctgttagtaagtaggttatatttttgaaaaatgactcaaaataatgaagatacaataaaagccctaatgagtttgggcttaagtgaacaaaaggcaaaggagactttaaaaaataccacagttacctcaactcttctcaaaattcttcatgaagtacgaggagtaaacatatccgatggggttgggacattgctgtaccagctgggcacaaaaattaagccgcagatttcccatcatttacctattcttgttaaatatatcgcttcaaacaaacttgatactactttgagagtggacaaagccattgagtttgctctttctcatataaaagaattaaatacgaatgagttggagaccttctgtggtgtcggtgttgtaataacgccagaacaaatcgaaaaagtagttgagaagtacataaaagacaacaaaaaggatcttctggagaagagatacagattcaataccgggccactgatgcagaaagttagagctgacttggtgtgggcagatggaaaggcagtaaaaagtgaggtggatcttcaggtttttgatctgcttggacccaagactgaagcagacttagcacctgctcccaaaccggataaaaaagccagtaaagttaccaaaaatgaagtcaagcaaactaaagatgtgcagaaagttgaacaagaactggatcagggtttaacaatattagatgttatgaaaaaagtcaactttcatgcacccggagaaaactacaaaacggatggatacgttgtaacagaaaatactgaaagattattgaaagaacatctgaaaattactggtggtcaggtaagaacaagattccctccagaacccaatggtatcttgcacattggtcatgccaaagctattaacatcaatttcggatatgctgctgccaacaatggcatatgtttccttagatatgatgatactaatcctgaaaaagaagaagaaaaatttttcacgggcattaaagatatggttacttggttgggatataccccatataagataacacactcctcggactatttcgaccaattgtatacatgggcgattgagttaatcaagaaaggacttgcatacgtttgtcaccaaacagctgatgagatgaaagggttcaatcctcaaccttcgccatggagggataggccagtcgaagagaatttacagctctttgaggatatgaaaaatggaaaaatcgacgaaggcgcagcaacattgagaatgaaaattactttggaagagggaaaattggatccagtggcctatagggtaagattcactccccatcatagaactggagacaaatggtgtatctacccaacttacgattacacccattgtttatgtgatagtatagaacatatcacgcattcactttgtaccaaggagtttcaatccaggcgttcaagttactactggttatcgcaatgccctaaatatttattgccctgtacagtgggaatacggccggctcaatggttaactataccgtcgtatcaaaaagaaaaatagccaaacttattgatgaacaagtagttaaagattgggacgacccaagactgttcacactcactgccttaagaagacgcggatttccttcagaagccgttaacaatttctgtgctcaattcgggagttacagggtctcaaagcactgtagatccgtccatgttggaggccttcgttagagattacttaaataatacagcgccgaggaggatggttgttttagaaccattgaaaattacaatagaaaacttcccgcatagtaagcccatagcctgtgtcagttccaaacttcccatccaagccagaactcgggtaatcacgatgttattctgaatagaactatatacattgagaaaagcgacttcatgggaggttggagacaaaggctaccgtcgactaacaaaaacgcagtccgttggtatccgacatggctgggtttagttttggaagtaactggatgttaaaaaagacggcaagggcatcaaggaagttatatggcaagtggtacggaagtagatcaagttaaatcgaaaccaaaggcttttaatccattggggtcagtgatcctcaagaaatagaagttcgtctaatattctcccttattcaaacataaaaatcccgaagatccaaatgaagtccctgggaggatttttaacagactgcaattcagattcgttaaaggttttaaaaagcctggcagatagatctctttcaactggcaaagtagtggataatttcaatttgagagaattgggntcttnctcgtagatccagattctaccaaacacaatcttg

SEQ ID NO: 3385 - DNA, 947 bp, Diabrotica virgifera
cggacgcgtgggcccatgaagctgtcaagaagcaccaagaagttgttatactgtccatgaaaatggaaaaggatgtatctgttcgccagcaagcagtagacttactctacgctatgtgcgataagagcaatgcggaagaaattgtacaagagatgctaaattaccttgagactgctgattattctattcgcgaggaaatggtattgaaagttgctatccttgcagaaaaatatgctactgattatacttggtacgtagatgtaattttaaatttaatacgtattgctggtgattacgtatccgaagaggtttggtatcgagtgattcaaatcgtaataaaccgagatgaggtgcaaggatatgctgcaaaaacagtatttgaagcattgcaagcacccgcatgtcacgaaaatatggtaaaggtcggaggatacattctaggtgaattcggaaatttgattgcaggcgatcaaagatcttccccattagttcaattccagcttctacattccaaataccacctttgctcacccatgactcgggctcttctactctccacttacattaaattcatcaaccctcttccctgaaatccgcacacaagtccaggaggtcttcaaacagcacagcaacttacgctcagctgatgccgagcttccaacaaagagcatcagaataccctccaactgagtattatttggctagctctgattctactagcgactcttttaaaaaaaaattgcctcctattcccgaaagagacccgtcctttccttgccgaacagaaaaaaaagcacctagagcatatgccggaaaatttaacaacagtaaacgcaaatcccggcccacaattaatctcaaagatgccatacattactcaattttggcccggcacaagacctgccctagtgctacgccgaaggctcgcctaaatccaccgaccaacc

SEQ ID NO: 3386 - DNA, 1359 bp, Diabrotica virgifera
tttagtactaaaataaaatagcataaaatgatccatagtttatttattataaatgcacaaggtgacgtttttctggaaaaacattggcgaagtgttataccgaaatcagtatgtgactattatttagaagcccagagatcaaatggaagtgatattaacccagttatagcgacccctcaccactaccttatatctatacaaaggggcggtgtgagttttgtggctgtatgcatggaagagataccacctctgtttgttatcgaattcctgcatagagtagtagatatttttcaagattatttttctgaatgtacagagtctattattaaagagaactatgttgttgtatacgagctattggatgagatgttagataatggatttcctctggccaccgagagtaatatattgaaggagttgatcaaaccaccaaatattttgaggactattgcgaatacaatgacaggaaagacaaatgttagtgatattctacccactggccaactgtcaaacattccttggaggagatcaggagttaaatatactaataatgaggcatattttgatgtgatagaagaagttgatgctattattgataaatctggatctacagtttctgcagaaattcagggttatatcgattgctgtataaaattgagtggtatgccagacttgactctatcctttgtaaatccaagattatttgatgatgttagcttccatccatgtgtcaggttcaagagatgggaggctgaacggttactttctttcattccaccagatggcaattttaggctgatctcctaccacatcagcagtcagagcgtggttgcaattcccgtctatgtgagacacaatctctccattaaaaccggcgaacaagccaggctggatttgactgtgggtcccaaacagactatgggaagaactattgaaagtcaaactcgaagtattgatgcccaaatgcatactcaactgtgtactaacagcaaaccaaggcaaatataatttcgatcccgtgtctaagattttacattgggacatcggaaaaattgatgtgacgaaattgccaaatatcagaggatctgtgtccatagccagtggttcaaacactgctgagataacccccttccataaatgtgcattttacgatcagtcaattggcagttagcggtctgaaagtcaacaggctaagacttgtacggagaaaaataccaacccattccaagggtggtaaagtatattaccaagggcaggggcggtttttgtgtgcgcatggggatccttaactcaaacagctttaaatggggaataggttattttaatttattaaaaccgctgaaaaaattttttttattt

SEQ ID NO: 3387 - DNA, 974 bp, Diabrotica virgifera
  misc_feature (941)..(941): n is a, c, g, or t
ggtagtatgtacgtcggatgaatccagacaagtgaaaaaagatggaaaagtggttaataattttgctgtacatcatacacttcgcaacagccggagaaactaaccaaaattcgtccaacatttgcacgcgatgcaaatgcaacagtaaggacgagttccttctggactgcaccaatcaaaactttgagcacatcttggcggaatggcctccccataaccagtcgctggtcgccacttttagttataacaacatcacaaatttaggacaacttccggccacgaatcaaacagccaaatttgttttcgatcattgccgtatcaagcatttggaagatagaatgttctttttgattcaaaacgtcgaatatatagatctgagtcacaatttgttaaccaccgaagcaatctccggagaggtcttcaaaggtccctacagtgatagacaatatcgtcctatcggagtaaaaactttgaatttagcgtacaatcagatccacagtctaaataccaagtttttcgaacatatgcctttactagaagacctctacttacaaggcaacgatttcagcgttttggatccatcgacacaaattgctttaggatctttaacgaatataaaggttctaaacttagcagacaatgaattgacggtaatagaagaaaatgtgatgagaaacgtacacagcttacgagacctggacttatcttccaatcattttgattttgttccgaaaccgttgagttacatcagtaaaaacctgcagatccttaatttaagcaacaactacatattccagctgaccgatgaaagtttcctgggaatgaatttatccgaattgtacttaaataacttgccacgactaaaatttgtcggaccaaacacattcgcaactttaagacgactgaaaaaaactacatttgcgtgacaatcaacaattggnaaattatcgacaggggaagctttcggggaaact

SEQ ID NO: 3388 - DNA, 1652 bp, Diabrotica virgifera
aaacaaaccccccaccttgcgtttgtagttctctttagcaacttcatcatagcaattggtccggtcaatagttcatagatttgatcaagtgatagtgatatcagtttatcatatggaataaaagcccggcattttcacactcctgcacagtattagtgaatctttggtattcgtaataaccagtgtaaacgtgttgtgagtttggatagttgattgttaatttaatattcatccaccatgtctcagctaataaaagaacaagatgcaggatttctttttagatcgcctctagaagaaaaagctgttattcccgataaaatccccaagtgtccatggacgaaggatctttataaaacggaaaaatctccacacagcaaatgggattggaagccctatccatccaaagtacttccaaatatagccaaagctgtaggaaaaacacctatggtaaaattaaatggtattccaaaagctgagaatttagagtgcgaaatctatggaaaatgcgaatttctaaacccagttggatcaataaaagaccgtatgctgattcgatgcattgaagacggcgaaagaagtggaatcctgaaacctggtgcaacaattattgaagtttcttctggtaacacaggcgtcgcattagcttgggcatcatcaattaaaggttacaaatgcatcgtggtattaccggacaagtattcaatggagaaggaatttctcattaaagcgtttggtggacaagtcgtaagagtaccaatgggagcaccatatacaagtgaaaatggaatgtatggaaaagctcatgctcttcataaacaaataccaaattccattctactagatcaattttccaatccgtctaatccattagcacattatgacaccaccgccgaggaaatataccaccagtgtgatggacaagttgatatgattgtaatgggatgtggcacaggaggaactctgactggtataagcagaaagtttaaagaaatttctcccaatacaataattataggtgctgatccttatgggtcacaatacgctcaaccagctgaactcaataaaactgatgtgaaggcttttgatatcgaaggtataggatatgaaattgctcctacagtatgtgatagatcgatggtcagtaaatggtacaaattccatgacaaagagtctctgaacatgtgtagaagattaataagagaagaaggattattagttggaacaagcagtggcgtaataatggcaggtgctttaaaagcaattaaagattttaacatgggaaagggcaagaaagtggtagttctacttccagacggcgccaaaaattatctgaccaaattctgctgtgatcaatggatggaacaaagaaatttattacctgctgttaacactcataatcattggtggtgggacgtaaacgttatggagctgtcatttaaaccatgtcaaactgtggaaaaatcagcatcgcccaaggatgttttagctcttatggataaacttaatgtagattatttacctgctgtaagcgaaggactgattgttggattggctacaagaagaaatactctgaatcgtatgatagcggatgagtcaccaaatgatgaaaatcataactgcttggtacggatgttttctaaactacccaaagc

SEQ ID NO: 3389 - DNA, 1148 bp, Diabrotica virgifera
ggaggaggccattcaaaaggtccacaaggattcagtcagcaatggcaatatcaatcaacaattgatccagaagaattgtttaggaaaattttcggagatgcttttactcgaggctcttctcattttgaagattttgcagaatcaaactatggatttggcgaagctcaagagattctcctaagaataactttcacacaagcagctagaggaaccaccaaggatgtaaacataaatgtagtagacaactgtccaaaatgtagaggagcaagatgcgaaccaggtacccaagctacaaaatgccaattttgtaacggtactggaatggaaagtatcaccactggccccttcgtcatgagatccacttgtagatattgccaaggttcccgaatgtatattaaacataaatgtactgaatgtgaaggaaaaggttccactgtacaaagaagaaaagttagcattccagtgccagcaggtatcgaagacggccaaacagtccgaatgtccgtaggaaataaggaactatttgttacgtttagggtagataaatcagactatttcaagagagatggtccagatgttcatactgaggcagatatttccgtagcacaggctcttttaggcggtacaattaggatccaaggattatatgaagatcacacaattcaggtaatgccaggaacatcctcccatactagaattcgtctaagtggaaaaggaatgaagaaaattaatggttatggacatggggatcattatgtagtattaaaaattaaaactccgaaacatttaactgaaaagcagaaagcattggcgatggcatatgctgaattagaacaagatacaccgggccaaatcttaggaattactgttaagaaagatggagcgcaatatgcgggatcccgaggaacaatcacaagcgaaacattctgaagaagcgccaggttttcttaaaaaaatcaaaaaagaaatttttgggtagactaagttttgaagtgatagtttaaaacatttttatttgaccaacagtgatatattaaatgaattctatagaataaaagattatataattacttaatgaaggggtacctgggttttcaaaattatcgggaaacaaaacctttcacaaccaacgaaaaaccacttttttt

SEQ ID NO: 3390 - DNA, 1334 bp, Diabrotica virgifera
caattaatgcttgtttccacctacgtataattaagaagtgaatttcgcaatgagttgttaacttacatatattttctttgctataaatcttaagaaatttacagcacaaggtatccttcattatgtcgtttctttttttaaaaatgggtagtgcaagaactctttttggaattttaggctcaaaacagatattactatgttcaaattcccagtttactactaaaatttcaagaacatttcttcatcaatgctttagatgtcataaatctctactgctaaatacctggtcagctaataatttaactcaaaattctttactccataaaagaacgtttcataagtcacacagtttcaatgccgcaagacgggattattatgaattattaggagtaggtaaaaatgcttcaaactctgatattaagaaagcttattacaaattggccaaaaagtatcatccagatgtaaataagaatgatccagaagcatctaaaaagtttcaagaagtttctgaagcctatgaaattcttggagatgaaaataaaagaaagcaatatgacacttggggtgcaacagctgatcaaatgggaggcatgggtggtggaggaggccattcaaaaggtccacaaggattcagtcagcaatggcaatatcaatcaacaattgatccagaagaattgtttaggaaaattttcggagatgcttttactcgaggctcttctcattttgaagattttgcagaatcaaactatggatttggcgaagctcaagagattctcctaagaataactttcacacaagcagctagaggaaccaccaaggatgtaaacataaatgtagtagacaactgtccaaaatgtagaggagcaagatgcgaaccaggtacccaagctacaaaatgccaattttgtaacggtactggaatggaaagtatcactactggccccttcgtcatgagatccacttgtagatattgccaaggttcccgaatgtatattaaacataaatgtactgaatgtgaaggaaaaggttccactgtacaaagaagaaaagttagcattccagtgccagcaggtatcgaaaaacgccaaacagtcccaatgcccggaggaaataaggaactatttgggtggcgttcttcaagattctccagggcaagccaaaaaactcatgagatctgtatcgacacggccaacgccctccctaaaaccagggttcttttaagggggtccaaattaaggaatccaaaggatttaaaagaaaaaaataccaccaaatttccaggaaaagccccaaaaaaaattccctccccccaaactaaaaaaattttcccttat

SEQ ID NO: 3391 - DNA, 1827 bp, Diabrotica virgifera
cggacgcgtgggtatctgacgacacagtgatcataaacttgtgctgaaagacgggcataaagtgtcatcttaacttttacccagtataatcagtgtttgttttgaaaagtccattaccatggccgttcctgaaggtgctgcagtcttgaggacctataaatacagatctccattaagtaccagatatgccagcgacgaaatgcaatacaatttcagtgatcacaataaattttccatgtggagaaaactatgggtgaacctagcaaaagcagaacaagaacaaggtttacaaattacagatgaacagatcagagaaatgcaaaataatgtaactgatatcgattttgaagaagcggaagcagaagaaaaattaaccagacatgatgtgatggcccatgttcacgtattcgcaaagcagtgcccactagcagctccgattatccacttaggagctacatcttgtttcgttggagataatacagatttaatagttatcagagatggtctaaatatcctgattccaaagctagccaatgtaataaacaatcttgcccgttttgccaatatgtacaaagatttgcctacgttaggttatacacatctccaacctgcccagttaactaccgttggtaaaagagctacactttggctttatgattttcttatggatgaagtagccatggatagagcaataaatgatctacgttttagaggtgttaaaggcactacaggtacgcaagcttcttttatgcaattatttaaaaacgatagtgaaagagttagagccctagatagaagagttgctgaattatgtggatttgaaagaacataccctgttactgggcaaacttattcaagaaaagttgatgtagagctggtatctatgttggcatcacttggtacttccattcacaagatgtgtagtgatcttcgattgttggccaattttaaggaaattgaagaaccatttgaatctagccaaattggaagttcagctatgccttacaaaagaaatcctatgagatccgagaggtgttgtgcattggctagacatttaataaccttgttttccaatgctgctaatacccatgctggtcagtggttagaaagaactttagatgattctgctaacaaaagattaaccctttccgaagcattcttgacagcagatgcagctttaatggttttgatgaatattacccaaggacttgtcgtttaccctaaagtgatacaaaaaagaataaaccaagaacttccatttatgtcagctaaaaacataattatgacaataaaaagaaaggtggatatagacagatatgccatgaaaaaaatcagagtcctttcacatgaaagctggagcacaagttcagcagtttggaaaagacaatgattttcttgacagggtaagagcagatccatattttaaaccaatagtacctgaactacaatctctttctggaccctttccccctatattgggaagagctttcttgaacaaggtcactggaattttttaaaatggacaaagtttaatcctaatttttggtaaaaaaattttaaaaaatattttaaccaaagctactccctggttaattctaaatcctttaaaaaatgaattttttaaattggtttttcttctggtggaaaaggaatctttccaaaaaatttttttgatattttttttaaaaaaaaaaaacaattttttaaggaggttttgttttttttttgttcccaaaaaaaaaggggttcccgtttggtttttttttttttttttgaagagggggagttttgaaaaaggggtttttttttaatatttttttttgtttt

SEQ ID NO: 3392 - DNA, 1735 bp, Diabrotica virgifera
cttcgtgcgatgtgatgagtgtttagggctgttttttaagtgaacctgtgataataatatgtactaaaagtaacaaatttctcaaagaaataggatagtgatagttatattcatcatgaatcttgaattcctccagactttcttgctgttaagtgtagtttccatcgccgtagtttcggctggaagagacttctatcaaatcttaggtgtagacaagtcagctagtttacatgacattaaaaaagcttataggaaattagccaaagaattacatcccgataaaaaccaagacgatcccaattcttcgcagaaattccaagatttaggggcagcttacgaagtcctatcggacgaggacaaaaggaagaagtatgatagatgtggtgaagattgcttacagaaggatggtatgatggatggaggtatggatccttttgcaagcttctttggagactttggcttccattttggaggcggcgaacaaaaacatgaaactcccagaggagctgacttagttatggatgtatacgtaactctagaagatctctacactggtactttcattgaaatcaccaggaacaaaccagttttaaaaccctcgaggggtacacggaagtgtaattgcagacaagaaatgatcaccaaaagtttaggtccaggacgattccaaatgatgcagcaaactgtatgtgatgagtgtccaaatgttaagttagtcaatgaggagagattattagagatggaagttgagcaaggtatgatagatggacaggaaactaagtttatagcggaaggagagccacatttggatggggaacctggggatttaattttgaagattaagacacagcctcacaaagtttttgaaagaaggggagatgacttgtatacaaatataaccattagtttacaggatgctctcactggtttcacgatggaaatacctcatttggatggacacaaagtcagtattgttagagataaaatcacatggccaggtgcacgcattcgtaagaagggcgaaggtatgcccaattatgacaacaataatctacatggtatactttttatcacctttgatgtggaatttcctaaacaagaactgactgaagaggataaagaagccctcaagaagatcctcaaccaaagctcaaacaacaaagtgtacaatggtctccgcggctattaggatacatatccctctacatttttgggacctctgtataaagtatttaaattcggtttccattttacttaatttatttttgattcctatttatttaagtgaagagaattgtgtatatacaaaaggaattttttgaaatataccagtggtatctatggacaaattttatctaaaaacccacgtgtgttaagtcaatatccaatatacatacatggatatgggaagagaccgaatatggtattgaagtaatcaaccgtcaaatcaagataaacttgaaattggtgaatcccatatactggtaaaatgattctggtttagggaatttattgctattagggcttttgaaattaaccgccaaatatttttcagccaccagggcaaagcttaacccttaaataaattaaatttttggtttggaaaaaagggggtccacctaaaggcccgctggtttcttcttacaattttttttgaaacctaaaaaacggaaaataaaaaaatttgggggacctccccccaatttgttttttaccatgggtttttagggggggg

SEQ ID NO: 3393 - DNA, 1204 bp, Diabrotica virgifera
attgcttcaaacgatcaaaactattttttagatttgataccattagtaaattaaacgacagtgattaacaatgaaagttgttattattttcgcttttatctgcaatattgcatttgcagctcatgtttacccggaatacttaaaacaatatcgctgcaaggcatcttcggaaaattatagtgaatgctttctaaataagctcagaaatactctgccctactacgttaaaggcattcctgaattagatatacctccatttgatccgtttacactacctatatacagtcgcaatgtaaacatattgggaaacaagattagtgcgactttcaaaaattcgattgtaactggactaaggaactctattattcataatgctaaggttgatctgaataacaactatgcagaaataagcgttactattccttggttggatatggccacagaatatgatatttctggtgaattctttcaatacccactagatgtgaagggtacttttaaaggaaatataactgacattcaacttttctcaaaatctactctacaaactttcaaaaataacggtgaagattattataaatttgataaaataaaccaaaaagtacaaataggaggaggccatattgaaataacaactacagataaagatcttatgccgatagttcaaacaatacaagaatattttaatgagcatcccagaggcttctttaacttgatattgccattcacattggaatacgcacaagacctactcagagaatttggcaatgaatatttagccaatcttcctgcttctgaatggttaccgcagtaaacataaatttgaaaaaaatagtagacttagtagtttaaacaacatagttttttagttaaaaaaattgaccgtagtatttaaataatataatgacaataatgtttgtgatgatcagtgagatatatctatccgctattctatggaaaattccagaaatgcaatgctttttgaatttttcccataagtggagagaaatttgcctaaaaataataagcctaatgtttcaaaggaatggaacccccaactttcttgttcaccaaaaaaaaaaacaaatttccctttaaaaaacttttttttggaatattttttttcattggtgggggttttttggttaggggggaaaaaaaaaaaaaatatatttttttaaaaaaaaaaaaaaaaaaggggggg

SEQ ID NO: 3394 - DNA, 1311 bp, Diabrotica virgifera
ccgttcacgctctccgaggtgaaagcacatttaaaattattcctttatcaaataaatataatttaagcattgcccgaattaataatttttggaaatcggaatcacagtataattaaaagtgtattataagtaaaaatggtaaaagaaacaaccacatctataaagaaaaaacgcaaagtttccaacccagaacatgaaggcgataatgatatatataagaaagtggcaaattttgaagaaaaagaatcattaaatagtcaagcatctttagaagcaaatgtttattttgagctttgtgaagatatcagaaatcttcttgccaaagcaatgagtttaagacagaaagataagaaatctaatgaaataaaagatattcacgcagaaatagttgtcaaaatgtgtatggtgaaaaaactgaacagaactgacaagattaggcatgtgcatggaaaggaaaccctaactacagaaaaacagaaatgtgacagcatcaagctgacgtatcagaacttggtgtatgaacgtcaccatttggtgacagaaactaacaagtgtttagcttttagatctaaagatgaagacatagaacttgtaccgtttgaagaatttatgagagaagcaccagaatcattgtcctcgaaattttcttcatatgatccggatgacagagaacaacagcacagtttacgtctcgctagattggaatgggaattaacccaacgtaagaatttggcacaattgtgtaaagcttttttggaacagaagaagaaactgagcgaagatctgttattaagaaaagacaagctaaccgccctcacaccgctacttgtcaatgtaatcaacgccaccaagccgcttcaagatcatttggaaatgtctccgagcggcctgagggttgaacataaactagcttatcttctaccagaccccttatacatattctatgtcaacgtcgtctcttataaagtcgtttacgatattaatctcgatgtggaaatcatcggcgacgaagaggaagctaaccgatggaaagatttaaaaattggaatgggattcgctaatgacgatgagtctgacaccccagagactgaacaggatgccgcaaaaaaagagggagtcgttgaaattaaaaaacgacgtcacaggaggtcggggcaacagaaaaatccgatggaaggaaaaaaaaaagctattagaatcccttacaaacaagttcaacttgtaacagtgtaaaaaatggtccttaaaagactaaagggaggggggccctcctttggggcgaactacacaaagttttttccaccaccacac

SEQ ID NO: 3395 - DNA, 1311 bp, Diabrotica virgifera
attttaaagaaatattattacaattagttaagtataatcggtattgaagaaagttaaggtttctgtaaatattaattgacatactttggatataagttgctggttattggagtaatcatgccagctgtccgtggagatggcatgagaggcttggctgtctttatttcagacattagaaactgcaaaagcaaagaagcggaaataaaaaggattaacaaagaactagctaatatccgtagcaaatttaaaggtgataaaaccttagatggctatcaaaagaaaaagtatgtctgtaagttactcttcatatttttattgggtcatgacattgattttggtcatatggaagctgtaaatcttctctcctcgaataaatattccgagaaacaaataggatatttgtttatctcagttctagtcaacacaaatagtgaactcatcaaacttattattcaaagcattaaaaatgatcttgcttcaagaaatcctatccatgttaacctggcattgcaatgtattgctaatatcggtagtaaagaaatggctgaagcattcggaaatgatattcctaagctattagtttctggagatactatggatgttgtgaagcaaagtgctgctctctgcttgttacgtttgttcagaacctctcaagacattatcccaggaggagaatggacttctcgaataattcatttgttgaatgatcagcatatgggtgtagtcactgctgctactagcttaatagatgctcttgtgaagaaaaatccagaggagtacaagggatgtgtatcattggctgtctctagactaagtagaattgttacagcaagttatactgacctacagattatacctactattttgtacctgcaccttggctgtcagtaaagttgcttcggttactacaaaattatacaccctccagctgaagatccaggagttagaggaaggttaaaatgaatgtttggaaacaatattgaaccaaagtcaagagccccccaatccaaaaaaagcccaacaactcaatgggtaaaaaagctgttcttcttttgaggccaaaagtttttttatccccaccgaaaggggggggaatccttcttgtaaaaacgggggaacccactgggccagtttttgaggaaatcgggaaaacaatttgggaaaccttgttctttaataaatggggccatttaacaaccccttgaatttctccatggaagctgttaaaaaaacacacaaaaaattgtattatcttcccctcaaaaaggaaaagagagtttttttgttcccccgccagccagaaaacttatt

SEQ ID NO: 3396 - DNA, 1363 bp, Diabrotica virgifera
  misc_feature (1316)..(1316): n is a, c, g, or t
ggaaattctatattatcgtcttcgtttgcacagggtttgccaactcctctagttgttattactgatctagagagcattgtaccaaagaggaggaatgaccacaaacaacaaattcaaaaattagtaaacaaatggttgcctgacgagaaagttttagtgatggataaatacgtggatggagtcaatgttttacggaaaattggaagtcaaaaaagaaaatcggtattgtatagagaccgaagaccacatatttttagtgagagaattgagtatgttccagatgcggaaggtactctaggaaccttaaaaattagtggttatctaagaggtactgcactatctgtaaatcagctggttcatattcccggattaggagatttccagatgtctcagattgatgctccaaacgatccttttaaacatgaaaagaaaagtagagatacaaacacaatggaatcagaagagcagcaagtgatccgtgtacttgaacggagtgatccattgaaacaagaatctctggatgccgagaatgtgcctgatccaatggatgcagagcagacgtggccaactgaagaagaaatggaggctgcagataaacaacaaaagctaagaaaagtgaagagagttcccaaaggatggtcagactaccaagcagcatggattcctgaagacgatgccgaatttcaggaacacaattcggatgaagacgaatccgaatcagacgatgaatacatggacgccatgtcagaggaaaaatccgacgtttctggagacgaaggagaagataaagactttgcttcggtaaccgagtcggaagtggctgtgaatgacgacaaatatgataaagaaatggatttgtatgccgaaaagcaggagttggacaaactgaaggcagctaaaagtgacagggagtttccggatgaaatcgatacaccttttgaagtgcctgccagagagaggttccagaaatatagaggactagaaagtttcagaacgtcaccttgggatcctaaagaaaatcttccaagcgactatgcaaggatatttcagttccaaaactttgacagaaccaaaaagagagtcctaagcgaacaagatgacaaagatggcgctttgcctggttggtatattacagttcacgtcaaggcagtttcacagcttctttgggagactttccaaaaaactaacgcacctgtgactctgataggtatgtttcctcatgagcataagatgtcagtgctcaatgttgtgctaagaaggacccaaaactacagtttgccgatcaatcgaaaagagaggttggtattccagtgcgnatatagaaagatttgttgtcaatccgattttcagcagtcataccaac

SEQ ID NO: 3397 - DNA, 1130 bp, Diabrotica virgifera
acatgttactgtgggcacaaccgaaagtcttttgcaattactgcagagtattgcagtatattattataaattataacccttttgttttgcggtgtgtaaaatagtgtaagaaaaatggtattggacttagatctctttagaaaggataagggtggtaatcccgaattaataaaggacaatcaaaaaaggcgatttaaagatgttgcattagtagacacagtaatagaaaaagataccacatggagaagtcttagacataaggccgacacctggaataaattaaagaacctttgcagcaaagcaattggtgaaaaaatgaagaaaaaggaagaccaaggaagccctaccgaaagtttaccggaaaatataattgctagttttgaaaacttagacctagaaggcatgaagccccttactgtaaatcagataaaaaagataagaacattaatagatgaagctatacaatcaaacgaagaagcattattacgagtagaaattgaaaggaatagtgcactgaaagaagtaggaaatcatttacatgagtcagttccagtagatgacaatgaagataacaacaaagtcgagagaacatttggagattgtgaaagccgaaagaaatattcacatgttgatttgatagtcatgattgatggtatggatggagaacgaggagcagttgtttctggaggaagaggatattatttaaccggtccagctgtcttcttagaacaagcaataatccaattagctttacgagtattacataaaaaagggtataaaccattatatacaccttttttcatgagaaaagagatcatgcaagaagttgcccagctctctcagtttgatgaagaactgtacaaggtagtaggaaaaggcagcgaaaaatcagaagaaaaagaaattgaagaaaagtatctaatagcacatcggaacaaccaattgctgctttccaccgagacgagcggatagctgaaatatgctaccccccaaatattgatttgggggtatttccacctggtttttggcaaaaaaattgagctcctgggggcccgaaccccaagagattttttaaaagtttctctatttaaaaaggggaaacaaattttttgttttttcccccccttttt

SEQ ID NO: 3398 - DNA, 913 bp, Diabrotica virgifera
atttgatatttcatttacaaaattagaaatttggaaatacaaaatgccagaagtagatattgaatggccatggcaatacaattttccaccgtttttcacgttgcagccacatcctgaaacaagagcaaagcaagtagatgcatggaagtcattaattttaaacttttgcgaacaaaccaaaacttacaccctagatgtaagagacacaaaccagtcacctttatttaataattcatcaataaacagaaaattagaacaaaacgttataatctctatactaagcgaattgcaaaaaagtggccatgcatctcctgtagataaaaacaaaaaccggtgggaaatctattggcatacccaagaggaatgggctagcattgtatatgattctatttgtgaaaggggtatgcaaaatacagtggttacattatttgaactcacacaaggagaggatgtttcagatgcaatcttttttggaatgaatcaagaggtacttattaaagttttgcgggttctagaaaatgaaagaaaatgtgaacttatactagaagatgagatacaaggagcaaaatttttttagctattgatgaagtgcatcggatccaagtgataagtttaaaataattgaatgggtccgctgaaaaacattgtaagcaccacattgtttgtttttgagaagtcaaagaaaaagttttgtaataatggtgagtttatacattttacgggtgactaatatggtttgtaatttgaatttacaaactttattactaactcttaaaatgtttaagtttgccattgttataattttaaaacttctttttcgatttcttaaaaacaagtgatgtggcgcttacaacactatttcgcagacccatcaattatctgtgccactctttgataaatttatactcataat

SEQ ID NO: 3399 - DNA, 1100 bp, Diabrotica virgifera
ctataaaaccgcatcagtttttgaacaatctaagtaggttataaatactggtaacatgaaatttacttcattgtatatactagctagtctgctggtgttctcatcagcagtagttagatatgacaactacacattatacaaaatatatccaaagtctaccaatgatttagaatttcttcaaaacctacaaaagtccaaagaatataaattggacttctggaatgagccatctactttgagaaaatttgttaatgtgcttgtttctccaaaagacaagtacagctttgaatacattatcggtaaaaataatttaaattttgaagttattactgacaatatacaagacagaatagatgaggaatctagagtacacagtcttcaaactgtaaaaggtgttgaacttacttgggataagtactatgatttggaagcaataaacctttggttgaaaaaacttgccagcgaatatcacgataaagttactctaatcgaaggaggaaagtcatacgaaggtcgagatatactgggtgtgaaagtaagttttggaccacaaaaaggcaaacgaagtgtatggcttgattcacaaattcacgcaagggaatggatatccggtgctacgacaacatacattctaaatgagatattgcgcagtgacgattccagaatccgagatatagctgaaagtcatgattggtatatcttcccagttattaatccagacggatttgaatttactcatactacgaaccgtatgtggagaaaaacacgtactgattatgggcaaggagaagaatgtagaggtgctgatcccaacagaaactgggattacaaatggaatgaaggcggatcaactgacgatccatgcgatgaaatttatgctgggcctaaagcattctccgaagttgaaactagaaccttatctgagtatatgagcacagtggtggacgaactattacttttcataacattccattcgttttccgaattaatccttttaccttatggtacactgaccgaacatttagacaattacaatggtaacctaatcagtagcactaaaggctgctgaagcattggctaagagatacggaactgaatat

SEQ ID NO: 3400 - DNA, 1123 bp, Diabrotica virgifera
caggcagctatgatggtccaccaactatctaagaaggaagcatctagacatgctattatgaacagtcctcaaatggtagctgccttagtgagagctatatcaaactctaatgacttagagactaccaaaggagctgttggtaccctacacaagttatcacaccacagacaaggtttacttgctatttttaaaagcggaggtattccagcacttgtaaagttgctcagttctcctgtagaaagtgttcttgtctatgctataaccacccttcacaaccttttattacatcaagatggatcaaagatggctgttagacttgcaggtggtttgcaaaagatggttgcactactccaaagaaaccatgtcaaatttttgtcaattgtaactgattgcttacaaattttggcttatggtaaccaggagagcaagttgatcattttggcaagtcaaggacctattgaattggtcagaatcatgagatcttacgattatgagaagttgttgtggactacttctagagttctgaaagttctttcagtttgtgccagtaacaaacctgctatagttgaagcaggaggaatgcaagctttggcaatgcacttgggaaatccaagcacaagattggttcaaaattgtctatggacattgcgaaatctatcagatgctgctacaaaagttgatggtctagaaagcttattgcaatctttggtacaagtattagcatcttctgatgtcaatgtagtgacatgtgctgctggtatcctttccaatctgacttgtaacaatcagcgcaataaagtaactgtgtgccaagtgggaggggttgatgcacttgtgcgcactatagtcagtgcaggagatagagaagaaatcacggaaccagctgtttgtgcactgcgtcatttgacatccagacatgtggaatcagaaatggcacagaatgctgttagactcaactacggcatgcagattatagtaaaactgttgaacccaccttcccgttggccattggtgaaagcagtgattggtttgatcaaaaatttggctttatgtcctgccaatcatgcccccattgagagaacatggtgccatacatcatcttgtacagctgttgatgagagct

SEQ ID NO: 3401 - DNA, 1895 bp, Diabrotica virgifera
ggggtggccccggaaaaaaaaatgaagttaaaaaaacgttgttttctcttttttttttttttttttttgtgttttttttttcccatccaaaacaaaatgtgttttttactaccagatcccgggccgccgcccttttttattttttttattttttttttatttttaagtattattatattaatattatcatcttattttttaatttttgatttagtttatgtaattgaatatttattattaatattaaattcaagaaatttcatatttgttattttactagattgaatatctttaatatttataagatttgttttatttatttcttcaatagtaatttattatagtgaagaatatataagaggtgatttatttaaaaatcgatttattttactagttgtaatatttgttttttcaataataatattaattattagtcctaatttaatttcaattttattaggttgagatgggttaggtttagtttcttattgtttagtaatttattatcaaaatattaaaagatttaatgctggtatattaactgctttatctaatcgaattggtgatgtagcattattgatagctattgcttgaatattaaattttggtagttgaaattttattttttatttagatgtaataaaaaatgattttattatacaattaattacttgattagttattttagctgctataactaaaagtgctcaaattcctttttcttcttggttacctgcagcaatagctgctcctacccctgtttcttctttagtacattcttctactttagtaacagcaggtgtttatttattaattcgttttaatttttcatttagagatgagataataataatattattatttatttcttctataacaatatttatgtctggtttaggggctaattttgaatttgatttaaaaaaaattattgctttatctactttaagtcaattaggtttaataataagaattttatctttaggagaatataaattagctttttttcatcttttaattcatgctttatttaaagcattattatttatgtgtgctggtaatattattcataatttaaataattgtcaggatattcgttatataggaggtttaattaaacatttaccattgacttgtacttatttaaatatttgtaatctttctttatgtggttttccttttatgtctggattttattctaaagatttaattgttgaaattttatcttttagttatttaaatatttatatttatataattttttatatttctattggtttgacagttgcttatagatttcgtttaacttattattctttaacgggtagatttaattatctagctttaaatatattatctgaaactggttatttaatacttaagggtataagaggattaattttatttgtagtttttagtggaagattattttcttgattagtattttctactcctatttttatttgtcttccttttttaataaaaattataactttgatttttattatagttggagtttgattaggttatgagttagctaaatttaaaatttcttataatttattaaggttaaataatatttctagagtattattttttagaataatatgaaatataccttttttatctactttaggaattaattattatccaatttattttggtatattttataaaaaattttttgatataggatgatttgaatattatggaagttcaggtgtaataaaacaattaaataatagaatatttttacagttattttctcttaatcatttaaaaatttatttattattattaattttttgattaatttttttactattaaatatttattaaaaaaaaaaaaaaagggcggccgctcgcgatctaaaaaaaaaagggcgaccgctcgc

SEQ ID NO: 3402 - DNA, 1924 bp, Diabrotica virgifera
  misc_feature (1857)..(1857): n is a, c, g, or t
  misc_feature (1868)..(1868): n is a, c, g, or t
  misc_feature (1902)..(1903): n is a, c, g, or t
caactccccagctacaagtgtagcacgtgggaaatttgtcaaaaacatatttgcagttaaatattttttttatattttcaggcagtaaagttaacaacagattttcaaaatgtctaatatgtacaatttcaaaaaaatagctgtagttcctacagcaaaggactttatagatattatattgtccaaaacgcaaaggaagacacctacagtagtccacaaacaatataaaatcagtagaataagggctttttatacgagaaaggttaaattttcccaacaaagctttcatgataggttaacacagattttgacagagtttcccaaactggacgacgtccatccattctacgctgatttgatgaacgttttgtatgacaaagaccattacaaattagctctgggtcaattaaatacggcgagacatttaatagacaatgtagcgaaagattattgtagacttttgaagtatggagattcgctttacaggtgcaaacagcttaagagagccgctttggggcgtatggccaccatcatgaagagacaagcagctaatttgtcttatttggaacaagttagacagcatttggcaagattaccatctattgacccttacacaagaactattattatctgcggtttcccaaatgttggcaagtcctctttcatcaacaaaatcacaagagccgatgtggaagttcaaccttacgcattcacaacaaaatctttatatgtaggacacacagattacaaatatttgcgttggcaagtcatcgacacacccggtatattggatcattctctcgaagaaagaaacgttattgaaatgcaggctgttacagccctggcgcatcttagagcttgtgttttatactttttggatctatctgaacagtgtggacataacttagatgaacaagtaaaactttttgaatcaatcaaaccattattcgccaacaaacctcttcttcttgttgctaataaatgcgatataatcaaattagatgaattgccaaaggaaaaaaggaaagttcttcaggagatcgaagaagataaacaattgactgttatagaaatgtcgacagtagatgacactggtgtgatggaagttaagactgaagcttgcgagaaattgttgagcttccgagttgatcagaagatgaggtccaaaaaggttgatggtgtactaaatcgtttacatgtagccacgcctaagcccagagatgataaggctcgtcccccatgtatccctgaaagcgttttagccaagaaacaattaataggagaaaaacgtaaacgaaaacttgaaagagacatcgaaatagaagagggagatgactatgtactggatcttaagaaacattatgtcgatataccagaagaagaaagacatgatatcataccagaaatttgggaaggccataacatcgctgattacattgatcccgacatttttgaaaaattggcagaattggagaaggacgaggaatacagggaagaaaccggtatgtatctggtacctaagatggaactggatgacaccatgaaagagattaagaagttggctctccaaattagacacaagaaggccatcattaaagatgaggcaaggattaacaaacaaagtaggaaacctgttatgccaaggacggctggagctaaggttagaggaagatcagcttcaagacttcgtgaaaacatggctgaattgggtgttgacctttctgataatgaagatgctcattacatgaatactaagcaaagaagcagatccatgggtccaccagccaagaagatgaggatggaagtgagcgacagtacctctctgaacagatcaagatctttgtctaaacctccaangaacgaaatgngtgtgaaggatgtagctatgaagaagaaattggnncagatcgcccacagagctatt

SEQ ID NO: 3403 - DNA, 955 bp, Diabrotica virgifera
  misc_feature (933)..(934): n is a, c, g, or t
tcttcgtccggttgaatgtactttgtccggcaaacgattttcgtgtttaatgataattattaaataaattgtaatacttgtacaaagaaaatgggtcctcatagtgtattgtcgttaatgtttgcgtcagtagtaatcacattagctcatgaagatgtttactcaatcaaatacaccacagaaaatttttcccaagaagttggaaagaaaaatcattttgtcatgttctacgccccttggtgcgggcattgtcaaaaattttctccaaaatgggaacaattagctgaaatgttgaatgaagatgacacgaataatataaaaatagctaaagttgattgtactacagacagtgaagtatgctccgaacaagatattactggatatcccacacttaaattttacaaagtaggagactcagaaggtgtgaggtttagaggaaccagagatcttccttcaataaccaattttatcaacgagcaactgagagagggagatgaaagccatactgaggaagcagtctctgatgaagccacggccgttgatggcttgaccgagctgacagaagataacttccacaaacatgttaagagtggaaaacattttatcaagttctatgccccttggtgtggacactgtcagaaattagccccagcgtgggagcaactcgctaaaactctagagcttgacaatgaagttaccgtagggaaagtagactgcacgcagcatagatctgtctgtaacgactttgacgtgaaaggataccccactctattatggatagaaaatggcgcaaaggtggacaagtaccaaggagacagaagccacgtcgacctcaagcaatacgttaacaaaatgttaggatccgagaagacagaaggagcaactccaaaagaggctgcatctgacgctgatcttcatcaggagaagtaaccnngcgacactttcagtctaccat

SEQ ID NO: 3404 - DNA, 483 bp, Diabrotica virgifera
ggcacgttaacatgttaaaaaactatatattattaaaatgctcgggcaatcacaacatacccaagcgtcccgcaacaaaatggcaaaaatcaccttcgttcttttggctgtagtagcagttgtggtcttggcaacagctgaggccagccccaaggcagctcatggagtaagtgtctttaaagcagtggctcttggaaaagttggagcatcatgtgattgcgatacctgctcacaagaatgtgaaagcattggctcagattatgttggaggcatttgttaccaagacgactgttattgtgcatacattaattaaatatgttgaaattgcaccagcattttaataatatatagttttttaacatgttaggaaaaaaaaaaaaaaaaaattgtaaaaaaaaaaaaaaaaaaaaaaaaaaaaaaaaaaaacacaaaaaaaaaaaaaaaaaacaaaaaaaaaaaaaaaaaaaaaaaaagggggggccc

SEQ ID NO: 3405 - DNA, 1875 bp, Diabrotica virgifera
ttttatttgaaaatttcaaataattttacgaaaatgttgagccgatcggcaattttagttttgctcttttccgctttcaccttcgccgatgaagcacctagagcagttttgaccccaggccacgtacttccacttgtgaaaaatggaaaatacaattattttatgggtactacctttaaggcaactcaattgcaagccctcaggttttgtaaaaatatcaacatgactttgctggatatcgaatcagaggcagaaaacgaagctgtatacaaattaattaaagaaaaaaatgaaggtgacagttattggtcttcaggaagcagaataatcgacggaaaatcctggttgtggttaagtaccggcaaacaaatcgagcaaacctactgggacaatggccagcccaataccaataacgaatattgtttgagtctgaagatcgataataaccgcaacaaggtattctggcatgatgatgtttgcagttatgaaaaaccttttatatgcaaagcagctgcagatgaaaatgaaaagggacaatcagaagtatggtccaacatttttgaaggtaccaaaggattgatttctgacgagtttgtctacggaaacaaatactactattttgcaaggcaattcaggggtagttttgctcaaggtttccaattctgtgatagcattggtatgctacccgtttctgtactctcacaagacgaaaatgacaggatatacaagcatcttagagatacaaatgctgaggaaaaatggtggtcctcaggagcaagatcaaccgacagtgtccactggttttggttatccaacggacaacttgtcaattatacaaactgggctgtttcagaacctaacaacagactcagtgaacaatgcatagctttggacatgaataaggataagggattgtacttctttgatattggatgccgtgtagaacatccagttgtgtgcgaaaggccagttaaaccaagtaaattgagcaaaagggaaactcaacaacgttggttaaaacgtgcccagtctgtcaagaaccaagaaactcttggaaaatattatgtagaacaagactttgaggctactcatgatgaagctgttgaatattgtaagttcctagatatgcaactttctgagataaattctcaacagaagacagatggagtaaccagggaattactacttgtcgctgacaatggtcctttctatatttctggtaagaggtctaaagctgactgggtcttcgacagtaacaaccaaaaaatggattataccaattggcaatcaggaagaccacaagaggaattgaaaaatggttgcattcaaatgaacgaaaaaggacaatggatagatgtaaattgtgacaaagaatctctttttatttgtgaaagacctggtgctgacaatgatctagctgacgactgtcctcaaccagtaatcaacgtatacatcaacaacaacatgccagccttagaacatcaatcatttattcctatcagagtagatgaccaatcagccggagacgagcattccgttcttgtccagaatagatgggatacttgcagcaattaattaaatgtaaataaaaattaaaaaatctgcttacaaaaaaaaaaaaaaagggcggccctaaaaaataaaatttatattgtaaataaattttttaaatatttttttgtaatgaaatgttattcgttttaaaaaaatctaatttttaacaaaaaaatttaatttttttttacaatatatttaaatttaatatttttttttttttaatttaaaatttttagggtttagctaaaaaaaaaaatttttttaaatttaatttttaaaaaaaaattaggattaaaaaattttctattttttaaaaaa

SEQ ID NO: 3406 - DNA, 934 bp, Diabrotica virgifera
  misc_feature (750)..(750): n is a, c, g, or t
cagtaacagtgatttatttaaaatgtctacaatcgaaatagagttactcaatctttcaaaaagtgatctagtttccataataataaacaaaaaagtgtctgacaatatcaaaattagtaacgaacttgcagattttctagcgaataaaagtggatctattgaaatgactacacaaactccttgtgaagacattcgtttccttctactaaactgtgaattgactgtggctaaatgtgaaattaaagctaacaaacgagtgatggcagaaatggaaaaatcgtcaaaacatcaagaccatatcgcaaagttacttacaggtaatatacaaacgttaaaagaagaagcattaaaggctcgtaatgaagctgcatcacggaagacctacagtacaacaaacaacattacagatgcaatgcagtacaacaacatcagcagtggagctagcgaagatgtcaggaaagtagcattattaggagatggtaccgatcaatccggtgctactagtgctcaaccagaagctgcagctgcgaagccaaagaaaggtggatttctttcgaaactaacttcaaaattgcccttaggaaaactgccattaccagcaggaggcttacctgctggccttccaactggaggtctccctgccggaggtgttcctgctggaggtctccctgcaggaggtcttcctgcaggaggtcttcctgcaggaggtcttcctgcaggaggtcttcctgctggaagccttcccactgngggcttacctgctggactgcctgctgaaaacttaccttccgaaagtttacctactcctccagctactgttccaaaggtgtagatggctcgtgtgaagtaaaaactgtgttttcgaagtttagtgtaaactcaagcgatgcaaaaaagtttttgggtaattttatcctattttatgtgtctataa

SEQ ID NO: 3407 - DNA, 898 bp, Diabrotica virgifera
ggtggttggacgttacgttaggggttaaacggtttatttttgtttatctttattttttgttaggcttatcatatttaagttatataaacaaattaaattaacccttaataaacagataaaagatttgtcggagctatattcaatttaaatatataattcttgttgtaaaaaaggtttaattttttacacaaaatgtcagcagatgaaccttcatatgaaccactcaatagaataggaagaggtgcttatgggacagtgtacaaagctagagacagaaaaacgggaaaccttgtagccctgaaacgagtatgtgtacatttaacagaagatggtatatcattaaacactttaagagaaatatccttgttacgacaagtaaactcctttgatcatccaaacattgttcgtcttttggatgtgtgtcatggacaacaaatggaaaaagaactcataatgtatttggtatttgaacatgtggaacaagacttggcaacatacatagacagacatccaaatggattcagtacaatacatatcagaaatttatgtaaagaaattctaaggggcgtggattttttgcacagcattcgagtcatccatagagatctgaagcctcaaaacttgctggtcacccatgatggacacatcaaattggcagactttggtttggccaagatctacgattgtgaaatgcagctgacatcagtagtggttacgctatggtacagagcgcctgaagttttactggggctggcttatgctacaccagtagacgtttggtccattggctgtattatcgtggaactgtataatttgaaaacacttttctgtggtacttccgatggcgatcaactcagtaaaatattttagagtgataagtaaaaccatccgaggatga

SEQ ID NO: 3408 - DNA, 893 bp, Diabrotica virgifera
cgtggcgtttttctatttacagtatgtgaatgtgtcaaagtaactgtgtttttcaaaaattaacaaaagaaattcaaaatgtacaagtggacaaaaaatattaaacaaatgtatatagtgtatctatttctaatcgaatcaacaaaatatgatcttactgaacagaatatgatgcaagctaatattaaatgcaactcgtatgttttattatatcctaaaccaaagacttattcatcttgaaggtgactgtgtgccgtcatctcttttattgagacaattaggacgtttttcgttctcagcggcttctcggaaatccctggcttacagaaacggatggtgactatagtcacggaactgtcaaaattaattttgtatcttatatgaagcctcaaacgttttggaaatatttcttctctttatcaggaactggaaagaagtatatgccctcagtttgttatctttctctagatgatgggaggaaaaatttttaaaatacctgtttgtcagagttttattactattaagaagaattcttcatcttaaaggtaaccgggtgtcgtcatcacttttattgacacaattaggacgttttttgatctcaatggcttttggtgtggacaatagttatagaactttcaaaaccaattttgtgtcctgtctagatcatcaaacggttttgagaagatttcttcccttcatatggagctggaaagaagtatttgacacctgttagttatctttctctagatgatggaaagaaaatctttttgaaagctatacagaagtcttaaaatacctgtttgtcagagttttatccacctgttagttatatttctgtagatgatgggaagaaaatatttttggaagctatacagattcttaaaatacctctt

SEQ ID NO: 3409 - DNA, 1010 bp, Diabrotica virgifera
gttaaacacaaattttaaaatgtcggtatccacgaactatctgaaattagccctgatagtgagtttaattctctctatatgtggaaattatttagataatgatcagcaaaaccgtagtgttcaagaagaaataaaggagtcatcaccaatatttaaaagatcagcatattatggtaaggcagatggtacaccctttaagaattgtaaggagatattagaatctggtgtaaatatttctggcatttacgaaatacaaccaattggttccaataaattaataaatgtaacatgtgatatggaaacaagaggtggtggatggactgtaatacagagaagaattgacgggtctgttgagttctacagaggttggagagagtataaatttgggttcggagatctaaatggagaactatggctaggattggagagtatttaccatttgacagcatttgaagctaatgagctgcttgtggagttagtagataaggatggaattagtgcttacgctttgtatgactcttttgcaatcggctcagaagtcgagggatactatttaagtactttaaagggatattctggtgatgccggtgattcgttatctaatcatttaggacaaaaatttactactctagatctggatcaagaccaaaagcctgatggaaactgcgcagaaatattcataggggcgtggtggtacaacaactgttacgagagccatttaaatggtaaattcagaaacatacgttggccagcggcgtataagtataaaggaattgtctggtttggttttaaaaacaacgaatatttcttatctcaagcaagaatgttaataagaccgaaatattagaaaaaagaaagattttaataaatattattttgttcaaattttgttgggtatgtctccacagctggtttaccaatattatttttgttgaaaatttttccaaaaaaatatattacttgaaggatttcctcttaaaatacgttccaacctgttttacacacaaatt

SEQ ID NO: 3410 - DNA, 1201 bp, Diabrotica virgifera
cgctgctcatgactataaaaacaagtttttggattttgtgagagaagaaaatttaacggcagatcaaatatattataacgccgatgagactggcctgttttacagaatgttgccaagcaaaactttgacctcaaaaactgaagaaactgcaaaaggatacaaaaaagcaaagactgattgacaataatggcctgcagcaatgctttggggaagcatttcctctagtcttaataggaaaagcaaaaaatccgtgagcactgaaaaacgtaaatcgggattatttaccagtctcaaaagaatgcatggatggacagcaccacttttaaaaactggttttttgattgttttgtgccaggtgtaacaaaatatttaaaagactgtgggttgccaattaaagctgtcctaataattgataatgcccccttacatccttcagcagatgtgctggtcagtggagacattaccgtcaagattttgccgcctaatgtaacagcgctattacatgtgtaaggaaatcttaaagggttggtactcaaataacccttaagggtcgtttaaacacagcgataaatcaaacaacttatcaaggtcaatcgagttgttgcaacttatcattgtgtgtaaacggtgcatcgcacaacttatcaaagttggagttgggttgaaggtggtatcgcattgaatcgcagcgtctaaacagcgtttcaacttgtcatcacaactagttgctgtgacttatcgttgtgtttaaacgacgctttatagtccttatttaaataattactacttcatctgctacaacatactttatttacaagtcttcgaagtgtattataaacaataatattaaatcagccaaaccatgtcgcaattctatgtacaataatataattgaattctcatatgttttgtcgtctattttatattcaattgttaatcacaacaacacgtctctaagttcacctgcggtcaatgtcactccaatagtacacatttcataaggttatttaaaattaacttaaaacatattattctatacagagtgtcctacttatattacacatggacgagggggttctcgagaaaatcaagaaggtttacagaagacagatgtccagcacactcatagaagatgaaggaccaccattaactccgcatactcaccaaaaagcgtaacgcggaacagcatgaaacagtcgat

SEQ ID NO: 3411 - DNA, 1112 bp, Diabrotica virgifera
  misc_feature (927)..(927): n is a, c, g, or t
aaaaaaaaaaaaaaaaaaaaaagggcggccgctcgcgatctagaactagggagaaagtctatctggggacaacaacgctgctcatgactataaaaacttttttttggattttgtgagagaagaaaatttaacggcagatcaaatatattataacgccgatgagactggcctgttttacagaatgttgccaagcaaaactttgacctcaaaaactgaagaaaccgcaaaaggatacaaaaaaagcaaagactgattgacaataatggcctgcagcaatgctttggggaagcatttcctctagtcttaataggaaaagcaaaaaatccgcgagcactgaaaaacgtaaatcgggattatttaccagtctcaaaagaaggcatggatggacagcaccacttttaaaaactggttttttgattgttttgtgccaggtgtaacaaaatatttaaaagactgtgggttgccaattaaagctgtcctaataattgataatgcgcccttacatccttcagcagatgtgctggtcagtggagacattaccgtcaagattttgccgcctaatgtaacagcgctattacatgtgtaaggaaatcttaaagggttggtactcaaataacccttatagtccttatttaaataattactacttcatctgctacaacatactttatttacaagtcttcgaagtgtattataaacaataatattaaatcagccaaaccatgtcgcaattctatgtacaataatataattgaattctcatatgttttgtcgtctattttatattcaattgttaatcacaacaacacgtctctaagttcacctgcggtcaatgtcactccaatagtacacatttcataaggttatttaaaattaacttaaaacatattattctatacagagtgtcctacttatattacacatggnacgagggggttctcgagaaaatcaagaaggtttacagaagacagatgtcaagcacaatcatagaagatgaaggacaaccattgacttggcatactcaccaaaaaagcgtaacgcggaaacagcatggaaacagccgatcggtggtctatctatctctttttaccaagcgatcccgcgcatgtgac

SEQ ID NO: 3412 - DNA, 1005 bp, Diabrotica virgifera
cgaccccccccgttccggtaagttataagaataaaaggaaaattaatctttgccagcattttcctagtaatacaggtatacaagtttgattttcgagaacatatccgcccacgcgtccggagttggatgcttgagttgcaattgaccagtgtgaatttcgggacgacgtcgcagtgtttcatgtttggttcatttgttccgctggataccctgcactgagctgagatctctgatttgcggttaaccggtgtaaatttcaatataacgtcgcgatgttttcaaggcaattcatttgttctactgtaatcagtagtttatgcaacactacatactagtttatgcaacactacaaacatcgatttccctattttgccgaacttcattgatcttttctctcgtagtagatccgtacatttttgacaatttttccacaaccaaacaattcaaattttttaacaatacgactaatcgttgattgtgtcggaactggcttatctggatagacacaagtaaatttaagtttaatgtcacgatacgagtggactccaaaataccattttaaactttgtatttttttctttctttgaatacatggttagaaatcggattgcctgcgaatgtgcgatagcgagcggtaaaagggattacagtcgaacaaattaattgattttaaaacatcgcgacgttatattgaagtttacactggttggttgcaggtcggagatctcagttcagtgcagcgtatccagtggagcaggtgaattgaatatgggacgttgcggcgttgtcttgaaatttgcactggttgattgcgggtcaagaatctaacttattgtattgagggtcctatgttccgaaaataaatttccctacctaccctccttatttttttttcgtttattttaatttatttggccaatccagcactactaattctggttctatataatttttttgatggattgaggggggctttataaacacaaaatagcaaccttttactca

SEQ ID NO: 3413 - DNA, 1028 bp, Diabrotica virgifera
  misc_feature (956)..(956): n is a, c, g, or t
  misc_feature (1003)..(1003): n is a, c, g, or t
  misc_feature (1012)..(1012): n is a, c, g, or t
ttcagtgctactcgaactgcgtttcgttcagaaactcaaatgtctcgacagcaaaatagttcatagaaattaagtgttgtgtagcagctacgtatacctccaattcagtgcggtgccaaaaataatattaaagtgcaacaactacaatgaaatacgccgcgctcttatttacttttctaaacctattgcatttgattttctgcgatttcgacctagtaattttacataataacgacattcacggtagatttgaacaaactgaacgaaattcgggaacttgccagccgaaaaacaggaacaccacatgcattggaggttttgccaggactgcccatgtgatacggaaacacagggaagctgcacagaatggaacaggaccggaagttctttatttatacgctggtgatacttttatcggaactgtatggtatactgtacatacatggaacataagttcgactttcatgaatcttcttagacctgatgcacaatgtcttggaaatcatgagttcgacaaaggaacgaaagaacttggacaatatttatcgaagttgacattccctacagttacttgcaacttggacttatcactagaacctaacatcacaccttacgttcaaaaatacataattattgaaaaagctggcagaaagatcggaataattggatatttgacacccgaaaccaagaaaatatccagtccggaacaaacaatatttttagatgaaattgaagaaatcaataaacaggccgaacttttggaccaacagggaattaaaatcattatagcagtaggtcattctggctacctaaaggacaaggaaatcgccgaaaaggtcccgttagtagatgtggtagtgggtgggcatacgaacacctttctttggaatggacccgcaccagatacagatacaattgacgggccatacccaaccgtaataaactcaccttcccgngaagaaagtacctgtagttcaagcttatgcttttatacaaatattangtaaactanatctaaaattcgacga

SEQ ID NO: 3414 - DNA, 1065 bp, Diabrotica virgifera
  misc_feature (908)..(909): n is a, c, g, or t
  misc_feature (955)..(956): n is a, c, g, or t
gtcgttggtaaatcaagtgagtaattaagactgaatagtgcagtgaacaccggcaacatgccgtcaatacataagaagaaagcttttgatattaatgatctagaatcagtagcacgaatctctcatataccaattgtagaatcaggatggagttatgccgaaggagtctatatgaaaattaagagatcaaattcgttgatacactggactttggacactgccgagcaatcggctcagtcagtgtacgaagctgcttcaccggcaatgattctattgaaaggacctttgtcgtctctagatcaaattgtttgtaaaagtctagatattgttgaacaaactgtaccttctatcaatttaccgccagaaatgatttactggaacacgaaacagtacgttcaagaagtcggaacgaagatagctcagcctgttttaaagagagccgattcagtgaagcagattggaaacagtgtattatccagcaaatacactgccatagctgctgatactttggacggcgctttagttgtagctgagaagtacgtcgataaatatttgccggctcaggatgatcaagcttcagaagaagtttctgttcctgttactgaggatggtcctaaaggaaaagcgattagcacaattcatcacgctgacaggttttcaagaaagcttagaagacgcttgactcaaagaacaatcgccgaagtcaaagccctaaaacaccaaagtgccgaagcagtacacgtacttacatatgttctagaactgattgctactgatcctgtcctggcttaccaaaaaaaaaaaaaaagggcattttaaaataataaaatattttttagtaaaagtaaagaaaaattttatttaatgatagttaattagtattgtgagagaatattttatttttatannagaaaaatttattttttgtactttgtgtatcagggattattaattnnataatatatatttattattttcgaattaaaagagctaaaaaataaaaattttattgtaaataaatattttaaataatttttttgtaatgaaatgtttattcgtttttaa

SEQ ID NO: 3415 - DNA, 1520 bp, Diabrotica virgifera
ttcttgtccgcgcgagcggccgctcgcgatctagaactagtcctctaatttttgttaagataaatattcttccaaagctgatacgttttatgaattaatagtgagtgatcgttgtgtggttactaaatacataggatatttttagaggaggtaacatggctcatagaaaacgaagaaatcgaataagaaaatcgtatgcaactaaacgtttggaaaaagaaattttggaacaactgactactacatcacaaaatacaaccaagccggttattgcacaaccatgctatgttacagttggggtacagactgaagatgaattgccgtcaatacataagaagaaagcttttgatattaatgatctagaatcagtagcacgaatctctcatataccaattgtagaatcaggatggagttatgccgaaggagtctatatgaaaattaagagatcaaattcgttgatacactggactttggacactgccgagcaatcggctcagtcagtgtacgaagctgcttcaccggcaatgattctactaaaaggacctttgtcgtctctagatcaaattgtttgcaaaagtctagatattgttgaacaaactgtaccttctatcaatttaccgccagaaatgatttactggaacacgaaacagtacgttcaagaagtcggaacgaagatagctcagcctgttttaaagagagccgattcagtgaagcagattggaaacagtgtattatccagcaaatacactgccatagctgctgatactttggacggcgctttagttgtagctgagaagtacgtcgataaatatttgccggctcaggatgatcaagcttcagaagaagtttctgttcctgttactgaggatggtcctaaaggaaaagcgattagcacaattcatcacgctgacaggttttcaagaaagcttagaagacgcttgactcaaagaacaatcgccgaagtcaaagccctaaaacaccaaagtgccgaagcagtacacgttctcacatatgttctagaactgattgctactgatcctgtcctggcttaccaaaaaggaaaagatttgtgggctagtttgagccaagacgaaccggagaaccaggcaaggccagaaaatctcgagcagttgattgtactcttgaccagggaatctgccagaagagttgttcatctgattaatttctcaagcaccttgattagcacacttccaaagaggatttcatattccatcggtgctgttgtcaacaagttcttagctctgacggattctgctgtcaaggaacaaatcgccgaagacttatctaaacgaggagaaaccaagctgtgctttccgttcctcaaataactgatactccccaagcaactctggtcaactccaagcaaaacgcaaacggcgttgccaccaaaataattaagaacaaatttactgattgatatattatgataacgaattatgtaaaagatataataataatagtattttgggcccttatgtactaaaagtaaacatttttta

SEQ ID NO: 3416 - DNA, 1011 bp, Diabrotica virgifera
ctgggcgatcctgatcctgcgcctgaagttatttgaacattgataagtttatttgaaaatgatagaatatcaacaaatttaaagtatcaagattatgggcgaggaggaaatcacaccaaataatatcaaagaaaatcagagtgagaatatgaatgggaatataaatggtcaagaggaaaatccacctccagaagaaatggatacaaatggggaaaatgatgtaaatgaagatgatctggatgaagacaatgatgacatgtcgcctgaagagtttgctgcacttgatcaccagttagatgccttaaattctgctttagatgacatagaacagaaaaatgataatatacattcgcagttactagaactactccatgctaacagggaaatccggactcaattacagcaagataaagctagcacagataacagagaagacgtaaataaaacaaatgaaccaaaagcatgaaatgtagcattccggtaattatctgacattagatattattcatttgatgcattttgttgtcttttcagtatattctagtgaagaggaaaaccagtattaaaaaaattttcaattattttaactatcagttataaaaataggctatattgttgatttactacattttgtcttacctttatgatgatacatagattagtcatcagctaatatatttttgtttcaattttttttttcaatttttttaatgtttgacattgttggggtggattttccctattccccctcccctagatccaccactgattagtactatgtgcaaactagtacacttctaaagtaacttaattttccttaaataaatatttaaaacatgactataattattataaacttacatagtatcattaaaattcaaaacttgtttatcaaataaagcaatatgtacctatactgtgtttcaaacgtaaaagtagtatgggtgtatattgcaagcggggttttccattctataaattatcataaatattccctctacaagtacctgc

SEQ ID NO: 3417 - DNA, 1040 bp, Diabrotica virgifera
atttaaaagagctaaaaaattaaaatttttattgtaaaataaatattttaaataatttttttgtaatgaaatgctattactcactttgatgaaaaattttgcaattttgaaaaaaattcgtaagtgcttcgaggatgggtgtagtaatacgaaaaagaggttttggtccaacagatcaagaatggggcttctctgaagtaagacctggtgctaatttattttggtggcttcattataccaccgcagatgtctctacaccaacagatagacctcttctaatatggctacagggaggcccaggatcatcttcaacaggttatggaaactttgaggagttaggtccattagattcagatttaaatcctaggaatactacttgggtacaatgggctaatgttctgtttgtggataatcctgtcggaaccggatttggatatgtaaccagtgatgacttgtacgcaaaaaataatactcaaattgcaacagattttttggaatttatgaaagatttctacaaacagttgcccaaatttaagaccgtaccattgtacatattttgcgagtcatacggtggaaaaatggcagcagaaattgcacttgtattataccaagccatacaaaaaggtgaaatagaatcaaacttaaaaggcgttgcacttggcgattcttggatttctcccttagatgctgaactttcgtatggaccatatttattcaatcttgggttttatcgatcgaaatggatacgacgcaataatggaagaagctgcacgagtaaagaaagccatagacaaaggcgactttgacgaagctcttagtctatggtatagtatggaatcagttggtggaggttgagacacgtggaattgattggtataatgtctttacaggacgagtatctaataatatcaggggtttggacaagcaaaacacaggtgcatcaagtgttacagacgacctagccaccattatgaatttctaagttgctcctgcgtaaatattaccaaagagtgggttgccaaagatctgaagtgtttgac

SEQ ID NO: 3418 - DNA, 1480 bp, Diabrotica virgifera
aacggcacttaaaatatataaaaatatcttatttggtttggatatgtatactcgtattataagaatactactcagttactcagtctactgcttcgactacaaaatgcgagtactagtggtattgtgtataatattacaagtagttttgggaaaaagaggttttggtccaacagatcaagaatggggcttctctgaagtaagacctggtgctaatttattttggtggcttcattataccaccgcagatgtctctacaccaacagatagacctcttctaatatggctacagggaggcccaggatcatcttcaacaggttatggaaactttgaggagttaggtccattagattcagatttaaatcctaggaatactacttgggtacaatgggctaatgttctgtttgtggataatcctgtcggaaccggatttggatatgtaaccagtgatgacttgtacgcaaaaaataatactcaaattgcaacagattttttggaatttatgaaagatttctacaaacagttgcccaaatttaagaccgtaccattgtacatattttgcgagtcatacggtggaaaaatggcagcagaaattgcacttgtattataccaagccatacaaaaaggtgaaatagaatcaaacttaaaaggcgttgcacttggcgattcttggatttctcccttagatgctgaactttcgtatggaccatatttattcaacttgggttttatcgatcgaaatggatacgacgcaataatggaagaagctgcacgagtaaagaaagccatagacaaaggcgactttgacgaagctcttagtctatggtatagtatggaatcattggtggaggttgagacacgtggaattgattggtataatgtctttacaggacgagtatctaataatatcaggggtttggacaagcaaaacacaggtgcatcaagtgttacagacgacctagccaccattatgaattctaaagttgctcctgcgttaaatattaccaaagagtgggttgatcaaagatctgaagtgtttgactctttaggaaacgactttatgagacctgtgacgcatatagttgaagaacttcttaatactacagatttaattgtagctgtgtacaacggacaattggatttaattgtggatacacctgcaacttataattgggttgaaaatattgcgtttaaaggaaaagatgagtgggaacatgcagaaaggatcgaaatatataacgccgtcgactatatccaatcaatggcttttataaaagagcaaacaaatttgccttttactgggtaaacctagcaggtcatatggttccacatgacaaccctactgctatggagttcattttaagagacgtaacagataatttcaaagtataaaattttttataagtcacaaaatattatcctaattaataatattttgtgtattttgaataaaaggtaatatgtaaaaaagcccacgcgtccg

SEQ ID NO: 3419 - DNA, 992 bp, Diabrotica virgifera
  misc_feature (907)..(907): n is a, c, g, or t
  misc_feature (930)..(930): n is a, c, g, or t
cataattcaaggaaaaatagagagtaggagaagcgtagaaaggagatgtgttttctggttgaaaaacctgagtgaatgttttggttgcagctcaaggcaactgttcagagcaactgccttgaaggtcagagtagccctaatgattgccaacctttgtggaggagatggcacttaaagaagaagaacttttgtatcagaaggagtcataagaaatcagatttacattttaatcaacaaaaggttaagtaattcgatgatgtaggtaaaaatatatcctggtacgcttattaaatcggaagagttaacccactcgtaggaatattcatcttatactcaagagaattcacaaacctgataatatgaaatgtaatcttaaaaattaagaagtatcgactgggtttttttttattaaggtctgtttttctattcataatatctcgtactcgttcatttgttatgtgtgagactctaacaatgccaaaatcatcgccagaagtccatttccaatgcgagcagcttctgttctcttcgcttattcacttgtcaggtttcacatccatacaatacctcgcttttaaagatgctattgtatagctgtgttttcttttcttttggttttttctttgtttttgaccaaagtagtgagttcaaagctcctattagtttctttactttcataattctttcctctgtttcgaattctgtccttccactttgttagattctcgttccaaggtatacataatcagagctttgttcgataaccataccatcctcttgttgtaactcatttttctctcctcatatacacatatatttggttttctctatattgacgcatcggccccattttttctattctcgaaatagccggtttgtcataactattggatcatctttatcctgngcaatcaccacctgatcatcagncaaatgtagtgactatagtgggtgagtcgtcgtttagctttatccccataacagaacatgat

SEQ ID NO: 3420 - DNA, 1616 bp, Diabrotica virgifera
  misc_feature (1552)..(1552): n is a, c, g, or t
  misc_feature (1567)..(1567): n is a, c, g, or t
gaacaaaaacatcacaacaggaattttcattctgaaaacttagtgataccgagtgagactgtgaagtgactttgtactttctgttcgttcaaaaaaagttcgtaagcgttcttaaagatgtctgcctgtgttaatgaaagagtgtttgtagactcacctcttaaatccaaagtagctctttttaacaaagtagctgataaacacattcaaggacaagctgtaaatcccttctcaaacggacaacaagcaggaggtttgcaccgaccaacgatatcgaaagaggaatatggaaagcctccaaaaggatcgctctcagaaatcagagcatttaaagctactatccatgttagtagagaaatgttagaattatgtgaagttatatctcaatgtggtgaacgtctttttagtccagaagaaaaaccaaacgatcctagaatagtcatcagttttggagaactctttgcgatatacacagcaatttccgacaaagtagttggtattttacttagggcacgtaaatacaacttagttgacttcgaaggagaatgtttgtttcaaagacaagacgatcatgtaccaatcatacttgttaaaccaatcagtgaaatcagaaccttcttaaaagagaggatcgcgactgcgacaaaggcactgaaggagactggagaaatgtagtagattataaataaaattttaatttacttaagcactaacatttaaccaaaaaatggaccatatttctttaagaactagtatctttccacattacatttatttgtataagtatactatttatttattcggtagcatttcataaaagttactttctttttatcttggagattgtattatttttaaatatgacattattattcttgatgaaaaatacagtggaaaatatggacaatctaccaaaacaaaaacacgcaacttttgagaaagaatctgacataggtacttgattatccattagaatgattttcactctataatagatgaccataccccaaacctagcaaagcagatgagaaacacatgccggttctgaggcctacattaagggagtagggattcaggtagcaattatgcatattgtagagttaacaccacaacgctttatctgtgcttcactgatgcatacatagtaaggcttttgagtaagtgaactggaagaagatgaggtaaattctattttaaatgccgaatgatttaataataccgatactaaatctgtattatatcaactgtgccagcatcaggcttaatggagaaccaactccaagatgatgatcacaaagtgagtctgataattaagaattaaaatggataaattggtagaaggaaagtttagtaatacataatgaaactgaggtatcatacaactggagccttttactatttctaaaatattgatcaatatttcgttcttcctggatccaaggcggacctgtgaagtggtcctaaaagcctaccctgttagctcccaggcaagctacactttatgaaatacagtcaaacctgtgttaacggtcacctgccaaaacccaaaacncggagacctgtactnaacggcagtttcaaaattccccaaaccaattatatgtagactacaaaac

SEQ ID NO: 3421 - DNA, 1712 bp, Diabrotica virgifera
ctgtggtttagtgttgcacgtgaaaattttatattttataattttgaaataaagtaatattgaataactttccactcacaaaatgatgcaaccacagatattactcttaaaagagggaactgactcatcccaaggaaaacctcaattaatctcaaacataaatgcctgccagaatgtgacggatgctgtaagaacaacattggggcccaggggtatggacaagctcatagtacagaggcaaggacatgctactatatcaaacgacggggcaactattttgaaattattggatatcgttcaccctgctgcgaaaactttggtagatattgctaagtcacaagatgcagaggtcggggacggtacgacaagtgtagtattactagcaggagagtttttaaaacaaataaagccttacgttgatgagggtgttcacccgagaataataatcaaagcagtcagaagatcgttccaaatttgccttgagaaaataagtgaaatagctgttaaaatcaataaatcaaatgctgacgaattcagatctctattggaaaagtgtgctgccacagcgatgagctcgaaattaattaatcaacaaagatctttcttttctaaaatggttgtagatgctgttctgttactagacgatttactacctctcaatatgatcggtatcaaaaaggtacaaggtggagccctagaagagtcacttttggtagccggagtagcatttaagaaaactttttcttatgccggatttgaaatgcaacccaaggtatacaaagattgtaaaatagctctgctaaacattgaattggaacttaaagctgagagggataacgcagaagtaagagtagataatgtaaaagaatatcagaaaattgttgatgcagaatggactatcttgtacaataaacttcaaaaaatttatgagtctggagctaatgttgttttgtcaaaattacccattggagacgttgctacccaatactttgctgatagggatatgttctgtgctggtcgtgttcaagaagatgatatgaaacgtaccctgaaagcatgtggaggtgctgtaatgaccactgttaatgacatcagcgattctgtactcggtaaatgtgagctgtttgaagaaaaacaaataggaggagaaagatttaatttctttaaaggctgcccaaatgcaaaaacgtgtactttaattttacgtggaggagcagaacaatttttaaaagaaactggaagatcacttcctgatgccatcatgattgttaaaaggactatttaaaaatgacgccatttgtagctggggggggggggattttaaaaaagggatcaaaacaaaaattggatcattctccgacaattgccggcaaaaaacagtttctgattggtgaaataactaaggcttaaaaaatcatccccaaaaaatatgcgataaggcaggattttgcgcccccaacttctcaaacaaaattccacaaaaaacgcggagggtccctgtttggtacgggggggacaaaaaaaaaaaaaaaaattcttccaaaactttcaaagcctggggaatgggaacccggccatccttaaaaaccacccccttttacttgtcccccacaaaaatcatcacatgtcttgattttttgtttgtgttgagtaaaaaaaataaaaaaaaaatcaaaaaatcatggaggggccccccccccccaacaaggggg

SEQ ID NO: 3422 - DNA, 1117 bp, Diabrotica virgifera
gtcaaaaattttgggttggctcaacacgagttttctattttatttgaaaaaatactattttaaataatggctatcagtttgttaaatccaaaagctgaagtggctagagctgcacaagccctagccgttaatatatcagcggcaaaaggcattcaagatgtaatgaagtcaaaccttggtcccaaaggaacagtgaaaatgttggtatctggtgccggcgatataaaaataaccaaagatggaaacgttctattgcacgaaatgcaaattcaacaccccacggcttcccttattgctcgagcctcaactgcccaagatgatatgaccggcgacggcactacatcgactgtgttagtcataggtgaactattaaaacaagcagatatttacatagcagaaggtctccaccctagattgttaacagatggctttgataaggctaggacaaaagcgttggaagtactggagaaaatgaagatttcaattgaagcgaacaaagaaactttaacagatatttgcaggacgagtttaagaacaaagctgcatcaaaaactggctgatgttttgacagacgtttgtgtggatgccgttctagctataaagaaagatgacaaacctgttgatcttcatatggttgaattaatggaaatgcagcacaaaacagaaacagatactcagttaattaagggtttagtcctggaccatggctcccgtcatccagatatgcctaaaagtctcaacaactgctacattttaacatgtaatgtcagcatggaatatgaaaaaagtgaagtcaattcaggattcttctacaaaactgcagaagagagagaaaaattagtgactgcagagcgtgaattcattgagcagagagttaagaaagtcattgaactgaaaaggtcactctgtaatggaactgataagacttttgttgttattaaccaaaaaggtattgaccccatgagcctggatatgcttgccaaagaaggaataatagctctcagaagagctaagagacgtaacatggagcgtctatcattggcttgtggtggagtagctatgaacagctttgatgatctgcaagaatctcaacttggtagaggcggacatgtatatg

SEQ ID NO: 3423 - DNA, 438 bp, Diabrotica virgifera
acgcgtctataaggtgtcgtattattatagatttaagatacaaaagatgttactcagatttctaaggataccgaaaataaaaacagttgcaatacccattagagaactgtctaatttaagcataggaaaagcaactactgctgcaaaatttatccctgtattagaaacatccacaagtactattcaaaatccttggatatatcgacaaaacgataacttcaatcttccgcgatgtccaaatttaaagatagatctcccaaatactatcaaaacaatcatacctgcaatagaaccaaataaacaggatgtaattgaagcaccagcatttgatgatagtatcaagaaagaggcggtgaaaatgatcgtaatcaggaggaaaaagatgaagaaacataaactgaaaaaatttgagaaagcgaatgaagtttgaatgggcat

SEQ ID NO: 3424 - DNA, 983 bp, Diabrotica virgifera
aacagcgtatacggttcacagttatttttagtcttcgttacattttttctactgtcaacttcaactttcgtcatggctgaagaaaacaaacacttgactgccgtcctccagggtaatggactgtttaccagaaacgcttaccagatactagcccaagaaaaaggcaaaaatatatttttctcacctataagtatacacgcaattttatctttggcttcacaaggatctggagggaaaacacaaaaagcattgactagcgccctccaagttgctgatatcgcaacgttggccgagggctacaaagcagctatgcttaagctgaattccgttgaggatgtaactctacttatggctaataaggtttatgtcaaaaatgaatatgcattgaaagatgagtttaaagacaaagttgtcaatcatttcttttccgaagttcaaaatgttgatttctcccaatcagcagcagctgctaagactattaacacctgggttgaagaaaaaacaaaagataaaattaaggatttaatacaacctgatgatttgaatgatgacacccgcttggttttggtcaacgccatatatttcaaaggcaaatgggctgcaccgttcaaacctgaggacacaaaaaccgagaagttctacttaaacgacaatgattcgatagatgttcaaatgatgcatactaaaaagaagttcttctttaaaaacgatgaagcattagatgccaaagtcttggaattaccttataccaacaaagatctaagcatgatcgtgatattgcctaataagagaaacggtattaatgagttggaacttaaattggctaatactgatctaactaagatcacggaaaatatgtttaggccagacgttatcgttgctttgcccaagtttaaattgaaaccaccatcaatttggaggagcctctcacaaagttgggtcttggcgtcatattcagtgatcacgcggacttcactggcatg

SEQ ID NO: 3425 - DNA, 1741 bp, Diabrotica virgifera
  misc_feature (1688)..(1688): n is a, c, g, or t
  misc_feature (1691)..(1691): n is a, c, g, or t
  misc_feature (1700)..(1700): n is a, c, g, or t
  misc_feature (1717)..(1717): n is a, c, g, or t
agtgctcaaaatgaaaggactattgattgtttgcttggccgtattggccttaaccagcgctgctgataaggaagataaaaagggcaagaagaggagtttcccagcctactcaggatattcctcaggatattctggtgccgtaccagctgtccaatataactccgcttctcaattgttcggacaatcctcttccgtctatggaggtggtttggactcatcttcccaacttttgggtagtggatatggcagtggatatggcagtggatacggcagtggatttggcagtggcagtggggttgaaaatctcaatgttcagacttattctcaaggtctccaaggattgcaaggattacaatcatcccaagtactaggagaagtccaaggtttccaatctgctcatgctcaattgccacttgcacagacctattctcaagaagtccaactgccagttgttcaaactcaatcagttcaagcccaattgccagctgtacaaagttatactcatgaacaacacgtacatcccactcacagctacaactacatcaacaaggctgtacctgtatatgtacccaaaccagtcccctatgaagtaaccaagaccgtacaagtaccaactccttacaaagtaacagtaccaaaaccatacgctgtccctgtccaagtaagagtaccagtagatgtacccaaaccatacgaagtcaaagtagaacacaaagttccagtaccagtacccgaaagagtaccagtagaaattcccagaccatacccagtctacaaaaccaagcaagtccgtgttgaagtagaaaagccagtatacgttaaagagaaagtagaagtaagagtgccagtacctaaaccatacccagttgaagtaccaactccagttcacatcagagtaccccaaagaatccttcttaaagtaccacaaattgttggagctcacaatcacgctaccccatgtgaacacgctgctgctgtccaagctggacgagtggtgaacatccccaactatgtatatggtcaaggtcaagcctatgggcacatggaaggacagcaaaacctcctggctggtcaatccctatccggactcgaacaatcatcctttggtcgttcctctcttgagcaagcatctttcggacaatccgtttcatctggtttgccaagccaagcttctttggaacaatcatcaattggacaatctctttccaacatcgctgaacaatctttggccaacagccaagctgcttacgatcaatccgtccaaggacttggagacaactcaaacttaggtttcggacaagaatccttcggacaacaatcttttggagcaagcgaaggagtacaatctttcggagatgtgaaccaacaaggtcttcaatcttacgaagaattcagaagaagccaccaaggagaaggagttgtcagtgtggaaaatgaatctgtttctgtagaatctaaaactgataacggagtatctggaggtattggaagcatcttcgaatctagatctggattcgttgaaggcagatcagaagaaaccgcttcagtagaaccacaacccgctgcaccagctgcggaagttagcgcaactaacgaaccagctaacgaagtcgaacacaattctgctgaaagtaaagaagaatcaactgtgccttctgcacaccgatattgtttaaattgtggcattntangtatctcangtatttgagataatttngtgtatatagtgtgtatatgcttt

SEQ ID NO: 3426 - DNA, 1662 bp, Diabrotica virgifera
ctcttagacgtccaagagtgctcaaaatgaaaggactattgattgtttgcttggccgtattggccttaaccagcgctgctgataaggaagataaaaagggcaagaagaggagtttcccagcctactcaggatattcctcaggatattctggtgccgtaccagctgtccaatataactccgcttctcaattgttcggacaatcctcttccgtctatggaggtggtttggactcatcttcccaacttttgggtagtggatatggcagtggatatggcagtggatacggcagtggatttggcagtggcagtggggttgaaaatctcaatgttcagacttattctcaaggtctccaaggattgcaaggattgcaatcatcccaagtactaggagaaggccaaagtttccaatctggtcaagcctttgaacagggctattcccaaggattagaaggattgcaaggagtacaaggattacaaggagtgcaaggagtacaaggattacaaggattccaaggagtacaaggattacaatcatcccaagtactaggagaagtccaaggtttccaatctgctcatgctcaattgccacttgcacagacctattctcaagaagtccaactgccagttgttcaaactcaatcagttcaagcccaattgccagctgtacaaagttatactcatgaacaacacgtacatcccactcacagctacaactacatcaacaaggctgtacctgtatatgtacccaaaccagtcccctatgaagtaaccaagaccgtacaagtaccaactccttacaaagtaacagtaccaaaaccatacgctgtccctgtccaagtaagagtaccagtagatgtacccaaaccatacgaagtcaaagtagaacacaaagttccagtaccagtaccccgaaagagtaccagtagaaattcccagaccatacccagtctacaaaaccaaagcaagtcccgggttgaaagaataaagcccagtaggccttgaaaaaaaaagtaaaaaggaacaagggcaaggcatcctaaacccttacccccggtcgcagaaacaatttcccgttcctcgcccctggaacccgcaagcatctttcggacaaaacgattcacctggtttgccaaggcaagcttcccaaaccccatcgtccccccggcaatttctttccaacatcgctgaacaatcttaggccaacagccaagctgcttacggatcaatccgtgcaaggacttggagacaactcaaacttaggtttcggacaagaatccttgggacaacaatcttttggagcaagcgaaggagtacaatctttcggagatgtgaaccaacaaggtcttcaatcttacgaagaattcagaagaagccaccaaggagaaggagttgtcagtgtggaaaatgaatctgtttctgtagaatctaaaactgataacggagtatctggaggtattggaagcatcttcgaatctagatctggattcgttgaaggcagatcagaagaaaccgcttcagtagaaccacaacccgctgcaccagctgcggaagttagcgcaactaacgaaccagctaacgaagtcgaacagaattctgctgaagttaaagaagaatcaactgtgccttctgcaacaccggatattgtttaaattgtccgatttta

SEQ ID NO: 3427 - DNA, 1438 bp, Diabrotica virgifera
ctgtgacataatgttcaagtgtatcacatatctgtccgctatattagtggtagctgtcgtatgttcggaaaacgataaagattggtggaaaacggccactttttaccaaatttacccgaaatcatttaaagacactaatggtgatggagtaggagatttaaaaggtattattgagaaattagactacgtaaaagatcttggagtaacgggagtatggctttcacccatatacaaatcaccattggtggacgaaggatacgacatcagtgattttagagacattaatccgatatttggagacttggagactttcgttaaacttgtaaatgaaacacattcacgtggactaaaaatcgtgctggattacgtaccaaatcataccagcgatcagcacccatggtttacgaaatcagaaaacagagaagaaggatatgaagatttttttgtttgggtcgatgggaaaaatggagataagaatgaacctccaaataattggcgcagtgtctttaaaaattcagcgtgggaatggagcgataaacgaaagcaattttacctacaccagttcttcaagcaacagccagatcttaacttttttaatgatcaagtccagaaagaaatgaaggatattatcaactactggttggaagaatacggtatagatgggatcagaatagattctatgccttacttggttgaaaaccaaacttggccagatgaacctagatcatatgatccaagcgcatccgaagatgaatatgaatatttggatcacatctattcacgaagtcaaaaggaaagctatgacataatctacgactggagaagacacattgatgatatatctaaaaatacgtcgaacaccaaagtatgcatgacagaagctgtggttgacctgaagcacataataccatattacggaacacctgatggttcaaaactaggtgctcatttctcgtttaatttcatcttgcttgtgttgaacactacttccacagcaagtgacctttctaccttaataaacttatggatggatagtctccctaaaatatacacatctaattgggtgctaggaaatcacgatcaacacaggatagcaacaaaagtcggtacagaaaaagtggatggtctaaatatgttgatggctttcctccctggcattcaaatcacgtacaacggagaagaaattggaatggaaaacggagaagtaaactgcgaaacacaaggtctagatcacgctgagaattgctcagattattacaggatctccagagatttccaaaggacaccattccaatgggacagcagtgagtttgcaggatttaccagtggaaataaaacatggttgcctgtcagttcgaaaaagactaaatgcaatgtggctgatcaaattaatgacgaaagaagccatttgaatatatattaaaaaactccaaaggct

SEQ ID NO: 3428 - DNA, 1943 bp, Diabrotica virgifera
cctctacccccggacaacattcacgtttgattcaaaaactataataaaatgaagactgttttagttttatccattgcgacaatacttttacattttgtgatttgtgtgtcaatcggaaaagaagatgcatttaaacaaatgacaaaaggtttattggagtaccggaaaacaggcactccaccgcaatatctgaaatcggctgtcgaaaaatacaataagcctaattatttcctagtaccaaccggtacttttgataaatcagaagtatgttacacttgcgcactaatagtagatatgtttaaacaccacagagcagatggaatgagtgatgaagagtttaaaaaggaacttcttggcttttgtaatctctacaaggtatacccagaaagagtttgtaaaggaagggtagatcttaatgctcctatatttttatacattatggataacacacccaatttaactggtattgatgcatgcggaatggctttgcaatacgacgattgtgctcttggaacaagatataattggaccgttaatgttcctccgccaactcaaacaataaaaacgaaaaaagtaacagcagaaaaaccatttaatattcttcacatcaccgatatccattatgatcccagatatactgtaggcaagcaaaatacatgcaatgaaccagtgtgttgccaggatgaccaacctaacgcaacaactgccggagaagcttgtggatactggtctgactatattaacgcagatatcccttggagaactgtagtaaatgccttagagcaaactaaaaaccacaattatgactacgtatatttcactggagatattgtacctcacagattatgggacacaagtgtagaagacaacagtaaaataatatctcaaatattggacgcctttgctgattactataaaggtccagtttatcccagtttaggaaatcatgaagcaaacccagtcgataattactcagaagaaacagacccctcactttcaagtaaatggttatatgacttactttttcaaaaactatctaaatggatgcccatcgatgaagtcaaagatacaatactgaaaggagggtactatacagtttcgccaaagaatggactgagagttgttgttttaaataataatgtttgcaactcaggaaactggtggatcattcatcaacctaacgacccctacgatcagcttaaatggttatcaaacgtgctgctgaaagcagaacaagacaatgaacgagtacatttattatatcatatgccctctggtcaggacgaatgttacagagtttggtcccgagaatacaggaaaattattgaaagattttcgacaataatagcagttcagtttaatgggcacactcacagagacgaattctatgtctactacagcaaatcgaactccagcaaagctatcaatatggcatggaatggagcatcggtcgtaacttatgacaaagcaaatccaagctataaagttttttcaattgacggaaatacattcgatgcgcttgatttcgaggaatggacttttaatctcactttggccaatttaaatccgaataaaaatcccgaatggtacaagctttattcgttcaaaaatgcattcggcgttaaaagtttggaagcgcaagaaatcaatgatcttgtaatgagaatgacccaaaaacatgaacttctcgaccaatactacaggtacaaatttagagacggagacattgctctaaaagaaggttgtgacgatgattgcaaaaaggacttgttatgcagaatggtaaaaaccgaatatggtgacgacgaagtatgtgaaaaagtaaaggaactttatgatcgcaataaagacatccaagtatttggctgcataactgtatatttttaatcctatatatcttttttgtaatatttttggtaataaaaaaaaggtttcttcatact

SEQ ID NO: 3429 - DNA, 907 bp, Diabrotica virgifera
actatattattcaagtgcgaccaagtgaattattagtaaaaagtttcattgaattttcaatcttggactttgaaagaaattttaaatcaacaagtaaaaaatatggatatttttccacacctatttcaagacaacttttgggcacctaactgtcctggccgtggtgcagattctggaaatcttgtgcaaaatattacagatgtcttaaattccatcgcaatagctaaagccatgttctgtccagaatatgacatcaacaaccaagatgtgaatggtaattctgaagtgccacaacctagtacctctgctacgactgacaaaaccaatcttgaagccaatccaggcgacaattttaaagaagatatcttaaattccattgcaatcgctaaagcaatgttctgtccagagtatgacaacaatcaagatgtgaatggtaattctgaagtgccacaacctagttcctctgctacgactgacaagaccaattttgaagccaatccaggtgacgattttaaagaagatatcttgaattccatcgcaatcgctaaagcaatgttctgcccagaatatgacaacaaccacgatgtgagtagtaattctgaagtgccacaacctagtacctctgctacgactgacaagaccaattttgaagccaatccaggtgaggattttaaagaagatatcttgaattctatcgcaatcgctaaagcaatgttctgcccagaatatgacaacaaccacgatgtgagtaataattctgaagtgccacaacctagtacctcttctacaactgaacaaaaccaatttttgaagccatttaaggggacagtattaaagaaggttatcttaaattccatcgaaataactaaagcaatgtttttgtccagagaaatgacaacaacaaccc

SEQ ID NO: 3430 - DNA, 871 bp, Diabrotica virgifera
ttttttttttttttgaaccgcagctgcggtagttttttgaacaaattcggggacaaatttagttttctaaaatggcacatacatataaacttatatattttgacgtccccggaaagggtgaagcaattagaatgatcttaagctatggagaaattccatttgaggacaaacgcatccagatgggggattggccaaaacttaaaccaactacccctcttggacaacttcccttgttagaggtcgatggtaaagcaatccctcaaagtactgcaatctgcaggtacttggcatcaatagtaaaactagatggcaaagatgcaaaagaaaatcttgctctagatgttgcactagaaactctttttgatttacaaaaaatgaacggcgaaataaagtatgaacaagacgccgctaaaaaaaaggaaaaacttgaaaaattattacaacaaggattacctctgtattttggaaaactagacgaatatgctaagaaacacaatggttacatagcttttgaaaggttgtcatgggctgatattttattcgtttgtgtatatgaagcattagtcaatcttgcaggtaaggaggctgtagcttcttaccctagtttacagcaagttaagaagaatgttctagcaacaaaaggtattaataaatggattaaaaatagaccagcagtggagggatacgatttgaaacaagatctttaagatttttttatatatttttatttaataaataattattattatgagaaataaaaaaaaagaaaaattcaaaaatacaatgaaaagtatatgatgaaaaaagaacactatattcttgaaaaaagaaaaataaaaaaaaaaaaaaaggggaaaaaaaaaatgggggg

SEQ ID NO: 3431 - DNA, 811 bp, Diabrotica virgifera
tacccacgcgtccgacgaagttgtataaaaacactttatttatataccggtgcgcggtgtttcgtttaattcgtatcgtatcagatcagcggtagttctctctactctaagtggacaaatttagttttctaaaatggcacatacatataaacttacatattttgacttccccggaaagggtgaagcaattagaatgatcttaagctatggagaaataccattcgaggacaaacgtatccagatgggggattggccaaaaattaagccaactactcctcttggacaacttcccatattagaggtcgatggtaaagaaatcccccaaagcactgcaatcagcaggtacttggcatctaaattaaacctcgatggcaaagatctgaaggaaaatcttgcactagatgttgcagtagaaactctcttggatttacaaaaagttggcgtcggaataaagtatgaacaggacgctgctaagagagcagagaacgttgaaaaatcgaaacaagttctacctgtttattttggaaaactagaagaacatgctaagaaacacaatggttacatagtttttgacaggatgtcatgggctgatattttattcgtttgcgtgtatgaatttttagtcccttgtgtaggtaaagaagcagtatctgcttaccccagtttacaacaagttttgaagaatgttctagcagcaaaaggtattaataaatatattaaaaataggccagcagtagagggttatgatttaaaacaagatctttaagaattttttatatattttttatttaataaagtaataataattttt

SEQ ID NO: 3432 - DNA, 1442 bp, Diabrotica virgifera
gtccgcccacacgtccgaaaaacactttataccggggtgtttcgtttaattcggatcgtagccgcggtagttttttgaacaaattcggggacaaatttagttttctaaaatggcacatacatataaacttatatattttgacgtccccggaaagggtgaagcaattagaatgatcttaagctatggagaaattccatttgaggacaaacgcatccagatgggggattggccaaaacttaaaccaactacccctcttggacaacttcccttgttagaggtcgatggtaaagcaatccctcaaagtactgcaatctgcaggtacttggcatcaatagtaaaactcgatggcaaagatgcaaaagaaaatcttgcactagatgttgcactagaaactctttttgatttacaaaaaatgaacgtcgaaataaagtatgaacaggacgccgctaagaaagcagagaacgttgaaaaatcgaaacaagttctacctgtttattttggaaaactagaagaacatgctaagaaacacaatggttacatagtttttgacaggatgtcatgggctgatattttattcgtttgcgtgtatgaatttttagtcccttgtgtaggtaaagaagcagtatctgcttaccccagtttacaacaagttttgaagaatgttctagcagcaaaaggtattaataaatatattaaaaataggccagcagtagctacttctattataaaacttgacgttatcaaataattaaaatgtaaaatgttagttttgctttaaaatttttgtgcagaattacagctacatttgaagtagcttaattcaaaaaataatatatattatagtaaatataataaccaggcataatctaaaaaaaatcaataaaatattttctttttgtcatttctttcacttttgcggaaacttaacaaaaacggaaacaaaaccgttccttaactgtgttaactgaggttaactttgtaggtgtataatttaatggcaaaataaaataaacttatatgtacaccataaaatttcaaactccaatataaaaaatagtttaaaaacaactgtttgtgtaatataaataactttctaaagaaaaacagcataacaggacaaaaaacagcaaaaaattcccccaaatgacagcagcccctaaacaaaaaaaaaaacaaaaaaggccccaaaatttgttactctccggtgtaaaaaattttccccaaccgtaatttttttccccccctttttttctcttttctttttttctaagtgttaaaagaggttaaaaaaaagaaaaaaagggggggttttttcttataaaaaaagaggggggagagggggggggggggggttttatttttttttagtgcggcggaaagaaaaaaatataagagatatgaaaaaaaaaaaagaaatatgatggggttttttttttttcccc

SEQ ID NO: 3433 - DNA, 512 bp, Diabrotica virgifera
  misc_feature (2)..(2): n is a, c, g, or t
anatgcagatcccttttaatttcccccggtttaattcaattaacaaataaaatccttccaatttggccaaaaaccccccgggagaatccgaaaaatgttattgtttgatagaatcaaagaaatggtttcaagttctgatataataacataactcaagtgagaaattgacgtttaataatttagcttaggtaaaatgttttgtactattgtcgttgtgttttctttcaattacgcagaactaaaaaatgctctgaaaaaactgtgttaaaaataacaattttgttaaaaagggtgaaggacagcgatatgattcagatacctctcaaaaagggtttaatactataatatattcgatattaatgacatctagtatcgatttaaaacatctaatactcctgaaatacttgaaccaataaaaaatattctttgtggcatgttttgtcctaccacaatgaaaaagaaagagaagaaaaataaaaatatattaaattttacaaacatacgaatactgt

SEQ ID NO: 3434 - DNA, 2163 bp, Diabrotica virgifera
gtgcattcgtgagtcaattctattgtgagaatacctttacttaaggaaatccatgattatataaataaatagacagatttattttccaagccatgttttatcaccctatagcatcttcaggtattattaaaaatgataaattattaatgtatatttgtttgttaagaccagtgattttacattaattaattttaaatcttagaaagttaattttcaaataattgtagctctttcttctactaaaaaaaactgacttacaaattatgaaatatctcaacgtgtataattattaagaatccagtgttcgcggcattcctgcaaatatctatatcaatattgcactttgttatttgaacgttccagtattttatgcataagttggatttattctttagccacggagttttttattgtatggcacacagacacctttcccattttaccttaatcactagttttaatttgggccatactataatttacttggtttttatcgaaagaaatgtgtgaacatatttggtaaacaaaatatagaataattaactaatatactactttgactgtttttagctctagtatagctgtcgggataatctgttgctttatttttgtcgacaactatatcataagtgttttgaaattaatctagtctaaataagaaaacatacgatttttatatttcaacttagccttcttttacttaaccgtgataattttgctgcagaaaggaatcctccgaaccatgttttgttctcacaaggaacagaagacaatggtcggccaattagtatctccttatagtcggcataagtacatacgcatgtactcaccagtattgattctacgatttgctatcgtcatattatgttgaatttcttataacacaaccgcagatttccacagttcaacaaaaagtactgcttctttttcgcaatcctgattatgttctgagtttaacaataatgttcaatagactatcgttaatgggctatggtagcaagcgaaaatccaaaagtcgactgcaacgaaatagtattagttcataactataaatacttaggtcatgaaatccaaattgacagagacaactgaaccgctgaactacacagaagaatcatattagcataagccgcatatgaagctctatcagacatctccaagagatttgttgatatgttgacttatttgaaaaagaatccctggcaactgtctgtaggaagctcaatagaactggaggaaattaggggagacctatgtttaactttggacgcagagggttggataatggtgatagtcgttaattaaagtcataaagccccagattagactgttctctgtcatttgttacaggatcaacaacgaatcaattttattttgaaaatgttacaaaaaaaaggaatgtcgatctgcacagatctctcttgagaaacattgtagctacaaatttctcaaaatatagttaattgttctacgaaaacttcttgccaagttttgtcaatgattttgcctccctctcagttttttatgcgtcggaaattacgtgaaggtacctttgaaagaagacggtgtacggttttttgagacaacttatgggtcgtattaagtgggaaaaattgtagggtaatgaagtagatcttaggcaagacatcaatcatccttcaagctagatggtttagtctgtgctttgtatattcctcaagtttataatgcggtgactttataactccttactaatgttgtatcaattaagtccagtaaccgtttgaccttcaagtaagccgtttaaccttcaaatattcatccgttatgtgacagagatattctagcaggctttcagtgtttctaagttgcatttttactgattttttcgcagcgaaacgattaagctgtgtcatacatcacaattaatgtcctgcaccatacccaaataataatcaaggcctaaatatttgttattattgtatctataaaaaacaatcaatatgagttagtataacagttgccaactatgttcacatatttactttatatatttatgtctgtatatacttgtttcaacgatgccatgcgcttttggaagagttcttccaatgatatatgaggtttttaaagtaattttaattgtttctctgttaaatgaaatcgtacgagcaattctatata

SEQ ID NO: 3435 - DNA, 1941 bp, Diabrotica virgifera
tttggcaagtgttttgggggggggagaaattattgggggtttttttaaatttggcccccccccgggaggggcccttttttttcaccctttccccttcaaaaccattaaaaaagaagaggttccttgtcttgcccggggggggggggggggggatcaggatgtttttgcaaaaggggaccattaaaaaaatgttataacaaattattttgtttttttttttttgttctccctgttaggtcggatggggggagtcaaaagtataattcctgtattttacggcaggggggggaaacattttttttttttttttttttttttttttttaattttcgggatccgaaaaatctttcattttctcagttccgaaacctcatttggcgcaattttttttatcaattgaaatggatatttttttggttttcagccaatatgaaaaatttcttgttttgggaggagtaacataaagtcaaatgtttcgccagggtctttcaattgaacataccctaactccaaattgttggtcatcgaaatcaaagaataaaagataggttttttcatttttaaccagtacttccacgttatagtatccatatacattctttaagtaaaatttattgaaatggaaattttcaatatgactctctttgaaatgagtgctgatagctgatagtttgactttttgatgacactttgatgttgggcccactacttctgcatcttggaaagtacttggagaatctttatttagttttagattggcaattgtttcttcaactatgtaatttcttgtattgtctatatgagcatcacaaaagaaacacttggaaccatctccatcagccttgtctttgcaatctttgcaaagagcatggccttttaaacactggaaaatgggttctgtgaagggaatctcacaaccaggacatttcaggaaatttttcaatgcatcagcttttgttggctctgaaggtttttcttcttctatctcatcttcttctgtaacttcgtcaataacaacatctttccccaaaagcagatcttctatgtcattctcattttcagcttttacttcaacaacatttacagtacaagaataatcactaccgaatgtacgttttaaaataggcttttcaatttttgcataaacatactttaacatacctcgtctgtagctagaatataagtgatactcgtatttacaatctcctttaagacatctataacagtaaacacgatcattatgcaacacaatgttgttttcagttaaatgaactgaatttttactatttttagctctcaaaactacttcaaattgtttgtcattgttttttataccacataaagcgaatcgatatgtgtctacactcagttcatagaacaaaatatagcacacattatctttctctagtacagcaaagccagtaccacggaaactttctataaatattttttcggaatgatatagtttcttgtgcttctccttgaaatgagaggcaaagtttgcttctaatacggtttctttacagtcagacgccagacatggtattgttcgatgttcacaatccttttcatggtccctaactgactctaagtccacagtttcagagcagcccttgtaaatacagggaaatttcatgtacgtagctaagtcttcatacaacgagtttctaaagttgaatcgagttttgattgaacatcttccacatttgtactttactttattttctctttcgtcttgagttgtcatatttattggagggtaagagagatacaaaccgcagaaagagcatcttaatttctttgcaacttcactagtaagcaggaactccggtttggttttggttgtgttgttctcttcactattttccatgtttacttaagattatagtttataactgaatccacagataataaggaggagatacaaaatcaaccgccggt

SEQ ID NO: 3436 - DNA, 1234 bp, Diabrotica virgifera
ttttagttgaattaattgactgacgagtgaacagaattggcgtaaatttgcgctattttgtcgaaatttgagtgcttaggtgattggagagtgaaagatgtcgattgaatatttgcaagtagccgaagatgaaggagaggaacctatcgaactccccactgaagatgatggtacacttttgttaagtaccttatcggcccagtttccgggttcgtctggcttaaaatacaaaaatccggaaactaaaactttcagaggagttcgattatcggaaggaagactacatcctccacctgatgatggatggggttctcatatattttactgcgtttttccgaaagagaataaacgaaagagtgatgataatttggagaattcaactgcaaagacaaagcgtatggagacaaaattgcgttgtactgatttgattgtacttggtttaccttggaagacaactgagcagaatttgagagagtattttgaaacatttggtgaggtgctaatggcgcaagttaagaaagacccaaagacaggacaatccaaaggatttggatttatcaggtttgcatcgtatgaatctcagatgagagttttagcgcagaggcatatgattgatggaaggtggtgtgatgtgaaagttcccaattcgaaagaaggactgattcaacaagtgccatgcaaagtttttattggaaggtgtaccgaggacttgacagctgatgatctgagagactattttggcaagtttggcgaagttactgatgtttttataccgaaaccttttcgagcttttagttttgtaacatttttggaccctgaagttgctcagtcactctgtggtgaagatcatattataaaaggtgtttcggtgcatgtgtcgaatgctgctccgaaatccgatacccgaggtggcaactatcgtggcgatagaaacaatggtttacagaatcgagggggcggcgttggtcctggaggccctgacggtcctggaatgtacaatcaacgatataacggcgcaggtcccaatcaaggcaattggggaaatcaaggcggtcctcgtggcaatattgatatgccaaacttacaagctttgggaataactgggcaaggtcagcaaggtaataaccaaggcaactgcaatccactgggtatgggtttaaatgctttgggagcactgccgatgaatcctgctattgttgctgcagctttgaatcaagctggatggggtttgatt

SEQ ID NO: 3437 - DNA, 932 bp, Diabrotica virgifera
cagcgtgattgacacaagacagggcggcattttgggttttgagaaggcgaaggtatgggagaagagacttctacgtctgtggaggttaatacagattatacgccgccgaagttttttaggattaataggagtttattgctgttaaaatcaacgttattctttcttcatggagctacatcgtcgcttgtcccttacctcaccatccacatgcagagcatcggtctttcgatggagcagatcgccatcatttacctgtgcttgccattcaccacattccttgcgcctccggcaacaggttacttagtggacaaattcggtaagtataagcctgtggtcattggatgttttattcttacggcaatactgcatcactcgctgttgttcatgccccatcaggaaacacctggaacagtgccaagtggatatattattagacatccaaagaagatgtacgttgaggtgtggtggagtccttgcccaagcagggaatgccccgacgatgaagaactagatttagttctcgacttttgcatggaccattgtctattaaaggaagctaagcaagcaaagaacaagaaattaattaaagcaaatccaccgaagagaccttgcgatgatgaagatcctggagataaggatgacctaaatttccacataaaaaagaaacaaaggaacgatactgctacagcattcacactagatatgcatccgaatctcggagatccagtggaacaattcggtattgaaatcgaagatgaagacgacgaggatgttactgattttaaaaagagatttaggcttggtatgcttaaaagacacggagtggacatcaacgaactggagactaaagatttaagatgtggtggaatcgttttggaagccaatggaactacaagatcgcttctaccgaatatactgatgattgcattcta

SEQ ID NO: 3438 - DNA, 747 bp, Diabrotica virgifera
tcttgcggccggagaaacagaaacttgaactggcttttgtatttctgataacaaatcaaaaataaaatggaaaaaaatttagagcattcaatgggacaacttatcaacacaccaggagtgtatggatgtgtttttgcagatagacatggtctctgtttgggaatgaaaggagaaacttcaacaaacagtgctggcattattggtgcaattgcagaggaagccttaaaaatagaaccaaatagtaaacctccagttatacattttgaaaatgataatcgttcatgtactattcaaaggattggtactataactggagctattttcaagaatttacaaaactaaactataggactcattttaatacaatataaaatatctgttttacagcaattttttaaatatcgcataatcatttattttttgagtatatctataccctgtttttaaaccaggaggagtaaactcgaaagacagattcacacccaataatgtcactagaaaaatcaccaaatacatcttctgttttggttgatcatgtcagcctttgacagtaatccataaatattgtatttactaatacgtcgctaaagacttctaaaaacaactgttttggaaataacaatttttaaaggaataatgcaggaaacacaaaaaattgctgatataacttaattaccctatgatgtcaatagtgtcaaaatttcataacagaggagtaaactttcttaaggttggaccatttacaaa

SEQ ID NO: 3439 - DNA, 995 bp, Diabrotica virgifera
cctggctatatatgtcttatactagttggtcaagcgcgttaatcatttttacgtattacagatagaaatggattatctgtctgtaccaattaatgccttaaagggcactctaaataatcactttcaagggaaggaagcttggcaaatagtcacaagcactactacaactgtgctgttgtctgtatggttttatggatttttatttcaagatgagagtcttaccgaaagaacaaagaaaacagtatttaggttagcaagaagaattcctgcgatcagaaggaaaatagagactgaattggacacaatagcaaagagttttgaagatgacattaagaaatcaaccagtactgtaacatatattactgaactacctcaaaaagggctgacaaatgacgaacttattcaatgtttggaccagaatttgtctctgggtgaatacaactggaaaggtggtaaagtatcaggagctgtctatttttacaatcaagatttaataaacctcatttctggcatttatggtaaaactgcttacacaaatcctttacatccagatttatttcccggagtatgcaaaatggaagcagaagttattagaatagcatctaatctatttcatggagacgagaatgtagttggatcgatgacaagtggcggtaccgaatcaatactgatggcctgcaaggcatacagagactatgccagagaagttaaaggcattaaaaagccagaaatagtcgtaccaacaacagtgcattcagcgtttgataaggctgcacaatatttgaagttaaaagttagatctatcccagttgatccccaaacataccaagtaaatattacgaaatttagaagagctatcaattcgaatacgatcttgttagtagggtcagctccaaatttcccatacggaaccatggataatataacagcaatatctgaaatgggggttgaagtatggcatacctgttcacgtcgactcttgtctaggaggattt

SEQ ID NO: 3440 - DNA, 1424 bp, Diabrotica virgifera
ctttgaatgcacgtgagagtgtacatgtatgttttgatttaacttttcgtaaataattaaaaatggtttcgaagcgtaagaagaagtatacatctggagaaggtgctcagtttatgactagaaaagcagcccttaagaaacttcagttatcccttaacgattttcgcaagctgtgtattttaaaagggatatatccaagagaacctagaaatcgcaaaagagcccaaaaaggaaaagccggaattaaaaccctgtaccatgtgaaggatatacaatttttactacatgaaccaattatttggcgtttaagggattacaaaatatttaataaaaaagttggacgtgctagagctgtaaaagattttgaaaaactaaataagtttcttaataaccatcccacacttaaattagatcatattgtaaaagaacgttatccaacgtttatggatgccttgaaagatttagatgactgcctgacgctatgttttttgtttagtacatttccttcattagcacatgtaccaagagatcaatctgctttatgtagaagattgacactcgaatttcttcatgcagtagttgaagggaaggcattaagaaaagtatttatttcaattaaaggaatatattttcaggccgaatttaaaggacaaactattacttgggttacacctcatcatttttcatttacaccacagtctaaagccgaagtcgactttaaacttatgtctacctttgttgaattctatactgtgatgcttggatttgtaaattttaggctttatcatagtttaaatttgtattaccctcccaaatttacagctgtacaacaaagtagcagtgaaaaaatgttagtagatgaagacatttttgtatcagaaagagtagcagcattgaatttttctttgtcaaaaacgtctaatgaagccctagaggatgatttagaaattgataattttaatgcagatggaagtgaagtgaatgaagaaaaacttgaagaaattcgcaaggaagcagaacaaattaagaaacttaaaacactattcaagggcctaaagttcttcttaaatagggaagttcctagggagccccttgtttttgtaataaggtgttttggtggagaagtatcttgggataagacaatgtttgttggatcaacttttaatgaagatgatgaatgtataactcatcagattgtagatcggccttctatggaaaagcagtttatatctaggtattatgtccaaccgcaatgggttttcgattctggtaatgctcgggacttactaccagtacagaaatatttcatggggggagttcttcctccacatttgtcaccgttcatcgataaagaaagagatcagcaatacattccacctgaagctagagcattgtacaatgaaaaccgaattagaaagagcaca

SEQ ID NO: 3441 - DNA, 864 bp, Diabrotica virgifera
tttcgtccggaaaattatgtccaaacgtgtgtaaaaacatctaacaccaggacatctattttttcatataaagatgtatacgataaacgtcctagtaatcgttttcctgtgtatcggattatgtcagggatattttaaaataatagcagatgatggggatttaacatgtagacctagtggtgtggaatgtctaaccgcatctacttttaccacttgtacgaatattggcagcgtcgcatctttacatgcaatcttgcgttgtcctgatggctatcactgtgatgattctacatctataccgtgtaaaccatcgacagaaggttcaacaacaagcagtacaattactagtagttccactgaaatttcaagtagtacatcgacaagaacaactgatacgccgaactcaacaagttcaacgataacttcatccagtacagaagaagacattactacatcaagtactgtaatagacacaagtacaacgaagaaaaaagtaccaagaccttctggtccgccacaatgtactgcagttggcctttatcctgctcctcggtgtaatcagtattacgaatgcgtacaaagtacttatttgattttctggacaacctatacagcagaattaagaacgtgcatagatggcgattactatgataccgaacgaaaacaatgcattttggcctctttaagtgattgtgaataagcataaatattataatgtatttaactaattttgaatacatacacataattaagaatcatatttgtagtagtaaaattttaaatttaaaaatatataaaaaaataagtagaaatatcgaaatgatttttaataatatagcattaaaataaaaaagacatccacat

SEQ ID NO: 3442 - DNA, 910 bp, Diabrotica virgifera
  misc_feature (871)..(871): n is a, c, g, or t
gcaaaattcaagatactcgatttcaatgtttaaatatattttccaattgtacttgatgccattttttatcattatttacattcagtgagaagtttacttctccactgtgttatgccagtgtattgataaggatcctctgctttaactgtataattatattcatgtagtttaatttatttatatattagaaagattgcgaagaccccagtgatttatacagaaagttcttctgagactttatccaaccaaagaataaattttgataagattaacaaattcaataaatagcaattggaaaaactaaagtaagaggaaaagtagaaacaagaactcacaatccaaattaattggaaaaaaataagctagcatgtagttaaaacaaatggtcgagcgtattctgatgtaaactgtgttaaaataattccaaataatatactaaagtaattctaattcttagaattattttaccacagtttaaatcagtatatccttttaagtgtactgaaccgttgattttaagtatatactagcttattctttaattgtaaactttaataatcactgatatacgcaacattttagcccgtaaagtttctttagtttctcagtcgccccgtttttaacaataagaattttatttgaatttggagcacatgtttctacttttagtaacatgtagtgactagccattcttgtctgattctttaagttggtacctatgattatgtaaaagttgtcaattttatgttaagtcatttgttagtttttggtaaaaatatttgcagtaaaacataatttgtccttataatttcttttctacttaatataggaatggtggcatgttccttccgacatctacctattaacattncatcaaatacaagagtcaaaattccagcgtctttgcatg

SEQ ID NO: 3443 - DNA, 1363 bp, Diabrotica virgifera
caaatttagagcgattttgatttttgatcctcttaaatgtcaacatttgattattaatttaatatagttaggatggctgtagttattttaactggatcaaaattaatcacaaaacagcctggattagttgcggtcgcatatatccgctcaaataactatagcaccgaagatagggcatacaatttagccagcttaaaacgaggtactggaggaagatccagtttcaatggcattgtagctacagtctttggagccacaggcttccttggtagatatgtctgcaatagactaggaaaaataggttcacaaatcattatcccatacagaggagacaactacgagcctttcagattgaaactggtaggagacttgggtcaggtttactttcatccataccacttaagagatgaagagtctattgctaagtgtatcaagtactcaaatgttgttgttaacctagtaggaagagactgggaaactagaaattttaagtttgatgatgtgcatgtagatggtgcaagacggctagcacgtttggcaaaacaggctggagttgagagatttattcacttgtcgtctataaatgctgatgaaaaccctcaaagggcagggatactaaaaggtggatccaattttcttagaagcaaagctagaggtgaagaagcagttttggaagaatttccagaggctacaatcttcagaccatctgatgtatatggacaggaggatagatttgttagatattatgcccatccatggaggagatctgccaactatttcccactgtggcataaaggtgaaagaactgtaaagcaacctgtgtatgttagtgatgttacctcaggtattataaatgctataaaggatcctgatactgcagggaaaatatatcaagctgtcggccctaaacgataccttttatcagatttggtcgactatttccacagaataatgcgcaaagatgacgaatggggttataaacgttacgacatgcgttgggacccacttttccaacttcgtgtttctctaacagagaaattctccataaattggccaattgggcatttgcactgggaaaaaatagaaagggagcacttaacggacgatgttaaaagtgatattccaactttggaagatctaggagtcaatttaacagctgtagaaaaccaaatgccatgggagttcaaaccttggacatggggtatttatagaggacaagatcccgacgaacctgtcgctccagctgctccgccaaaggctcttgtttaaatgtgtaaaaatctttgtatgagttactaaaaaattaattggactgcgttgctattcctttttcgcttttaaacattatatcattatttcatta

SEQ ID NO: 3444 - DNA, 1225 bp, Diabrotica virgifera
  misc_feature (1079)..(1080): n is a, c, g, or t
  misc_feature (1103)..(1103): n is a, c, g, or t
  misc_feature (1138)..(1138): n is a, c, g, or t
  misc_feature (1147)..(1148): n is a, c, g, or t
  misc_feature (1180)..(1181): n is a, c, g, or t
  misc_feature (1187)..(1188): n is a, c, g, or t
  misc_feature (1205)..(1205): n is a, c, g, or t
  misc_feature (1216)..(1216): n is a, c, g, or t
gaagagagcaatagaattgattcaaaaacacaaaagtattgaaagcatcatccaaaacatagacaaagataaatacccaattccagaaaattggaattatgaaggggctagagaactcttcaagaatccagaagtgtcagaggcagacgatattgaattaaaatggggcgaaccagatgaagaggaactagtgaaatatttatgtggagacaaaaatttcagcgaggacagagtgagaaacggggtcaaaaaacttatgaaagccaaaggcggatcaacacaaggcagattggatgggttcttcacagttctttcgaccactccagctaagagaaaggtagatgataagaaaaatactcctaataagcgaggaaaggcaacgggtaaaggaaggggtagagcaaaataaataacagtatggataggtatttttatgaaaatcaatatcgatctaatgatagatttttataacagcgaaaaattgtttgtatattatgataagtcggtgtaagataagtttaacaaaatatttgaaagatccgctatatctaaagtcaaaaatttattattatacagttggctttaaatagaagttaagatgtaacatatgtggagataagatgtctagtataatttattaattacaaatttttgcaaattttttattggaatcatagacagtgttgcttgacaaaatttgataagatatttgtctttataagttagaaaatgctggacattctctggaatcttcaatctttaatgaacattttatgcatctatttctgaatttgggagattaatttttgttaaaaaagagtaacagacgacgcaataataatggtcttccgaactgatagcttaataaaatggattgctatttttttgacctcacttgtgagtgatttacatttttattatttaaattccttaaaattaaaaaaaaaatggtattttgaaaattctatttttattctaatagtcatcatctctattgtacactatggtttattttttaaccaagaggagtaaactaaaaagacagattcacacccaagaaagtcaccaaatacatcttnncttttttggttgatcatgtcggnctttcacggtaatccataaatattatattatgtantataatacnngtcggtaagagctctaaaaacaactgcttttnnatatannagcatgtaaaaatctanaaattaaaggnaatacacag

SEQ ID NO: 3445 - DNA, 1238 bp, Diabrotica virgifera
atttaatacaacacgccctcacaggacattcttggagttaaggcatgtataatagttaagtcaccatgagcgcaacattttcggaacctccaaccataaaattggaggagacaagcgaaaacgttacagaaattcagtcctatttagaagggttccagaaggagatcgttggagattctgttgttcaacctagttcagggagtgaagaacaagaagtggaaaatgaacaggaagaaggaacttattttgttgaccaagctgggcactactattatcaggctaagggttcaacccaacccgtcatgacagtagtgccaacaattgcaacaagtggagatactgatgaatacgttattaatcaggagaatgatgaagagggtgaggacggagaagagcaaattatccaacaaagtgaagataaccagtttgtgattagttccggcaatgcataccaaagagtgacagtagtaccatctgataataattccggcgaacttagctatgtgcttatcgttcaagatcccttggatattaaagaaggagatcagactgacggagaacaagatatgactgtgtatgatttcgatgatgctgaagatggaggagtagtagattcagacgaagacgacaaaagtaaaatagttaaacttttacctagaaaatcccaagttgttgcacaagctcacatgtgcaactattgcaactataccagccccaaacggtatcttctttccaggcacatgaaatcgcattctgaagaacgtccccataaatgtagtgtatgcgagaggggctttaagaccctagcttcccttcagaatcacgtgaacacccatactggaacaaaaccacatgcttgtaggtactgtgatgcagctttcactacttcaggagaattagtgcgtcacgtaagataccgccacacccacgaaaaacctcataaatgcacagaatgtgattatgctagcgtcgaactctccaaattgaagcgccacattcgttgccacacgggggaaaggccttatcaatgtccacattgcacgtatgcaagtcctgatacttttaaacttaagaggcacttaagaatccatactggggagaaaccttatgaatgtgatatttgtcatacacgattcacgcagtcaaacagtctcaagggccccaaacttacgcataatattggagaccagcccctcttttagtgcgacttgtgtcctacgacttgtggacgcaagact

SEQ ID NO: 3446 - DNA, 1027 bp, Diabrotica virgifera
ttgaccaaaagtcaatcgtactttcgtactcgaaaaattttgcagccaagtatcatcatcaactttacgctgctacaaaatgccgctatcaaaacaagagtctttgaacctgcgtcagaaacttattggagaatcatgccaactgtttttccgacaaaaccccttgaaaatcgtcagggctaaggggcagtatatgtatgacgaaaaggatgattcgtatttggactgcattaacaatgttgcccatgttgggcattgtcatccaaaagtggtcaaagctggaagtgagcagatggcttcactaagtacaaacaatcgctatctccacgacaacattcttctctgcgctcaaagaattctgagcacgatgccagacgaattgtcagtatgttatttcgtcaattctggctcagaagctaacgatttagcgctgagattggcccaaatacacaccggaaataaggacgtgatcgctttggaacatgcttaccatggccatttgacttcactgattgatatttctcactacaaatttaacctacctggtggagttggacaaagagaccacgtccatgtggctcctttacctgattcttacagaggtaaatatcgtgactctgagtatccaaaggaaaacataggtcacgcatatgccgacgatgttcgcgaaatttgccagaaagttcaagagaaaggagatggagtatgtgccttcatagcagaaagtcttataagctgcggaggtcaagtcattccacccaaaaattatttcaatgaggtttacgacagtgtcaggagtgctggaggagtgtgcatcgctgatgaagtccaggttggcttcggaaggataggaaagcactggtgggctttccacagtacgacgtagttcctgatatcgtaccatgggcaaacctatgggaaatggacatcctgggaaatgggtctctcccgcacctcaggatcaaagagtccaccaaaaaaaatatcaaaaaatatttttctcccaccagggggggggaaaattttt

SEQ ID NO: 3447 - DNA, 793 bp, Diabrotica virgifera
  misc_feature (792)..(792): n is a, c, g, or t
caaaaaaatcagaaaggttttttttttttttttgatgaatgttaagtaaaacttgattttatagtgtaagaagacgtattaagtaagaataaaaattattagtttgttgatttatataaatatgactgaagaaatggaaaattcggattcagaacccactaccagcatagaaaagagcaaaaagaaacctaaaagagggattatttatttatctacaatacctccatacatgaatgtggcaaaaattagagaattttttagtgattttggacaagtaggaagaatatatttagaattggcagataaagaattgaaatcaaaagataaagacaagccaaaaaagaaacgaaaagtagcaaaaaaaattctcagaaggttgggtagaatttgaaagaaagtatatagccaaacaagtagcttctcttcttaataatacacaggttagcaataggaaaaaatctaaacagtatgactgtatgtggaatattaaatatttatcgaattttaaatggacacacttacatgaaagattggcatatgaaaaagcagcaagaagacagaaactgagggcagaaatacaattagccaaaaagaagagcaacttctttgcatcaaatgttgaaaaaactaaaaagaataaaacagtagtgaataaagaatttgaaaatattgaagaaaaggttgcagaacagatggatgctgaagaacataaggaaaagagtggtgataggaaagaatttttacaatctcttttttaatattggtgttaataaacatgattcataaacgttnt

SEQ ID NO: 3448 - DNA, 2099 bp, Diabrotica virgifera
  misc_feature (1994)..(1994): n is a, c, g, or t
  misc_feature (2028)..(2028): n is a, c, g, or t
  misc_feature (2056)..(2056): n is a, c, g, or t
  misc_feature (2064)..(2064): n is a, c, g, or t
atttatttacaaaattttatatgacaatacctaacaagtttgcgtttaaaatttataaagcggaatatgaatcatctacgtgaatttggcacgaattatgtactcttgctagcttcatggaaccctcttcaccccaatctgttccccatgaattgttcataacaatgaactcatcattcgtcctaacatcacacaaagatgaagtggttggttcttctttccgtcgtaacgttaagtacagctttgccaactctccgcggcagacacctttccattggtgatgatggaactgtaactcttattggatctaacggtttcgaaattgatatattcaaaagtgttactgaccccagcatcgttgatgtcatcctaagaagcccacgtggacctaccaggtcttttcaaattgatgaggtcaacaatatcagagaagttagtgaccgtaatgtcttcggatattccagatatcatgacttcaaccaggctgatatccttgcccaaatcttccgtcagtaccaaggttctatagcggaaaaccaatactacagtcttctaaacagaatccaattgttggtcgaaggaggagttcttaacgaagctatctatgatgttttgagggaatggaaccagtacaatttgcaagatgttagcgatattgtcccatcgcaacacagagaaaacattttacccattaacgaacaatggaacctcgatagagaaactctaatccagcctcttcaatccactttggaagaaattagagaaaaacgccaacttcaacaagaattattaaaatctggaaagtattttgatctagaggatgaaaaccttgatcttcttttaggagaaaagtataacactgacaaaattttgaaacttatttacaaagaacaaattggccagttgccaataaatccttcaaatgtacttttgatgaggccaaatggagaagacaaacctttagatgttaatttcgttgataaattcgtaaaaaatgaggattcaattaatttgaaaatccaagagttcatcgataataaagatatcgcttcaccatacctgattttcaaacaaaggcttcttaatattgaagtagaaaagttcattcaacaactagcataccatcaaaatctaattaatcgacaaattgaacaatatatcggtcaatccgaagtgattcctaacgaattggtatatcaacaaagattaatctttaaacaagcctacccattgctccaaaaactgacagaagacgttttgtttataaaccgcaaaattatagaacttcgtggaaaaggaatattggcagaaagagaatttttcgtacagcaaaaaataaattccctgttaagtcaacaattgataaaattattgttagttcaacaaattcacttgaagcaacaaatacaatcattaataccaaaagctgatgctgtttctagagatttagttctcttccaacaagctacccaggaacaattgcaagacacaattcactctttaatcaagcagcttctgttggaacaatcgtcattcaaggatttagtcgaaaagtgcattcaagaaggtaccgcaataccccaggaatttatttcccattattacataatccacaaagaattacttcaattaatcgcacaaggagataccattcctaaagcaatttggtaccaacaatatgtaatgcaccaacaaattgtattttttctgaaacaagccaatcttatgacccaaccaattttcccacttcaacctaagaatctgctgcaacaactcccttactaaagaagtattaaatggtacttcttgttttatgtaaaaaaattatagtacttatcaaggtattttagaagaccttaatcttaaacttattacaagtttttaagttttcggtccaggtagaaattaataaattttaatctattgtatttttaataattattacatatctgctctttagtatgtttacctcttgaaatttaacgatactactncaatacacatggctttgttataggattaagatangatacggttttctaaaatatattgatangtactatnaagtctagtatctaaccttatatttattaaataaa

SEQ ID NO: 3449 - DNA, 780 bp, Diabrotica virgifera
  misc_feature (763)..(763): n is a, c, g, or t
  misc_feature (776)..(776): n is a, c, g, or t
gggcaaacggaggacatggtgctaacggaggaaatggaggtagcgcagataatggaggaaatggaggtaatggaagcaatggaggaaatggaggtaatggaagcaacggaggaaatggaggacatggtggaagcgaaaacaaagacggagacgatttcttaagcaaacttgcgcaaactgtcccaggtaatattccaactgttcttcaggaaggaagaaaattccatgtatccagagacttacgcgttacacaatctcaagctagagccttttgtgcgtaccataaattaaaacttcccgatataaaagattttgaagaaaataccgtccttgccaaacttctgccatatcccgttactactggacctttctgggttgatggagaaaaagtaaaaggcaaatggatctggaaacaatcagacgaacccattgagtactttaattgggctatagctcatgtagacgctgaaagtaagtcttgtcttggactcacaaacgtaggaaaatacgagtcagcatcttgcgaccaaaagaaacctttcatttgcgaatctgcaagcgatgaaagcagtaccgccaaggataagggagatgctataattaacgttattatgactaataatttaataaacgaaaatggaaaggtaactaatgccaaggaacttatttcctcccaatatattgaagtcaagccagaaggtggctaccatattactgttgacaataatgcaggaaaatgctaaattgtgtaaaaccttcctanataaagattttanatag

SEQ ID NO: 3450 - DNA, 1384 bp, Diabrotica virgifera
gccgccctttttttttttttttttcccattgcctccagcagacctctcgcgagccgaaaaaagcgaatgctgggaaggtgtagattgtcgcttatatttttttcactttttgtgtgtctaaatgcggcgaaacttgagaaaggatgggaggatgttttcggaaacaacccttcatcaacccttcctgtccacaaggtcggcaacaaaaattacgtcgttgttactaataccaggctaaacttcttacaagccatggatttttgtgaaaatctacacatgaacttggtaaccatcgagtctgcagaggaaaacaaagctgtcgaaaaatttattactgatgcaaatggcggtaacgaatactggactgctggtacaagattgctcgatggtaaaacttggttatggtttaccactggcgatgttatccaatattctgcttggaatgctggtgaaccaagcggaggaaacgagtattgtcttataactataaaatcgaataatggtttagtgtggaatgatgtcaaatgtgaccttgaatatccatttgtttgtgaaagacctatcgatgaaaaacgggaagatttgtttgccaatgaagaaaaagattggcagaatatcttaaatgttcacaaaaatcaaccaaatttggatcttttacacgttaatggaaaggaattctatatatctcaggagtacagaggaaattattatgaagcattagattattgccaagttcataacatgagactagcatctatcgattctaaagaagaaaatgatagattgtacagacacatcagggacatcagtgccggtactgatttctggtcttctggtacacgtttattagatggaagaaactgggtttggttacctaaaggtttgcctgttggttacaccaactggggtcctggtcaaccagataacaacaatgatcattgcattcgtttgcatttggataagaacaatggtctgttttgggatgacatcaactgcaataatgttaacagagtaatctgtgagaggtctgctggaggaaatggggcaaacggaggacatggtgctaacggaggaaatggaggtaacgcaggtaatggaagaaatgggaggaatggaatgaggaaattggtaatagcaaccaggaaatgggggacatggtggcaacagtgttatgctggattgggaaacaatgtcaattgacgcgtgattctcatgatagcactttattcatgatgccatttttcatgttgacttttttacttaccaattttgaattcttaactttacaggtttcaaaaaaatcgacaggccaaattggaacatgggggcatactaacggctgtcctccggtatattcatatgataacttaatttatcatattgt

SEQ ID NO: 3451 - DNA, 2538 bp, Diabrotica virgifera
ggagccttgcgcgcagtttcgcggttcggccccagaacgatgactcttttttatcctggtcattggttattcagtccctcgcgtccggtaggtaataccttaatataaatttttgcagttcatggtttgacatcgttatcatcaaatagtatcaccaaataggagaatgtcagttccggggacaccagaaatacggatccagcggcctttatatgaaaacgatcaactaagacaggatttgaattatgaaaaagaccaaactaactttgtgaacaaattatgcaaggaaaaagtttccccaaaaagtattataaaatcaaccattcctgtcctgggatggttacctaaatatgaatggagaacggatatattatcagaccttgcttctggatacacagtggctatcatgcacattcctcaaggtatggcatacgctcttttaggaaatgtacctccagttgttggaatatatatggccatttttccagtattagtatattttttcttgggaacgtcaagacatgtgtccatgggtacgttttcaatagcatgcttgatgacaggaaaagcagtactggaacatgccgacccatcatactttgatacgaccaatactaacagtacggatgttgttataaggggcatgggttattctcctgttcaagtggctacaactgtcacttttatagtctcgattattcagttattaatgtttgcattaagacttggagcagccaccaacttgttatcagatatgctagttagtgcttttacttgcggatccgcctttcaaattgttgtaacccaaataaaggatcttcttggaataactatgcccaaaattaaggggaatttcttaacaatcaagatactcaaggtgatatttgaagaaattggacaaacaaactatgctgctgtgattatttctgcaatcacaattgtggtgttgatatttaataatgaattccttaagcaactagtagcgaaaaaatcatctatacctatcccaatagaactgattgtagtaataattggaacagtgtcttcccaatacctagattttcataagaattatggaatcaaaattgtaggcgatattcctacaggatttcctcaaccagaaatgcctccacttgatttggtaccatcggtccttgtagacggggtctcaactgctattgtatcttatgccatatcgatgtcattggcaatgatattagcccaaaaagccaattatgaagtggacgcaaatcaggaactattagcaatgggtgttagtaatgcagtgggatcattcttctcgtgtatgccgctttgtgcttcattatccaggtcgatgatccagcaagtggttggtggtaaaacgcaaatccgatcaatcgtgtcttcgatgttattgattgttaccgttctttggattgcaccattttttgaatctcttcccaaagctgtattagctggtattatcgtagtctcgcttaaaggaatgttggtgcaagtaactcaacttgtatcttactataaactcagtaagtttgacgccttagtttggataacaacttttgtctcagttgtatttataagcatggaaattgcattaatggttggaataagtttatcacttttatccatctttattgccagtttcaaaccttatacctgccttttgggatctgtaccacatactgatctttatttggatatgaatagatacaaaggggcaaaagaaatagaaggattaaaaatattccattattgtggaggaattaactttgctaccaagggtatattcaagaccgaattgtacagacttattaaccttaatcctcaaaaggaactcatttctcgtgaaaaattggacaagatcatgaataaggatctacctcctaccgagttcaaagaaaaagttaaaaaattggaaagtaaaataaatagagatctcaaatgcataatcttggacttttcttcggtgatctgtttagacccgtgtagtgtcacaatgttgagaaatgaaatggccgagtttaaaaagcttgatattactttctatgtggcagcatgctctgatgatatctataacttgctaaacaaatgtggactactttcaaaagaaaaggagtctcttagagttttcccaagtatacacgatgccgtgcaagctgcaagtcacgctatgaacattccaattgagcttcaaattctgccaatagtactgccaaatattatgatcgaaaatgaagaaagttgagacattcatctgccaaccaataagggattaaagttacttttttgctattgttatggagaaagcaacattttacaggtgaaattactgggctgcataacagaacaaaacgaaaacaaaacaaaaaaatgtttaagtaaaatcgctttcaaactgcaagggataaaaatcgcgttatagtgatgtaaacgatgttaaaatatgtgaaattgtaaaaatgtatataaattatttattactagtatgtaaacaaaaaaaaaaaaaaagggcggccgctcgcgatctagaactag

SEQ ID NO: 3452 - DNA, 936 bp, Diabrotica virgifera
  misc_feature (708)..(708): n is a, c, g, or t
  misc_feature (840)..(840): n is a, c, g, or t
acgcgcagatacattatacgttagctctgattgggtattccaatgacatgtcaaaaattatccaatatggcggctgtggttaaagaatgttttgtcatttttattattatggttattgttgttaagttgtgttttaaaagttgtgagaacaaagacaaaagtgagttgatggttgtactgactttttaaatagtttttatatatatatttttggacttattaatacagaaaaaaagaatgtgtgtgtgtgtactttgtacgcacgttagaagttgtacttccattaaaattgtgcaaaaaatcttatgttttttagaatttctacgattcctcaagggaaaaccaattgctgggacgctccagttcgtcaaaaaatgacggattaagggccggttgttcgaacgctaatcaaaaagttgattataattaagtccccttaacaaccatcaaataacgcccctcattcgtacgtcaatcagttgattgtaataattattaattaacataacaatttttaacataattgattaataaatctcataattgtaatcaattatgttttcagcaacccaaacaaagttgacattgacagttggtgacagtaattaaatatttgataatgatcagttgattccatttttgattagcgttcgaacaatcagccctaacatttatttatcgagaatttaatatttttaattattttanaatttgacgaaaatacagaagaaagtcgaaaggctagtatttgcgcttgacaaaattatagtataaatttttgtcgaaaaaacgacgttctttagagcttatacgattcctcacgagaaaatcagttgcggngacgacgccgacgcttcattcataaaaaatgacgtattaccgttatttttaattttttggcataattttaaaaatagtttaatatttaaataaaaa

SEQ ID NO: 3453 - DNA, 855 bp, Diabrotica virgifera
cttcgattaaataaccttgacgtatatattttttatattccttgtaggcaaaaagaataaataattatgaactacatttcaaatttttttgcaaaaacacagcgtctgaaacctactactttagttaggtttacacatagtctggaatcatcacataaagttaacaacttagaaaagaaatttttggtatggacaggcaaatataaaaatgttgcagaagtaccaccttatgttactcaaagtacaatggagaggtgtagaaacagaatgagaattaaaattgcaaattatatgatggctgctacagctgtaggctgtcttgctatggtttatttgggaaaacaagatgccaagaagggaaaaactttaagtcaggaaaataaagattggcatgcgaaaattaaagctgagcatgaggccaaaaaagataatgcataagttaaattattttagagcataaaatgtatataacacattaagggccggttgttcgaacgctaatcaagaagtttattataattaagtccccttaacaaccatcaaataacaacacccctcattcgtatgtcaatcagttaattgcaatcaattatgttaattatcattatgataattaacataattggttgattaatgaattattaattaacttaacaattattaacataattgattaataaatctcataattgtaatcaattatgttttcagcaacccacacaaagttgacattgacagttggtgacagtaattaaatatttgataatgatcagttgattccatttttgattagcgttcgaaaaaccggccctaagaattatgtagtgtgtattcaattgtatataaatgcgaatt

SEQ ID NO: 3454 - DNA, 2365 bp, Diabrotica virgifera
cccacgcgtccgagttggagacgataggtcgtccggtgtcgttgttttataggcagtgattacattattgtgccggtcgatattgagttatttctggctttattacattgtcagatgctgttatgatgaagaaggagctagtgatccttttgacacttttaacaacatatgtcacatctcatcctcctgcaacttctacaaaacctgcgcctgcagttagtaattgcggatatgattcatgccatcccgtaaagggtggagattttataaacgtccacattgttcctcacactcacgatgatgtcggctggctgaagactgttgatcaatacttctacggcagcaaaacgttgatacagaatgcaggtgtgcaatacattttggattcagtcatagattctttgcgaaaggatccaaatagaagatttatttacgtcgaaacggccttcttttggaaatggtggataaaacaacacgatactgttaaatctcaagttaggaaattcgtaaacaatggacaactggaattcataagtggtggatggagcatgaacgacgaagctgccacacactaccagtcaattattgatcaaatgacctggggtttgagaaaattaaatgattcctttggagaatgtggtaggccaaaaatgggatggcagatcgatccatttggtcatagtagagagatggcctcaatatttgctcaattgggtttcgacggtttattattgggcagaatcgattaccaagaaaaagattttagattatcgacaaaaactgcagaagtagtttggaggtctagccaaaatttaggagaaaaaagtaacatatttactggatccatgtttaatgtttattcacctcccagaggattctgttttgatttgttatgttcagacgagccaattatcgacgacaaaaaaagtccagattacaacgttgatgaaagggttaatgaattcttccgagtcctcgataacatgacaagcgtgtacgatactcacaacctaattataaccatgggtgaagacttcaattaccaagacgctgcaacttggttcaaaaacttagataaattgatttcctacgcaaatctccgccaatctaatggctccagatataatcttatttactctacaccatcttgttatgtcaaagccatatatgatgaaactaaaggaaagaagaaatggtatgttaagcaagatgatttcttcccttatgcgtccgatccacacgctttttggacggggtactttacttctacgacctaccctcaaaaggtttgagagggaaggaaacaatttcttacaggtgtgcaaacagctttattctttagctgatttagatcctgtcgacagagttgacctgaatgctcttcgcgaagctatgggagtaatgcaacatcacgatgcaatcacaggaactgagaagcaacatgttgccaacgattatgccagaatactctccaacggaatcaaggagtgtgaatggataaccgcaacagcgctaagcaaaatagttgccccaaatatgagaagttacttgcgcgatgaacccgtacctactataccgttcacaacatgtcccttggcaaatattagtcaatgtgcattcactgaaaccaacaacgattttgtcataacagtctacaacccattaagcagacctgtatctaagcatgtgcgagttccagtagtaggaaacaaatatactgtcaaggatcctcaaggagccactgtagttacccaaataattcctgttcccgcctcattactcaggattccaggcagaaaaagtctagcagaaaacgaattggtttttaaagctgttgatattcccgctcttggttttaaatcatactttatacagaaatatgaaagtaatgatattccaaaggggataccaaaaggccgctcgattgatgagtcaccaaacactgaatttgatattgacccagacaccggtatgatcacggaaataagcattaatggtcattccatcaacttcacacaggatttcttgtattatcaaggatacgttggtgataacgagaaatttatcaaccgatcttccggagcttacatattcagaccttatggagatccctttaaagtggcaactaaggctagcttcaaggttaccagaggtcctgtagtaaccgaggtccaccaaacgttcaacgactggatcagtcaagttatcagggtgtatgaagaagaaaatgttatcgagtttaattggctggtaggaccaatacccattgatgatgtgcatggtaaagaaattatcacgagatacaaaacttccattaaatctaatgccacattttacacggattcaaatggtcgtgaaacactga

SEQ ID NO: 3455 - DNA, 1076 bp, Diabrotica virgifera
acactgtgataagatagtacaactattaatagttaatatacacctatttataaggtccggcaacaaaagttaacatacaattacagaagatgattctgtattatataacatttgtttttgttctaggagtggtaatatgcaaggaatctccgccaccaacagttactcttccactaggagtggtggagggatacattaaaaagacagtcaatggaaaggaatttaatgcattcgaaggtgtaccatatgcaagtccaccagttggtgatttaagatttgagaaacctgtaccagtaaaaccgtggacgggaatatggaaggcagaaacaataatgaggtgtattcaatacgatcatatgaccccagcgggacaagatatggtatcaggaactgaagactgtctatacgttaacatttatactccaaaaaaacagtcatcaaagaagctgaacgtactcctctacatccacggaggtgccttcatgtttaaccatggtggattgtatgggtcagaaatgatcatggatagagacgttatttacgttacaataaactatcgtttggggccactaggttttttgagtaccgaagataatgtaattcctggaaatggtggaatgagggaccaaattctagccctgaaatggattaaagacaacatagagtatttcggaggaaatcctgattccataacgattatgggcatgtctgctggaggagcaagtgtacatacacattatataactccacattcaaaaggcttattcgcaaaaggattttcccaaagtggttgtgttttaaacccttgggtgttgatggaagaaccacttaaccatgccaaaaaagtagcttctcttgtcggatgtccaacagaaagtaatgaagaaatggttaattgtttgaaaaccaagccagcaaaacagattgtaaatactgtaaaacattttcaaccttggctatacaatccattttcttccattcggtttgggtattaaacagctggggcggaaaacccagttttttccaaagccttattttttttgttggttaaacaaaagggcttaactctaaaaatt

SEQ ID NO: 3456 - DNA, 887 bp, Diabrotica virgifera
  misc_feature (816)..(816): n is a, c, g, or t
gtttatgaagaaaaaattgaattgaaaacaaagatgaaatctcaaaccgaatataaattaaaatcagccccagaagatgcaatttcagctgtaaagtttggcccaaatacaaaccaatttttactagtaagttcttgggatggatatgtaagattgtacgatgtaatcgctaataacatgagacacaaatatgctcacgacgatgcagcagtattggattgttgcttcaccgatgcagtccactcatatagtggaggcttagatgcagtattaaaatcttttgacttcaattcaaccaaggaaagttcagttggaaaccatgcagcccctatcaaatgtgtcgaatattgcagtgaaattaatgctattattactggaagttgggaccaccacgttaagttatgggatcctcgtcaacatgcatgcagtggcagttataatcaaggagaaagagtgtatacgatgagtgtttgtggtgagaaattagttgtcggaacagcaggccgcaagattctagtgtgggatataaggaacatgtcatacacgctacagaaacgtgaatcaaatttaaaatatcaaactagagccataagatgttttccgaataaacaaggttacgttttaagtagcattgagggtagagttgcagtagaatatttggatacgaacccagaagtacaaaagaaaaaatatgctttcaaatgtcatagaattaaagaggatggtttagaaaagatttatcctgttaatgctattagtttccatcctatacataatacttttgcaactggtggatcggatggttatgtcatattntgggatggtttcacaagaaacgtttatgccagttccatcataccatacttcagtgacttcattaagctcag

SEQ ID NO: 3457 - DNA, 1035 bp, Diabrotica virgifera
atttttatttattttaaaataataaaatattttttagtaaaagtaaagaaaaattttatttaatgatagttaattagtattgtgagagaatattttatttttataaaagaaaaatttattttttgtaccttgagtatcagggattattagttaataattatatatttattatttctctgaatttaaaagagatatcaaattcaaaagttttattgcgggacgcgctttcgacgccaggatataaacgagctcagcagtcatggctaaacgtaacaaggatgtcgaagccgaagtcctcaactggatcttcggttgcctgggtgaaccagttcccaaaggagaattcgaagatatacttaaagatggcgtcgtattgtgcaaccttatgaacaagcttacacctggatgtatcaagaaaatccaatccaaagggaccaactttcagctgatggaaaacatccaaaggtttcaagctgctgccaaaaaatacggtctaccggaagaagaaattttccagactgctgatctcttcgaaagaaggaatatcgcacaggttgctatttcattgttctccttgggtcgtatcacccaaaaacacccagaatggaatggccctacactaggacctaagatggccgaagaaaacaagaggacttttaccgaggaacaactcagggcgcacgaaggacaactcaacctccaaatgggcttcaacaagggtgcttctcaatctggacatggaggtttcggaaacactcgccatatgtaaaattttctagagacccaactccgaagagtgttagcagtatttggaatcaaatcatagagatcataacaatcagcatgctacctagctctttcgagtttaaattaatatattcggtgtaaatggggtatttatttatgtattgtttttgtaattaaagtttaaacgtatgtaaaaaactttttctaaaataactttttcttaatattattgttaattttttcaatatacgtttagattcaaaaaaaaaaaaaaagggcggccgctct

SEQ ID NO: 3458 - DNA, 2326 bp, Diabrotica virgifera
atttaattttgaactgaaattttcaagtgaaatatcttaagataatgtttaatatatttcttctgttggtaacagtgacagtggaatcggattctgtgatggaaatagaaggatacaaattatgtaccctaagcatccgagggaaaataaaaacaagataactatgtactctctgtgcctgtatattatatcttgataagcaaagacagaagcaccgctggatatggtgtcaaggctcatgattgggatggaatacctgttatctcatataaaaccaattggaaaagatattcgaaatcttgtatgaacagtcaggaatgaaaactagcctatgtaaaatcagtatcagactatgccttcctttccaaaagatgtgaaatgatccccatcgaatgagttactagacgtctggctacaggatcattcttacgcagacatccaggtgttaaggaaagattccgctttactccagtcaaacatgaaactttcttcaaaaaagaacacacctaccgcctaaatatttcgtgttggtatcacgtgacgtcacgggctatgtcgcggatgacgtgcaacggaaaacacgaagtagatttaatgactaaaacatcaatcatagttttcgaaatcctcgaaaaagtttgggcaacaagaaattgtgcacttatagacatgaagatcgaatttggagttgatgatcaaggaaacttactagtagctgacgttatagactctgattcctggcgtctttggccttctggagacaaacgtctgatggtagacaaacaggtctacagaaatctaacaacagtaacagacaaggatctcgacacagtaaaaaggaacttcgaatggatcgctgatcagttggaccatctaatccctcccaacaaccatctggtggtcattatcatgggcagccctgcagataaagatcattgcaacaaaatcaagcagcagtgcgaagatctaggtcttaatgtagaaataagagtagcttcagctcacaaaactactgattttgctcttgaactagtgagttattatgaaggtatgaacattcctcttattttcatcgctgtagctggacgatcaaacggtttgggtccagtgatctctggaaacacagattatcccgttattaactgcccacctggatcaagagatgatttgtcgagggatatttggtctagtgttaatgtaccttcaggtttgggatgtagtacagtcatctacccagaaactgcagctctttgtgcagccactaacatcgccatgactaactatattgtctggagcagactgcgtcttagaaggctgggatatttcgagtcgttgcaaaagccgataggcaatgagaagtattttaaggtttttgacgtgtatatattaaaatatgtctagtctgtaaatcccagtgtactcgacaaagtgatctaaaaaagaacacacctaccgcctaaatatttcgtgttggtatcatgcggcgtcacaggctatgacgcggatgacgtgcaacggttagtaaattagacgaagtatatatacctacttatttctatattatttattcaaaaattacaacagtcggaaactttctaaatttttggttaacattcttctatactaaattcaaattcaagatgcagcagaaataaacaaaccaagacacgtcaaatgttaccaggagcactcccaaatcataatttacaatgtatatacattgtaaatcccaaatcatgatttccaacgtttatacactgtaaattatgattcctgagtgctcccagtagtattcaacgcgtcttgatctgtttacctccactagaccttgaattcaaatttagtatagatacatacaagttttaatatcactaataaattttacgtacattccattccttcactgaaaatattcattgttcgattgtgtctccttttctttttcatacagtgtatctgcgtagccttttgcttcctcatacctcctcctcttagcccaaggggcataagtcaatttataaaaccctagaaaacttcccaaaaacccaacaaaagcaacgccaagccacactggattcccagattgtttcgaagcaaaagatcgatgccaagacattttatttagcttcaatcctttcctctgtaggcttatttaatggttgaatgtggtcgtatctctctgtagtaaacaccggtttccaaatataataaccactaacgactcctaaaagagaacctaccactaattgtgttgctgttaggttgcgaggttttctaattcttattttcattacaaaatttaaataaaaataaattacatatcgaa

SEQ ID NO: 3459 - DNA, 850 bp, Diabrotica virgifera
  misc_feature (22)..(22): n is a, c, g, or t
aattatacaaattaaatgcacnatattattgtgtatttctttaggttaacattaatagaaatcttcaaatattatttctacgcgtatatattaaaatatgtctaatagttgctgtaattccagtggactcggcaaagtgattctaaaaaagaacacacctaccgcctaaatatttcgtgttggtatcatgcgaggtcacaggctatgacgcggatgacgtgaaacggttagtaaattagacgaagtatagtcagaaatgaatgtgaaacttcgaaacccaaaaataattttggctggtaagggttataagaattaaataatcaggaaatctaacatattttgtatgacattatggaaatcacatttttaaattactttttactatttttgttgggaatgaaccacaattttactttaaaataagtttatttgacgtttaaatttgcacttcggaaatcattctcaaaatacaaacaagaacaattacttaaaacttattcacaacaaaaatagtaagttgtattaagatcccacaaggaaaatagcttcagaacaattttaaattgctttaaaacaaaatacacagattgcgcaaattgtaaaatttaagtatacagccaaatctataaaggtttgagctaaatattttgtcatagcttttatataatgcaaaaaacatttagtcaattgatgtcttgctagataaatcagtgagcaaaatcaaataatgtacaaaaattgggaagtgtcccacacaaatttaaaacttacgaatgtaaaaaacatttttctttaaaagtactacagtaaagtattatttaaatataataaagatgtccataaatgagtc

SEQ ID NO: 3460 - DNA, 1086 bp, Diabrotica virgifera
  misc_feature (1071)..(1071): n is a, c, g, or t
cgttcaataaaataccttttaagataccttttagtattgtagaatttggtattggttgtttctttagtttattaaataattcatcatccagtagaaatggcttcagtgaaagaaattggaggatacaaattaggtaacctaatcattgaaggaaaaacaaaacaggtttacgatgtaccctctgtgcctggacattgtatcttgttaagcaaagacagaatcaccgctggagatggtgtcaaggctcatgatttggctggaaaatctgttatctcaaataaaaccaatggaaaagttttcgaaatcttgaggaaagttggtatgaaaactgcctatgtaaaatcagtatctgacaatgccttcctttccaaaaaatgtgaaatgatccccatcgaatgggttactagacgtctggctacaggatcattcttacgcagacatccaggtgttaaggaaggattccgctttactccagtcaaacatgaaactttcttcaaggatgatgccaaccacgatccccaatggtctgaagaacaaatcatttctgctgaattcaaggtcaatggtgttgtgattggaaaacacgaagtagatttaatgactaaaacatcaatcatagttttcgaaatcctcgaaaaagtttgggcaacaagaaattgtgcacttatagacatgaagatcgaatttggagttgatgatcaaggaaacttactagtagctgacgttatagactctgattcctggcgtctttggccttctggagacaaacgtctgatggtagacaaacaggtctacagaaatctaacaacagtaacagacaaggatctcgacacagtaaaaaggaacttcgaatggatcgctgatcagttggaccatctaatccctcccaacaaccatctggtggtcattatcatgggcagccctgcagataaagatcattgcaacaaaatcaagcagcagtgcgaagatctaggtcttaatgtagaaataagagtagcttcagctcacaaaactactgattttgctcttgaactagtgagttattatgaaggtatgaacattcctcttatnttcatcgctgtagct

SEQ ID NO: 3461 - DNA, 1025 bp, Diabrotica virgifera
cattacgcgtccggtaaaagatgataccaaaagatatacttgaccttctagaagagtctttgggtgaaaagatagaaaattttaaaattcaggaacatgaaggcaaccaaaaaggccagggacatttaggtgaaatcgtattcctctccttgaaaaacaagaacaccggcgaagatcatcatttagtggttaaacaatgtctcacaggttctgaagagactagaaaacttatgtccatgtgttttaagaacgaagtgcatttttataaaaaagtggtaccagctttacaagcgttccagaagtcctatcctagagctgaaatttttagccacctaccaaaatgttttgcaacgagctcgaaaggaggaaaggaaaaattggtcatggaaaatttaaagctacaaggctacaaagtccatcctaagaaagtgcccctaaacagtaaaatgtacgagactatttttaagacgtatggaaagtttcatggaatttcctacgcttttaagcattaccatcctgatcaggttactgaattgggcaaagggtatcaatctacaatgaaaatgttttttgatcgaggtttcatgcaacaagcaattaccggttgttgcaacaaaacaaaagaatttttggaagaggaaggtgaaataaaaattctcgatagttttaagaaatattgtgataacggtcctcaaatgtttcttgatgcacttgactacaaaagtccatattcaatttttatccacggtgattgttggagtaataatatgatgttcaaatataataaagcgggtgaaatagaagatattaaattgttcgacttccaactggctactgtagcttcacctgttttggatctgacatacagtttctactcaggagctgacgaagaaagcttatctaagttggatcatttccttgaaatatattacaaaagccttagtgataccttaaaggagtatggatgtattgcagaaaaaattctgccatttacagaattaaaaaaagaatggaaagaacagaac

SEQ ID NO: 3462 - DNA, 1050 bp, Diabrotica virgifera
gtactgttttaattccgttaaaacatgataccaaaagatatatgtgatctagtggaagagtctttaaatgatgaaaagatagaaaacttcgaaattgaagaacatgaaggtaatcaaaaaggtcagggacatttaggtgagattgtattcttatcattgaaacacaaaaacacaggaaaagagcatcatctagtcgttaaacaatgtctcacaggttctgaagaaactaccaaattgatgtcgatgtgttttaacaacgaagtgcatttttataaaaacgtgattccagctttagaagcgttccaaaagtcttatcctaaagctgaaatttttagccatataccaagatgttttgcaacgagctcgaaaaaaggaaaagaaaaattggtaatggaaaatttaaagatagaagactacataatccatcctaagaaagtgccactaaatagtaaaatgtacgagataatttttaaaacgtatggaaaatttcatggaatttcctccgcttttaagcattaccatcctgaacaagttagcgaattaggcaaagggtatcaatccactctcaaaacgttttttgatggaggtctgatgcaaaaagcaattataggtaattgtaacaaaataaaagaatttttagaagaggaagatgaaataaaaattctcgatagttttaaaaaatattgtgataacggtcctcaaatgtttcttgatgcacttgactacaaaagtccatattcaattttgatccacggtgactcttggagtaataatatgatgttcaaatacaacaaatcgggagagatagaagatattaaattgttcgacttccaactggctactgtagcttcacctgttctggatctgacgtatagtttctactcaggagctgacgaagaagcttatctaaggtggatcatttccttgaatatatttccaaagccttagtgatacctaaaccccccacccaccttggctcccccccaaatctttttttccccccccccgcctcgttaaatccctattgcccacacctgcaccgcccctggg

SEQ ID NO: 3463 - DNA, 1467 bp, Diabrotica virgifera
aaaatatcacatctcccaggattttgcatataaatttagtttggaaaaaataaaatttaaacaacacgaggcattggaagtgttttaattgaagtttgtgatagtaatttggtgattgatggtgcgttgaactagcggaccagaaccgttttgaaccatgggtcaccacgtcacagtgcttttggctattgcctttattgctagtactgtatacgcaaactctataccatcatgtgacagtacaatctactgccaaggcaaacttctacacaccattcaaatggcaaggctgtttccagattccaaaacatttgtagacatgcaacaaaaacatcctgctcaagtaacgttacaaaatttcgagcaattaatgagtgacaagaaagataatccttctagagaagatttgataaaatttgttaatgataactttgagagtacaggagaattagttgattggactcctccagacctgaataaaaacccaaaattcttaagaaggatagatgatcctagagttaaaaacttcgctcaaagtttagtgaacgtttggcctaaacttgctagaaaagttagcgatagtgtaagagaacacgcagatcaacattctttgatcgacattcctaatggcttcataatcccaggaggacggtttaaagaaatctattattgggatagttactggatagtagaaggattactagtcagtgaaatgactgaaacagttagaggagttttagagaatttcttatcaattgtggagagatttggctttattccaaatggagctagagtatactatctaaatagatcacaaccaccattactagccatgatgatgggaaagtatatagatcaaacaggaaacaaaacatggttggaaaaacacgtagatactctcgagaaagaaatgaattggtggtggagtgaacgaaaagtaacagtaaagaaagatggagcgaactatgatatgttcatgtatgctgtcaaaagcgacacacccagaccggaatcctactatgaagatattattacgtgccaaaattttacagaatcggaacagaaagcctgttacagaaacttaaaaagcggtgcagaaagtggttgggacttctcttctcgttggttatacaatgacgacagaaaccccagtacaaacctctctcaaatagacatcattgatgtcataccagtagatctaaacgctatcctctgcagagcttgaagactctctagtttttcacttgtaggtaataacgaaaaggcagaagcagccataagcacttttaagatcagcaatttcagcagtcattacaatgattttccccaaaatcccccaaaaaaacccctaaaccccgggaaaaccccttcaaaaaaatgaaaaaacagaaaaaaaaacatgggttgaagggtttttatttaaaaattttttttttaatttaatggtgaaatataaggggacacctt

SEQ ID NO: 3464 - DNA, 1508 bp, Diabrotica virgifera
  misc_feature (17)..(17): n is a, c, g, or t
tacgatgagaacgatgntagagcaatcattagagtggcagattaagctatatgtgaactttatagacttcgagaaagcatttgatcgtgtagagcgcaaagccttatggaaattgctatagaaatacggaatgcctcccaagtatatcacaattataaaactgttctacaaaagatctacagcacgcatagtccacgaagggaagttttttttcctttggagttgtatgactacgggcgctacaaggctcattcgccgattcaacagaacaaatagatattggtacaggagttaggcaaggctgtatgctatctccgaccttattcctgatagtaatcgactggatcatgttcaaggctattagtaagtaataagactggaataagagagaatgtttttaaccaacttgaggacttggaatttacagataatatataccttgtaacagaaaaaaacaacatatgcatagtgccggattaaccaataggcaaagtaggcagttgcctaggggccttggccccaaagggggcctcgcagggcccaaaacgaaaaaataataattagaattaaataaaaactgtaaatgttaaaaaactcaaatatcgagcaagaacgtaagagtgatggtgaacgtataaaaatacattacaatgcatacttttgttcagatagaaagtccatgttgtgagaataaataatcgttaatgaatgccctttggtaatgggaacagtactaaagatggaaataagaatgacgattcgagagtggagcagaaaaacgcaagaaaaagcaggagaaagaaattacccttaagcaagatcgaaaacaggaccaaaacttactagtccgttctttaacggtaaaatattgcaaaacctctaaattttaaagaaccgctctaattgacatgaaatttggcatacacatagctaataagtcaaagaaaaaaagtgatattgtgcctatatgtgcttttgccctgggggtgaaaaaatattcgtccaaagaaagtcaggaaatggataaactggccaatttcaagcaacttttgttctatagagccttttcactaattcatcacttttcgagttatttggcagtgaatatgttcattttttcaacaaaataaccacgcccttagacggtttttcacaaataacttaaatagtaagtactttggcgaaaaaacattcgtagcaaaaatataccctgtaaaaaatttaaaaaatggtgtatacatcacgtctctacacctagcacaagcagagttacagctaatgaaaattaggatcacattcgtcaaattccaaatggaatactttaacgtgaaataatcaaaaatgaagcacatttcgaagaaaactcattacaacttattcaaagtatttaaaaaaagcttcatttttgttttataaaaaaaatttctagcatcaaagttaaacaagttacgctcaaaataaaaatagtcccttttggttttggtaaaaaaatcgagcggacgcaagaa

SEQ ID NO: 3465 - DNA, 993 bp, Diabrotica virgifera
cagcattgacagatttaaaccttccaataatagctcacctgatattagtgtggtttaggagagttattttgaatactggataagaccatatttggcataattatgacaggggtaattggagcgtttggtgaaagatcttttaggatctgcggattagaaaccaacgccattagaggtgaggattttaaactgtctaatagagtaggttgaggtaacataatgggatttggtgtagtacctaaattttgcaaaaacatttgagtattatccacatttgaacgcagattattcacatctgaaggtagaacgctatttaatctggaagtaaacaaagtgtcaatattagatgacttggcaaaaccatctggaactgctttggaatgagcgaaattaccagatttaataccaattgaatttacgttgctactagaatattcaggttgtggtgtagaactagtaggtggcaaataagtagtactagttggtgtcgaagaaggtaaatactcggtgcttggtcttgcagtcgtctgtacaaagtttataacttgttggtcagtaccactatcaggaatattattgttgtcagaaccatctgaaccatcttcggaatggtggtgaatccatggaacaaaaggcggtaccttaatgtgatcaccttctgggtggaatccttgatcatctgcggtgtatcttacttcgtacataacaccgtctggacccggataggcgaacattcctgtaactttaaggaattcgtgttttgttcctgggtagtgcacttcgctactttcttccctggagattccgttgctggtttcatatccaaatcggtatggtcctttgcctgagtcgtcgtaatcaaacttcagtatacgcgcgtttttggaatcgtctaactgtcctccagagcagaacataaacaacccaaacagcagagagaccgaatactgaagatgcatcttaattttttacagactttctttgactagttct

SEQ ID NO: 3466 - DNA, 1485 bp, Diabrotica virgifera
  misc_feature (1377)..(1377): n is a, c, g, or t
  misc_feature (1398)..(1398): n is a, c, g, or t
  misc_feature (1409)..(1410): n is a, c, g, or t
ggtgcggcggtgtgcctttttcctataaaaaaataattaatagtatttactatatcaactaattacaacaattctcggatttaatatcctagatcttaattaacgctatgtcaaagagaagaattgatgtaatggatcccttcatcaaaaagaaaagggaagaacgtggtataagtacagctgtaacaacaacttctgtctctgttaatccttactcaggattaccatttacacaaaagtatcatgagctctttagaaaaagaatttgtcttccagtgtttgaatacagagcagacttcatgagacttctaagtgaccaccagtgcatagtgctcgtcggtgaaacaggttctggtaaaacaactcagataccacaatggtgtgtagaatattcaaggaccgtaggacagaaaggtgtttgctgtactcaacctaggagagtagccgctatgtcagtcgctcagcgagtttcagaagaaatggatgtagctctgggtcaagaagttggttatagtattcgttttgaagactgctcttcagctaaaactatattaaagtacatgacagatggtatgttgttacgagaaggtatgagtgatccaatgttagatgcctaccaatgtatattgcttgatgaagctcatgaacgtaccctagccacagatattttaatgggtgtactaaaagaagtgattaagcaacgtaaggatctaaaattggtgattatgagtgctacattagatgctggaaaatttcaacattatttcgacaatgctcctttgatgaatgtccctggacgaacacatcccgtagaaatcttttacacaccggaacctgaaagagattatctagaggctgccattagaacagtgattcaaattcacatgtgtgaggaaatagcaggtgatattctgctgtttttaactggacaggaagaaattgaagtcgcttgtaagcgaataaaacgagaaatagacaatttaggcccagaagtgggagaactgaagtgcatacccttatattcaacactaccgccaaacctacagcaaagaatcttcgaagatcctccaccaaacaaagcaaatggagcaatcggcaggaaagttgtggtctctactaatattgcagaaacttccctcactattgatggtgttgtttttgtcattgatccgggttttgccaaacaaaaggtgtataatcctaggataagagtcgaatctctactggtttcacccattagtaaggcttcagcacaacaaagagcaggtcgtgctggtaggacaaaacctggaaagtgcttcaggttgtacacagaaaaggcttttaagaatgaaatgcaagataatacatatccaaaaaatattgaggtcgaactgnggctccgtggtgctccaattnaagaagctcgnngatcgacgatttagttcacttcgatttcatggatccaccagctcctcgaacactgatgcgtgccttggagctgct

SEQ ID NO: 3467 - DNA, 894 bp, Diabrotica virgifera
gttcggtctgaatcgtagtgtgcggggtcattagactcaattattcacctctaattctcagttccaaattgattaaatattacaataaaagtatagtgaagttatccagcagcagtggatttgaagaattttagagcatactatatccaatgagttctaccccgcacctaccatgaaatcttaaagccaccctacaacaacaccagggccagaccacacagagagaaacaatcaataggcgaccagcctggattatttccacattttcttttttttgagtacctccagctgctttccaacagttttgagtaccttcagctgctttctaccagtcttcctctcctgtacctccagcaggacagctgctagcgagagttagcacccttgggtgctcattacatcaacttcaagattaggaaagagtggtttgtttgggaacatttactgtgctcttattaaagacagactggttttgtgatatttagtacatttttttttatagttcaattgcacacacatttttcctgctttatattttttataggtttttttttctttacaacataatatttaattgatagcgttccccaacactctgcaatctataaaggtataaatttctgagctcagatattttccctgataatagtagtcggtactcttatcttgattatttttaggctgtgttccacttttgtataattatttaaactcattccattattttagtatatgtttaattaaatttttaaaaattaacttcacatattagtcaaaattgtaattattaactttatttaacttgaacttattaactttacttaactttaacttattaactttatttaactttaactttaatttattaaattcatatgaacttctggattctat

SEQ ID NO: 3468 - DNA, 1189 bp, Diabrotica virgifera
  misc_feature (1118)..(1118): n is a, c, g, or t
gattcagctgtgaacgtgagccttggattgccattgtttctcgagtgttcggtctgaatcgtagtgtgcggggtcattagactcaattattcacctctaattctcagttccaaattgattaaatattacaataaaagtatagtgaagttatccagcagcagtggatttgaagaattttagagcatactatatccaatgagttctaccccggtaaatacacattttattaagtattttattcagccattttggaagtccttgacatttgctaactaagtttcacatagtctattttcatggtttttatgttttattttcatggatcaaactcatctagagataattcaatattcgttgttaatttgtgcttccagttggaaaatagagctaatttaaactccattttttatattcctttcaagtctacagaactcctatcttttgaacgatgaacaaataagtatccatcgcttagtcttactatatttcatccttgtataatatatctatataccggtgtatatattataataaaatattctttcacagtaattatattttgtatttcaattggaaattacttgtgttatttgaccaaggtcatctgatagcaacctgataaaaggtcaagctgtctagtcattcaagtttttggacttaatgacctatttcttcttattcccataggaataaaaacacctcctcgtatctcttgcttctttttttttgacattggtagattggtagtaacaccacactgtgttttttttagcacctaccatgaaatcttaaagccaccctacaacaacaccaaggccagaccacacagagagaaacaatcaataggcgaccagcctggattatttccacattttcttttttttgagtacctccagctgctttccaacagttttgagtaccttcagctgctttctaccagtcttcctctcctgtacctccagcaggacagctgctagcgagagttagcacccttgggtgctcattacatcaacttcaagattaggaaagagtggtttgtttgggaacatttactgtgctcttattaaagacagactggttttgggaaatttagtacattttttttttataagtcattngcacacacatttttcctgctttatttttttttaataggttttttttttctttaccacataatatttaaatt

SEQ ID NO: 3469 - DNA, 946 bp, Diabrotica virgifera
tgctagtgtttttatttttagtttgaatttgaaaataacataaaacaaataacaataaaaccatggtgcggcacaataatcagttaccaaataaccttccccaattacagaatcttatcaaaagagatgccgtctcttatcatgaagaatttatgcagcaacttaaacattttcacaacactttggaagtcttcaagttagcgcctaatcaaaacaacaaaactctagatgaattggtgatgttcctagcacaagtggcccagtgctatacaaaggagttagagaagttccctcaattattaattgatcttttgcaaagccataatactgctttggataacaataccagaatgactttatgcagggctttgattttactgagaaataaaaaattgctagcacccactgatttactagaactgttttttcagctgttgaggtgccaggacaagtctctgagatcgtttttggaaaaccatataatcacagatatcaaaaatattaacagcaaacacaaaaatgcgaaattaaacacaacattgcaaaattttatgttcacaatgttaaaagatactaatactagagcggcaaaaatgtctgtagatattatgattgaactttacaagaagaacatctggaatgatgtgaagactgtgaatgtgattgccactggatgtttctctaaaataactaaggtaatggttacttgcttgaaattcttcctggggaaagatccggatgaaaaagactcggacgattcagattctgacaatgaagttgatccaaaagaagtaatgatggctaacaaattcaataagaaaacaagaaaaagggagaagcaactggacaaagtaaaaaaattagctaagaaagcacaaaagaagaaatcacaaggcccagcttttaacttttctgcagtcatctacttcacgatcctcaaggtatg

SEQ ID NO: 3470 - DNA, 503 bp, Diabrotica virgifera
cacgcgtccaaaatcaatccttgaaaaaaggcaacttcacggaacttttacaaaaacttagtaaggttctaaaaccccaggcttacctattaacacacgcatcaccggtaacaattgaaaaaattgatgaagcttatgacattccagcgatttcaaagctactagacttgatcaatgttatggttttcgatttccacggcgcttttgacaactatgtaggacatatctcaccgctttttcccgctaaagttgactacgattactataataataaaacatacaatgtggatacaggaattcaatattggttgaatggtggtgcagatcctgcaaaattaaacttgggtgttgtcgcttatggaagaacttttactttggctgataaaaataataccgctctatatgctcctgtcaaaggtggaagtacagttggaccttatacacaacaatctggatatttgggatataatgagatttgcagatactataccgactcaacttac

SEQ ID NO: 3471 - DNA, 1062 bp, Diabrotica virgifera
aaaattagtgccaacaactgaaacagtgacattagttcgagcgtagcaagagcggttgaattaaaaagtaacttccacacttccagtaacttcgtttttgtcagttcttctagttttatacaaagaaaaaatagcaacatgagtaaattcgttgttttattggcatgtttggcagttgttggctatgcctcagcattagaatgttatttctgcgacgattgtcaaggatctccaagcagctggccaaaaagagcttgtggcactgtccaacccgcagctggtatggaatgggcgtgttcacgaattgattacaaatccagagctacctacaaagatgccgtagacagaggatgcgcagcagtcccaaaggtgaatggaaaattaaacttcaattgcccaacaaccaagggagaaccaaaatcttgtgccgcctgtcaacaagacttatgtaactcagctccaagcatacagttcagctttgtggcactagcttctgttgtattggctgtaattgttccaaagttattgtaacttaatgtaagtgcatgaagtacacaatgaaaatacttgcgggttacaatcgaataagacacacatttatctaaagaactcgcacattttgtaataataaacagagatttacaacttaaaatttttgtaaaatagcaatatttgaaatatcattacatttgtctatagccacaaataataataatagttaatgtattcttgttattgtattgattttttaaagtttaaataaatataataaatattgaaatcaaaaaaaaaaaaaaggcagtagcggaaaatgaagaaaaactagcccaaccagtaattgcacaagacgcgaagccagcagagcaagaactaccactaccagaccaacttcttcccacatcagaaaaacttcttccccaaaaaccaagacccattaccctgccagcagcgattcctcatcagaatctccctctgagagcagcgatgaatcttggagaaagaaatcatcctccgagtcctcctcgagcggaaaagaatccagcgaagtaaaaatccaagaaa

SEQ ID NO: 3472 - DNA, 1126 bp, Diabrotica virgifera
  misc_feature (906)..(906): n is a, c, g, or t
gatacaagactctaaacagacgtcctgctaacgcgtccggtaaatccagaagaaaaaccagaaggtgaaaagaaagccaaatcagaagagcccaaacccgaagagcagaaggtacaaaaagttgaagaagccaaaccaagcgaaggaaaatctttagagcaacaaccagctgaaattaaacctgtcgaattagtaccagtagcagaagaaaaaccaattgaaggacccaaactaccagaaggtaaattagagaagcttccactgccagaaaaacctctggaagagcccaagccaaccgacgcagcgaaaatcgaagaacccaaatccgcagaagagaaactacccgaaccaagtgcgtccagttcttgaactgtatttccatgatcgtggaaatttcccaagaatgactgatgaggttcgctggcgcttttgttccacaacacacttaatttttttagtgaacaactgggctgaccgaacctcgaatagtagattttatttatgtgtgctcaaaaataaaaaaatcgtgttttgttatagaaacagtgttgtttttattttatagtatttttgttttattatttttttgtttgtttcgatcagaattcattatttctttttgatttatgttaacgacaagccaggaattcattcgaccttgtgaatctaaccatagtttctcttctaatcgatttagtttaaggttatgtattaaaagcttttaataaacttttatacattaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacacgttcctcccatcccagcaatagatcaatcttatacaaaaaactccaaccaacnggggggggggggcgcctataaaaaaacacaatttctcggccggtgaattggtactttttttttttttattgatgaacaaacactaacaccatgacgggcggcggttttaaacaccacctggggggcgaaaacccttgctttccccatttatttccttggatggaaatccctctctctctctaaggggggggaaaaaaaaaaaggccccccccctatcccc

SEQ ID NO: 3473 - DNA, 1263 bp, Diabrotica virgifera
cccacgcgtacgcccacgcgtccgcccacgcgtcccccgacgcctcgtgtttttggtgtgacttttttttatcacgggttattttttcgtgtgttgcgctcatcgacaaaccacaagaatgaaacttatcgtaggattattattaatagccacagctctggcatacccagtagcggaaaatgaagaaaaactagcccaaccagtaattgcacaagacgcgaagccagcagagcaagaactaccactaccagaccaacttcttcccacatcagaaaaacttcttccccaaaaacaagaaccattacctgccagcagcgattcctcatcagaatcttcctctgagagcagcgatgagtctggagaaaagaaatcatcctccgagtcctcctcgagcgagaaagaatccagcgaagtaaaaatccaagaaaagaaacttgccgaacctctcccagctatcaaagagccaattaaggaagaagtgaggccaatcgatccacttcctgttttgaaaccatctgaaccagctcaaccagatgttttaccagaagaacctaaactaatagatcccgtagtgccccaaattgctgctaaagcgatcccagccgaaccagaagagaaacctctagctctgccaactctagttgctgaagaaaaaccagctgagcaagctccaaaattggtcgccactgaaataaaagaagacaaaatcttactcagtgaacaaaaagtagaagctagtcctgtagccgaagaaaaactgcccgaattgaagaaagccgaagaacctgctccacaacttgaaggtaaatcagtactcgaactacctgaggaaaaaccacaacctgcacagcctgaaggtaaattggaaccagtacaacctgtccttgcggcagttccagctgtagaattagaagtaaagccagaagaaaaaccagaaggtgaaaagaaagccaaatcagaagagcccaaacccgaagagcagaagggacaaaaagttgaaaaagccaaaccaagcgaaggaaaatcttttaagagcaacaacccagctaaaaataaactccttcacgaaatttaccacccagaaaccaaaaaaaaccgcccccgacagcccccccaggctcaactcaaaaagaggaattttacatgaaccccgttttcccccgtggcccaaaaaaaaacccctttgggaaagaaagccccacgacccaccccccacccccaagcgggaaaaaatctaaaaaaaaaaccccaaaatacctcccc

SEQ ID NO: 3474 - DNA, 1302 bp, Diabrotica virgifera
cttttctttgtgattgtgtgtaggagttgaatttttttatagctttatttataaaattaaaattaagataagatattttataattatcgagaactctagatctcgatagttttagctggcaagaaattaattcgtagaaaatggtagatacggagagacttaggacttggctaactgcttatcacaatcctgatgtagcttatagagaaataatcaacatcaccacacaatacagaggtttacatccagaacagagtgtctacaccttcaacgatggcacaagaatggatctcattaacttaactggtacaattcctgtgcgttacaaaggcaatatttataatattccaatttgtatatggttaattgacacacatccagagaatgctcccatttgctatgttaaaccgacttccgacatgtccataaaagtttccatgtttgtagatcaaaatggaaaagtttatctgccatatttgcacgattgggtgccgaatgaatcagatttgctaggattaatccaagttatgattgttacatttggcgaacaacctccagtgtttgctagggccaaagacaatgaatcgtatccgtcaaattcattcatgcctcaaccatctggtggttacatgcctccgtatcctaccccctacccaccagcatcaggaggtttcggcgggtaccctccatatcctccaaccagcaacaattctttccaaggatatccaccctacccttcttcgcaaccgcagtatccatttaatttcccccctggacctcaggccggaacaggtactataaaagaagaacatatcagggaatctctgatgacagctttggaagagaagctgcttagaagaatgaaggaacaattccagcagaatcaagctgaactagagacgctcaagaggacacaggaggagttgaagcaaggaaaattgaaggtggacgggttcttgcccccatcagcaaaaaaaaaaaaaaagggggggccctccaaaaagaacccaatttaacaaaccccggggtgcggaagcccaaatttttcttaaagggccccccaaatttaatttccggggcgcgcgtttttaaaaagccggggagggggaaaaaccccggggtttcccccacctaatccccctcggccaaccacccccccccttccccccccgggggggaaaaaaaaaaaaaaaggccccgcccccaccaaatccccctcccccccaccatagggcgccccccccgcaaggggggaaaggggggggcccccccccccgtgacatgggggcgcaattaaatagc

SEQ ID NO: 3475 - DNA, 919 bp, Diabrotica virgifera
agcaattctaaaagcactagaatatgtacaacaggaagaggaacagaatgccattatcttttccgattcactttcagttcttaaaattttaaaatccaactcaaacaaaacacatgatattagctttaacatccaaacaattattaaaacattacaagatcaaaataaatttataaaattcttctgggttaaagcacacgtaggaataacaaaaaatgaaattgcagataaagttgccaaagaaagcatagaaatgggggaacagataaattgtgaattaactacggatgaacaaataaacatatcaaaacataaaatgatgatacaatggtcctacttgtggcaagaatacacctttacaaatccaacacgatacaccagactagaaaccaaattgaggaaaaaaccttggtacaataagtacaattacaatcgcaaaagcataaccactattagtcgaataaagtttggtcacacatgttatccagcacacttacataaaatcaaaatacttgagagtgatctttgtgaagtttgtaataaaatcggtgatctggaccacatcttttttgattgccaaaaatatagggcttaatccaatgcgtgttcagaaaacttctacaattgaacattgaaagcccatataacataatgcatcttcttgctttaaacagaaaagaaatttacgattgtttgttatattccgtcagaataacaaaaatacaaatttaacaataccttttgctgctaccttatgtctttccttaatgtatatataccttatctatcagaggcctaccgttgatcgtttataaaatgccctgatcggccccctgggcgagaagagtgtaatccttgtgttaaattccttgtactctcttttacaaaatttgtatctggctgtgtggggtttaccctt

SEQ ID NO: 3476 - DNA, 1089 bp, Diabrotica virgifera
agttggtaaaaatttatgaaggaattttaatcttaagagaaagccttttgctttagtttatttacaaactaaaagtgtgtgttatatgtatgatatgcataaagtgtaaattttacctaaaagtacaaagatttgtataaagtacaacaatgtcttaccagccagggagagtaagaggtaggggtagaggttctaacttccgtaatgttagaggaaatgatagaaaactgaacactggatatccaactgataccaacactcctagtgtttcgggtacgaacatatccaaacatgacaataactgctgctcagaaataactttttctcttgaacttgatgaattcagccaaagcttcttcacggaattaaaaaatatatggaatatgttgaagaagagccctccagttgtaagcaaacttcacatacactttaacaatacagataacccatatatacaagtattacggctgctctacaattgtcaggaatttcataatgccaaaaataaatctctaccaatgtttatcaattgaagagttcaaaaatttggagtacaatgaatagggataatattaaacatcttttagtacccccagactaaaactgatgcctttaaattatctttaagacaaaatactttggcgttgaataagttgcttatagatgcgtttgagatgaaacaggagcgagagatatttttgagtatttttaagtgcctaaattgacagaaacagtataaagaggcttgtcaatatactaaaatgctaaaccttcacgactgtttcgacatttacgattttcttaatacctctcatattacaaaataaactttacggagttgatgatttttttaaaaaaaatccgaaaacatcaacagaacttggggaaatggatgggaggaaaaatttagcaaatacccccggtaggaaaaaatttgggagaatattgaagaaaaaccaacccttccccaattttaatggtaaaacaaaatggcttggcaaaacctttgggaaaaaaataaaaaaataaaaaaaggggggaaaaagtgtttaaatttatcccccctttgtatttaactccccccaattt

SEQ ID NO: 3477 - DNA, 1739 bp, Diabrotica virgifera
  misc_feature (12)..(12): n is a, c, g, or t
cccctatcacgncctccgcccacgcgtccgagaacatatagctgagtgacttcagagcgagaaatttttaatccagaatgtttatttgaattggaaaaaaatctcactgtattattcacatttttcttatataatagtgtctagtggacaaagtataatccaaagtgaaggatgaaggagaatactttatcacttatttgttctggaaatattttgagaattgtcgttcacttattttagaagataggcttaaaaatgatcatgtcaaagccaactaaggttattcaaatgagcagaagattctacagctctggctctaaaaacgatattgttattatttctgcagttcgaactccaatgggtacgtttctgggacccttagcacctttatcagctcccagattgggagcagttgccatacaagcagctgttgaacgagctggaattcccaaagaagaagtcaaagaagtcttcatgggccatgtttgtcaaggaggcgctggacaggccccagccagacaggctacagtttttgcaggtcttccaaagtcaacaatatgcacaactgtcaacaaagtatgctcatcaggcatgaaatctgtaatgtttgcaacacagagcttgctactcggcgaccaagacgtcatactagccgggggaatggaatccatgtcgaatgtaccatactatatgagacgaggccagacaccatatggaggagtacatcttgctgatggcgttgtagctgatggtttatgggacgtttacaacaaattccatatgggtaactgcgcagaaaacacagcaaagaagctgaacatctccagggctgaacaggatgagtatgctatcaacagttacaagaaaagtgccgaagcatacaaaaacaatgcttttgcttctgaattagtatcagttaatgtaccacaaaggaaaggacaaccagatttggtggtttcagtagatgaagagtacaaaagggttaactttgaaaagtttaacaaactgccaacggttttccaaaaggaaaacggcacagtaacagctggaaacgcttcaactttaaacgacggtgcagctgctttgatcttaaccactgccgaaaatgccaagaggttaaacgctaaacctctagctcgagttgttggttaccaagacggtgaatgtgacccaatcgatttcccaatagcccctgccgtagctattccaaaattgctcgaaaagaccggagtcagcaaagacgaggttgccatgtgggaaatcaatgaagcgttcagcgttgttgtcttagctaaccaaaaaatccttgggctcaatccagacaaagttaacatccacggaggtgctgtcagtttgggccatcccatcggtatgtctggtgccagacttatcactcatctcgttcactctctcaaggctgaagagaaaggagtcggtgctatctgtaatggaggaggaggagcttcttccatgatgatcgagaaattgtaagtggatcttggatctcagaactgaatcttaggtttaagtgcaaaaatcatatattttttaagaattttagatgtgcatttatgaactgatattataattttataaactattttaaatcctgaatatagtatatcccttaatgctcttttaaagtacagtatgcggcaaaataaactgctgaaaatgatattgaaataaactggaaagtctcagatacagaatccaccattataattaaaaataaaaat

SEQ ID NO: 3478 - DNA, 1244 bp, Diabrotica virgifera
agttgaaggcacaacaacttacgctttttagttttaaattttaaactcacatttttagtatggccgaaagtgctggaaactggtgtctcattgaaagtgatcctggtgttttttcagaactaattagggaatttgggtgcaaaggggtacaggtggaagagctgtgggggctggataacgacttattcgaaaatttgaagccaattcatggattaatatttttattcaaatggacgaaagacgatgacccatctggttcactagtacaagatagccgattagaaaaaatattctttgcaaaacaagtaatagagaacgcttgtgccactcaagctatcctcagtgttctgttgaattgccgtcacaatgatctaaagttaggacatacacttactgaactaaaagacttttgtcaaggtttcgatgctaatatgaaaggtttaactattagtaattcacccgtgatcaggaccgttcataattcatttgcgagacagcaattgtttgaatttgatccaacaatggcaaacaagaatgatgatgcatttcattttgtaagttatgtacctatcgacggcagattatatgaactagacggtttgaagcaagggcctatagatttaggagctataccggcagaagctgaatggactgaaattgttagacctattatagaaaaacgaatacaaaggtatagtgaaggtgaaatccatttcaatcttatggccatcgtctcagataggaaaatgatgtatgaaaaacaaatagaagaacttcagaaacaaagtgaatcttcaggaatggagacagacacccaacaggctgaaataacgaggttacgtcttcttatagctgaagaaaataacaaaaggcatcagtatcaaatagaaaatatcagacggaagcacagctatttacccctaattgtagagatactgaaaaattttggcgaaaaaatttttggggaaaaaaaagagaaaaattttttccctttttttttaaaaaaaatataaggaaaaaaaaatttattaaaaaaacaaaaaaaacaaaaaagccccccccccttgaaaatttttttttaaaaaaaaaaaatttttttttttttataaaaaaacccccttttttttttttttttattttatttattaaaaggggggggggaagggtttttttatataaaataaaattaaaaatataatttaaaaaaaaaaaaaaaaaaaaaaaaaagggggggggggcgcccc

SEQ ID NO: 3479 - DNA, 2190 bp, Diabrotica virgifera
gtggaaagtaatgatacagaagtggaagaacagaccgaatctgaggaagataagtgcattaatgtttatctccgtatcaggggtgatgttaatgaatatgctttatatgaaatcgatggaaatagtttgatttgtaatgtaccagaaggttcattcacctttagaaatgtcaaatcaggcgattctatgaaaagaaactactcttttaccaaaatttttggccctgaatatgatcaacaaactatttttaattatatcataaaacccaaagttttatcatttattaatggtagaagttccacaatatttacatatggagcttctggttctggtaaaacatttactattgttggcacaccagaggaaccaggtttaatacctagagctttagaatacatgtttagatccataccaaaagtgtctcaaatgccagatgtacaactattgccaaatggtagcacacaatatttttctaaaagtgttatggacatgcatgagcagtataaaaactctattatagatactacaatagttgatgatattaggacatacaagcgaatccaagaaaggttgagttctgaaccagttgctaaggttgaagatgatcccaatgtctctgtaagtgtatgggttagttttgcagaaatttacaatgagattatttatgatctgttgagtcttccagcagcccgaaatcaaccacgccagagactagttctgggaaaatcgcagggcaacacattcataaagaaattgacatatttaaatgttagaaatggtctagaagcttatcagatacttcagtatggattacataatctcaattatgctgctactgccatcaattcccattctagcagatctcactgtatatttactgttagtctcttgcagacttccaagtgcagcaatgatgtgtatgtcagcaattttaacttttgtgatttagctggatccgaaagattaaaaaagaccaataattttggtgacaggctgaaagaatcaaataatataaacacatctttacttgtattaggaagatgcatggagaatataagaaaatgccaacaaataaaagacagtagattaataccgtttagagaatcaaagttgacacaaattttccaaaatgcccttttaggtcatgagaatgtagagatgattgttaacatcaatccttcacgtaatatgtttgatgaaacagtacatgttctcaatttttccgctatcgctaaaactgttattgttaaagaagagctacctaaaccaattaaaaaagaaactagattttctttattaatgaaagcagaaaattctccaagacttaaggaaattgtttccaataaactagaagtggaaaaacttaaaaagaaatacaatagagccaaagaagagattagaagactccagactgtagttaaccgtcttaatgaagaattaagagacggcttaacatcagatgaaaaatctgaagaaattaaacatttgcatcgggccattgataaaatcattgatgaaagggatagcgtcatacaaatctacgagaaaaaactggtagaaaacaccgatcatctatccgcagtttatgaggagagtattgcacgttatattgaaatgcataaaaaagataaagaagaagccattcaaagaattagaaaagaatacgaagaaagaattgctgaaatgcaggtcattacaatcagttcaagtgatgaagaagatgattcacctaaaaaatctaatagtaaatcacagaaagaatttaaagatagaattttacattaccagaaatcttgtcggtgaaatgtctgatgaattgccgagagaaaagagaagcttaaaaagacatggaaaacttgttagaaaagggcgaagagcactctgcctttccttgaatgggacctaaaaaacttttcccaaaaaaattataaaaaaaaattcaaaacttgttatgttaccctgaaaaaatccaaattgttaaacctaaaaacttcaaaaaaaaaacttgtttggggttggcttttgaaaaaattttatgggaatttggatggttaattgagtttttaaaaaatttttgaaaaaaaaaaaaaaaaaaattttttttcttttttttgcccccccaaaaaaaaaaaaaaaaccaaaaaaaaaacttccccccctctcccaccccccccaaaaattttttttttt

SEQ ID NO: 3480 - DNA, 1327 bp, Diabrotica virgifera
  misc_feature (1084)..(1084): n is a, c, g, or t
  misc_feature (1150)..(1150): n is a, c, g, or t
  misc_feature (1212)..(1212): n is a, c, g, or t
aaccttagctctaaaagccttcacccatactgcagaatatgatgcggcaatttctgactatttccgaaaagaattctccagtggaatctcccaattgaccttgaggtatggtacgaacccacatcaaaagccagcacagctatatacaaccttggaaaagctacctctcaccgtcgttaacggctctcctggttttatcaatctttgcgatgctctcaatggttggcaacttgtaaaagagttaaaagctgctcttggcttgcccgcagctactagcttcaagcatgtttcgcccgcaggagcagctgttggcgttcctctcgatgaaactcaggcaaaagtatgtatggttgatgatttagctggaaaactgacaccacttgcaatcgcctatgccagagctagaggcgctgataggatgtcttcattcggagacttcgtggctctttccgatgtttgcgatcaagtcacagctcgtttggtctccagagaagtgtcagatggtattattgctccaggatatacacccgaagcattagagttattgaaaaagaagaaaaatggaggctactgtattttacagatggatccagactatgtacctagtcccatcgaaagaaaaatcttattcggtttaaccttagaacaaaaacgtaacgatgccgaaataaacaaatcgattttcaccaatatcgtcagtgagaacaagaatcttcccgaatctgccgtaagagacctaatcgtcgctactatcgctcttaaatacacacaaagtaactcagtatgctacgccaaagacggtcaagttatcggaataggcgctggacagcaatctagaattcattgcaccagattggcgggagataaggctgacaattggtggttgagacaacaccccaaagtgctcaacatgaaatttaagaagactgtgaagagagcagagatctctaatgccattgacaattatgttaatggatcagtaggtaaagatatggatagatcccttttcgaatcaatgtacgcagaagttcctctagaattaacgccaacagaaagacaaacatggttgagccacttgaatggncgttgttgtatcttctgatgcattcttccccttcagagacaatgttgatagagcaagactgagtgnagtctcatacattggcagtccatcaggttccacgaacgaatgacgaaaagtatcaggcttgncacgaacacaaaatcgtcttgcccacactaattttgcgggttgttcaccactgatctggtagctatatacataacgtactatttttataaaatggtataaaatattgtttttgct

SEQ ID NO: 3481 - DNA, 1338 bp, Diabrotica virgifera
atttaaactgtaccagtgttaaaataagctactcttaaattatttattagttaagtgagtctcactgtttacaatggcaacaggtagtggaaaaggaaaaatcgcattattatcagtatcaaacaaactaggccttgttgagttcggtaaaaacttacacagtcttggattcacattggttggtagtggaggcacagctgccattcttcgagatgccggtctcaaaatcaaagatgtctcagacgtgtcaggagccccagaaattctcggaggaagagtgaagactctacaccctgttgtccatggtggaattctagctagattgttaccttccgaccaagaagatctcaagaaccaaaaaatagaaatgattagagtagtagtttgcaatctatatccattcgtagaaactgtatcaaaccctaaagtaacgctagatgatgctgtagagaatatcgacattggcggtgtgacactcttgagagcagcagccaaaaaccatcaaagagttacagttattaccgatcccagtgattatagtaaagtcattagtgaattaagaaataatccagagaaagacacctcattacaaaccagacaaaccttagctctaaaagccttcacccatactgcagaatatgatgcagcaatttctgactatttccgaaaagaattctccagtggaatctcccaattgaccttgaggtatggtatgaacccacatcaaaagccagcacagctatatacaaccttggaaaagctacctctcaccgtcgttaacggctctcctggttttatcaatctttgcgatgctctcaatggttggcaacttgtaaaagagttaaaagctgctcttggcttgcccgcagctactagcttcaagcatgtttcgcccgcaggagcagctgttggcgttcctctcgatgaaactcaggcaaaagtatgtatggttgatgatttagctggaaaactgacaccacttgcaatcgcctatgccagagctagaggtgctgataggatgtcttcattcggagacttcgtggctctttccgatgtttgcgatcaagtcacagctcgtttggtctccagaaaaaaggcaaatgggattattgttcccggaattaccccccaaacattaaaattttttaaaaaaaaaaaaagggaggggttgttttttttttctaatgggttcccatttttctcctcccctctcacccctaaaaaaaaaatttttttttttctcgttttaaaaattataaaaaaaaaaaacgggagccatggacaaaaaaaaaaaaaaaaaaattttttttttccccccccattattccccgggggggg

SEQ ID NO: 3482 - DNA, 1073 bp, Diabrotica virgifera
  misc_feature (913)..(913): n is a, c, g, or t
  misc_feature (949)..(949): n is a, c, g, or t
  misc_feature (976)..(976): n is a, c, g, or t
tacgttctggggtactaatgttacttggaatttgaaacttcaaaacgaggtgttcagaacgtcaattgtgcggtagatgtgtatgattgctttcttgtgttatttattttgttccattccgatctaaaatgttgaactttgaaaaaataaatgtctttataagaattggtgattcgctgcacacttctgcaattctatatttattatgcagtatcataaaggaaaagtcatatgctggtatatctgccaagacgcagttcctctacgccgcagtatttatcaccagatatcttgactcattcatggtattcagatcatattacaacactttagtggaagtgactttggtgcttgtttcagtatgcacgtttttactatcgttcaaaatgaggagcacatacgaaagaaaatatgatttcttttggtccgaagttctggttgccggggcattgatattagcaatgttcgttaataacagtttagaagctattgaagtactcaggacattcagtcactacttagaggcagtagttttgattccgcagatgtacatgatgttccagagtaaaaaaattacccgccccatgattttgtatttattcttcttggttctgtacaaaataatgtacatttgcaacggtatctacctatacaacaagcacaaccagttcgatgctatatcagagatagctggttttgttaatgtcatgctattcttcattgctctggaaattatttggcgctgcagtaaaataacaagtcacgaatatgagcagaaggatgtgactaaatggaaaaatatattcttcatcagtggtggtcttacaaaacctgaaactgccaaaaaagatgctcctttgattactgaacaagtttaccagcctgtagtcgtataggacgttataaaatattnaagtgacttaagtttattgttatcttatcttgttcnttagggaggtcagagactacaatgctnttttattgatttttattgattatctgactaatgtattctttagtttacgaaaattggtaacctttctttatgtatataaataaaaaattgtagaatt

SEQ ID NO: 3483 - DNA, 692 bp, Diabrotica virgifera
aatctaacctcatttttgtatataaatttctaaaaatttaataattttgcacgtgtttattttaaaccgaaaattctacatgaattaaataaattatgcccctaggtaattgggctaaaattggaattggttggtctgttgtagtagttgctggtatctattccttttatttagccaagtcgaatgtcgaaaagaggcgctatgataatatgaaaataagagaacgtatgagagaagccaatagtggagattattcgcccagttatagaaaattttcgactataaagtccgaatcctaagcatttattatattatatttagttaaagactttacacttaaaaacaacacatcatgtcccaaaaagaagtgcaaaatatgcaactaatccaagagttggaaatagaaatgatggcggatatgtacaatagactgactgcaacttgtcacaagaaatgtgttcctccagtctatggagatgcggaaatagcaaaaggtgaagctgtgtgtttggacagatgtgttgctaagtttctagatatccatgaacgcattggcaaaaaactgggccaaatgtctatgcaagatgaagctttgttgaagaagtagtatgttaccgagtttagtagttgttataattgttctgtggtattttagttttgtttatataactggttgatacaaaagaagaaaa

SEQ ID NO: 3484 - DNA, 537 bp, Diabrotica virgifera
aaaatcggcaaaatgaaattgatcttagcagttctagccatttctgccgcatattgcgtagctgccccagcagaaccaaccaaggaacccattccaatagttaaattcgaaaatgaaggagtaaatgcggacggatcctacagttggaattatgaaaccggaaacaacataattgcccacgagcaaggaacagttaaagccggaggaaaacccgacgaatctgaattggaggttgtaggaggttatgaatacaccgacaacgagggcaacaaggttcagatctcctacatcgccaacaaagacgggttccaacctcaaggagacgttctccccactcctccaccaatcccaccagcgatcgtcagacttctggaatacctcaaagcacatccatctgaagaagatgaaaaagaacaaaacaaagtttaaagtttagttagataaatggcagtttttgtaaatattttgtaaataaaatatattttaaacccgcaatcgacggctgggcggtctagagtgtccgggcttacgtgactg

SEQ ID NO: 3485 - DNA, 1295 bp, Diabrotica virgifera
ctcggttccattccatctaatagtagtagtagtagtagtagtgaatgagctttcattcgtttcggcgagggattagattttgtactcgtgaattgggtcaggttatttggcgccatgaatcttcttggaaaagctctcgtttttgtattgatgggttgtgcttccacccagaattttggtcaaccaccggaaggctttggaaatcaaggaagattcgattttggtaacaatggaaatagtccatttggtagcggtggaaacagtccatttggtagcggtggaaacagtccatttggtagcggtggaaatagtccatttggtaacagtggaaatagtccctttgggggcaacgcaaatggaccatttggagataatccagagctaaatcaagttatgatgcagggtaaatctttctttgatctgatccctcacttacttaagcagaaatgtgacgaatctggacattctgacgtacttcagtctattcaggaacagttaggtcaaactcaaaaatgcctgaaagacaaagtcaatttagacggagaaaaacttgctgatgaatttgctggtgcttcacgaactggcgaactcgacaacttttttaagaaaaactgtaaggtttggcctgacatccatggatgtgttcagcctatggtgacttctgcggagaaatgtttgactagcgatgaaaagcgcaccgttgaaaagttattttctctcgccgatgacacgaatactttcttctgcgagaacaatgccgatcgccttaagaaactacttagtggtaatcttgcgcaatgtatggaaactgtaggtaaagatgtccaagaatgtgcagccaaaaccctgcagaataggcaaaaacaacaacaacaacaacaaaaacaacaaaccagcgataaaaaggtcatattcagttttgatgaagaaacctgtagtgacttccagtctggacgtaaatgcgtcacctcaaaagtagctaaatgtgaatcaaaagatacttccaaaatcgtagatgactatttagcactggttcaagaccatgtttgcagttcagcgtcaagcttgtcttggttttcgtttgctaatattttgttattggtaggaacctacttgtattctaggatgttctaagcctttctggtgtacaagaactagttaaacaactggctacctcacgaacattcttgaatataaatgcttctggccaaatattatgactgtaataggtatgcataactttgtttacatttataaatacctagcataaagggaaacaattcgtgtctacctac

SEQ ID NO: 3486 - DNA, 2629 bp, Diabrotica virgifera
tacagcttcgtgtgaatctgtaatgaagaacctccattacagcttcgtacaaactcaagattcacacgaagctgtaatggaggttcttctatttgattttcattatcaaaatggaggttcttcattacagcttcgtgtgaatcttgagtttgtacgtaacctaagatatcatagagctgagacagtatgtttttattctttttcgatgatagagctttcaaaatgtcttccttttttgctaatcttccagcattaactgcttctatgtgagctttagcctgttttagagtcccgatattctcattttttaattgattcctgaggttctcaattgttttgctaaaacttaagatctcctcagatgctggttccttttcagtcaataaagtttcttgatgaaagctaataccagaggttttgcctattttttcaacaacttcttcaatgttgatcccttccaaggatttcgatgtacttgtatctgttaaagttatggtttgctccgattcaatatgattgcccatttcttctctagtgaatgagctttcattcgtttcggcgagggattagattttgtactcgtgaattgggtcaggttatttggcgccatgaatcttcttggaaaagctctcgtttttgtattgatgggttgtgcttccacccagaattttggtcaaccaccggaaggctttggaaatcaaggaagattcgattttggtaacagtggaaatagtccatttggtagcggtggaaacagtccatttggtagcggtggaaacagtccatttggtagcggtggaaatagtccatttggtaacagtggaaatagtccctttgggggcaacgcaaatggaccatttggagataatccagagctaaatcaagttatgatgcagggtaaatctttctttgatctgatccctcacttacttaagcagaaatgagacgaatctggacattctgacgtacttcagtctattcagaaacagttaggccaaactcaaaaatgcctgaaagacttcatcgcgcgctcgcgcccacgcgtccgcccacgcgtccgaaagtcaatttagacggagaaaaacttgctgatgaatttgctggtgcttcacgaactggcgaactcgacaacttttttaagaaaaactgtaaggtttggcctgacatccatggatgtgttcagcctatggtgacttctgcggagaaatgtttgactagcgatgaaaagcgcaccgttgaaaagttattttctctcgccgatgacacgaatactttcttctgcgagaacaatgccgatcgccttaagaaactacttagtggtaatcttgcgcaatgtatggaaactgtaggtaaagatgtccaagaatgtgcagccaaaaccctgcagaataggcaaaaacaacaacaacaacaacaaaaacaacaaaccagcgataaaaaggtcatattcagttttgatgaagaaacctgtagtgacttccagtctggacgtaaatgcgtcacctcaaaagtagctaaatgtgaatcaaaagatacttccaaaatcgtagatgactatttagcactggttcaagaccatgtttgcagttcagcgtcaagcttgtcttggttttcgtttgctaatattttgttattggtaggaacctacttgtattctaggatgttctaagcctttctggtgtacaagaactagttaaacaactggctacctcacgaacattcttgaatataaatgcttctggccaaatattatgactgtaataggtatgcataactttgtttacatttataaatacctagcataaagggaaacaattcgtgtctacctacccttaccaggccattaaaatgtagtttattttaaagtaaatagagacaaacattattattgaatggataataattccagtagtcttttaaatgctacaacattgtttacacaacgtataataaatgttgactttcagtaaaactccacacataatctacttatatgcaaccaatattacacaatatttttgaaatgttgcggaaacctattgaaaaaaaactttggtaggtattacttgaatatatctaacaaaataagcgtttttttgtagatgttaatgcaatagcgttaaaaattatttttaattactgattaagttgtacgtagctaattacataaattctaatgagttcaataataatcaaaaatatttttttattttaacgattcaaacattttagttttattttcgaattttattgtaaagggatcttaacacaaagcatttatgtattgggacaaagaatgtttataattatgttcttgtaatatataccatattttttcatctctacagcttggtcagcttggacgtaaaggacacattgaagtagattgtttaattacatattagttttttaatatatttcttgataatgcccaatttacatacatagtgtttaagttgttgttttattgtagtaagtgtcacgcttctgtcaagtgtattaagtaatatgtagttgttataaaatattatcttaaatagtctttactcatgtgcctgttacttatatgaagcgaaaataaatataataataaacaacttgtcaatttaaaaaaaaaaaaaaagggcgg

SEQ ID NO: 3487 - DNA, 1269 bp, Diabrotica virgifera
gagagtagtgtggtcgctttagatttagaggcattaaaataaacgagacttttttaaaacaagctagaaacacggcgtgtgtttttcgtgggtgttttggccccctatgggtcctacaaggatatggcagaatattaccttaacacaaacgatcacatatataaacaagaaatagactcggatatagatattagtggtaacgaagattctgacgattctgccggagctgaacccaccaggttgatcaaatctattaataaaggccggtggagcaaagaagaggacgcaaggttgaagcaattagtggaagaatatagtgaaaagtgggatgtcatagccgaacacttccctgacaggtctgacgtacagtgtcaacagcgatggacgaaagtcgtcaatcctgatttagtgaagggtccttggacgaaagaggaggacgaaaaagtcatcgaattagtaaataaatacggagccaaaaaatggactcttatagcccggcatctcaaaggtcgaatcggcaagcaatgtcgagaacgatggcacaaccacctaaacccgaaaataaagaagagcgcctggaccgagcaagaagacgacatcatctacaaggcacatcaagtcttaggtaaccaatgggcccgaatagcgaagctattgcccggacggaccgacaatgccatcaagaaccattggaattccacaatgaggaggaaatacgagtcggagaaccgcgatcatggggagtccaagcgtgggagacaacggaggaatatgaggccctcagagaacttctattcccattatggccaccaaaggacccaagagacgcaggtggggcaggaaggttttcctgtaaagaaagaaaatttaatcctgaatctacaggatgaggattggacggttgaaatgtttgaccatgccagcagccagtcgagttattcgccaggggctccaacgccttaacccctacgccgcagatgtcttagtgtctaccaaaaaatcaacccttccccacctcaacaagcacaaaattctaacgagcccgtgtctttaaccttcttcaaattgtatggcaaaaccaaacttccccccttgcccaaaaattgacgcccctgaaatgacgatgctttgtcagaattccaaatggggttctaccaataccctgggggcactccgctggaaacgacaaataaggaacttttttaaatcaagggggacctggcttcaaaattttaccccaaaaacaaattgagcctgtaaccacaaccc

SEQ ID NO: 3488 - DNA, 1221 bp, Diabrotica virgifera
  misc_feature (1107)..(1107): n is a, c, g, or t
  misc_feature (1166)..(1166): n is a, c, g, or t
  misc_feature (1182)..(1182): n is a, c, g, or t
cgagacgggcctgttttgtgtttttttctggacaggtgaaggtgtatgtatttttattgttgatttcctggatttgccggttaagcacgcacgtgtttttataaccttgtaacttttgcaacattgctctaatctaattttgttttaattgcttctccttggtcttcctgatgggaattggttgaaccatgtgattccaaaattccataaaagtcacaattccagtcattctggagattttttatagcgattgtaggctgcgctacctgactggttttgccagagcagtggtgggtgaggtgcggtctggtctgggtctgagtgtttgggtcaaaatagatttgaagcactttgtttgcaacatttggttttgtctatattgcatgcacacttaaattggtgcttcacacttacatttacacatggtgagtgccattttacataaagcgcgaatattgttcaatagtcagacactaaaacaacttgaacattttcaagatacacggaagtttagtttgtcaactgctgcgaaaatgagaatcgtgcaatacagactgaagaaaggaggaaaacagcatcttggagcacagctgtcttcggggggcgatataattgatatcagtgccgtagatcattccatccctaattctttggtggagtttttgggccaagggtgtggagtctatgaaaaacctagcagaatagtagcagaaggaaaatctgtaacttctctcgaaaatggagatctggtgtcgcccataactagacccgccacgcgtccgccacgcgtccggaactatagtggacattgttcggaacagaatatacctgagccaaaagaacccatgatattcagtaaattttcatctgtgattgtgggaccatacgacaatatagaaattccaccagtcacggacagtgttgattgggaagtagaactagcagtagtcataggaaagaaagcaaaggcaattagacaagaccaagccaacgatcatatattcggctataccgttgctcaagacattagcgcgagggactggcagaagaagagaaacaacggacaatttttgttaggaaaaagtatggacacgttttgtcctctanggcctgtagtagttaccaaaaataaagtcgatgtaaacaatctatccatccagtctggngtgaatggcgtacttnaacagatggaaatacctcagaactgatctttaaaattga

SEQ ID NO: 3489 - DNA, 958 bp, Diabrotica virgifera
cccacgcgtccgattctgtagttgtgtgtgtgtttgtacatacagtgtaaagtcagtgaatttgctttataaccatgtcagataagaatcctgaacaagtagtgaatactgcacgaaatgcattcaatagcggaaagacaagatccttagattttagactaaaacagttaaaagcattcatacgactactagatgaaaatactccacaaatatgtgatgctttaaacaaagacctgaggaagaataaaattgaggctgttcttatggaaattggtgtggtgaaaaaagacatcaattacttcttgaaaaatcttcgcgaattagaaaaacccgtgagacccgataaagaagttgcgaatattatggatagtgtcttcattaaacatgatccttatggagttgtccttattatgggagcttggaattatccaataacattatcgttacaacctgttgcaggtgcaattgctgcaggaaattgtgttctgttgaagccttctgaagttgcaccagcaacctcgaagtttcttgctgaatatattccaaagtatttagacacagaagcataccaggtctttgaaggaggagtagccgaaacaactgaattgttaaaacaaaggttcgattacattttatacactggatcatctgcagtaggaaagattatcttagaagcagctgccaaacacttgacacctgtcactcttgaactgggaggtaaaagtcccgtgtatttggacaaatcagcagatttggaagttgcagtgaagcgactattatggggaaaatgcgcaaattctggacagacctgtattgctcccgattatcttctctgttccaaagacctgcaagaaaaagttgttcaaattgcgaaaaaagtcattaaggaattcttcgggggaaatgtcaaagcttctccagattacggaagaattattaatgacaggcatttcaaaag

SEQ ID NO: 3490 - DNA, 973 bp, Diabrotica virgifera
caagtctctagtcaagggactggctttttattttcgcaatttttggaataattctaaaaattgagaactctcagccaaatttaagtgctagaattgaataaaacaaaatgccgaagaataaaggaaaaggaggtaaaaatcgtaggaggggaaagaatgaaaatgaaacagaaaaacgtgaattggtattcaaagaagatggacaagaatatgcacaagtcacaaaaatgttgggtaacggtaggctagaggctatgtgttttgatggtgtcaagaggttatgtcatattagagggaaacttagaaagaaggtttggataaatcaaggtgacattattctcataggtctcagagagtaccaagatgccaaagcagatgtgattctaaaatacacccctgatgaagctcgtaatctaaaaacatatggtgaattcccagaatctgttagaattaatgaaaccgttacattcgtcgaagaaggttttgatgaagatattgaatttggtgatgacatcagttcagcagacgaagctgaccctgttgatggcatctgatgacatgaagacgatgatagtaggtcaggccaataaaggtgatctttttttctgataaaatttattgttcaagatattaatatataatagaaacggtttgccctgttaatagagaagatatatatgtaaaacatttctgatctttgtttctaattcggtatttacaacacctgtatcataatataagccagtttccctaaatgacatttcagcctcattttcatcatagattatctctattttcagggcagtatataattttgaatgtaattcaccataaaagttttaacaatagcaaaaatgtatttaacttatcatttatgttttaaggacgttagaaaatataaaattttttgattaatctttctttctttgatgtatttattttgtagctggatgtcaattatattcactgtttg

SEQ ID NO: 3491 - DNA, 1174 bp, Diabrotica virgifera
cccccccctccccccccggcctttttttaaaaaacgcggggcggcccccatgaaaaattagaaatttttgggggtaccccattaagaaaagagttttaggcggttgcccatgccccggggtaggtaaactttggttcctttggagcgagaactaggtcaagtctctagtcaagggactggctttttattttcgcaatttttggaataattctaaaaattgagaactctcagccaaatttaagtgctagaattgaataaaacaaaatgccgaagaataaaggaaaaggaggtaaaaatcgtaggaggggaaagaatgaaaatgaaacagaaaaacgtgaattggtattcaaagaagatggacaagaatatgcacaagtcacaaaaatgttgggtaacggtaggctagaggctatgtgttttgatggtgtcaagaggttatgtcatattagagggaaacttagaaagaaggtttggataaatcaaggtgacattattctcataggtctcagagagtaccaagatgccaaagcagatgtgattctaaaatacacccctgatgaagctcgtaatctaaaaacatatggtgaattcccagaatctgttagaattaatgaaaccgttacattcgtcgaagaaggttttgatgaagatattgaatttggtgatgacatcagttcagcagacgaagctgaccctgttgatggcatctgatgacatgaagacgatgatagtaggtcaggccaataaagatcttgaatgggttatctcagaaccggatttcatcatgtaccagaacactttgaaagacctatgtgattgtagatatttatattaataatttatcataggttaatgtatcaatagattttttggcctgaccacttgctaccaaaaaaatgtcattttcttgcagccctctctcatagcatctcaacccttagaaaaataatcattttttataattaacgattaaaatcattttatcaaattaatgcaattttttcaaactgatatttgtggatgtttcttatgtgaaagaaagttctagggatatgtttatagatatagaactgttatatatgtgtaatattttgtacaattcggtttttctgttttttaatggcaacaaaaatgtaaaagcgtaaataaacatcataaaatagtaaaaaaaaaa

SEQ ID NO: 3492 - DNA, 1274 bp, Diabrotica virgifera
ctcacaaatcacaaaacaccatttttttaatgttattggagttgggactgggtacaggatgaactttgtacttttataattttccttttacttcatgtagtaattcattcatataaatcatatatcaaaattataagtataggaagtcggtagtatcgaaaatatttaccaagatgttttcaaattatactagaactctaggaactcagctaagaagattccaaagcaccttggtaattgcagaacataataatgaagtcttgtcccctatcacacaaaatgctataactgctgcaaaaaagttaggtggtgaagtatcagttctagttgcagggacaaaatgtggaccagcttcatcagccctttcaaaagcaggtggtgtatccaaggttctggtagctgaaaatgaagcatttaaaggtttcactgctgaaaatttgactccattaatattaaatgcacaaaaacagtttaaatttacacatattattgctggtgcctcagcatttggaaaggctcttttgccccgagtagctgcgaagcttgatgtttctcccgtaacagatattattgctataaagtcccctgataccttcgttaggactatctatgctggtaatgcaattcagactttgcaagtcacagaccctattaaaatattaacgattagaggaactaactttgaagctgacccattggatggtggttctgcagccactgaaaatattccagcagatggttgtgccaatgatcttactacttttgttagccaggaattgagcaaatcagacaggcctgaactaacaagtgctaaagtagttgttagtggaggtcggggtttaaagtcaggagacaatttcaaacttctatatgatctagctgataagttaaatgctgcagttggtgcttcccgtgcagctgtagatgctggatatgtaccaaatgatatgcaagttggtcaaacaggaaaaattgttgcgcctgatctatatattgctgttggtatttctggagccatccaacatttggctggtatgaagacagcaagactatagttgctatcaacaaggaccctgaagctccaattttccaagttgttgattatggactgggggtggccgttctttaaaaaaaagttcgttcctagattgaaaagaaaaaaatttaaataaatcttttaaaaaatttttttttttgaagaaaagcacccccaaattattaaaaaacaatattttttttttcattttcaaaaaaaaaaaaaaaaaagggggggg

SEQ ID NO: 3493 - DNA, 1862 bp, Diabrotica virgifera
ctgactagtgatgaaaataatggacatggttatggaagcagttctacaaagactcaaacaataactcaaacaagcagcagctcaatccagggtggtaacctagaacaatctatcttaaatgggcatggaaataatggtattggttacggaagcggctccaaagtaattgaaacaactgtaacaaaacaccttggaggtaacaagggaaaacatcttggtaacctcgaacaagtagtcttaggtggtcatgaaaacaatggacatggttatggaagcagttctacaaaaactcaaacaataactcaaacaagcagcagctcaaaccagggtggtaacctagaacaaattatcttaaacggtcatggaaataatggaagcggctccaaagtagttgaaacaactgtaacaagacaccttgaaggtaacaatggaaaacatcttggtaaccttgaacaagtagtcttaactggtcatgaaaataatggacatggttatggaagcagttctacaaacactcaaacaataactcaaacaagcagcagctcaagccagggtggtaacctagaacaatctatcttaaatggtcatggaaataatggtattggttacggaagcggttccaaagtaattgaaacaacggtaacaaagcaccttggaggtaacaatggaaaacatcttggtaaccttgaacaagtagtcctaactggtcatgaaaataatggacatggttatggaagcagttctacaaacgctcaaacaataactcaaacgagcagcaccagttcaagccagataggtgagctggaacaatctatcttaaagattcacggaaataatggtattggttatggaagtggctccaaggtaattgaaactactgtaacaaaacaccttggagctaacaatggaaaacatcttggtaaccttgaacaagtagtccaaactggtcatgaaacattaactcaaacaagcagcagctcaaaccagggtggtaacctagaacaaattatcttaaatggtcatgggaataatggtgttggttacggaagcggctccaaagtagttgaaacaacggtaacaaaacaccttggagataacaatggaaaacatcttggtaacctcgaacaagtagtcttaactggtcatgaaaacaatggacatggttatggaagcagttctacaaagactcatacaataactcaaacaagcagcagctcaacccagggtggtaacctagaacaatctatcttaaatggtcatggaaataatggtattggttacggaagcggctccaaagtaattgaaacaacggtaacaaagcaccttggaggtaacaatggaaaacatcttggtaaccttgaacaagtagtcctaactggtcatgaaaataatggacatggttatggaagcagttctacaaacgctcaaacaataactcaaacgagcagcaccagttcaagccagataggtgagctggaacaatctatcttaaagattcacggaaataatggtattggttatggaagtggctccaaggtaattgaaactactgtaacaaaacaccttggaggtaacaatggaaaacatcttggtaaccttgaacaagtagtccaaactggtcatgaaacattaactcaaacaagcagcagctcaaaccagggtggtaacatagatcaatctgtcttcaatggtcatgggaataatggcattggttatggaagccattctaaagttgtgaaagtcctttccagtcatagttctagtcaacaagagggacaaagtattcatgagggtggacactcctttgtaaaagtcatggaaataatggcattggacatggtcgtggacgaggggggaggacg

SEQ ID NO: 3494 - DNA, 2624 bp, Diabrotica virgifera
gaaacaacggtaacaaaacaccttagaggtaacaatggaaaacatcttggtaacgtcgaacaagtagtcttaactggtcatgaaaacaatggacatggttttggaagcagttctacaaaaactcatacaataactcaaacaagcagcagctcaagccagggtggtaagctagaacaaattatcttaaatggtcatggaaataatggtattggttacggaagcggctccaaagtaattgaaacaactgtaacaaaacaccttggaggtaacaatggaaaacatcttggtaaactcgatcaagtagtcctaactggtcatgaaaacaatggacatggttatggaagcagttctacaaagactcaaacaataactcaaacaagcagcagctcaagccagggtggtaatctagaacaaactatcttaaacggtcatggaaataatggtattggttacggaagcggttccaaagtaattgaaacaacggtaacaaaacaccttggaggtaacaatggaaaacatcttggtaaactcgatcaagtagtcctaactggtcatgaaaacaatggacatggttatggaagcagttctacaaagactcaaacaataactcaaacaagcagcagctcaagccagggtggtaacctagaacaatctatcttaaatggtcatggaaataatggtattggttacggaagcggctccaaagtaattgaaacaactgtaacaaaacaccttggaggtaacaatggaaaacatcttggtaaccttgaacaatcagtcctgactagtcatgaaaataatggacatggttatggaagcagttctacaaagactcaaacaataactcaaacaagcagcagctcaatccagggtggtaacctagaacaatctatcttaaatgggcatggagataatggtattggttacggaagcggctccaaagtaattgaaacaactgtaacaaaacaccttggaggtaacaagggaaaacatcttggtaacctcgaacaagtagtcttaggtggtcatgaaaacaatggacatggttatggaagcagttctacaaaaactcaaacaataactcaaacaagcagcagctcaaaccagggtggtaacctagaacaaattatcttaaacggtcatggaaataatggaagcggctccaaagtagttgaaacaactgtaacaaaacaccttggaggtaacaagggaaaacatcttggtaacctcgaacaagtagtcttaactggtcatgaaaataatggacatggttatggaagcagttctacaaaaactcaaacaataactcaaacaagcagcagctcaagccagggtggtaacctagaacaaattatcttaaatggtcatgggaataatggtgttggttacggaagcggctcaaaagtagtcgaaacaacggtaacaaaacaccttggaggtaacaatggaaaacatcttggtaacctcgaacaagttgtcttaactggtcatgaaaacaatggacatggttatggtacaaagactcaaacaataactcaaacaagcagcagctcaagccagggtggtaacctagaacaatctatcttaaatggtcatggaaataatggtattggttacggaagcggttccaaagtaattgaaacaacggtaacaaagcaccttggaggtaacaatggaaaacatcttggtaaccttgaacaagtagtcctaactggtcatgaaaataatggacatggttatggaagcagttctacaaacgctcaaacaataactcaaacgagcagcaccagttcaagccagataggtgagctggaacaatctatcttaaagattcacggaaataatggtattggttatggaagtggctccaaggtaattgaaactactgtaacaaaacaccttggagctaacaatggaaaacatcttggtaaccttgaacaagtagtccaaactggtcatgaaacattaactcaaacaagcagcagctcaaaccagggtggtaacctagaacaaattatcttaaatggtcatgggaatggtgttggttacggaagcggctccaaagtagttgaaacaacggtaacaaaacaccttggagataacaatggaaaacatcttggtaaacctcgaacaagtagtcttaactggtcatgaaaacaatggacatggttatggaagcagttcaaccaagactcatacaataaattcaaacaagcagcagctcaaccccgggtggtgcccacgcaaaatctaacttaattctttattaaaattattggaaaaaaaacgggagttgggttctacgaaaggaaaacacaaaaactaggaaaaatgggagaaaaaaatgggaaaatggggagggaaacctggacaaaaaaacctttggaatcctgaagaaaaaaaaaaaacccctaaggtcaagttcttccaaccgcttaaaacatatacttcaaacgagcaggccccagatccaaagccaaaaaaggggggcttggaaccaatctttctttaaagatttcaccggaaaaaaaagggaattgtggtttttggaaaggggttcccaagggaaaattaaaaattactggtaaaaaaaacaccccttggaggggaaaaaacgggaaaaa

SEQ ID NO: 3495 - DNA, 1327 bp, Diabrotica virgifera
  misc_feature (1222)..(1223): n is a, c, g, or t
gatgaggcaactgatcgacatttagggagataagactttctgcataaagagcataaaaagacttacaccagtttctgaagtattaataactgcaaacttcgatttttctgaagctctagaatcagtttatccattactagacattatatttgattacctagactttaacgatttaacgaggtgttgtcaagtcaagaactcatggaaagaaattgcagaaaatattttaagcaaaagagcccaagccagttggtttacatgttttaaaggatcaacaaccaattgttttgagcatagcgttaatctcaattacaataatgtaggatttggaataatattgtatgattttaggagaatcaagctaaataaatttatttgtgtacatacagagtgggaggagttgtcaagaaaaacagttccagagtattttgaagaagaatttgtcccacagaaaactgactactgcgttatatcatgcgcgaaagttatatcatatttcgatagcaagagtaaaaacatatgtaaagcatcttattttgatggtctattcttcccaaaaattcccaatgtgagaatgacgatgttttactgtaatcccgtcaagaaggatggaatacagaaggtagtcgatacctatataaatccaaacgaagaggtcaagtgtttgcttatgttttcaacgactgatcagaaaaaaccactgtataatttactgaaagcccttataccagaaaatgaagcaccttctgtagcagtagctggaggtatcataagaggaacaaaaactttccaacagatccatgctgcaaaacggatatacacaaataaagatatattttcaatagttttcctgaaggacaaaagcgaggagactgacttcaatgctttttcctgtgttattgtaggagatgacttgtccaaagatgaatttgctgaaaagctagtaaagtttagacaacaagtgttgttaagaacccaaacagtagccataaggatatgttgttcagccaaagttgatgctgacgaagaacctttaattttcaataaaatattcccaggaataccagtttttggattccatgccgacggagagataggatgggattgtgttttgcatcctaaagcatcgtgtgattctgaagaacatttgccaaaaaaagccaagcatagatatccaaatgtgagtcatcaatggtcaacagtgtttgttttgattacttgnngtgccatattatcctaattgttgtgtggtaattgttgttttatatttttaagtattttttgtagtattataatcgttttgggacaaaggatagatttttaattc

SEQ ID NO: 3496 - DNA, 1566 bp, Diabrotica virgifera
  misc_feature (1221)..(1222): n is a, c, g, or t
  misc_feature (1281)..(1281): n is a, c, g, or t
  misc_feature (1310)..(1310): n is a, c, g, or t
  misc_feature (1363)..(1363): n is a, c, g, or t
ggttcctcaagttctttgtttataacagccttggcgacatccgtatcaattgttacccaaagaattcgtgttctgcgggtcaggatgcataaaagaaacttgtgtaaatccatctgaataaaggaggccgttgtaccccccttggcgacaggactaaatactttattaatacaattcctaaaatgtaactttatgagcaaacatagtttattaaaaagctaatatttctttattcaagaaggatatatctgagtttttttttctaaacctgatattttaaaaaagaaaattcttgtcagagaaaaagatctgaaatcctataatatcaataaacactgcacaaaataaatgaaataaactaatatgaatcttaaaacctttctactgaaaaagtgaaaattcttagtcataaccctcttcttccaaatgaacgatataacataaagtgatacgctgtcacgaatttagggggcggagcgttcacaagacgaaacacaactgttaccgctccatcggtaactgctctcttactttttcgtctcctgaatacgaccattatttccacagttatgatgcgaaattctgtattaatatcacaaagttttgtgatattaatcacagcaatgatttgtcatattccataaaaacaaaatgccataatgactcataacagacgaatttataatcaggaatttttaagaaaatgttaccgtatattagttcataattccctaatatctggacatgttacagcacagttatttcgaaattattggcttagttactggtagcgccatctatcatacaataagagtaatatgcaataattcgttaacttacttgatgttctactataaattctttgatacatatgtggaaggaatggggtttcacgcgaatacgtttagttttcaattaggtatatgcgacttaaggaagccctaaaatcggtaactttgcttagtccactatcgttatttaatcgccgaattacggcggaggtaggaggaagttagaatcagcgagaatcatgtgcaatgtacgtgggaagtggaaccgtctggtacacgacggtgcgcattggtgtcatttataggccgtatatctaatttaaaataaacatgtatatccgcataagcacgacagcgttcctaacttcagcagacatcggttatagcttgtagtcgtgaatccctatccgcacttgctattccgagatgnncagtacgataaaattaactggaatattactgatgatgctctgtagtgtccattactgtngtatagcggtatttatttgtaacatattnggtttagtttgtagtaaatataaaacacaatataattttcgattaatttattnctgatgtctttcttttacgaacacctttgagtcaattttttcatgctttcgaaggacagaaatatatactctctaagcacacaaaaacaaaaaaaattgtttatttattttttcgggtttttggtattttttaacagggggaaacagaaggggtttaaaaaattttttatttttaaaaaaaaaagggggtttcctattttttg

SEQ ID NO: 3497 - DNA, 1188 bp, Diabrotica virgifera
gctatccgggctgttgcactaatcatacgggttggttgttagttcacttttttctacagtaccatgtgtcactagcataatactcaaaaaattaatatttaattttgtgaacttagttaacatcattttgaaaaatgcggtacactttgagttacatcggtgctaccctagcgtccactgtaacactgatttttgccctctactactgcctcacgggaaaaggagagcaagttagtttagcatggttattgttgaatgtgtctccccacatgtgggcaggtctaggaattggccttgctgtatcattatcagttgtaggagctgctgcaggaattcacactacaggagtcagtatcgtaggagctggtgttaaagcccccagaatcaaaaccaaaaatttaatttctattattttctgtgaagctgtggctatctatgggttaattatggctatagtactctgtggaagttggaagaatttcgatgtagacctattcaacctcaaaactcataactttgctcaaaaccattatggatcacatgttatttttggatccggtttaactgttggatttgtaaatctattatgtggattttgtgttggagtagttggttctggtgcagccatttctgatgcagccaattcatcattattcgtcaaaattttgattattgagatttttggaagtgccattggtctcttcggtctgattgttggagtatacttgacgtcaagaggctctatggtttaaatgttcagtaaatgaacatgaaaaataaaatgaataatttgttaaaagtgtgtgtgatgaagatacaactattttcactagtttacgccccaaaatatttcattgtggtttttgaacaatatttaaaatccattctaaattaaaattcttcaaataattgttgaaaacagattcaagggtctttaatcagtgtatataatagtattaaataaatattccactaattttgttaatcattgttaaacattgtatagttacaaaaaaaaatttttaatttaaaaaaatatgcttgtacaacaattaatcgccccctaataattaattaattactcacttataattaaaatttctatttttttttatgttcaaaaaaaataaaaaaaaaattttgtttaattttttaaaaaaaaaaaaaaaaaagggggggggcgccccc

SEQ ID NO: 3498 - DNA, 972 bp, Diabrotica virgifera
agccctgaaattgtccagattatcacatgacatttgagaaaactaaattagtaagtgaacacgaatttagttcaaaatgcctttctgtggtcccaaattgtccctctgcggcctgattatcagtgcatggggtatcatccagttgggtttcatgggtgtattctattacattggggctgtggctttagcagaagatattccagaggttgagtttaagggcgatttagacaaattttatagcgacgtcaacacgggtttcacacagaatgcttacaactgctggattgctgctctcctatacctgataacattagcagtatcagctcaccaattctgggccaacaacagatcatcattgaacgtctaagaatcttttaatttgcttttgtatatatttatttacattccttctccagctgtagattttaaatgtatagaccctcaaatacttcagagtaccaatttttctgttaaacttagcgaactcgtacaccaaagcaatatccaaacgcaacatgaaacactcaacatcccataaatatcagaggttatgtatcccttgaacgcgcttaaaactacctaggagtcctcgaactttgttcaccgacgcaatgcggataaggatcatccaccgaaaaccagatgcgacactcagtgcatattatctttccacagtgtatgttatatgcgatttcgatagggtattgctttggtgtacgagtccgcttaggtcagtcaatgtagcatgttgttgtttttaaagttttcattggtactaaaacttttgttcaccaacgtagtattataaaaatcatagtaatattaataacgctgcaatgttatgaatcttaccaaattattttatggttctgttgtattagtgatttgaatttaaaaattgtacacatttactatgaaataaattgatttattttgttaaaaaaaaaaaaaaaagggcggccggctctaaaa

SEQ ID NO: 3499 - DNA, 881 bp, Diabrotica virgifera
  misc_feature (633)..(633): n is a, c, g, or t
  misc_feature (657)..(657): n is a, c, g, or t
  misc_feature (669)..(669): n is a, c, g, or t
  misc_feature (685)..(686): n is a, c, g, or t
  misc_feature (695)..(695): n is a, c, g, or t
  misc_feature (816)..(816): n is a, c, g, or t
cggacgcgtgggtgcgattctgttctagtaaaatttattgaactagattttaaaaatgaaccatattataaaagaatatttaatcctttgtgtgttgttttttgtgagattgaataaaagcgaatcatatggaccaagaataatagcgaacgtttactatgagtcaaaatgcccttacgataaaagttttatagaacagcaattgcttcctataatggaaggaaatttaaccaattatgttaatttaactatattacctttcggttcaccggtgccaccacataaatttgaatgttttggtcctgtagacccgttgtgctctggacacattgactactccgataactattatagaccaatcccaacaggaattcaagaatggtgttttaaaaaaatgatctgttatttgaaaaaattaaaacaacgattcgaaaaacggccaattacctcgaaaaaacagttttgtgacctttcggatttatcctttggtttccttgataaccgttgttctatttttaatacattgaactttgacaaacctaataacagttctgagaaaaaggttaaggataaccatagtattaatttaagaacgaacgtgctaaacccgatgcaataataacgttaacctgngagacgagttcagaatgtatggantaataacatccnaaaaagcaaatattcnngaataatgngctctaagggcaaagattagaaagcagtatgtgaatatatagatactaatcaatataaaagcgttaagacataaaaatagtataatatagtataataaatagtaaagataatagaaatatnaatgaaaaaatatttaaatattccctagatataattataaactgtaatttttctttactgataat

SEQ ID NO: 3500 - DNA, 1988 bp, Diabrotica virgifera
ctgatctgtctttcatatttttaaagtcaagatggctcgaggacctaaaaagcatttgaagcgtttagacgcacccaaagcatggatgtttttataaaatagaattttatatttagtaccttgagtatcagggattattaaataataattatatatatactattttctaatttataatagctaagaaattaaacgtttttattgcaaaataaatattttatataattttttagtagcagaaatgttattctattttttagtatatctgatttttgaagaaataatttaaattaattgattaacaagatatttacaatcaaagatatttatattattaacattaaatatttttagcgaggagcttaaatctaaatataaaaattattttatatatttggtcctttcgtactaaaatatattaataaattaaagatagaaaccaacctggctcacaccggtttaaactcagatcttttaaaattttaaaagtcgaacagacttaataatatagctgctacaccaattataaactttaatccaacatcgaggtcgcaatctttattatcgatttgaactctccaataaaattacgctgttatccctaaggtaatttattcttataatcaaaaaaattggatcaaaaaattattaattaatataataatataaaaaaagttaaatttattttttaatcaccccaattaaataaatttattatataaataaatttaatactaaaaaaacttattaataattttataaaactctatagggtcttctcgtcttttaaaaaaatttaagctttttaacttaaaaataaaattctttataaattaaataaagacaggttttttttttatccaacccttcattccagctttcaataaaaaaactaatgattatgctaccttagcacggtcaaaataccgcggccattcaaattaatcagtgggcaggcgagactttatatttaatacaaaaagacatgtttttaataaacaggtgaaaaaaatgttgccgaattcctttattaaacctatatatttttactaaatatacaattttttaatactaatattgtccgcctgatctgtctttcatatttttaaagtcaagatggctcgaggacctaaaaagcatttgaagcgtttaaacgcacccaaagcatggatgttggacaaattgggaggtgtatttgccccccgtccatccaccggtcctcacaagttgagagaatctttaccattagtaattttcttaagaaacagactaaagtatgccctcaccaacagtgaagtcacaaaaattgttatgcaaagattaattaaagtcgatggaaaagtcagaacagacagtaactatcctgcaggatttatggatgttattactattgagaagactggtgaattcttccgtcttatctatgatgttaaaggtagatttgccattcaccgtattaccgctgaagaagcaaaatacaaactctgcaaagtacgaagagtccaaactggaccaaaaggaattccattcttggtgacacatgatggccgtaccatcagataccctgacccaaacatcaaagtcaatgacaccatccaattggaaattgccacatctaaaattctagactacattaagttcgaatctggaaacttatgtatgatcactggaggaagaaatttgggtcgtgtaggtacagttatcaatagggaacgtcatcctggatcctttgatattgtgcatgttaaagatgctaatggtcatgtatttgctactaggttaaataacgttttcattattggtaagggagctaaggccttcgtttccctcccaagaggaaagggagtcaaattgtctattgctgaagagagagacaagaggttagcagccaaaacacattaaatgtaatggttgattacattattttcaataaaacttaaaaaatctgaaaaaaaaaaaaaaaaaaggggggccgctttaaaagatcc

SEQ ID NO: 3501 - DNA, 1076 bp, Diabrotica virgifera
attacatattgtttatcgtgtgcaactaactatatattttagtatctgaggaatataatatatggttgtagaagtatacataggtaaatatagtatacctggaaaatacaattataaattatttttgaagattgttattaattggagcgcaaaaatatatgcaatttagtatactggcggtgagctgataaaaaatgggaaaacaaacggactctgaccgttccttgggtaccaaggtaaaggatgttatacttcagcgactagtcatattacaatggctacctaagtacaccaaaaatgatattctggcagacttaatagctggtctaacggtgggcctgaccatgatgccccaatcgattgcttacgctggcttggctggtcttcctgcccagtatgggttatatacagcgtttattggatcatttacgtatatttttgtgggcactatcaaagaagtttctattgggccgaccagtttgatgtcactcttaaccttctcctatacagttggcaaacctatagaatgtgttattcttctggcgtttacagctgggtgtgtggaactgcttatgggaatactaaaactaggatttctggtggacttcatatcaccatgtcttacgtcgggattcacatctgccagtaccatcatcatcatatccaaccagttgaaaaacctgtttggaatcaatatacattctcacgactttgttggagtaacgaaagaattatttcaaaagtttaatgaaataaggatgcctgacactatactgggtgtaacttgcattgttgtacttctgttttttaagaaccttaatcgattagttaagacagaaaacaaaacagttaagaaattatatggttactttccatctccaaaaatgctatcgttgtccttctagctactatagtagccggatcctggagcaaaactggcagtactcctttcaagatcatcggaaatgttcccaaaggtgttccagttttagcatttccttctctcagcactcatgtaagaaacccggactgtaaaaaactgtcgagaatgtgcaatctttgggcagtggagtttt

SEQ ID NO: 3502 - DNA, 1235 bp, Diabrotica virgifera
  misc_feature (1196)..(1196): n is a, c, g, or t
  misc_feature (1203)..(1203): n is a, c, g, or t
agcgcagtgttgcgagtatggctgtcgttatttccgctgaaaaaataaacaaatgataataatacttcgaaaacaataacaatttcggacaataactacttcctctttttgaataaaccagtttgtgttcatagtggtacttgttccatcttaatgatgttaaaacgtcgaaaaatgttggtgatttcaatgctaggttaggcacgaaaatatctttggttcgcgtgtgattcgtgtgtgagaataattatcgaatctctaattaatttattaattgtttatgcctggtgtgattagtggttttgtagtgttaaattattattcgaaatgtgttggaatagctgtgttgtgctactttctttcgcatctctgttgatgaaagccaaagctcagtatgcagaaaacacacccccttctctttggatggacgatcgaaattggaacattcgtgaaaacgaaaccattggtacaaaaatttcgcaagctcatggagacgatcctgaaggagtagttttaacttatggacttgaaccaattatgtggcatttaggtggcaaggtggagaaattaccttttagaatcgataacgagaccggcactgtctaccttaatgaaagtttgactgggagggcaaatgaaaacctacatctctacgttactgcaagcgatggccaactcaccgcaaaatcagaagtaaacgtaaacatcttacctgccaactcccgttttaacccttccatgcccatcagaccaccttcaagagggttcatcaactacccaggaatcatcccaaggcccggacaatcacctcctctaccaccaaactttccaaacactaatccatctgtgatcaaccctcccacattcataccaaagcaaccttactatccagagattagaacaccccccaaaaacaccaattctaatactaacacagtcttaaaaccggtgaggatagatgatgttaaaaacactattagcgaaagaaccacggaaacaacaactagtactacagaaaaaatcacaactgaaaaagttagtcaaaatgatgttgagtctacaaatgaattgttaacttccgatttaccgattcgatcatctgaaagattatctgggacggtaaattccatagcagctgtaataggagttttctaacggttggcggtattgcatttgcatttagaaggaagattttnatatccnaacaaaaagacagtaagggacgatatgagaag

SEQ ID NO: 3503 - DNA, 1930 bp, Diabrotica virgifera
gttatacgtatgttaagatattacgcacaaagtttaacatcattttttttaaataccggttgccaacatggcgcagaacttactctatatttctttaatactctttatagtactttatgcatcagcagtagataagaataattttaaaacgtgtgaacaaagtagtttttgcagacgattaagaagcgttaaacctggcgaaagcaagtatgaattagatttagaatcgttagaaatcaccgacaattctgtggagtcaaaacttttaaacactgaagctggaatcctttttaagttttcattaactgccattagtggaaacatctttaggttgcaagtggatgaagcttctcctttgtatgcgaggtataggcctcaatttgccttacgtggtgagcctcaagtagccaaattgaaactacttgaaaggaacaaagaatatgtttccatagaatataacaacaacaaggtcatagtacatgcaagaccattcaaaattgaagtcttcgacaaagatgaactcattagcgttgttaatggaagaggtctgtttaagtttgaacacttcagaaagaaaccagaacagaataacgaaggagaacaacaacaagaagtagctgaagatccgggaacttgggaagaaaacttcaaaagtcatcatgacagcaaaccaaaaggtccttcagctgttggattggatatcagttttccaggtgccttaagagtttatggtttgccagagcatgcggacagacttcctttaagaacaactggacctggaggtgtggatccatatcgtctatacaatttggatgtgtttgaatatgaattagattcaacaatggccatttatggagcaatcccagtggtctatgctcattctcctaaacgaaccattggtgccttttggcttaatgctgccgaaacttgggttgatatcaacaatagtaaagatggaaatgttatgtcttcaatagtaaacttagtatcaggcagtaaatccgaaaataatgtagatgtccatttcatgagtgaatccggtgttgctgatcttttcattttgttgggtccaacacctaaagctgctgtcaaacaatatgcctccctcactggagtacatccattacctcagtactacacattggcataccaccaatgccgatggaattataacgatgaagatgatgttaccacggtggttcaaacttttgacgcaaacgatatgccggttgacttcatgtggttggatatcgagtatactaatggaaagaagtatttcacatgggatccaattaaatttccacacccagaaattatggtaaacaatctgacagctactggtaggaaactcatagtcattattgatccacactacaaaagagaatcaggatactttgttcacgaagattgtctagcaaacgactactacgtaaaaacaaaagacaacaacgtatatgaaggttggtgttggccaggatctagtagctatatcgatttctataaaccagaagctgctgagtactacaagaacttgtacagattggaaaactttaaaggaaccagccacgacgtttacatctggaacgatatgaatgagccgtctgtcttcaacggacctgaaattactatgcccaaggatactatccatcatggtgggtgggagcacagagatgttcacaatgaatatgctttagcacatacatatgctacattccaaggacttcttcaacgtacaccaaataaacgtccattcatcctcactagaggacactttcccggatcccaacgttacacagtagtatggactggagacaacgccgctgaatggtctcacttagctgtcagctacccaatgtgtcttagtgaagctctaggtggcatgagtttctgtggggccgatgtccgaaggtttctttcaccatccctgata

SEQ ID NO: 3504 - DNA, 1051 bp, Diabrotica virgifera
aacgagcataacctcacattttaacaataacataaattaatttttcatttatggctggaattgttcgaaaattttcaacatcgactaataacagtcctaaagagttatacaaatatttaatacgacagtgtagaaagttacctagtggcccccgagagcattatcaatttatgattcgtcaaagctacaagcagcatgtcaatgagcaagatagtgaaagaatcaaacaaatcataagtagagcctatgaagacgcagactggattctaaaaaagtacctaggtaaaagcagttgagcgaaatgtttccagtaccattagccaccagtagtgaagagatcccagtctcagttttttgggaagtagtcttgctgtatcacaaccgaccatatttagtgaacaaattagtgacagccaatactaagatttctttgtataaaatagattgcaaaggtagttttggccatatcagtgaattatttaagctatctagtatattatacgaaagaagaaaactgaaagaattatcaaaagaaagtttaaatgatgattttatcaaaagttttgttgagtgttacgataaaaactttaagttggacaaattaaatgaagaaacctttcttgatagtttcagtggagtttatatatcagttcaggttttaatatcaagaagaagtactgatcatagagttttagaattggccatcttcgataaagataccaattcggctatatttttaacagcttatgaaaattctgaagatatgttaacacctaattttccgtatgaatttaattggaaaaatggatgttttggactcaatcttcagaattttgaagacgcagataccagcaaagccgagtggctagctttgaccttgtttcccaagcttctaaaatggtcacaagatgatggtagtaaaaatactataagatcattatcattagtgcctctagatgaatactgtgtcttatatgaaagattgaaaaagaacttacgtgaaaagatttgctaaaggactggatagataagggtaaaaccgacccccaaa

SEQ ID NO: 3505 - DNA, 874 bp, Diabrotica virgifera
  misc_feature (759)..(759): n is a, c, g, or t
  misc_feature (824)..(824): n is a, c, g, or t
cccctttaagaccggagagacggttacatattcagtacatcagttacatcagtaaaaaagctgcattgaattcgtgatttagccaagaagttctcaattaagccacattcaataaaaatggtgtgattgaaaagccggattccttcatagtggtgtaactcccgatatttgggggggccactctccagttgggagggcatgggcatgatatcgcccgacgacgcatacagctatcctctgatagcacgcttcctacattctctgccccacgtcaatgtcagctttcaacatgtcaacagctcctttgaaccgaacaatcccgtatacttggagagtttgggaattctcggctctatcccggcaatatggttgatattaacgctgttcgtcctactcatttacctgttgacgagatgttgtgatcggaaaccgagagcctcaaagtcgatagcggcccttaaactcactttagccgttgtatcggttctgtgttgtgccggcataggcataggactctatggtaatgacgatttacacaatggcgtagtccggactttgagtgaaggaaggcaagtagacattttaatatccaaaatacgcaaccaaacagaagacatcgagcgacagttgaggatacaagcagagagacaaataaaagaaattgcaaacgtgttcggaacacatcacagtgataaacctttatttaacgaaatagaaggttattttaagaaacttgtcagtaaccgcaacgctactgcnaacgcagctagagatatacgccaacctttagtgggagtcaaccttacatcgacaataataattgntgaaaaaattgaggcagtgcgatggcctttcacgatgggaaatttgagcg

SEQ ID NO: 3506 - DNA, 911 bp, Diabrotica virgifera
gatctgtttgtgggtgggtgtatttgctccagttatttggattaacaattattttgaaagaagttctcaattaagccacattcaataaaaatggtgtgattgaaaagccggattccttcatagtggtgtaactcccgatatttgggggggccactctccagttgggagggcatgggcatgatatcgcccgacgacgcatacagctatcctctgatagcacgcttcctacattctctgccccacgtcaatgtcagctttcaacatgtcaacagctcctttgaaccgaacaatcccgtatacttggagagtttgggaattctcggctctatcccggcaatatggttgatattaacgctgttcgtcctactcatttacctgttgacgagatgttgtgatcggaaaccgagagcctcaaagtcgatagcggcccttaaactcactttagccgttgtatcggttctgtgttgtgccggcataggcataggactctatggtaatgacgatttacacaatggcgtagtccggactttgagtgaaggaaggcaagtagacattttaatatccaaaatacgcaaccaaacagaagacatcgagcgacagttgaggatacaagcagagagacaaataaaagaaattgcaaacgtgttcggaacacatcacagtgataaacctttatttaacgaaatagaaggttattttaagaaacttgtcagtaaccgcaacgctactgcaaacgcagctagagatatacgccaacctttagtgggagtcaacctctaaccgacaataataattggtgaaaaaattgaggcagtgcgatatgcagttaggatgggaattttgagcgttttactcattctatttcagatttgacaggttggcgtagcgaggcacaacaggtgcgctcttat

SEQ ID NO: 3507 - DNA, 1347 bp, Diabrotica virgifera
gatacacatgcgaattattattgatacacatcaaataaattttatagacacaaacgattaaaatgttgcttattataaagttgatttaaccctttaatatttatttatttattttgtatattttattctatcgttagaaacttttgaaataaacctcgtaggaaaacagagataagcaattctaataaactcggtttcgacattattaacattaagttagtttttgggcttgatttcatgtcaacgttatcaagagaatatgaattttctcgggtttcaagtggagcctttggagtcgatgttggtgttaggcgcagatcaagacgagaggtcatcaaaatgactgggttaataagtttgatagtgtttgctctggttattactgttgtgtatggtgtacattattcggaaagtgatggtcccacattccggtattttcaaagagttgaatctgctaatgaaaatgacaaatatcaaaagatatccaattctacaatatggacttacgaatgcagatccgaacaatgtgagagaagaccagctgataccaatgaaattagggtgtccctagagcagtgtaatatgttatgcagtaatccgtccttatggcctaaaccaagatcagtttacgtatcaaacaaatccgtttcttcttttttgaagaatcaaataaaattgaaaataaatagtccgtcttcaattaaagatgacttaaagcaagccttcagaatttttttgaatactattccagatgaaaggaaatttcgaactcaagatgaagtcgatgtcgcagatatcttcattaatctgaccgttacaaaagatgataataaaccaaaacaagatacggacgagtcttacactctttcggtaacaaaatcaaactctaatataacggtaaacatttcatctacgacatatttcggagccagacatgggttagaaacactcagtcagctaatctggttagatagcgtttcacaaaagcttctaatatatcatgatatttctataagagacaaacctatgtttcctcatagaggcttgatggtagatacggctagaaacttctttcctatgaaacagctcttaaaagtagtagatggtatggctgctaataaagtaatgtattccatctgcatttaactgattctgtgagttttccattgtacttctaataatccttggtggccccaatttgggatttacagtccaaaaaaaaagtccccccccaaaaaaaaaaaaagttttggaaaagaacccccaaaatttcgcggccctcaaaaattatttttgaaaaaataagtttctcatatttttttaaaccgcagggttgtaacccacccc

SEQ ID NO: 3508 - DNA, 1195 bp, Diabrotica virgifera
tttgcgtccggccctcgttcctttttttttttttttacttttattgctgctgtcttcctctgattcttcgttggtttccatcgtaacctcatcatcggcaactgcaaagtctaaacttttgaatccttcagataaactctgcagtcttagttctttagcttctttcttcaactttaacttctctttgttctttgttttcttgtttttcttcttttctttagctcctttggttgctttttcgtcattgtttgtagaggaggttactacagggttgtgtctaactatattggaaacgtttagacaggcacatagtttgttaaaggcggttttggcttctttggataaggtaactgtgctcataaattctcgaactgattctgctattgctggccatttcatgcactctatatttaagacactcgttttcaaggcaactaataatttaaacatattacacaaaaatttttccgatgggactttgcgttcagtttcacataaagatttgaatagagttatggcattatttgagaattcctcgtgactttcgtttaaagcttccctaattttctccgtgtttgatcttaagtatctttgatttgtgtaaaatgaaaggaccaattccaagccttgggactttttgaaaactttaacgttagcgtcaaagaggtattttaaaattgtagttactaaagtaagattgccatcccaggaaatttttaagaggttcttaaaaaccagaaagggcgttgcacattctcttttattgaagtatgtgtccaattcgttccttattaactctactatggagtttttaagacgcttttttactttctttggtgtagcttcggcattggaaagtaaatctgaacacttgatcgtgaaaatgcaacagtgtgaaatctgttctctcatatcttgcacgatccaagtattctttgtccctttatcaagcaaactcttgagtagatcacacaagactgcgtcatctacaccatcagtgttttcaaatttcttcaaatttgataacttcttcaaacatgattttagtcgtcgcgagcggcgagcttcgtgttcatctcttacgctgaattccacagtttttaacaaagggagcataatttctaaagtaataatcatcgaagggttggaatctaaatatatatcgatcaaatctaaaactctaactctgaaatgg

SEQ ID NO: 3509 - DNA, 724 bp, Diabrotica virgifera
ataacgaatgccggcgttacgaatctcgttaaacttgcagagcaaattttcgacagcaatttcatagagtggcattttattaatagtcccccaattgtagaggtaattttgaaagttttgaaagcgtttatgaaaccagaactttacaataggttaagataccatcacacgctggacactttacccgattatattccactcgaggtcttaccaaaggattacggtggcaatgaaagatctttagaagaattaagagaactatatttaaaaaaactcgaggagcaccaaccatactttgacagactggagactttaaaagtcgacgaagcacgtcgtcctaggtcagaaaacgctcctacgggtatgcaggcaatgtttaacaacattaacagtttgctctttggataaattagtactctagttctagatacatacatatctattttgtaagctgcttcataaacagattcaattaatcaaacccaagattattttttatagttttgataccttgctggtactaattaaatataaggttttgataatcactgaacaggtatattaaattttaatagatagtgttgtatgtagttttaattttgtaagtaggtttgtattttaatttttatgtacgtttttttataaataatgtagaatatatatagtgactagttctaaaaattactgtaaaactattaactgagccaataaacttttatcatct

SEQ ID NO: 3510 - DNA, 1344 bp, Diabrotica virgifera
tccgggaaatttcccagaccgtcgggtcgaccgcggtccgtccgcgacattagaaagtacacacgtaaaaaaaatgaattcctttccctttgctgtcgacaaaaaaacgaaattgtcgttgctaaaagggctcgacaaaaacgaagaacatttagaagaatgtgtagagtgcataaaaagttgggttgcgtcacagcctcatttgccagaggtgccaagcgacaaaatgatcgaattcttcatcttcaccaccaagtttgatattgaagctgcacaaaagacgatagataactattacactcttagatcaagtttaacgagagtattccagtatgcaaatccatcatcgcacgcaatgaaggcagccgttgattgtgcgtacatagtgcctctaccaaacctcgttaacgatagaaatggagtcgtggttataagagaactaccaaatgtaccatctggtttcgacgggcattggtggttaggagctgttatgaacgtttacgaagttcgaatgcaagaaggggcgcatactacgggaaatattttgttgtacgaccaccagcatctgtccatgaaacacgtttttcacgtaacgccggcattcgttatgaatctcgttaaacttgcagagcaaattttcgacagcaatttcatagagtggcattttattaatagtcccccaattgtagaggtaattttgaaagttttgaaagcgtttatgaaaccagaactttacaataggttaagataccatcacacgctggacactttacccgattatattccactcgaggtcttaccaaaggattacggtggcaatgaaagatctttagaagaattaagagaactatatttaaaaaaactcgaggagcaccaaccatactttgacagactggagactttaaaagtcgacgaagcacgtcgtcctaggtcagaaacgctcctacgggtatgcagggcatgtttaacaacattaacagtttgctcttttggctaagtctaaaacccctatactctaaaatgacaacctgatttattttgatatgctggtttctaaacaaacaattaatcaaacccaaaattttttttttaagttttgatacccttctggacaataaaaaaaaaaaaaaaggggtttggaaaaaccccgggaaaagggaaatttaaattttaaaaaaaaaaaaggggggggggggggttttttttttttttttggaaggggggggggggagtgtttttttttttttttttgggccgcctttttttttaaaaaaaaaaaaaaaaaggaatcattttttaaaaaaaaaaaaaaaaaaaaaagagggggggtgcctcccacacaat

SEQ ID NO: 3511 - DNA, 1006 bp, Diabrotica virgifera
gccctccacgctcccccacgcgtccgcgcgatttttatttgagggtctttggttcagtccacggtcgcgtgggtggtcttctcagcgtgtcggttgtttttttcgtgtgaataaattaattaagatgaccacgtcggagctaataatggttaattcatggaacgaccactacaacacagatagttgcaatattaagataaagaacaagaaactaaaaaaagagctgtatgagatagccagtagggaactgagagaaagtgaatctagtcgtaaggagtgtcttgaacatctcagaaactggattaaacagaatcctgatatagaaaactgtcttactgatgatacctttttgcttcgatttcttcgagtcaagaagttcagcattcctatggcagaacagaccctcctgaagtatctcaattataggaaaaggtttaaatacttcatgcataatttggactgttgtgagcctaacgtatcagaaatcattggcgatggatttttatatgtgagcccctttagagacacctgtggtagacgagttgttctttacgatgtatcaaaatttaatcttgagaagttcaacggagctgatcttgccaaagtgttttccattacttacgaaaccttaacggacgacgaagagaatcagatattgggtgttaaacacgtaggaaacttagaaggggctagtttaaactatattcctttatttactatttctgattttgcagtaatgattaggtggggcgagcaatcaatgccgatgcgacataaagagatcaatgtaattaattttcctccatacataaaattcgtttatgagtttatgttatccattgccagtgagaagctaaaaagtagagtcaatattcattcgtctttagaacaacttcacaaaaaagtgagcaagcactgcctgccagctgaacttggaggtgatatgccccgagaaagaaatgataaagctctggaaagcaagaattggaatcgaaaaagaaaacgt

SEQ ID NO: 3512 - DNA, 1165 bp, Diabrotica virgifera
ttacgttcatgaaggttttcttggtactagccgcttttgccacgctatgcgcagccaagccgacctttctgctcgactcccttgtgattcacaaggtagctaaaggacttggtctaggaaatgtcatcagcgttgatggagacgcaagagccaagctcggccaaaacgaaattggagttgatcttgctggaggcatcgggggagatgtcgttggatatcacgccaaagttgatggtaatgtgttaggacaaaaagttaatgtgcatggagacatatacgatggtgataaagttgatgccaagaatcatcaagtgtacaccgacgaaaacggtctccaatacatcctggtccgccaatatgtcggtaccaactcactcttggtcagaaaatatttgatctccggaaaaatggtcattgatggtactaatcaaccactggacattaacgcccgttatccagacaccaccgttgatgtacgctatcctaatattaacgtcaacgttgaacgcccaggctacaagattgtccagatcacttacccagatggtaccctccgtcctatgtacgtccgcatcgaagaaccaaatctaccccctggctatattcgtgtttatgacccaaccgtcccaattggatacagaattgtcaggatagagaccccagaagtaccagttgaccctattcgttatacagtgataagaacaccaaatgtacaggttaatccaattcaaattgaaagagtgcagcctgagtataaaactattcgtatactataaatattttaatgttttaaaagtaagaagaattataataaaattttttttctcaaaaaaaaaaaaaaaaaaaaaaaaaaggggcgccccctctaaagggatcccaactttacgtacccggggcatgcggaccgccaaacttctcctaaagggccaccaaaattcaaattcccgtggccgccggttttacaccggcggcatgggaaaaaccctggggttaccaaactttatcccccttcgcaccccttcccccctttttccccggtgtggggaaaaaaggaaaaaggcgccccaccccactctccccttccccaaacattggcccccgcccttgtaggggcaaaagggggacgccctcccctggtaaggggggggattatgaaagggcgcgg

SEQ ID NO: 3513 - DNA, 1203 bp, Diabrotica virgifera
agaggcttcaacaaaataatttcgagtcagccaaatccaccatcacaatgagaagatctctttgtacaacagttaaattaacattaaatgtgcatgtgcgtaaagggcgcaaccatcatgaaattcgaaagttaagtaccaaacccagttactaccactgcgttggagaagatcctcttagtcacttaacattgggacaactttcagaaaagtgcagttactctttcggtgatagaacagctgtagtatcatgtcatcaaaagaaaaagctgacatttcgtagccttctcgaagaagctgatagactagcagctggtttcttaaaattaggatttcaaaaagaagatcggataggcatatgggctccaaatctggtagaatggtacatagcttttatagcatgtgccagaggaggttttgtgatggtctcaatgaatccattttaccaagccaacgaagcagagaatttgattaaacaggtaaagataaaaggccttatatgtggtgatgtgttccgaaaacaagattactatcacctattgaaatcaatttgtccggaattagaggacagcaaaccaggcaaaatatatagtgatagagttccaagtttgcgaactgttgtacatataactgaggaaaacaaaaagggaacatttaaatttactgatatacaaaatatggccgatgaagatactatgttacaaattaaaaatttccaaaataaaataaaatttgatgatccttgcaacattcaatttacatcgggcaccacaggaatgccaaaagcccccgtacagagtcacttcaatattgttaataacggatatttttctggtaaacgggtagggttgcatcaaaaacaccatacaatctgcttgcaaaatccattatttcacgtatttgggactatagcttcacttactgcagctgttaaccatggtgctacaatcgttctacccaacgacacttacaatccagagaaaaacttgagtgctattgtacaagaagggtgtactgtgatatatggaacacccacgatgtacgttgatttagtgtctcaacaaaggaaacgtaatgaaaatatgaaagcagaaatagcgctatgtggaggagcattgtgcccttcagtattgttcaaagacatgctggatatcctttaaagaaaaagcccgaaaaatctatatatgggactcactgaaacaa

SEQ ID NO: 3514 - DNA, 1081 bp, Diabrotica virgifera
cccacgcgtccgcaagcctaaatggttcccacataacaatttcatgttcttggtagattcgatattcaatattcgataaatagactattgattatgtagttccttttagttctcttattttgaacataatcaatagcctaaaaggtttattcgaagaataaacttttacgaatattctaagtaactacatacatgaatgtgctcagtatatttggtccgagaatattcttcgaagtatatgcaaaaaacatgaaatttaaaatgtttttatagtacatgctatgcttctactacacacattctaaaaagaatatattccgacgaatgttggtagtgtatgcttcgaacatgaaaggaaaatcattgttatgtagtataatgttgataattttatttttattggactgcagtttgttaataaatttataaataaataggtatattatattgctgactgatttaattttaagtattttattattagcaatttataaatacatgatattggtgtttgattttgagtatcctttaaaatttattttatatctcattctgttaaaaggccttccacaactagcaaaaatgtatgaacaaggaagttattttaaaggacaaaaataataatagaaaaattagctttatggtgttttttttattaatttttttgacagtatgtttaaataaacaaatgctgatgacatgaaaatgaaagtgtaatacatacttttggctcaaaactttatagattatgggacttatgtccccgttaaacctcggttagctaatcgggacagaaaagtacctctttgggcctcttgcgttgtaatatcatgtataatcataatatcatcatcattggctccgcaacccatggtgggtcttgacctgttccagaatcagcttcctatccctcaccttggtttccaatttcgcactcctaatcataataataagtacaattgtgtttatgtctatgttatgcatacatttctgtcctgattaaaccccggttagctactattcgcggctcaaccccataaagtaaataccccatatctaaataataaaggaagtatattcc

SEQ ID NO: 3515 - DNA, 1398 bp, Diabrotica virgifera
  misc_feature (102)..(102): n is a, c, g, or t
tttatcgcaactacaaattttggaccgattgaaagaagcacggaatttttcattacttattttgtgacgaattcggggaattccttttctttgaatgatatnttgtagcgactggcaataacgtctatactgacttgtggaaattccccgtttatgactaacaaatcagcacaacttttttcggcactttagaacgttgctattctttttctcatcgatacatcgttgggaagttctgatagcagctacagacaaaagaaggattcaagacatacggtggagtgcaagaggcgatgccgtaaatgtgacatggcatcattacaaagagattctcgtcactttgtaaaaactgacagaggcaggtgaaagcttaaacatgaggacagatgcaggtgctttactagtttcgatgcagtaattttcctttctttgttttttgggcctgtggcaacctgtgctacatgaagtgaatgcacgatgcacaaaaatatttacaaacaaggggacttgacataagattgtgcgctcagaaagtaaatgctttgcagatgataatgacaagaaaagagaggaatgggcaaatgacgctgtaggttatgcaaaaaatatgtgtgaagaacttcgaatttccataaaacctcggaggcgcataacaagaaagtatatttttgatgacggaactagaggtgataacttgtcttgtgaaaatgagttgagacgaaagctgttttcttcgttagatagagttattgtagaaattcgtgagcgttttcaacagctacagaattgaacggataagttttcttatgtaacgccggctatattattagatccagacaacactgaatgtaatctagactacgcatcaatctgacgaaattgacgagcagtgtttcaagttggaaaaacttcgactgcggactttcgttgctgctataagcaacgaaattgattaatgcagattcgcttgaattatttaaatttattgttaaatccaagctggaaggtactctgcccaaaattttaataatgttccgaataatttttcacagttgctataagcaatgccagctgtgagaggtgtttttcaaatttgaattgataaaaaatatttttctattctcataacataatataataaatatgatgccactacctggatcataatgaaattccttatgataaaaaattttctttaaaaaaacaaattgtccaccaataaaaaatcgcgaatttggcattcccggaaaagggggataccccccccagtcaaaatccatacccccttgacagttctccatatttgaaccaacacccgacaaactggaaaaaactaccttaaatttatttttttgtacaaaatttaaaaaaattttgaataatttttttttgtgtggg

SEQ ID NO: 3516 - DNA, 2441 bp, Diabrotica virgifera
gggccacccacgcgtccgcggacgcgtgggcggacgcgtgggccacgcgtgtcaaaatggcgaaaaagaaaccagaggataaaaataatcaaagcgatgatgatacaaaaaacgagagtgattactcgtcgaacgaagaagaaccaaacttcagtgatcctgaagactacgaagacgatgtctctgatgaagaactcttaggtgatgttttaaaagaaaagcctaaggaaactgatggagtagaaagtgttatagtagtagatggagttcctcaagtaggtcctaatcgtattgaaaagttgaagtcagtcattgtcaaaatatttgtgaagtttggaacaatagtaaatgaattctaccctgtcaatagtgagggccacaccaaaggttatatctttatagaatattcctcaccatctgaagctgctgaggctgttaagctcactaacaattttaaattggataagcaccatacctttcaagttaacctctttactgatttttctaagtatgaccaaattcctaataagtgggaccctccagagccacaaccttaccaagggcaagcagacttgcattcttacttattggaaccggatgcatatgatcagtttgctgtagttgttgcacaaacacaagctgtgcaaatttggcagaatacacagcctgatcctagtctcattgaagctagaaacagctggagtcaaacgtacataaaatggtcacctctgggtacattcttatgtacttttcacaggttgggtgttgcattgtgggcaggacctggatttttgcaatacaaaaaatttacccattcaaatgttcaatttattgatttctcgccatgtgaaaagtatttagtgacttattccccacaaggagacccacataatccagaacagaaaaggatcatcatttgggatattaggacaggtcttgaaaagcgttcattcaatccagaaggtccaacagcatggccaatcttcaggtggtctcatgacgacaaatattttgctcgtattggtcaaaacaatgatgcccttcaagtatacgaaacaccatcttttggtcttctagataagaaatcaatcaaaattaacggcataagagatttcaattggtcgcccacagataatgttgtagcttattgggtagccgaagacaaagatgtgcctgccagtgtaactctgttagaattaccaaacaggaatgaaattagaaagaagaatttgtttaatgttgctgactgtaagatacactggcagaagtctggagattacctgtgtgtcaaggtagacaggtattcaaaggttcgcaaggagaagaatgaaaccaagtattcaggtatgtactgcaactttgaaatattccacatgaaggagaagcaaatacctgtagacagtgtagagtgcaaggaacccattcaggcgtttgcatgggagccggttggttctaaatttgcaatgatccatggcgaatcccccagcatcagtgccagtttctacgaggttaggataggacaggctcctattcttctcaagaaatttgagaaaagagcttgcaaccatctgttttggtctcctagtgggcagttcatagttttagcaggcttgggttccaacggaggtggatcgctggaatttgttgatactcacgaatttttaatcatgaacactacagaccatttccaattgtcagatgtagagtgggatccaactggaagatatgtaattactggagtctcattttggaagaccaaggttgatacaggttatttggatttggtccttccaaggaaaaatcctcaagcgtatcaatttggagaaattctcccagattctctggagacctagaccaccatcattactcagcgatgaaaagcaaaaggaggtcaagaagagcctaaagaaatactacccgcagttcgagagcaaagacaggatgcgacaatccaaggcttccaaggaacttatcgagaagagagctgctcttatggagaaattccaagcctacagagaggagaggatcgaggagtacttggaccaaaaatcaaggcgtttgcagcttagaaataacattgacactgatgaattaaatgcagagaacgttgaggaggaaatcgtagaattctttattaaagaagaagtaattccagtcgactagcaccatcttgaaagtccggtcctttccctgcgtgtgctttgttacaacacattcagggagatttaaagtgaaaacgttaaatattataatataaaaaatatttgtattttggacattgacataaatatttgttaatcaagtgtctcgttcaattaatagtgttttatatttttgacacgcgtaccatctttccaaaaactaatgaacattgttattaaacgccttgtggttactaaaataaaatatttcataagaaaataaagcaggcagatgagaaa

SEQ ID NO: 3517 - DNA, 835 bp, Diabrotica virgifera
aaagcgtacagtacaagatggctttcaagttcgttatcttcgccgcctgcgtagcagttgccagagctggagtcctcagctctccattggcttactccgcaccccttgccgcacccttagcttatgctgctcctgtatcccatgtagctaaagtagctgtagctgcaccattagccaaggcagtaatcgctgaagacttcgaccacaacccacaatactctttcggttatgatgtacaagacagcctgaccggagacagcaaaagccaagttgaaaccagaagcggaaatgttgtacaaggttcttactctttgaccgatcccgatggcacccgtcgtaccgtagactactccgccgatgacgtcaacggtttcaacgctgttgtccgcaaagaaccattggtagccaaagccgtagtagccgccccagcagtagccaaactcgcagctccagcagtagcttacgccgcacctgtagctaaactcgcagccccagcttttgcttaccaggctcatgctgctcctgccctcgcctactctgcaccattagctaaatacgctgcccccgctgtagcctacactgctccagctgtagcgaaatactcgtacgctgctccagctctttcctactcagcatactctgctccagctgtatcttacgccgctccagctgtatcatacgctgctccagctctttcctactctgcgccatctttggcctaccacgctgccccagctcagtatgcctactcaagcaatttgatccactaaattaattgtaaatatgtaaatattgtattttcaattaatttagtggatcaaatcgctgaagactt

SEQ ID NO: 3518 - DNA, 1256 bp, Diabrotica virgifera
cggacgcgtgggaaaatagaaaaataccaaatttgtccaaaaacttaaaatatcagaaaatggccagtaattccaaaaagaaatcagataaaggacccacacctgaggaaatcctaaccggttttcaaaatttgagggccgaacagagggctctatcaggaaaactttcagaatttgagttagacttgaatgaacacaaaatggtaatcgaaacattgaaaaatgtaaatgaagacagaaaatgttttagactgataggtggtatactaacagaaagaaaagtaaaagatgtactaccagtattggtaacgaaccaggagaaacttaaagaatttattgaaaagcttcaagaacaaattaccaagaaaggttcagaaattaatgaatatagggaaaaacacaatattaaatttaggggcttagaacctacaaaacaagacgaacaacctgtagcttcaacaacggaagctagagggaatgttttggtttcttaacaataaagtaattacactttttattgtatatttattttctggactttcttgaagacatattaactctttattaggcctttacaatgtttgtaagatatattaacaagtttttaatgtaaactgttgttatttttggttgaattagaaggcttgttctgttactttcaaatatgaagttttataaattgatatttttcatctaaacaaaataagtaagatgtttgtgtatgcgcagtatttttaccaaaaactgtctttaaattatcaagtaacatactattacattatctattagtggcaaaatcaaaactgtgaaaatacagagtaacctggcaaaaaatgacattttttgtttatttctaatacgtatcttgtatccaaactttatacgctttgtatgtaagtttatacatatagtagacaattcactatttgaaagtaatgaaagtggcaacagctttttgtattctgttaaagcattgtataagaatacctcttcatttaaagatattgttctgatacatctatcagcatcacctttcaagaactatttttgtattttaacagtaaatttgtgttatagtataattgaatcaaatgaatctcttcatagttttctatgtaaggtagtttttttgctctatttttaaatccttgcattttacacaatcctatagcacacatttgctgtcttgattactaatgttttatatatttaaagttacagcttattttcaagtgtaaaaattaaacttgaatgac

SEQ ID NO: 3519 - DNA, 1084 bp, Diabrotica virgifera
ggctgcagtgaacactcgccaaggcttcgaaaatggtttcctttacgtatagaggattatgtgccccagttttcacaatcttcaataaggattcatcggtcaatgtggcagccataccagaatatgcaagattcttggctaaaaatggaatcgatggagttttggtacatggaacatcaggagaaggtgtttcgatgaccgtcgcagaaagaaaagccgtcgtagaagtatgggcgaaggtagtaaaggaaaccaaacaacatttaatggtgcaagttggaggatgtccattacccgatgctgtagaaatggccaggcacgcagaatccgtcggtgctgattccttactttgccactctgaattattctttaaaccaacaaatccaactgaactagtgaactatttgaaatatgttgcagctgctgcacctaggaccccacttttatattaccacattcctggatggacaggcattaacattaatatggaaaagtttataacagaagctctacagaaaattcccaactttagaggaattaagtatacatctacagatttagaaggaggtattgcagctcttagggccagcggaagccaaagtgcggtattcttaggtgcagatacattattggcaagcgcatacactatgggatttgattcagctatcgccaccagtttaaatatgatgcctcagcatgcaatcaaaatagttaaagcaattagagaaaataacattgacgaagctaaaagattgcaaaaccttttaacagatgccgttaacattattattaaagatggtgcttgggtacctaccatgaaagcagcaatgaaccttttgacacctattaatgttggccaaagtagaccaccacttgtgaatctaacccgaggcacaaactgacgatatggaacaagcattgaagaaattaggtcttttgtaagcgtacaactctattttaagagtttttgttattgttactatcaaataaagaaactgacagcctgtttttttggttctcctttacaaaaaaaaaaaaaaaagaggaaggtctgccaacaaaaaaaaaaaaaaaaggggggggg

SEQ ID NO: 3520 - DNA, 1482 bp, Diabrotica virgifera
  misc_feature (1467)..(1467): n is a, c, g, or t
cacggtaaagataaaatagtctattcgaaattatctgacttattacctgtggaagtagtagatgaaaatgatcctagtcttgaaagaccagaccaagaagaaattgatgatctgacagaaagaactagacaagcattgatgaaaattacgaactctaagatagcagcagctatgccagtaagagccgctgataaattagcaccggctgaatttattcgatatactccgtcacagcaaggtgctgcatttaattcaggagcaaaacaaagagttattcgacttgtagatgcccaggttgatccaatggaacctcccaggtttaaaattaataagaaaattccgagaggtcccccgtcacctccagcgccagtcttacatagtccaaccaggagggtgacagttaaagaacaaaaggaatggaaaatacctccttgtatttccaactggaaaaatgcaaaaggctacactgtgccactggacaaaaggctagcagctgatggtagaggtctacaacaactacatattaatgaaaattttgccaaactggcggaggctctgtatatagccgatagaaaggccagagaagcagttgaaactagagcgcaattagaaaagaaactagcccaaaaagaaaaagaagcaaaggaagaacatctacgtcaattagctcaaagagccagagacgagagagctgggattaaggcagctcctagtcattccaagggaggcgtggacgaggaagaacacgaaagagacttgcttcgtcaagatcgtcataaagagcgagctcgagatcgtaatttagcgcgtgcagctcccgataagcgcagtaaacttcagcgagagcgcgaaagagacatctcagaacaaattgctctcggtatgccagcgaaaggtgcaccatccaacgacactcagtttgatcaaagattatttggtcaggctcaaggtcttggtcacggctatggggatgatgaagcttataatgtctatgataaaccttggagagatggaggatccatggcaaatcacatttatcgaccaagtaaaaatattgataaagatatgtatggtggagaagacattgaaaaagctattagaactaataggtttgtaccagataaagaatttgggggtactgatcgttctggagcaggccgatcaggtcctgtgcaattcgaaaaagaagaagatccgttcggattggatcagttcttgtcgcaagctaagagagccagtaaaagaaaagaacctgaaaagagagacgacagggataagaggaaaagaagagagtaaaagtattttacagtttctttttgagacctttataaaataaatataggtatactggtatacataattctgatgtatttttaaaaaagttatatttgatattatgtaactaattgtaataggtaaactcaacaatacatttttcagataatttttgtgaattattgtaattanatatctataacacac

SEQ ID NO: 3521 - DNA, 1063 bp, Diabrotica virgifera
cttataactctaaattcaggtacctgctgaaatttctataaataccacaaaagtatgaagttaataaggtacgggtaaatatctaggccacagcatttagatcaaaatggcactactgggggctcagctagtaataacactggttatgatcagtgttatacaaaaattggggccacattactccctagctaggtggttgttgtgctctactggccttgtcaggtacctgtacccaacagatagtgaattgagagagttggctaatatacccaaggaaaaatccaagaaccgtaaaaattccaaagcacaaaccaacgggaagactaccgtagatactttccatattcccagatcattggacataaaactagatagtattaagatcaccagacaggatgtaattcatattaggtactatacagaataccagtggttggtagatttttctgtgtatgctgctgttatttacggagctacagaattatatcaagtgtggtttcctttaaaaaatgaaatcaatttgagtatggtgtggtgctttttggtgattttatttgctatcaaattattattaggcctgactgtacagtattttaaaggagaagaatcaataggagagaggtcaacatgtatcgtcatgggttttatttatttgttaatttccatgatgatactaattgtggatgaaaaaaccttggagattggtctagaagatgcttatgacagctttaataagagtgcctctgtgtttttagagaagcaagggctgtcatcaacgggaccagcatcaaaaattgttttaaagttcttcatggccgtctgggattggagttctcggagctctcttcactttcccaggaattagacttgccaaaatgcactgggtacttttaaaatatttccaggataacaagctaaaacagctacttctccacttcccttcccccttgccgtttatcctgataattttctgggtaaaaccgggggtccaaaaattaactttaaccttcgaatttttcacggaccgaattggacccccttgtctaaagagaaaagttttttt

SEQ ID NO: 3522 - DNA, 712 bp, Diabrotica virgifera
gcgtccaaaaattttcaaattcccaaagaaaaggtaataatgggaaaataacaaccggcttcgccgatgcattaaatacccataattataaaaggacggataccaaaaacccaaaaaaggtgtgttcataacggtaattgtccggccaaccaattggcgtctcaatctttaaacgaaatggattccgaaaggggtatttggtatgcagctcagtatggtgacctagagagagtcaggaaactagccaacgagaggagatgtgcagatgagaaagattcagcgggttatactgctcttcactacgcagcacgaaatggccatctgacagtttgtttgtttttgttggacaatggtgcagatgttaatgctgttaccaaaggaggagctacagcattatgtcgagcagcaactgcaggcaaagaagatgtggtagatctcttactgtcaaaaaaagccgatcccttcattcaagattctgatggtaagacagccctacatcgagcgacggaaaacaaacattttgaaatttgcaaaagactgttgaatgtggcaccttcgctttgcgaagtggcagataatcgagggaataaggcagctgtcaggaactgatcaaaaatacggcctagatatttattaaatctattttcaaatcgttttattcgtttataattattgtatcggtgcactaaatttattaaaaaatttagacagt

SEQ ID NO: 3523 - DNA, 858 bp, Diabrotica virgifera
gttgtcaatagttgtcaatgcagatttgcaatgataatttttatttttgggtcctcagtgctctagaaagatatttctaaaaatatagtatgatattaagacatcctacaggacacagtgttatagagatttttgtaacgtaattctgataggaagattataaaaacaaaatataatgagtgacaacagggaatcattgagttcatttgtggagaaacaagaacgacctccagagtatgacaaaatcttaggaagaaaggtgttggtggctccttcagaagaacagtatgatcttttactgaagaggcttaagcagcagctgggagaagggagaggagaagttattttggagataggtggatcagatgacggatctgaaaatggattactagatgatgaattagaagctgcagtagcaaccctacaatcattggcaaatactttggagtgcagttgcgtaagactcagagaacgtaaagaaactaggggagttgtggtacagtacctcattaggagagttcttgatcagtcagattttttggaaatacgagttgcagttgttggtaacgtagatgctggtaaatcaactttacttggagttttaacacacggcgaattggataatggcagaggacacgctagacagagactatttaggcacaagcatgaaatggaatcaggaaggacaagttctgtaggaaatgatcattttgggttttgacgaagaaggaaatattgtgaataaaccagaacatggctcacttgattgggtaaagatttgcgaaagaagttcgaaagtgataactttttattgatttttgcgggacatgaaaagatatttaaaaaactaccagtttt

SEQ ID NO: 3524 - DNA, 972 bp, Diabrotica virgifera
  misc_feature (804)..(804): n is a, c, g, or t
cgacattagtcgttatcacattcggaatatatatttttttcagtaaaaagtgaatatatgtgccactgaattgaactactggatctataaaaatgggtgtctctggtactctggtagtgtccacactactcattttatacatttcaaggatggccgcagctatagactctgtttgtgattaccgacaacagttaacaacgggtgcatcttacacctttaacaactatggttctccaaatagctatccgattggaagtgactgccgatggtgggtccaaggtgatgtagatactagagtctatcttacttgcacgatagacattccactgacaagtaactgtggcggagacaagtttagagtctctcttataggtgatggtacctacttttctgatgctaggaactactgcggattgcaaacaatatcactagtctctacgagaaatactctcgctgtggaaatgtattcaacgatttattcatccggaggggtgttcagctgttcaataaaggctgttcgaaatcctgttactacaactaccccagcacccacttgtgactgtggttggaagcaagcaaccagaattgtcggtggggatgatactggtgtccacgaatacccttcaatggcagctttattagataactctatccttgaggtcatatgtggggcagttatcttaaatcagcgatatgttatgactgcagctcactgtccaactatagttacaatggacaaaatgagcatcctcgtagaggttgggatatgtctcaggttgattctaccaaggaatacgaagtatncaattattggaagcatccccagtatgatgctaacacccaaatcaacgacatagctattgtgcaatcacgttacctgatagcgttttcctttggacgtggaccatttgtttaccattatatacgaaacatatattttactacccaagtgtactttattaggatggggtc

SEQ ID NO: 3525 - DNA, 1004 bp, Diabrotica virgifera
gaaatcctgttactacaactaccccagcacccacttgtgactgtggttggaagcaagcaaccagaatttcgaacagcctttattgaacagctgaacacccctccggatgaataaaggctgttcgaaatcctgttactacaactaccccagcacccacttgtgactgtggttggaagcaagcaaccagaattgtcggtggggatgatactggtgtccacgaatacccttcaatggcagctttattagataactctatccttgaggtcatatgtggggcagttatcttaaatcagcgatatgttatgactgcagctcactgtccaactatagttacaatggacaaaatgagcatcctcgtaggaggttgggatatgtctcaggttgattctaccaaggaatacgaagtatcaaattattggaagcatccccagtatgatgctaacacccaaatcaacgacatagctattgtgcaatcacgttacctgatagcgttttccttggacgttggaccaatttgtttaccatttatatacgaacaatataattttaactaccaaagtgttactttattaggatggggtcaaacattttacaatggtccttcttccgatatcctccagaaagttaatgtccaagtaacgaataactcgtactgccaaaaaatgatgcccggtaatcagattacgcaagctcaaatatgtacttacgcctcaggtaaagatgcctgtcagcatgattctggaggtcctgtaatttggcaagattctgttagtagaagactgtatgcagttggagttatttcttatggattaggatgcgctacaaatcgtccagctgtaaatactagagttacgagctacttggattggattgtaaatattatacaagattatggcttttgtatgaaataattttgtttgtatgatataaaccaagaacttaaaaaatagtaattaaaatatatttgttgttaaatgttgtaatatacaaaatgttactttttt

SEQ ID NO: 3526 - DNA, 948 bp, Diabrotica virgifera
gtcattagcaactccgatgatttttagtggtagagtttttctaaagctaggtgtattactagctggaggtatatttctcgttaggtccgagaaatgtgtcagcaaggattttggaaatggaggaactgtatgcgtttgtaactccacgtattgcgacacgtatgaaccagtcaaaccagtgcccagtaaccaatacatcgtgataacatccaataaagctggtctaagattcaacaaagatatcagaaactttacctctaacacatcggggaaacagtgtgtcatacccaaagatgataaagtctgtgagactgtgagaacaacggactacaaagtatgtggcgctagcccaaaatctcttcttacgtcaggatcaactatctacattgactcatctattggatatcaagagataaagggttttggtggagccatcactgatgcagctatggtaaatgtggcaaatatgagtgcttcacttaagaaacacttgctaaggtcatatttttcacacgatgggcttaactacaccatagccagagttcctatgggttcgacagatttctcaactcgactgtattcctatattgacagtgacacaaatgaagtaaactgtgtggatcatactttaaaaaactttaagctagcaccagaagatatcaatcttaagattccatttattcatgaagcacttaagctacaaaagaatctgaaactattcacgtcgacgtgggttatccccaaagcgtacaaagaaaacaacagctatatgggattcgtgggttttgtcagaaaagaagtctaccagttgcttgctaattactacgtcaaatttttcgatttatacaaacaacataacctaacgttctggggtctttacaccagtaacgaaccttttatagccatggcagagtatgtcggtactcctggaactttatggtacccgga

SEQ ID NO: 3527 - DNA, 1339 bp, Diabrotica virgifera
  misc_feature (978)..(978): n is a, c, g, or t
ctagttctagatcgcgagcggccgctcgccccttgcgtccgggacgacaagatggtttttcggacggggatagaactttcggaagtaaaatacaatggcttttgggactggttcgtccacgtatcagatgtacaaactctctggaagctccaaccaacatatctgatcgttcaagctgtttattgtttaggagcgcttttaacactaatccatgctcttattaacaaaggtagactaccatatctatggatcggagtactactccatggtatatacgttgaagttatcacatattttcttcctgatatcgacaacttctggcattcacaaactccaattatcttcgtagggagaagattgcccctacatattatgcttttatatccctgtttcatctacaacgcacaaatcgccgcagctaaactcaaactgcccaaatggtctgagccttttttggtaggccttctagtagtcttaatcgatttaccatatgacatcgtctcagtaaaatacgtccactggacctggcacgataccgatccgaatctatttgacaggcactactgggtaccatggaactcctactttttccacacaacattcgcagcaggatttacgttctggttccatttcctcagagaaaaaatctgcaacagtggggatcgatgggtagcagacaaaagcgtattcaaggaattaatatgtaccattcttcctgcagtcttgggatttccaacaggaatcatcggttttatactgatataccatccacttcacgatctgtacaacatccacagcgaaataacatacataatcctgttcgttatttgcctgttactctcgtggacaggtgagcgcgtaacagcgcaaagagaaggcgctaacagcgtggtaggcaaacttcatgggagttcgtatttaactttgtttcatctagttgttcactacgctacgtttatgttaatgctgatatttttncatccagaggatgaagtatcaacgggtatgaaagagccaattgggccttgtgacgagtactctccattacagacagtcttttggaatgactttacagaaacgaaaatgggtatgtccgaccgactacaatgaagactatttcgatttcactgcttaccgaacagaaaatcccatcaacgttccctgtggacacatttgggaacacgtttgagaacgggccgatacatacaatcataggtctatttgctgatgggggtggagtttttggaatttgatttcaaatctatggtgaacagtatccgcaaaaaaagttaaaagataaagggaaagaaaagaaaccaaaaaaaatgtttttactttt

SEQ ID NO: 3528 - DNA, 1328 bp, Diabrotica virgifera
ataaaaatggctcaaggagtattgagctcggatatctccagaagaaacccacaggatgactacgaattaattcagcgaatagggagtggaacttatggggacgtttataaggccaaaaggctctcaactaatgattttgctgcgataaaagtgataaaactagaacctggtgatgatttcggaatcatacagcaggagattcttatgatgagagactgtctgcatcccaacattatagcgtattacggcagctatttgcgtagggataaactgtggatttgtatggaatattgtggaggcgggtctctacaggatatataccacataactgggcctttagctgaaaatcaaatagcgtacatgtgcagggaaacgttactaggcttacaataccttcataccatgggtaagatgcatcgagacataaagggtgccaacatccttctgactgaatgcggtgatgtcaagttggacgattttggagtgtccgctcaaattactgctacaataaataagagaaaatcgtttataggcacaccctattggatggccccagaggtagctgctgtggaaagaaaagggggttataatcagctctgtgatatttgggcaattggaattacagctatagaattagccgaattacagcctccgatgtctgaccttcatccgatgagagcgctgtttttgatgtcaaagagcggattcaaaccacctacacttaaggacaaagagaaatggagccccactttccaccactttgtaaagatagcactagttaaaaatccaaagaagagacctactgcagaaaaattgttgcagcatgcgtttttccaaggagacatgcatagaagactggctttagaattattgcaaaaagttaacaatccttcccatatgtttgctgacctcgaacctgacgaagatggggctgtgccgaatgttccacaaagaattgcatcacgactgacttcaagaccaaaaccccagaacgccgttctttctaactcagatgtagatcgcatcgatgaagccaataacactctacagagatcagatatacctacagtaatagtggaagaaaaacaaccgcaatgggacctgatggatattatgaacaacgccacgaccgtgtacaattgcatagaacatcaaaatcaaaaatggtggaattggaaatgcttttgattcgctcaacagggagaagggatcctaccaatattcatcactcggactatgaccaactagccacctctaccagtgcaagactcagacaacccggtgaaatgtgccatccccgccctatcgccctacaatccattctaaaa

SEQ ID NO: 3529 - DNA, 897 bp, Diabrotica virgifera
ggtttgttcgatagcacttagtaccactttgtcgtgtataatttacgtatatctttgcaatggtatctagttcaatggctttattgtggaaatctttgttattaattacatgttttttggtagtggttaaatctcaaggttttttcattgggtacaatccgtacattggttatgcaataccaaataataaccgaaataaatgggcaagggcaactcatatcaatccacttttgctaccagattttaacgactgggttgtagatgatgatggttgtcggactcctactggtggtactggtgactgtatacctgtaagacaatgtaaagcgatgatggacgttttacgaactgtaaaaagaccattgtcgccaagcattaggaagcagttaaacgcatatttctgtagttttgcaaacggcatggctaacgtttgctgtccgcaagagcctatcataatccacgatgattcggtgccagaagtgccacaacccccaccagatgtatctaatcatagaaacttaaatttactaccgtctgattgtggttatctagatccaaatgataggattagaaacggacagaatgctgatttaaatgaattcccttggatggctttactcagctacagaacaagaaggggtccagattttaagtgcggtggaactgtaattaataatagatatatccttacagctgctcattgtatttcaaatttggatacaccgctgttgggtgtacgagtgggagaatataatactaggactagacgtgactgtgttataggcaaagatggatctgaaaagtgtaataaagatcctgttcaagatttggccatagaagaaattattccacatccccaatttgatgctaccgtaatctccaacgacattggacttt

SEQ ID NO: 3530 - DNA, 1521 bp, Diabrotica virgifera
ggatgtggtttgttcgatagcacttagtaccactttgtcgtgtataatttacgtatatctttgcaatggtatctagttcaatggctttattgtggaaatctttgttattaattacatgttttttggtagtggttaaatctcaagactgggttgtagatgatgatggttgtcggactcctactggtggtactggtgactgtatacctgtaagacaatgtaaagcgatgatggacgttttacgaactgtaaaaagaccattgtcgccaagcattaggaagcagttaaacgcatatttctgtagttttgcaaacggcatggctaacgtttgctgtccgcaagagcctatcataatccacgatgattcggtgccagaagtgccacaacccccaccagatgtatctaatcatagaaacttaaatttactaccgtctgattgtggttatctagatccaaatgataggattagaaacggacagaatgctgatttaaatgaattcccttggatggctttactcagctacagaacaagaaggggtccagattttaagtgcggtggaactgtaattaataatagatatatccttacagctgctcattgtatttcaaatttggatacaccgctgttgggtgtacgagtgggagaatataatactaggactagacgtgactgtgttataggcaaagatggatctgaaaagtgtaataaagatcctgttcaagatttggccatagaagaaattattccacatccccaatttgatgctaccgtaatctccaacgacattggacttttaagggtggcacaaattaatttaggtgttgaaaacgctagaccagtatgtttgccgcttggtgaacatcgaactgagaagttgaaaagagtaacagttactggatggggagtaacagatacacaaacaggagccacaagtgatatacttcaaaaagttgatttaccagtagtcgacttggattattgtagaaacgtatacaagaatcaaagtcgagctcgcatcacctacaagcaagtttgcgctggaggtaagaacaagcaagattcttgtcccggtgatagtggaggaccacttcatgttgccggattgattgatgacaacgctcgttacatccaacaaggtgtcgtatcttttggaccccgtgaatgtggctaagaaggttttccaggagtttacaccagggtgggttattactgggactggaaattaaataacttaaaccttaattttattaaaagttatttccctctttgtgaaagggatggggtctttggattgagaaaaacatgctaaagggatggaccttttctttttctaaaattcaaaatgtttaacgcctaaaacaaacaaaaaaaaaagggggataattttttttaaaagattataaaaacaaataaatttttggtacataatttttcttttttaattggttttttttttttaattttgggatcaaagggaaaaaaaaaaaacaaatttttttctcataaataaaaaccttaacccg

SEQ ID NO: 3531 - DNA, 956 bp, Diabrotica virgifera
  misc_feature (833)..(833): n is a, c, g, or t
tcttttgcgggccggaggaatgttatttcaatagctgcggaaaatggccaaagcaaaaatttccaagaaagaagaggctcgccttagggaggaactccaaacagctgagaatcaaaattcagttccagcacctccagatggtggttatggatgggttattgtattcgcctcatttattagtaatatggtagtagatggtattggattatcttttgggcttattttaccatatttagttgaagaatacggtacaacaaaaggggttgcagcatgggttgggtcagttatggtaggtttccagatgggtgctggaccactcgttagtgccgtggcaaataaattcagttgtaggacagccagtatattcggctgccttttagcctcatcatgtatggctctttccactttttgtccatctataccaataatgatggtaatttatggtgtcttgggtggtactggatatagttttatatatttaccagcagtggtgatggttggatattatttcgagtcaaaacgatctttggcaactggtatagcagtttgtggaacaggtgtgggagcattcgcttttgctcctttggtaaattttttggttaactcatatggatggaaaaaaactaacttatttctggcaggaattacattggcatgtgcactttttggggcattaatgaaacctttaacgtacgaagaagtgacagaagaagtcgttcagcaggtccctgcaaaaccaggtgttatgagaacccgaacgagtgagggaaacatctcaactccgggtgtatataactctacactttcaatgaccaaaagaaaaggaagtcttncacctatgggcagaaaagatgtttatattcaggatccattcagaatctcaaagaattcaaatcgagaaagtcacttgctgagtatagaaatagcgtccacagtatccaaaacctaaaatctca

SEQ ID NO: 3532 - DNA, 1666 bp, Diabrotica virgifera
aatgaataagaaaatgtgtttatgtgccaaaaatgtttattaaaaaccgaacctattacagaattttaataaatatcaacgaagcatcgacatgagcgaaaagaggataaccctcagcaatgaggccatggaaaaaattatcgggaatatgacggcggaaatgcaaaacgttgatggtcaatatgttcccttaggcttcacaccaccttcttcaacatctgagcccttaaactggaatcagcaaacaaattatatgaacagatattctcctgaagttgagcagtatccccagcagcggtataattttattcctcaagctcaacacatgtttgatgccaatggatacaaaaaagagtatgacctctacaagtcgatgcaaaatggcactgcagatatgggactctttgagactgaatatccctacataccacagatgatgaataatattccagaacatcctttgcttcactctcatcatgatgccatgccacatgtatcaaatccttctcaattgatagatttagtaggtaactggatggtacctaataacagcggtacctattctccctttggtacttccgaaaattataaaccaaatgtatttgatttaccaactgatctcaacaccagtacaagtatacatttgaaagatgaaaccagatataagactgctgatcaaatggaggatatacagtttcagtttaatagagactcgaggaaaccaagaatggtggctgaagtaaaacctatgaggccaagctactcagatgttttaaccaaggctgtaccacagactttgagtaaaccgttaaaatgtgaaactaaagatagtaaacctaaaaaagacagtaagaagaacaacaaaaatgagaagaaccagaaaatgaatagtacattaggtaggagcagtactaacaatgatatgaagggtaatatagatcttaaagatgtcccaaatgaaaaaatctgaatcaaactaaaagtgacaaaaagactgcaaagggtggtaattttagcaaaaagtgggcctctctagataacattgctgatccttcaataaaagtagaaaaaacaaagaaaaaaaaaaaacgatgattgcaaagggttacgtccaaaaatttttcaaaaaaaatgaacaaaaaccatgaatgaggttaataataaaaccaactaattcttaaagttgaagaattttattttgaccccaaaatggccttaaaaaaaattaaaaaaccaaaaactccaccaaaggccaatgaatctttttggaagaaatgatcgacctccccggaaaaaaaaaaaaaaaaattctcttaaaaaagaagatccatggtccccctttggagggggtggggacaaaaattaaaaaaaaaataccaaaggggggggggaaaaaaccttatcgggatttttttttttgggggggtttctttttttcctccccaaatatggcgagcaaagccccccaaaattaaccgcgggaaggggtttctttaaacgggggacgggggttgcccccccctggttgtggctttttttaaaaacaacacaacaaacttttttcttaagaaaaaaatttctctccatgggctatcaaaaaaaaaatataaagaaaaaaaaaaaaagaaaaaaaaaaaaacaagccaacacccccccccccccttct

SEQ ID NO: 3533 - DNA, 1535 bp, Diabrotica virgifera
  misc_feature (1306)..(1306): n is a, c, g, or t
  misc_feature (1341)..(1341): n is a, c, g, or t
  misc_feature (1468)..(1468): n is a, c, g, or t
  misc_feature (1501)..(1501): n is a, c, g, or t
tttcgtccggggacagaagaaagccaaaaagagtacaaagtcttaagcaaatcaaagaaaaaatagcaaaaaatctaatactccccaaacaggcaatgatttgtctgcgaaaatttttgcaaccatggaaaaacataaagaagtgttctttgtcattaggttacattctgtacagtctgctgctagcttaaagccaattcaggatcctgatccttttataaactgtgatttaatggatggtcgagatgcattcctaacactcgcccgtgaaaaacattatgaattctcttctttaagaagggccaaatatagtactttgtctatgttatatgaattgcataatcaaggtcaagataaatttgtatatacttgtaatagttgtaaagcccatgtggaaacaaggtatcattgtactgtgtgtgaagactttgacttgtgcatccaatgttatgagaaagaaggtcatcctcacaaaatggagaaacttggattggatattgatgatggaagttcacctagtgatagcaaagccaatccaggagaagctagaaaattatctatacagcgttgtatccattctttggtacatgcttgtcaatgcagagatgccaattgtcggttaccaagctgtcagaagatgaaacgagtcacaaatcacaccaaattgtgcaagaggaaaacaaatggtggttgccctatttgcaaacaactcatcgctctatgttgctatcatgccaaacactgcccagaaaacaagtgtcctgtaccattctgttcaaacataaagcacaaactaaaacaacaacaattgcaacaaaggttgcaacaggcgcaactacttaggagaagaatggctgttatgactagaacagcaccagcagcgaatcctataccaggtggtgctaatgtcactatgggtggtgctggtgtgcaatcagtagtaccaggtgctgttagtcctgctaattcaatgagtacaggtttgccaaatcctcaaatgggaataccatctcctcaccaacctggaattggtctaaaaccacaaacaccgccagccaatgtacttcaagtagttaaacaagttcaggaggaagctgcaaggcaacaagcacctcacgttggttatggcaaagtcaatccaggtcaagttcctggtcagaatatgcctccaccacaaattaggaatatgggacatcttggagcaggacaaagtggaggtaatctcttaccaatggaacaatggcaacaaaggtatccaagtggtgtagcaccaggtattcgacagcaaggtccaccagtaatgcangccaaaccagatgggtcaaacacccatgcagacanacaaagcgggtgtcagggccgggtactgcgccctataagtgtttcttggaaagtatgatgcagaaaacagccttacagcaacttatgcaaactttagaaactcgccgcagtctgctgaaaacacacnacaaattttatcaatactttaatccatccacancttatggctgcatttataaacaaagacaggcaca

SEQ ID NO: 3534 - DNA, 1416 bp, Diabrotica virgifera
cggtccattctcagcgtccgaaaaagtttaccgatttcccgatttcactgtttgcgatttccgaaaataaaaaattgttaaaaactcccggagtgcaaaaaactatcaagaatgacggtaattaacaagatggaggtggacggaggtccgaagggagaaggttttcggtcatattatattacaaagattgaagaattgcagcttatagtggccgaaaagagtcaaaatcttagacgtttgcaagctcagagaaatgaactcaatgccaaagttcgtatgttgagagaagaactgatgttacttcaagagcaaggaagctatgtcggagaagttgtaaagcccatggataagaaaaaagtccttgtgaaagttcatccagaaggaaaatttgtagttgacattgacaaaaacatagacataaatgatgttactccaaattgtcgagtagccctcagaaatgaatcttacacattgcacaaaatacttccaaacaaggttgatcctttagtttccttgatgatggtggagaaagtccctgattcaacttatgaaatggtaggaggacttgacaagcaaattaaagaaatcaaagaagtaattgaacttccagttaaacatccagaactttttgatgctcttggtattgcacaacctaagggtgtgttgttatatggaccaccaggcactggaaaaactcttctggcacgtgctgtagctcatcacacagagtgtacatttattagagtatctggttcagaattggtacagaaattcataggagaaggatcccgtatggtaagagaactcttcgtaatggccagagaacatgctccttcaattattttcatggatgaaattgattccattggatcttcccgtattgaatcaggatctggtggtgattctgaagtccaaagaaccatgttggaacttctaaatcaattggatggttttgaagctaccaaaaacatcaaagtaattatggctaccaacagaattgatattttggatcccgctttactcagaccaggaagaattgacagaaaaattgaattccccccaccgaacgaagaagctagattggacatcttaaagattcactccagaaaaatgaacctcacaagaggaataaatctgagaaaaatagctgagttgatgccaggtgctagtggagctgaagttaagggtgtgtgtacggaagctggtatgtatgcactaagagaacgaagggtgcatgttactcaagaagattttgaaatggccgtcgccaaagttatgcagaaggattctgagaagaatatgtccatcaagaagttgtggaaataagttttttgtactacttaatatgtgattattttttaagaaaaaaaatatagcgaatagaaaaaaaaaaaaaaaaaaaaaaggcggcggccc

SEQ ID NO: 3535 - DNA, 921 bp, Diabrotica virgifera
cagcttgtcagttcccaaaaattattattaagaccgttataaactaaaataaatactaattatatcagtgaataagttataaaatgtggtgaaccttaaatcaaatccaacagagtcctatgtgaactaaagaattaactccattcaaaatcatttacatatgctgtgctgctgcagttcccattgtgcaagagcacaatagataatactatcaattttataaagaatccaaaaacttagggaattatggctactgcctatagaagagattattatagacgtcaacctactagtaattttacatatgtgagtccctgtgtgaaatacctcattttcatactcaacttcatattctggctatttggaggtctactgattggtatcggcctctacgctttcgttgacaaatggcagttgacaggctgggtacgactagaaaatgtctatgatgtgattttaaatatatcgttagtgatggtcattatgggaggagtcgtttttatcgttagcttcgccggttgtgtaggagcgctcagagaaaatacatgcttgctcaaattttactcactctgtctattaatattcttcctattggaaatgggaatagccatcgttggattcgtcttcccccattctatgcagtcagttttggaagaaaatttcaccgacaagatcattcatacttatcgagatgatccggatctacagaatttcgtagattttgctcaacaagagttccgatgttgcggactcagctcagaaggatatatggactggtcaaagaatgagtactttaactgcagctcgcccagtgttgaacactgcggtgtgccattttcttgctgcataaatgcgactgatcttagctcaagactggttaatatatgtgtggatatggagtacaaaccttgtcgggtgctg

SEQ ID NO: 3536 - DNA, 993 bp, Diabrotica virgifera
  misc_feature (887)..(887): n is a, c, g, or t
gtcaattggaaataaaaataaacatctttttaaataattactatgcattcatttttaaagtctggaaaattaggagagcctgcctccaagagtggaacatcaaagtctgtaaagaaaccaaaatctgtaccatgggtagaaaaatacagaccgaaaacagtagctgatgtagttgaacaaagtgaggcagttgcagttcttgaacagtgtatatcaggtgcagatttaccgaatttacttttctatggccctccgggtactggtaaaacaagtaccattttagcagcagcaagacaactctttggtgacatctataaagaaagaatccttgaactaaatgcatctgatgaaagaggtattcaggtgattagagataaagtaaagacatttgcccaattaactgctagtggcaccagaccagatggcaaaccatgtccaccatttaaaatagtgatattagatgaagcagattcaatgacacatgctgctcaagctgccctacgtagaactatggagaaagagacaaggaccacaagattttgtttaatttgtaattatgtgtccagaataatagaaccattgacatctagatgtactaaatttaggtttaaaccgttaaacgaaagcatgatatttgaaagattaactttaatttgtaaagaagagggagttcagtgtgatgacgatgctttaaatggtcttgtagaaactagtgggggagatatgagaagagctattacgtgtttgcaaagttgtgctaaactgaagggtacacaagaaaaaatagatgttgagagcgtacttgaagttacaggagttgtacccactaactggcttgatgaatttttatctgttttgcaagaatttggtagactataataacgtangaaattttatacaaaaattaatggtgggagcttatgcagcatcacaaatttgggagcaactcaatgaaaaacttattaactgtgacgagtttaatgataagcaaaa

SEQ ID NO: 3537 - DNA, 937 bp, Diabrotica virgifera
caatataatatagtttccatttgaatgtcgaaacttaaataaataataaaatggaacggtttttaaaatattagagaaacaataatacttgctatagttaacggtataattttgtaatatgctaaaatagttgtcaccaagttttccgcaactaacaagtgctctttctatttttaagttttccaaaaaatcataaataatgagctatctaaaattacttgctcggtttggttctgctggatatcggtcgtgtctacaaacctatcgtaatgctcctaatacaattgctattttacatatacaagattttaaatatgaccagaaacgatattataaagattttggccacaaacgggaaaaagaacctacaataacaaaaatttattacacattcttatttactatgtgtttaattcctatgatagattgggtctggttgaaaaagttattatcagttaaagcagaaagtgagaatattagagaaggaattcacattccaagggaggaactggatgattctgctgaggatgataccaagaagaaaaagcacagaagggaaaaaataggatttagagatagaaagataatcgaatacgagaatcgaataagacactactcgactccagataaagtttttcgatacttcgcgacccttcaagtccagggaccaacggtcgatcaacacgaaatttacatgactcctgatgacttcctgagatccatgactccaggtttaaaacaacctgatggactgggtctagatcagtaccgaagatacgatcccaagacggtgcatcaaaaattggaacttacgctagatgaagacagcattttctacaagcttggaaagttccggattaataacgttttcggattacatttttcttcttactgtgttatctacatctcgtcgtcacttcgaaattgcttttcgcat

SEQ ID NO: 3538 - DNA, 999 bp, Diabrotica virgifera
ataggttagaagtttgtcattatttgacgagtattgacgacattgtgacattttcaatataatatagtttccatttgaatgtcgaaacttaaataaataataaaatggaacggtttttaaaatattagagaaaaataatacttgctatagttaacggtataattttgtaatatgctaaaatagttgtcaccaagttttccgcaactaataagtgccctttctatttttaagttttccaaaaaatcataaataatgagctatctaaaattactggctcgttttggttctgctggatatcggtcgtgtctacaaacctatcgtaatgctcctaatacaattgctattttacatatacaagattttaaatacgaccagaaacgatattataaagattttggccacaaacgggaaaaagaacctacaataacaaaaatttattacacattcttatttactatgtgtttaattcctatgatagattgggtctggttgaaaaagttattatcagttaaagcagaaagtgagaatattagagaaggaattcacattccaagggaggaactggatgattctgctgaggatgataccaagaagaaaaagcacagaagggaaaaaataggatttagagatagaaagattatcgaatacgaaaacagaatgcgagcttattccacaccagacaagatttttagatactttgcaaccgttaagctcctgtaccacgatgtaacagaagtattcatgacacccgacgattttctgagagctataactcccggaatgaaacaaccagatggactgggtctagatcagtaccgaagatacgatcccaagacggtgcatcatcaaaaattggaacttacgctagatgaagacagcattttctacaagcttggaaattccggattaataacgttttcggattacatttttcttcttactgtgttatctacatctcgtcgtcccttcgaaattgctttcgcatgtttgaccctcacg

SEQ ID NO: 3539 - DNA, 1566 bp, Diabrotica virgifera
  misc_feature (1465)..(1465): n is a, c, g, or t
tttcgtccgagacctcaaagtaatgttccaagaaatgttggaactaatgatagaactatcacctcatcgggtacttctaatactcatagtactgctactacttatagtactagttataattttgaggcttataggcggactctggaagagaacaaaaatactcaggacgttatgcagactcattcgaaagataccaatctcgaggctcctcagaaaagaccatctgtgtcacaaagaagaaaactctggagaatgaggaaacaaggaattgatacttccaaggtcatatttcctcctaaacctcaaaagattactatagacaatgccgaaatcgcacaggccgttgaacagactgtgtttaacctccttcagaaaagaagacctaccacctcatcaagtgcttctaatacatccactgaggcttattggcggtctccaaaacagaacaagcccaccccatcgggttataaatatagtgagcatgtgacgcagactcattcgacagatactgatcggtcaaaattatctgggagtcagaggaggattcttcagagaatgaggtcagagggcattgacactaccaattttaaattgcctcctagacctcgaaataccccatacgcagcgtattatgccgaagtcacaaagggtcttaaacggactagagaaactactgaaaaggaattaacaaaaagaagcaaacctgcgcccataaagacagcagtcattcctagagaatatccagacaaaattgtggctgagaatgacgttggggcgatacaagatgccttaacgaaacttattgatgaagctccttctgctcctgtttatgaaaaaaaccgactcatggatgggtactatgggttaatatgtgctgacgaggagtcctttcgtatcaccaaggactatttggaagaaaacactccgtggaaggtagttaagactgaagaacttccaaaatccacaaaatacgtacgcatgttgatgtatcttccgaacactaagaatgatgatttgacggcacctttggcgcgacttgaaaaacaaaatcctggtctcaggaccaacctttggatgattctgagctctgaagcaactgctgatgaaggactgcatgtgagtcttcggatcgataaagagtctgaagaagtgcttaaacgacttgaatggaagccttacttccttttacagagagcgagaagttattgggagaaacgattacgagaaagacggaggaatacatcgacgaaaacggcgagaaacgagtgagaactgtggagtacgtagagaagctgattgagagagaggtataagaaagcaaaaattgatggcttatgaaatcagcatgactctcttttgtgcaccattctgcgggaacaaatccaagaaaaaaatcatatcactagaattaacgaaatacgacgacgttctgaagccgcagtcccttaaactagaccaggacganaacgatatcgaagaggaagaatcagtatccgaagtatctgaacctcccactcctacgacggatcaggagaaaaccctcgaatcccgcgatggagccacgaa

SEQ ID NO: 3540 - DNA, 1105 bp, Diabrotica virgifera
gtttttacttataagtttagattgagcattcatactgcgaacaatatgattaacaaaagtgtttttacgatattcttgctgggggttatttctttggcccagggattcaatacaaaatattttgacacagaatttcttacgtccaatgggaagttgaaattggctaagctagtaaaatatgaacctgaaaagtttgataattatggagtttctggaattacagcaaatatgaatgaatatgcagaaaaaattttcttcaatatcggaaggtatgctttaacccatggtcttgaccctgtcaatattgcaaatgtaactgaagattttatgctggcatcaattaagtttaaaaatggtaaacttcacggaatatccacactaaaaagatatcaggacgtgctagctaattacgtacattccagtaggactttaattgtcactttacctatagaatttgttgatcttaagtttacctatgattacgatgtgaggatatttggacttggtccaagcggtagcatggatggcgaaatcaaggaatttaagttttaccttcaattttctttagacctcgagcatttcgttttatcaattaaacaattgaagaccactgacagtggacatatctccgttcaattccatggaaatattacagatattatagtcaacatattatctgaattcataactacattcctgcatccattactacaaggcataatcgaggcaataataaaattaatagcaggtggcgtagtaagtgaaattaataaacttctacaacaattagtcaatccaaatgcaaccgagtttattattgaggaactactggtccagcttaacaaaactcttgtaaattaattacctatatatttctatatatttactgtttaaataaattaaaaagattgtgtaaaattaaataaaaattatatttttcatgttaagctgaataaaataagcattatttaaaaaaaaaaaaatcattaaaaaaaaaaacttattaagaaaaaaaatgagaataagagacaaacaaatcaaggtataaaaaaaaaaaactaaaaaaaaaaaaatgaaaaaaaaaaaagggggggcgccccaaaaa

SEQ ID NO: 3541 - DNA, 2026 bp, Diabrotica virgifera
  misc_feature (1867)..(1867): n is a, c, g, or t
gttaacaagtagagtgttaacatagtagatagcggcctacgggcatcaagtgaccaaaactagcatcaataaacaaagactttcttttcattcccctagtgggaattacattattttatttttggtatacggtatacggtgaaaatatggggtaacttgcatcaagtttgcaacacccaggattcataacccaatacctacaattccctatagtagggaatcatattgatttatggtagtggtcaataataaagctatttagtgccaagtgtgacacctccacgcggttaggggcgggcaaccactccgtggctattagtcgggtccgtcccgcaataagctccacggtagggctaagcgcacacttaaaacaattttgtggtgaaggacagttggtttagttaatttattgatttcgttcaggcgacttattgatttatttactatacttattaatttagttttattatacatttattaatttagtttttattatacatttattaatttagtttttattatacacttataaatatgagtactaaaggtagtacccaacatatgcatgaaagggaggaagatgagagcttcagcactcatctgaatctccgattaagttcgaactcggctgaagagccaactttcgaggaaaatatgaaagaactaatggaattcataaacaatgagatggatccgagcaatagactaaacaaagctgggagagaaggtctgaaagataggatcactgcgatagcaatgaacatggccaatttggctggacaaaataagatcttgagggaagaagtcgaaagactaagaaaagagtgtaagaatacagagcgaatgtcgtatgcaagggtaacggcacaacctgcaatggctataaaaaccgataaaaaaagtgaacaagaacgtaagatagagatgaggaaggaggagaataccttgttcatcacatgtgacaaagcaacgacaggtcgaaaggtacaagaggaactcactaaggtgttgaatccgcgaacagagaaaataagaattaaccgaatgaagaccattggtaaggctctcataatcgaggccgcaaccaaagaggatcttgaaaagatcaaaaacaatgctaacgtaacaagaaacttcaaatgtgaactgcccaaaaagaggaaaccgctagtcattttatatgacgtgagcagttctgctaaagaagacgatataaaggaagacataagagctcaaaattttgaaaacatgagcaaagaggagtttgaagattcatttaaaatacgttttaaaacgggcccaagaggaaagtcaactgtccactatgtggcagaggtgtcccctgggctgcggaaagcattaatcagagataagatatatataggattcagtgcgatcaacgccaaggactacatagtagtccccaagtgcctcaagtgccaagacctgggacacgttgcaaaacactgcacaaaggaaaccgcatgtagccattgcggaggtgcacacgaaaagaaagagtgtaacaagactgagcagcgaaggacttgcataccgtgcaaggcacgaggaaaacctgaatgcaataaagatctaaaagattgtccaacacacaagatgttaatagacaggcaaattctcaaaacagactggggtaaataaattcgatcgtgaagattgtgttaatcaatcaacacgtgagaatgacaaccctgtggatggacaatcttctaagacaccgtcaaaacgattccgagatcgactgcgattactttcctttaggaggaaaaagaaaaatataccgattgttaatagcgaaaaagaaaaaccaaagacaagcgatgatggagtgttggctctgtatganaatatggaggtcaacatgaggctatcgcgtctcgaggaggctaccatactggttgctgccttgaggcacatagtcagaaagctccatcaaagaggcgataaaatcacgtttcctgtacctgatgcggtggatagaattcagctcaaatgcttgaacata

SEQ ID NO: 3542 - DNA, 1121 bp, Diabrotica virgifera
gtcaactattgtcaacataaaacgcctacaatctataatattaattattttattaaatttaagtcactaacaaaataattattcaaaatgatgcaacaatatatgaaagaattagagcaggaaccatttgatgctgaagaatttgtagaacgtttggcttggaggactttagctgaatctaaaggagatggagaggaacatgagattaatcctgctcttttacacgagtcgtttgtacaagctataaaagatcttaatttacttcatgaacgacaacaaaagaaatgtgaaaaactagaagttgttgttagagaagatgaagcgaccttttttcaggagatatataatttacttgaacaaaataagcaagccatggacacttttcaagaattagatggcaaaataaatcatgtagcaacaaaagtactgcatttaggtgaccagttggacagtgtcaatgggcctagatctagagtagtagatgccttaaagttaatgatacatttaacagagttcttgtctgatgaatcagtattatcacctatctttacaaggccagaattgatagatgatgctgctgatgtgatccaaaaattataccttatatctcaagatttgcctcccaaatttgatgttgctaagagaaaaattgaaagaaaatactcggatatagaaaaatctttaatagaggaattcgttctagctatggataacgaagatttaaatagaatgaaagaaatagctaccgttttatctcagtttaaaggctattcccagtgcgtagatgctttatattgatcatagtcaaatgggatgtctgtcgagcaaggacgttatttgctaacttttttaacgctttgtaaatacaatcatgcaaataattgccaaggtttttaataatccggaacaagcgatgggctaaattttgtactgaaacatattttcacctcaaactccgtcaatacttgattcaaagattgattcccaggaaggaacctagggtatttaaagcattattgagttatattattaccacacaatcccgtatttaatgattttgagcatttttaccttgggaatggaaaaaacttttttattcgaatttaacaacaaaatttttt

SEQ ID NO: 3543 - DNA, 608 bp, Diabrotica virgifera
acttttggattgttcctcagactacggaaatggtgactgtgaagaaggtggtcttatgaccaacgctttcgaatatatccaggacaacggaatagaatctgagtctagctatccgtacacaggcagacaaggaaactgcagacgaagcgctagcaaatctgaactgaagatcaaaggttacaaagaaccagcaaataatgaagaagctttgaggcaagctgttggtactgttggtcccatttctgcagccatttacgccgaaccaatccagttctacaacagtggtatctttaacagcaaacagtgcgtgaacaatgtcaactacttggatcacggaatcctcgtcgttcaatacggtgaagaaaacaacactccctactcaagcatcttgaactctttcggtgcaatccagaagttcctgctcactgaggggttctgatttttcatagacgaagtaattttgtccttcaagagaaatattgcattatgtggattggctcagatggccagttatccagttttgtaaaggtgcaatataagtaaataaaataaggtaaaatggaaaagaaaaaaaaaagggcggccgctcgcgtctagaccgccttaaa

SEQ ID NO: 3544 - DNA, 1137 bp, Diabrotica virgifera
gggtcccagcacgcgtccgcacacacgtccgttgttgttctttaagaaaaatcaaaatgaaactattcatcgcctttgcagctgttattctaagcgccagtgctttgtcactcaatcagcattgggaaagctttaaagtccaacatggcaaagtttacaaaaacccaatcgaggaaagagtccgcttctctgttttccaagcaaatttgaaaaccataaacgaacacaacgctaaatacgaacaaggacttgttggttacacaatggcagtcaaccagttcgctgacatgaccccagaagaattcaaagccaagcttggtatgcaagctaagaacatgcccaagatcaagaaatcccgtcatgttcaaaatgtaaatgctgaggttccggactccattgattggagacaaaaaggtgccgttttaggtgttaaagatcaaggacagtgtggatcctgctgggctttcagtgctactggttctcttgaaggacaaaactacatcgtcaatggaaaatcagaacccctcagtgagcaggaacttctggattgttccgtagaatacggaaatggtgactgcgatgaaggtggtcttatgacccttgcttttgagttcgtcgaggaaaacggaatcgtatctgaagctagctatccgtacgaagctatccaaggagattgcagaacaaccaatgacaaagcagtacttcatattcaaggttacaatgaagtatatccaagtgaagaagctttgagacaagctgtcggtactgttggtcccatttctgcagctatttgggctgaaccaatccagttctactcaagcggtatatatgacgacccaaattgcttgaactatgtcgaatacttggatcacggaattctcgtcgtaggttacggtgaagagaatggcacaccctactggattgtcaagaactcatggggagcaacttggggtgaagaaggttacttcaggttgaagagaaatattgcattatgtggtttggctcagatggccagttatccagttttgtaaaggtgcaatataagtaaataaaataaggtaaaatggaaaaaaaaaaaaaaaaaaaaaaagggggggggggggccccggtcccaatttccccttatggggggccgtt

SEQ ID NO: 3545 - DNA, 1096 bp, Diabrotica virgifera
acggacacttgggcccacgcgttttgttgttctttaagaaaaatcaaaatgaaactatttgtcgccttcgcagccatcattttgagcgtcagtgctttgtcactcaacgaccattgggaaaactttaaggtcaaacatggcaaagcttacaaaaacccaatcgaggaaagagtccgcttttcagttttccaatccaatctgaaactcatcaacgaacacaatgccaaatacgagcaaggtcttgtaggttacacaatggcagtcaaccagttcgctgacatgacccaagaagagttcaaagccaagctcggtatgcaagcaaagaatatccctaacatcaagacaactcgtcatgttcaagatgtaaatgctgaggttccagactccattgactggagacaaaaaggtgccgttttaggtgttaaagatcaaggacagtgtggatcttgctgggctttcagtgctactggttcccttgaaggacaaaattacatcatcaatggcaaatcagtaggcctcagcgagcaagaacttttggattgttcctcagactacggaaatggcgactgcgactacggtggtcttatgaccagcgctttcgaatatatcgaagaccacggaatcgaatctgaatctagctatccttacgaagctgaacaaagagaatgcagacgcagttctggcaaagctgcagttaacattcaaggttacaaagaagtagcagccaatgaagaatctttaagacaagcagttggtactgttggtccaatttctgcagcaattaacgctaatcccatccaattctactcaagtggtgtttttgacggccagtgcgcaaatagcaggaatgacttggatcacggcatcctggtcgtaggttatggtgaagaaaacaacagcccttattggatcatcaagaactcatggggtgcagattggggtgagcaaggttacttcagactggagagaaatgttaatatgtgcggtttggatttagtgacaagttacccagttctgtaaacatatattctcagtcttcataattgaataaaattttttataaaaaaaaaaaaaaaaaaagaaaaggagggggggc

SEQ ID NO: 3546 - DNA, 1787 bp, Diabrotica virgifera
  misc_feature (1702)..(1702): n is a, c, g, or t
  misc_feature (1760)..(1760): n is a, c, g, or t
actagttctagatcgcgggcggccgctcggatctagaactagtgcatatcaaaggtgcgaatttagtcattaaattgccaaattttccatttgtattctctaaatcattcgtttggtaagaagatggcagacttagatgatttctttgccaaaaaagaccgcaagaagtccaaaagtacaaaaaaatatgctaccactgaagaagttgccaagaagctagaagacactgcaaaaaagactgacaaattaaagaaagaacgtgttaatgagggcgaagatagtatagttactgaacaagaccaagacgaatggaaggacttcgaggaagaaaagaaagactacacagggttaaagataggaaacttaaccatcggtcaaaattcggaaagcagtactacgggagctaaggaaagtaccgaacagcaacaagaagatgagcctggacaagatgtagacaagaaatctggaccttggaaacgcatcgacgtcggggaagcagcggaagtggagaaagttgaatataaaccggaaccgatacttcctaatgtatctaagactggcacttatatacccccaagtttacgatcttcaggacaaacccaagttcaaagtactaggctgaatagaacaaaagctgctccagatatccataacgaagaatttttcccatctctttctggtgatcataaaaaaaatcgtagcgaaggatcattcgaagtagtgcagtccaatagatcgacctcacatagacaagcggaacaatccaagataaactctgcgcaaggtcccagatggaacctcgccaaccgttacaatactctaagtagtaacgagagctagtgacgttaataatccatagagaccaatgtgtactgtgtcgagagaggtggccagcgataaaaaaatgttacttacgattgattaaccaataactttgaaagagtcgcgtctgttaattttttaatggagacttgagtcgctgttcgatgaattctgtttgtaataataacgtataatgattccctttgtcaaaaagtttattcagcaaatgcaggtcgtattctcgaaaaagacacttaatgctcataaaaatgattgtatcttatttcatagatggtataataattattctttgtcatggtatttatttgagatttccaaaggatgtggttaagaacttgatctagttatcgctgtaaggcaaatcaattttgttccaataacgtcatttcagttaaaaacgtatcacacctcctctcaaatagtgtcacaactaaaaaaaaataaaaacggttttattgcaccaacagtttaataaaactacaaactattaaaaaatgttacgtttatagttcaagtatttgtcgttagattaccctagtgtcattataatcaacggtgcaccgaacataaacagtgtcacatatcgacttgtgcaaagcatttgcccatctaagatgtgtataaagcgtcgtttgtcgagttaaggcagtatatgtgattactttattcaaaaccatctgcgtatgtgctcaataaaagtgacacatttatcacttataatagtttttgaattaaaccctgaaaagttctagcacacattttaaatggcgttttctcaatattttgctttttgacttttgacactgtttgagcggaggtgcgatattagtttgtcgtgttacaccagcaaagctcttanaacattcagtttggaaattttctcaggattttctatttttatttttcttgtaacttanaaactatagaaaataggaagatttaat

SEQ ID NO: 3547 - DNA, 736 bp, Diabrotica virgifera
tcctatatgcatatcgaccagtcgtatcatccagtagtagatcctccaaagaccataaaacttaagagttcccattttactatatccaaagatgtcgtaacctgcaagaaattcgtagaagcggaaagtatcaaatatggagaaacagaactaatcaggaaatttcaacaagtatattttggcgagacaattaaaagtgatacaggacagaaaaaacgagaaagctgctagcaaggtagctgcaaaatcgggcacaccgcttcagtttcccaaaggagccattattcatttctctggaatcgaggaaggtgtaaaattattgagggaagatcttaaagaaaaggtcaaggaagtcggcaaaattgaagtaaaattcgttgattttaatcaaggtgatttggagggatacctacgtttcgcagaagaaaacgaagctgtcgagttctttaagacagttgataatgacacacttgaaattaaagatcaaaaagtcaaattgagagtgttagaaggagacgaagaggaggaatatctgaagaaaacttcagattctattctaaacatgagaaaacataagaaacaaaattctaataacagaaaacgaaagggcaactttggtggcggaagaagagatgctaaagttagtaaaagggactaataaacaaaatatgttatcatctttatctaattgtttagatattgtaaaaattaggttaaaaataaaggttttttttac

SEQ ID NO: 3548 - DNA, 1218 bp, Diabrotica virgifera
cggacgcgtggggttgaaagttaggttaactccttcactaaacttgctcttgttatagatacacgtgtttacagcaaataagttattttttaagtatattgactgcaaattttcacaatggctaacgatttagaacaaaagatcatcaaacaaatcgaatattacttcggagacatcaatctgccgcgtgataaattcttacaagagaaaatcaaagaagatgaagggtggatcactctggatgtcttattaacgttcaaacgtctttcgtcgttatctactgaccaagagttaatcgcaaaagcagttgaaaagtctgaaaatggcctagtaatggtaagcgaagaccgtaagaaacttagacgcaatccagagaaaccgagtccagaattgaatgaggaaagacgcaaagagatcatggggaggacagcctacgcaaaaggatttccattggatgaagaatttaacaacattatcactttcctagatgcatatggaccagtcgaatcatgcagtcgtagatccaccaaagaccataaatttaagggttcctgttttattattttcaaagatgtcgaaacctgcaagaaattcgtagaagcggaaagtatcaaatatggagaaacagaactaatcaggaaattccaacaagtatattttgacgacaaaaaaaaagagatacaggacagaaaaaacgagaaagctgctagcaaggtagctgcaaaatcgggcacaccgcttcagtttcccaaaggagccattattcatttctctggaatcgaggaaggtgtaaaattattaagggaagatcttaaagaaaaggtcaaggaagtcggcaaaattgaagtaaaattcgttgattttaatcaaggtgatttggagggatacctacgtttcgcagaagaaaacgaagctgtcgagttctttaagacagttgataatgacacacttgaaattaaagatcaaaaagtcaaattgagagtgttagaaggagacgaagaggaggaatatctgaaaaaaacttcagattctattctaacagtgaaaaaacttagaaaaagaaattcttaaaacaaaaaaacaaaggggcacctttggggggggaaaaaaaagtcgccagttaaaaataggggcaaaacaaaaaaacaaggttattttttttttttaatggttcacaaattggcaaatctaagctaaaaaaaaaggggtttttttttc

SEQ ID NO: 3549 - DNA, 1753 bp, Diabrotica virgifera
cggacgcgtgggcgggttttcgcattcgaataagtcggcttcatatattttttagacctggatatataacaaaagcaactaagccatgagcggtcccttcaagagaaggtcttcgatcaagaccttgcctgccatgagtcttcccgtcgactcaatgcgcagggcttccattcgaagggcatcggtagccttgggacaacagaccaaaacggccggccaacaggaagttccttgggatattctagacagatgtttgctacccgtggtgttctgtcatgctgcggctgtcatcgctagtaacgcgttaaatgtgctcaaaatttggcaagtgacgacgtttactttgtttatatggtttacgattgtgactattggagcggttcttttttaccataatcttaaggtgacagcagcgggcaaagccgtcctcattaccggatgcgattccaggatagggagcgccctcgccaggcagctagacgaacaaggattcaccgtgtttgcaggattccagaacgccgcaggaagctccgcggcagaggagttgaaggaagtttgttctgcgagactgcatgttttgcagttggacgtgtcctcggaaactcaaattttagcggcatctttgtatgccgttgagcatctgccagatggcgctcctggtttgtgggctgttgtacatgctcaatcatgggtggcgttaggagaaattgaatggattccacctcaggtaatcaagaaagcagctgacatcaacttcattggaccaaccagagttacccaaattatgcttcctcttgtccgccgcgctaaaggtcgcatcgtcatgatcacatccggtctttgcagagttgcatctccagttagggggatccactgtggactgctggctgctttggaatctcaagctgagtgcttaaggaaggaactgaaaagcagaggtgttgatgtagtagtagtagccccaggcgaattgactgctggttcatcgtggttgtcagatcaacacataatcgatcaagctaaagacatgtggaaacaactgggtcaagaacagaaaacagaatatggtgaaaactacttcgaaaacgcgttaagaagtttagaaaagcacaccaaaaatcaagaagtggacctctttccagttcttcgctctttgaacgacgcctgtatccgcacatttcccttgacaagaatatacgccagactcccgcaaggaaaaggcccaagtgttcatcgctgaataccttccacgccctggatacgaacgcattttacctcttaaggttaaaaagtttaaaaaccttccgcttcattttacaacatataatcttatgtattgggtttgaaattggcctaaacctaactatagcttgccacaatacaaaaattttgcatttttggcaaatagaaatataaaaaaaatttttttaccggaaaattttaaaaaatttcggaattggatgcctattataaagcttcggaaccacaccggaaacgcgacagggggacccccaagaaaaaataaaaaagaagggtaattaaaaaaaaaacaaaaacctaaaggacgggaaacccccccaccctgaaaaaaagcggtaccttcctccaaaatttttgtttatttacaaaccctggaaataaaaaccaaaccccttaattttggggcccgggggaaaattcctcccctgttgtcccggaaaaaaaaaacacttttcaaaaagaaaactaaaaaatttggttttaaaaaccctcc

SEQ ID NO: 3550 - DNA, 1413 bp, Diabrotica virgifera
gtttatcgttcataaaatacattaaaaacgtgacttattaagttcattaacaaatatattcaaattctcgccaaaaactaacaattctcggattatacttccgcacggctcgtggtgttggttcgacggtaacttctcgacgtcgaatagtaccgccgccggttcttcaacgggctctgggattctaaaggctgtattccaccaggcctacagatgttggtcgttgcagtctaggtgatgtggttgcagtatggatgacatgtccctcgttcttgtatcgccggcgatttgaggattcttgaagctcccagagggaggacggtgatctttatcccaaaaactagaagagtaaaacacatatcaatcatcaagaagataaaccaaagtgtgccagtctgccaatcttttaagaaataattgtcagaaagagtagcagatgacaagaataaattaaatggaatgaagatgaggagaatagttaaaatttgatgactaaacgtgcatatatgtaaattaaaaagatatatttaaaactaaaatatcagaaaccatgcttttagatgggaggttaggttagatataaaaaaatattagaaaaactgctagatgcagaaatgtaattaaaatatgataatatgtattcttaccccaagagaatgataagtctggaaatagctattgtcagctctgtaattgccttttattagattaccaccactattttgagaattgaaatgacagcgtgaagagaaaataattatttaaaaataaaatatcaaagatgtgatgtttataacgttagaagttcattaagcttgtaagagcactaagagcaggctgttcattttcatcttctccaactgctagtttgacacaattctcgatgttttgtaacagttttctccatgacttcacaattgttgaaatactttacagactcccacgcagatgtgatttcgtagagtcgagaatagtgaatgacttccaaaacaacttcaagtcatatccttcaatttttgagctaagtaattttgttctgtagtttctcttcatagacgcaatgacgccttggtccataggctgaactagcgcagtggtgtttgggggcaaacatttttccgtcagcagacttaaacataaatatgtgattcaagatgtgagtgaacgttgtcaatcaaaaaacacagcttttttgtggcaaattgtttccttttaaatgttttttgacttctggtacaaattttgacttagtaaagataatacagtggactctctctgtaacgaacacggatattaacgagggtttcgcttataacgacggtacacttaaattttctcatgaaattcctattgaactataaacccctctgtcaccgagggcatattttggctacaaaccaagaaaaaatgaaa

SEQ ID NO: 3551 - DNA, 1391 bp, Diabrotica virgifera
  misc_feature (1293)..(1293): n is a, c, g, or t
tttgctgacgcagtcgtacttcgtactgactgaggttcctatgaggttgtacagaaggtttgcggagacaaaacggtacaaagttcttctccaaaaacctctacgatacttatagtctttaccattatgatcaaatttatataaatagtgttgtgaattgttttggaaaatgtcccaaacttttagcaaaataatcccaattactagccccattgctgctacttgtatggaatatgtccatccctggacagatagctgtgctcaagctacttgtggactttacctttactgcatttacgattctttgaggatctatggcactgtttacatgttgacgctgttaatgaaaggacgaataccaacgaaggacgatctaaagaagacttttttcggcatcatacagtccacagccttcctcagtggcacaggatttggatattctctattcttgtgtttgttaagaaagacattcggcaactacaatatcctcaccgtctccgcaataccagtgtttctctccagcgtcttctccattctcatagaacgaccgagccggcggattttgttagccttgtacgtcagcaatgtagctaccgaaacattatggaacatggcgaagtcccggaacatgatcagcagcatccggtacggagacgtcgccatatacagcatcagcatggccattctatccatgtactttaagggaggttaccacaaaagctcggattgccccgatagccacgatgacgctatgtttagagtaatgagatttgtgattggtccttacgaggaaaaaggctacatgcgcagtcctagtcagtccaataccttctacagggaggtacacaaagatgacgaaccgagtacatcctcgggagcgggatcttctcgaagctggcagacgaccaggcggaaaaacggagtatatcggatcgtgtgtcagatgttgagggtgtacagtaggataattaataaactaaagagttgtagtagacatccttcctgtaaacatccgtttagttgtttatattataccattgagggagctggaaggatgttttcgttaggcttaggtctacaagtcaccttgaaactggtgttaaacttgaaacgggtattacaatctccacaaaatatcaaaagtatattatttaggaaagaaacttttaatttagcaatgttcctagggttgtataatggtgtctttagggcgtgcctctgcattttacgtagagtaagaggtggagacagtcctgttcatgctcttcctgctggtattttggctggaatggncgtcagtcggtatccagactcgacagtttccctatatgttttatggaaagtggcgcagattacatataattttgggattgacaaaggcatattaccga

SEQ ID NO: 3552 - DNA, 1177 bp, Diabrotica virgifera
acgatgaagagctatgtacggaacagttttcttttactatttatcatcacaagtgtgatagcccaatttgacccaaagttcattattcccaaccgctgtgcacccaaagaaacatgtagcgaatgtattcaaataccggattgctcttggtgttttgaccccaactttggtaatggacctcgctgcttcgatgcagaaatacagttcccccaacataaaaagtgtcccgaagaattcgtattttttccggaaaatatacaaaatgttgtgaccaatctagagttaacaaaagctcgtaaatgggacaccgatggtgatgaaacgatcacggaaggagttgtagcaagctataaaactggtggtaccagagatcagatggtacaagtcgcacctcaaagaatacgtttgaagttgcggcctggagcagtgcacaccatcgcaatgaaatacacccaagcagaagactacccattggacatttactaccttatgggtttgagtaagtctacgtcatcaacgagaaattgttgagtttgggcgagacgctggcaacgatgaaaaaactgacctcaaacttacaagtgggctttggtacttttagtgacaaagctcttatgccacatgacaacaacttaacagagaattttctgcattctgctccttacggctacaaacacgtcttaagactatcgacagatgccgaattgttttcacgcactgtgaaacaagccaatgtttctggaaatttgatggcacctaaaaggtggtttcgatgcagtattaccagcgttgcaatgtactgatcagattggttggagacaagaagctagaaaattactggtgggttgcacagatgcaaatttccacgttgctggagatggaaaacttggagggtattattaaacccacgatgttcattgtcattttatccatgatgggttcctacacacagtcttcctaataaagactaccccctcttttcgcaacaaatccattgggagcggtaaagagaaaattccattccacggcattttttggaatgcccccgataattctggggaaacccctacaaaaaagatttgccaaaatggataaaggggttcgccagggggaaaaaatgggaaggaacaaactctctaattttatttccccttaaaaagaaaaaatatggaaaaat

SEQ ID NO: 3553 - DNA, 1476 bp, Diabrotica virgifera
gcggtggatcgcttcgtcgtctgtctgtaaatcgcaccgactcaaattgtataagagcctgttttaaaatataccgcgcccgccgatataactacgagtgcgaaattcgagaaaaaagttgaaaagtgagcatggcatccttgatcacagtgcacctcaacaagggaggctcccccaacctcggctttaggttgcaagggggcaaggactttggtactcctctcctcatacaaaaagtaaatgtcggttctccagctgaaagagcaggactggttgccggagatgctgtgatcaaaatcaataacacagatgtctataatttaagacacaaagacgcccaagatgtcgtagttagagcgggaccatcttttgaaatttcagtccaaagaggtggttcaacgtggataccttcagttatacctactggtcccttatcggctccatctccgtatgttaacagttctggtccagttacaaggacttctttggcagctaacaaaagcgaaaatatcggatctatcggaacaggacataatttgtctgctaagccatttagcccacagctgaatggttctgtaaacggtggaccaaaattagtaaataaacaatataatacacctctaaaactatattcagaggaaagcatagcagagacactttcagcacaaactgaagttttatctacaggagccttaggtgtaaacttcaagaaaaacgaaagaaactacgactcatctaatagtgaagtcctgagagcactaaaagaagcagaaaacgaacccagctatccagatcacgaggccgactcaggtgtagtgaccagtccaaacagcggaattgccggacttagacatgtccaagccccggaaaacagacctcaaccaccacaacctcagctgccacctggacagaacatttgcgcagattgcgaacggttgattgttggtgtatttgttagaataaaggacaaaaatttgcacgttgagtgctttaagtgttccacttgtggctcctctttaaagaacgtagggtattataacattaacaacaaactttactgcgacgttcacgccaagtcagctgcactcaaaaaccagactaatccaaatctagttccaattaccatcccaccaggtggaagagctccagctcacgctatctcgtctgccctttctagccattcttatccaatatcatctccattatctccaaagttaaacacagctggtacccaatatcagacaaattactccggtcccaaaccattctcaagcgtaaatgcgccactctctccccataacactcttccaagagcagccccattatctccagtagctccagcaccatcttttaatagtcattcttatactccttctgcttacagtccttcatcagattatgcaaattcgctgtgccatgctagagagagcgaaatctagtagaactgggatgaataagcttacaaataccaaatca

SEQ ID NO: 3554 - DNA, 1140 bp, Diabrotica virgifera
  misc_feature (30)..(30): n is a, c, g, or t
cccttttacgtccgggggatacgtgagcgnggggatatactcggacatttactcaaataatccttatttttgaagcttggttaggcaaatacagagacaacttaaaaacaggttaatttcaaattttctttgccacactcggtgaaatagtcggacaagtttgctagtaaaatactaagacaacttaaaaacacagatatgttaaaaaaaatcataatgcagatgtggggctaaactaagacatgtgggaatgtccgggtatttcaccacaactatgattagaaaaggcaaatattaatcggataataaaaaggtattttcagatatcttccttttaacccaggtatttccaacaaatcaattagtgcaatattaggatattgctcataaacaccacaaagcagccgattgaacaaatcttagtatctctccagatagcttatgaaattttacatcagatagagcagataactcaaaagtcaaatatttgaagatatcctagtattgttctagtgcgacgatatatataccaaaaaattataatttaaaaataaaaatcgacctgtttcgggatttttctccagagtcgcccattctcgagaaaataaatgtattccaactcaaacgttctcactgtataaaaaatgagactaaaagacataaaaaatagacagatctgatgttttcgaaatccctaatatttcgtacagttgttcacataaacatctttttggaaaaataatagagtaattaatagaaatacggaccgttttgtagctgttttaagaaatccttatcgaaaaaacaccattcaactctcatttcgtcctgacaattgttttaaatgtattgaggattaaggattttttattttatatacaggttcgtttccttctggttaggttttttcgttaatttaggtttcacattacgtaaaaatggtgctaacacacaaaaagagtttcgaaagaggggcagatatatttaaaacaatttaccaaggtgcaggggatccaaaaaaatattcccctttttgaaagaaaaaaaagtgaagaaataaaaaaaagaaaaaaggagaaaaatgtgttaacgaaacacaattttttttgtttcaaataaaatgggttttttttgtttggg

SEQ ID NO: 3555 - DNA, 591 bp, Diabrotica virgifera
tccggatcgacccacgcctccgaataagcacaatgaatatcgttggacactctttgggtgctcacgtggctggtgtacctggcagaattctaaatggacaattggatcacattatgggtttggatccagctggtccactattcacaacagaaaacaccagaaaccgtctcatgcccgggagtgcacagtttgtccacgttattcacacttgtggtggtcttataggacgcttaaatccacgcgtccgtgcggattattacccaaatggtggaaagaaccatcaacctggttgcgaaatggacgtgcttggtaattgtgcccatttcttatccattaagttctatattgaatcgatattaacgggtaacttcaaggccagaaaatgcggctcgtatgacgacttcactaaaggaaagtgcaacgattcgccaatttcatatatggggcaatataaagttgacaaaggggcacagggatcatatttcctccaaaccaataggaagccaccatatgctaaaatttaatgtgattaaatgtatattttgtatagaattaattaatcctttaactccttggtaaaaaaataaatta

SEQ ID NO: 3556 - DNA, 884 bp, Diabrotica virgifera
ttaaaataaaactaaaaagcaacaaaaacaacgacctcttcacgcgaaatgtctctcgaaagaatttctgctaaaagttaaattgttttcacgagtttaacgtgaatcactttctcgttaaaatgttcaaatgtgcaagggtagttatatttgtgattttagtggtggctattgagggaataaggagaaagcctgtcaacatcgctatttttctaaacgacgatgaccaatacgagatttcctcaattgcagttataagcgtcatacgaagagtcaacctataccacagggtggaatcatttttgcacccccacatctttaaagtacaaaaacatgaagttttaagagcgggtcaattagtgtgccagctggtggagaaaggcatcgccgccatttttggccccgagtcgccagaaattaacgacatgattcaatcagtgtcctccactcttcagattccacaattccagacgttctggaatccgaagttggcaactctcgcctaccgccaaccggtcgcagacagacccaatcaagttttcaacttgcacccgagtcctaaagctctctccaaagctttggccactttggtgcgcgagaacgactggaagagttacaccattctttatgaaaatgataatggacttttgaggctgcaggagacgctgaaacagctaaatcccagagaccccgttgtggcttttaaggcactggggccaaaggaaaatctcagatcagtgttgaaagaagttaaagcttctggagtttcgcacttcatcctagactgcgaggccgaccgaataatggacattttaagactggctcagaactttaattgttgtcagaatttcatagctacatactgactaacttggactcacata

SEQ ID NO: 3557 - DNA, 1493 bp, Diabrotica virgifera
atcgccattttatattgtcctttttgagtgaattaatgcgaggacgacaaagatagtgtgcgtgtggtgtgtgttcggtgtaacaaagacgtgttgttaatggtgtagcaaacaatttaggccaaaaacaatttagaaaatgaaaaattttgtgttttgtgttaccttgaattttctatttttcatcagctccgtattttcaattcaactagcggctaaagaaaaaactgtaatatttacaccaaaacatcagtttacgatatcttgtaatgtatccgaagcagagggaacaccagagatcatatggacgagaaatgatgtcgaggtaacgaagatagatgcccttaaaaatgtaaaatcatcttatagtaaagaaaaaagtcaggtcacattgacactgtcagacccaaaagatgattttgctggtaactataagtgtgttgcaaatcccggcaagccagacgaagtatatgctgaaattagagtgacaagggcggtacttgtcaaagtacccgcaaacatcaacgtagttgaagaagagaaattaagaatacagtgcaaagttttaggtgatgcaaagttatcatggacgttcaataatcaaacctacaacatttctgaaggccgcgttactcttgagaattacaccgaagatggtaaagtcgtggtaaatggaatgtttatagtagaaggcataacaaaggacgaccgaggaatagtcacatgcatagggggcgtggacgccgctactaacaaatcaatccaatctgaatgtatggttaggattaaagataaatatgccgccctttggcctttcttaggaatatgcgccgaagttatcattttatgtgccattattatagtatatgagaagaaacgtaataagaccgaactcgaagaaagtgatacagaccaaagtccagaccaaaagaatacaccagaccacgggaaagatgcaaacctaaggcacagacagtgaagaactagacaagaggtaaaaagcagtacagcataataaaatagaatataaagttaagaactatatagaagttaaacagttatattcgtcatgtgtagttgggactattcgcctcaacaacatttcgctcgaaggtgtttggaggtactgtacaaaaaaactaaaatttaggttaggtttaaattgttaaaaagccttcccactggtttgccttaaataacagcctttttattgtaggttaaatatgcatgttgttttctatttttgaagaagttttccgttacttataatttttagtacttaaaatatgtagatattgtaaaatcattgttatgcaactaaatgggctgatatttaacgtgaaaaaaatgtcataccattgtatatatttataacattaaaaaataaagaaaaaaatggaaccctccctggttcatttttttatttgccattggttaaaaaaaaaaaattaaaagttttttattttgggggacttgttttttttcctttttaa

SEQ ID NO: 3558 - DNA, 1053 bp, Diabrotica virgifera
gtgcgttattaccaattaaagtcgagtaaataatcgttaaatcagggaaatcggctgtctgtcaattgttccaggacatatctctacaaataagttctcctatggctgaaaagcaagcgtcgttctcattagttccgaaaattgtcaatggcggtattgccggtattattggtgtcacgtgtgtcttccctttagatcttgtcaaaactagactgcaaaatcaacaaattggtcccaatggcgagaaaatgtacaatagtatggttgacgccttcaagaagacgtatagggccgaagggtttctgggcatgtaccgaggatctgccgttaacattctactgattactccaaaaagccatcaagttagcagctaacgattttttcagatacaaccttcaaactaaagacaaattagatgcatttaaaaagacgtttaagacggaaggattttttgcactgtatagaggggccggagttaatttactattaataacgccagaaaaggcattaaagctcgcagcgaatgatttttttagataccatttatcaactggaggggtattgccagtatacaagcaagtcatcgctggaggtttggcaggtttatgccaactgattataacgacaccaatggaacttctaaagatccaaatgcaagaatgcgggaagggtcgaggcagctacaaaaatggggagtcaaggacaacagattaaagaaaaactgacagctacaaaattggctttaaatataattaaaacagatggtatctttggcttctacaaaggtactggtgctactgccttgagagatgtatcgttttctatggtctattttccccttttcttcgcattgaatgaattaggacctaaaagagccgatagtgatacaatcttctgggccactttttttgctggactaggtgcttggtggagtttcagcgttaagtgttatccctttcgatgttgttaaaacaagactgcaaacagcaaaaaagctgcaggagaagatttttacacaggaataccagatgcttttaggagaatatttctaaa

SEQ ID NO: 3559 - DNA, 1217 bp, Diabrotica virgifera
aaataatgtacttatacattttgacaatataacgatttgaattagaatctgcagcaaaatttattttgactatatgtttttactataaagaacaagtcccagtcttttaacatgtgacaaaaatgtgacttggtaagttttgcttctagacccctcatttctaaaataaagtaacattttcaagagttcctaagtcattttttaagaactaatacttgtgataggtcttttgtattttattaacattttaatagttgttgtaatcgtttggaattgctcatgtacatattacaagttctcttttgtgatattttgcaccatagttggcaaccctcagtgctattttgatgtggctgctatgataagttactctttcataattttcaatattcattcttgttccgctgccatgaaatcctctttcgtatactagtctcgcatatgtctcggatattgcagttttcttattttgatggtttcttttttttcattcacttacttaatttaactaaaaaatgattttattaacgtttcgacgtccaaatcagatacaaatattttgtattttgacttattttccatttagaatagttaattgcaaaaatgccacaaggaaatagcttcagagcaacatttcttatagttgcagcgtttaaggtctacacttctattctgtaatgtagtgataagccaacgtaattcttgttacgttcagtgtaaaagtatcttcagtttattttgctatttctattcatactgtaaatccgtttattaaattagtttgatttattatcccaggtttttgatatggtcaacaaaattcgtttttgcaggtttttttattctgtacattttttaacttgctcctccctttctcattgttccttccattggcatctttattaacatgatgggtactatattatagaagtctccataacatttagttttccatttgttttcgtcttcgcaattttattaatagttaccacgagacagaatacacaggttgaagtgtttgaggtatcttttgttttttggtatatgaacgttatattaattcaaaaaacctataatactatagatgtaattttacagttataaagtttcctccctgcctatgccagatgttgataaacaaagtattcttaatgaatatatcaacttaattatggtaagttttaactgcgacaaaaaaggtaaaaggtaaatttaac

SEQ ID NO: 3560 - DNA, 665 bp, Diabrotica virgifera
cccacgcctccgaaaaaaatgagtttcgcacaaattaaaatatatattaaaaaaacagtaaaataataaaaaaaaaaacaaaataaaaaaaaagctacacaatgtaccaatgtatctataaaaataatattgtagaatgtacttatgttaataagaaatttatgactatgaatctacaatcaatcacaaacaagtctggctaattggcttaaaactagagagagagacttgaattgaatagtaacgcaaccgtctctatttcgccctttttacgttaggacacgtttgcataggtaggtcaaaatgaccaaaggtacctcaagttttggtaaacgtcgcaataagacccacaccctatgcaggaggtgcggtagatcttcataccacatccaaaagtcacagtgcgctcagtgtggctacccatctgcaaaactacgttcctacaactggtccatcaaagccaagaggaggaagaccaccggaactggccgtctccgtcatcttaaaattgtacgcaggcgtttccgtaatggattccgtgaaggtactaaaccagttaagaaatcaacgtagatttattaatttttttttgtataagaacaaataaaaaactgtttagtttaaaaaaaaaaatcctttctcttcttaaaaaaaaaaagcgaaaa

SEQ ID NO: 3561 - DNA, 1817 bp, Diabrotica virgifera
tcaagatcgcgagccgccgccctttttttttttttttagtcgttttattctctttgcagaaatatcttcaactatctttacatggttcattgctaacataacagacataaatacctaaaaaatgaaaaatcttattttctttctgtacgcgattctggtgcccagtttaaacgctatccccgtagatgtcatccagagaaatattccagtagaagtgaggtatgaccagatcctcccaggaattgtatccagggagcaagttctaatgcacggaagaaggaacttagatgcaaaggtgcaattatcttcagacgaactgcctcaggtattgaaacatttaccgattccacttgaatctgatctcgttcctgaaattgttagcgaggaaaaagttcaggtggcatcagaagtcgaaaacaatgcagttaaatctttaattcaacctgaagatcaagaaagtgttgaagttcttcccgaaaaacctattgatttaccaatagaggttccagagacacctttcgtgaaatctttattagccccagaaccacttagcgattcgaacactgttctgcaaaaagcagctccaaaacctgcccagaccttagacagtgtcttacaagaaactcagaacatcatcagagttggtcttaagaatttgagagactctttcaaaccaaacaaaggcgaattgggtcccactgctgaacaatgggctacgttggagaaacaagttgacgaatacttctcagaagaaaagcacaaactcgctattagacaatctcaaccagtagaaggtggatctacagcagcaccagtagcccaacagcctcaaaataactgggtccagaatatcgttaatggaattaatggaattgctagtaactttgtccagagtatacagagtataggaagtgctactagtggtggagcacaacctcccaatggacaagcagatgaaggagcggcaggagcaccaccaagtaatggattccaaggattcgttcagtttttcaataatggcataagcaacattgtatctactatcacaggtacaaataataatcaacctacgacttcaaataacaaccttagtgatcctggaagcggtgccactcaagcgcctggtaatgttataggaggattttttggtaccattgtaagtaatgtacaaaatgcttttggcattcaaccaccaccacaaggagcacaaggcgatactgggtcacaacaacaaaatggaccagtccaagtaattcagtcagtgggtaatgccatatcaaacttctttggaggaaataggcctccatccaatagtcaaggagatgaaggtgcatcggcccaaccaggaaatagcaatataattcaaaatattcaaaacgctatccaaaatagtccattaaatccgttcagaccacaaaacggacaaactcaggtcaatacaaatccagttcaacaagctgttcaaagcattggatactcaagtacaacaacttatctccatgctggaggaagtggagctagtcccccacctcatccagttacttcaagcggtatataagaatcctgtatctgctcaagctggttctgaagacttgatacctgttgaggctgttccagttctcgaaatagaggaaccaattaaggaaaatgaaatcgttaaaaatctacttcctttagatgtaaaataataaatacaaacaaaaattacgtctcttgacatttatgatttggtattcaatatagaatgatgttttagtttttaatatttaattaatttattttaatacgcaaataaatgttgatagtaaaaaaataaa

SEQ ID NO: 3562 - DNA, 1186 bp, Diabrotica virgifera
cccccccgcgagacccgacccccttttcccgtcccgaagtttatcgggaattcttcgcagaatgttccatatgcttgtgaacagttcctgcagtattggaggtgatgttaaaaatagtattgcgtaatctccaaagtaccagaactgattaccgttgtctaatttcccgtactattaaacaaaacctacatactggagctgttgcgatggccaacgaaaagattgataaagaagaaattaggaaaaaattgactcctctgcagtatcatgttacacaggaaaaaggaacagaaagacccttcactgggtcttacaacaaagtctacgatgctggtacttatgtatgcatagtgtgtgaagtatccttatttagctctgataccaaatacgacagtggatgtggatggcctgcttttaatgatgtactagaccaaggaaaagtaaaactcacgcccgatactagtggagggagaatcagaaccgaggtgacctgcgcagaatgtggcgctcatttgggccatgtcttcggggatggtcccccaccgaccaggaagagattctgcatcaattccgcatcattgaactttataccccacgagaagaaagacgaaagctgaagattatttatttattttaaaaatctttgacctaatctgtaaactgcgtaactctataattttctgaaaatctgccatctgtttcaaaaggtccctacttatcgtctaaaaaaggtagcacatgcatatttttaccagataagtaaatagcgacctcttcgtatacaccgtatctcccttatcgccaaatttagtacgaaaaattcgtaactctctagtttgtcatcccacacgacaagaaaaagttggtggtaatattaaatacttattaaacaatatacaaaatgttagtaatatgtgtatctataaaatatttccgttttaccatcctatcttttaaaatgggagatacgtagtattcgcattagtctttggagagatagttttttgcgactcctgtaaaatttggataaatggagttaaacagtttacagatttggtcgacgaaatgctaactctactttaagcgattttcgaacttaactattttgtgaccagtcttaaataaattatgtgtaagattataaaggtttcttttgtgtatatgtaaaatagagatgttttacggt

SEQ ID NO: 3563 - DNA, 1026 bp, Diabrotica virgifera
acccagaggaagcctatatagccgacctagattcaaaatctggagctagtcttaaactgacaattctcaacaaatctggtagaatatggacaatggtagctggaggtggagcttctgttatttacagtgacaccatctgtgatttgggtggagctagcgaactcgccaactatggggaatactcaggtgcaccaactgaacaacaaacttacgaatacgccaaaaccatcctttccttgatgacacaagaaaagcatcctaaaggaaaagttctggttaccggagggggtattgccaatttcactaatgtagctgccactttccgcggtatcatcacggctttggtagagttcagggaaaggttgattgaacacaaaatttccatcttcgtcagaagagctggacccaattaccaggaaggtttaaggagaatgagagaagtcggacagactttgggtattcctctatacgtcttcggacctgaaactcacatgactgctatttgtggtatggctttgggaactcgcccaattccatcagaaaatcacgtagaaactgccacagcaaatttcgctcttcctagcggtgaaattgaacccaacaaacagcagcttgccagcaaagatggtgcggccaaaccagcagcccctccggcaaggaatatggtgatggatcacatctattcaatattgaaatttggtgccaaagatgccaatcagggagactcaaaagcccttccaatgtttaccaacaatactaaagcaataatttggggaatgcagaaccgtgctatccagagcatgctcgacttcgatttcgtgtgcaacagaaaaagccccagcgttgtagcaataatctaccccttcactggcgaccccagcaaaatactactgcggacacaaagataatactcattccggaatataaacaatgacagactgatgatgaaacatccctgacgctgatgtcctttggtatattttcgcttcaattcccatccagggttattcctataaattgtggaaa

SEQ ID NO: 3564 - DNA, 886 bp, Diabrotica virgifera
tatgacttggctcttgtttagttgtttatttttccatttttctacaagcatgaaatggattcggaatctgtatcttccactgtgaacaattttccatctaaggtcaataattttgctgttatagtgaatggtcaacacaccgacgtagcattaacaacatttacaaactatcaacacttgatcatcactcaatttgaaaagatagggaatctttaccaagtcaaggtagatcaaccagccaatggactaaccgtatcagaaaaggtctacaacattaagcagatactgggagctgagaatgtacatgcagaagttgcagttagatatttgacagaaaaactggccactcaaaaacctttgctagtttgtttaagcctaaaagactatagtagacgtagcttagatattattatagaatcaattgtaaatcacaagtaaaccatggctttagaaagagttaaaaaagctgaaagtttctacgggcaggtcgttataggacctcctggctcaggaaaaacaacatactgtgggaaaagtgtatgcgttttacaaagaaaaagttaaacagggaaagtagaaatcgttaattttaaatccagctaatgaaaatatgggttacagtcccgaaataaacatcatgcagttagtaactgtagaaaatgtcatggcccaaaattaaattaggacctaacggagccttaatggactgtatggaatacctcgaaaaaaactttgactggctttttaaaaaaattaacaaaattaaaaacagttatttaattttttgatttgccgggacaaagttgagttggtaaccaccttcataactgccaccaagaaaattttttggacctttaaaaaaaattgggaaaaatcatttgggggg

SEQ ID NO: 3565 - DNA, 1580 bp, Diabrotica virgifera
gagcgagagtggtgttgtgtaccttcacaacccacttaaaattgtgaaataatttatttaaaaatacaaaaaaatataaaaaaaactaataaaaaataacaaaaaaatcgcaaaatagtgtaaaaaagtaaaataacaaacgtaatgaatccaggcgccccaaattaccccatggcgtctttgtacgttggggatttacactctgatattactgaggccatgctttttgagaaattttcaactgcgggccctgttctttcgattcgcgtttgcagagacttgattacacgtagatccttgggttatgcgtacgtaaatttccagcaacctgctgatggaaaagaattgatggaaggaaaacctttgtatgtaggaagagcccaaaagaaagctgagcgccagcaagaactaaaacgtcgatttgaagcccttaaaatggaaagacttaatcgttatcagggtgtaaatctctatgttaaaaacttggatgatacaatagacgacgaacgtctccgtaaagaattctctccgttcggaaccataacttctgccaaagtaatgatggaagaaggtagaagcaagggttttggtttcgtctgcttttcctccccggaagaagctacaaaagcagtaacagagatgaacggcagaattgtcggtacgaagcctttatatgttgccttagctcagcgtaaagaagatcgcaaagcacatttaacatctcagtacatgcagcgcatggccaatatgcgcatgcaccagatgggtcagttcattcaaccaggtgcgtctagcggctatttcgttccaaccattcctaccgcacagagattctatggaccagcccagatggctcagattcgtaccagtcccagatggcctgcccaaacacctgtaagaccaggtgctcaaggaggagctactgcctacactggcatgccaaacacttacagagcggctactcgtccaccaaaccagtcaacaacaatgcgtagcaacatcagtgtacctagaccaattactggacaacaacctcaaagtatgcaaggtcgtccacttgctggacaaggtggagttgtaccttccgctggccgcacagcaaacttcaaatatacttcgaacatgagaaatccacctcaatccttgggaggtataccaggaactgcggctcctgtacagcaagctgtacacatccagggtcaagagccacttacagcaacaatgttggctgctgctcccccacaggaacaaaaacagatgttgggtgaaagattgtttccacttatccaacgcatgtatgcagatatggcaggtaaaatcactggtatgttgttggaaattgacaatactgagttgttgcacatgttggaacaccaggagtcgcttaagaataaagtggaagaagcagttgctgtactacaagcccatcaagccaaacaggctgctactcagattaaaaaagattagtagttggtcgtaggcgactgtagaagggatataatcgtttaagaatataatatgtatcctgaaattatgtattgttgattttcatattttactttatattctcaacgcctgaa

SEQ ID NO: 3566 - DNA, 3678 bp, Diabrotica virgifera
aaatagactttttaaacctattgtgaagaaaaactattaaaaaaacaaaaaaaattgtaaaatagtgtaaaaaagtaaaaaatatccaacgaagatgaatccggctgccccaaattatcctatggcgtctttatacgtcggcgatttacattctgatattactgaggccatgctttttgagaaattttcaaccgcgggtcctgtgctttcgattcgcgtgtgtagagacttgattacacgtcgatccttgggttatgcatatgtgaacttccaacaacctgcagatgctgagcgtgctttggataccatgaattttgacttgataaaaggtaggcctatccgcatcatgtggtctcaacgtgatccatcattgagaaaatctggcgttggaaatgtttttatcaagaatttagatcgttccattgacaacaaggccatgtacgatactttctcagcttttggtaacattcttagttgtaaggtagcccaagatgaaaacagctctagtaaaggttatgggtttgtccattttgaaaccgaagaagctgcaaataagtctattgaaaaggtaaatggtatgttgttgaggccatgctttttgagaaattttcaaccgcgggtcctgtgctttcgattcgcgtgtgtagagacttgattacacgtcgatccttgggttatgcatatgtgaacttccaacaacctgcagatgctgagcgtgctttggataccatgaattttgacttgataaaaggtaggcctatccgcatcatgtggtctcaacgtgatccatcattgagaaaatctggcgttggaaatgtttttatcaagaatttagatcgttccattgacaacaaggccatgtacgatactttctcagcttttggtaacattcttagttgtaaggtagcccaagatgaaaacagctctagtaaaggttatgggtttgtccattttgaaaccgaagaagctgcaaataagtctattgaaaaggtaaatggtatgttgttgaacggaaaaaaagtatatgtaggtcgctttattccacacaaagaaagagaaaaggaactgggagaaaaagccaagctgttcacaaatgtttatgttaaaaattttggtgaagattttgctgaggaacagttaaaggttatgtttgaaaagtatggtaaaattaccagctacaagataatgagtaaagaagatggtaaatcaaaaggatttggttttgtagcctttgaaagttcagaggcagcagaagcagcagttgaagctttaaatggaaaagaattggtggaaggaaaacctttgtatgtaggaagagcccaaaagaaagctgagcgccagcaagaactaaaacgtcgatttgaagcccttaaaatggaaagacttaatcgttatcagggtgtaaatctctatgttaaaaacttggatgatacaatagacgacgaacgtctccgtaaagaattctctccgttcggaaccataacttctgccaaagtaatgatggaagaaggtagaagcaagggttttggtttcgtctgcttttcctccccggaagaagctacaaaagcagtaacagagatgaacggcagaattgtcggtacgaagcctttatatgttgccttagctcagcgtaaagaagatcgcaaagcacatttaacatctcagtacatgcagcgcatggccaatatgcgcatgcaccagatgggtcagttcattcaaccaggtgcgtctagcggctatttcgttccaaccattcctaccgcacagagattctatggaccagcccagatggctcagattcgtaccagtcccagatggcctgcccaaacacctgtaagaccaggtgctcaaggaggagctactgcctacactggcatgccaaacacttacagagcggctactcgtccaccaaaccagtcaacaacaatgcgtagcaacatcagtgtacctagaccaattactggacaacaacctcaaagtggagttgtaccttccgctggccgcacagcaaacttcaaatatacttcgaacatgagaaatccacctcaatccttgggaggtataccaggaactgcggctcctgtacagcaagctgtacacatccagggtcaagagccacttacagcaacaatgttggctgctgctcccccacaggaacaaaaacagatgttgggtgaaagattgtttccacttatccaacgcatgtatgcagatatggcaggtaaaatcactggtatgttgttggaaattgacaatactgagttgttgcacatgttggaacaccaggagtcgcttaagaataaagtggaagaagcagttgctgtactacaagcccatcaagccaaacaggctgctactcagattaaaaaagattagtagttggtcgtaggcgactgtagaagggatataatcgtttaagaatataatatgtatcctgtaattatgtattgttgattttcatattttactttatatctcaacgtctgaaaaggcataagttattgagaagttaaagctatgagtaggcccttatgtgttcttacgcctatgaacacgttgttacatgtaaaacaaattgtgtatgaaaaatttcttcttcagatgtcattttaatgggaaactgctagcattcgtttatatattaaatatattgtatataataattattattataaatataataataattgttgcaaatttagcaattaatattttgtgaattttcaatgcaacttagcagaacttccatgtgtattttagttttttcatattattatttattttatattttcatgttataaattacccgttgtctgaaaagacgagggattgagatcattgttattgattattgattgtgcttgattattgattgattattaatattacccttccttacatcgcctatgaacaggatactatcaaataaataaaataaatataaaaattgcaaatagtcctatgacaaaaaagtaaaaaaatctatacttaacaatcccataataaagatttcttttcaattggaaactgtaacattcgtttgtattttcgcattgtttgcaattgttattttgatcattttcaatacaatttagtataagtttagtaatctaattttatatttttactgttttcatattgtgacaaattaatttctaaaagggcataaaaattttccaatatgacccttcttcgttcttacgttgcctttgaaaagaatactatcaaattaaacaaaaataattataaaaattgcaaagagtcctatgaccaaaaacgtaaaaaagattatctctatttaataatcaattcgtttgtatttttgcttatttacaatttttattttgatctattcaatggaattgtaagtctgacaatgctttatggaccattttgatggaagaaagcgttaatatattatttcagatatttttcgacaatttccttcattgtttatatccttcaatacatgaattttatggtttgtggactatcatgaatttttttatcgtttgtctcttccctttttaatttgatacgattatgactcacgtgtgttgcaactagagatacggaatgagtataagtaaaactattttgtattcacatgccataaaattgatatataaatatattcgatttcataaatcagttaaattccccccaaaaaaccattcc

SEQ ID NO: 3567 - DNA, 3197 bp, Diabrotica virgifera
atcaaaaaaattggatcaaaaaatttttaattaatataataatataaaaaaagttaaaatttatttttcaatctcccccaattaaataaatttattatataaataaatttaattctaacaaaactttattaataattgtataaaactctataggggtcttctcgtcttttaaaaaaatttaagctttttaacttaaaaataaaattctttataaattaaataaagacagtttttttttcatccagcccttcattgcagctttcaataaaaaacctaatgagtatgctaccttagcacggtcaaaataccgcggccattcaaactaatcagctgggcagacgagcctgtatgtttaatgccaaaagtcatgttcttcatacacaggtgacaaaaatgtctcgtaattgtttcagtacggacgcgtggtaatttagtgtgtgagcgagagtggtgttgtgtaccttcacaacccacttaaaattgtgaaataatttatttaaaaatacaaaaaaatataaaaaaaactaataaaaaataacaaaaaaatcgcaaaatagtgtaaaaaagtaaaataacaaacgtaatgaatccaggcgccccaaattaccccatggcgtctttgtacgttggggatttacactctgatattactgaggccatgctttttgagaaattttcaactgcgggccctgttctttcgattcgcgtttgcagagacttgattacacgtagatccttgggttatgcgtacgtaaatttccagcaacctgctgatgctgagcgtgcgctggatacaatgaactttgacttgattaaaggacgtcccatcagaataatgtggtctcaacgagatccatcattgagaaaatctggtgttggtaatgtttttattaagaatttggatcgttccattgacaacaaggctatgtatgatactttctcagctttcggtaatattcttagttgtaaggtagctcaagatgaaaacggctctagtaaaggatatggatttgttcattttgaaactgaagaagctgcaaataaatccattgaaaaggtaaatggtatgttgttgaatggaaaaaaagtatatgttggtcgctttattccacgtaaagaaagagaaaaggaactgggagaaaaggccaagcttttcacaaatgtatatgttaaaaattttggtgaagatttatctgaagaagagttacggaatatgtttgaaaagtatggtaaaattaccagctacaaaataatgagtaaagatgatggtaaatctaaaggctttggctttgttgcctttgaaaatccagaggcagccgaaacagcggtggaagctttgaatggaaaaaaattgatggaaggaaaacctttgtataaggaaaaccccaaaaaaaagttgaccccccgcaaaaaaaaaaaaaggcccaattttgacttaaaaataaaagggtaaatcgttatcagggtgtaaatctctatgttaaaaatttggatgatacaatagacgacgaacgtctccgtaaagaattctctccgttcggaaccataacttctgccaaagtaatgatggaagaaggtagaagcaagggttttggtttcgtctgcttttcctccccggaagaagctacaaaagcagtaacagagatgaacggcagaattgtcggtacgaagcctttatatgttgccttagctcagcgtaaagaagatcgcaaagcacatttaacttctcagtacatgcagcgtatggcaaatatgagaatgcaccagatgggtcagttcatacaaccaggtgcatctagcggttattttgttcctaccattcctgccgcacaaagattctatggaccagcacagatgactcaaattcgtgctagtaccagatgggccgcccaaacaactgtaagacagggtgctcaaggaggaactactgtataccccggtatgcaaaacacttacagagctactgcccgcccaccaaatcagtcaacaaccatgcgtagcaacatgagtgtacctaggcaaattactggacaacaaccacaaaatgcaattgtacctgctgctgttaacagaacagccaacttcaaatacacttcaaacatgagaaatccaccacaacctttgggaggtttaccaggtgctgctgctccagtacagcaggctgtacacattcaaggtcaggaaccattgacagcaaccatgttggctgctgctccaccacaggagcaaaaacagatgttgggtgaaagattgtttccacttatccaacgcatgtatccagacatggcaggtaaaatcactggtatgttattggagattgacaacactgagctgctacacatgttggaacaacaggagtcccttaagaacaaagtggaagaagcagttgctgttttacaagcccatcaagccaagcaagctgctactactcagattaagaaagagtagttgctgaagcagtgattattttatgttttatatttttaagcataaataaaaagtacttgtgcattttcgtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggccccttaaaaaaaaacaaattttaaaaacggggggggggaaaaaaaatttttttttaaagggccccaaaaaataaattccgggggccgtttttaaaaaggggggggggggaaaaaaccggggggaccccaaattaacccctttggaaaacccccccttttcccacggggggaaaaaaaaaaaaaagcccccccccccaccccccctccaaaaatttccccacctcaagaaggaaaaaagggacccccccctaaggcccatttaataggggggggggggggggggggatacccggaaggggggccccaaatttttggcgcggcccccaagccccccctcttttttttttttttctcttttttttttcccccacgtggcgggggtttttcccccgaaaaatattaaaaaagggggggccccttttttaggggtcccctttttatggttttttcgcccccccccccccccaaaaaaaatttatttaggggggggggggcccccggaggggggcccccccccccccagaa

SEQ ID NO: 3568 - DNA, 1465 bp, Diabrotica virgifera
ttaggccggaagaatatgataaccttttttctttttgacttctgacaaatagactttttaaacctattgtgaagaaaaactattaaaaaaacaaaaaaaattgtaaaatagtgtaaaaaagtaaaaaatatccaacgaagatgaatccggctgccccaaattatcctatggcgtctttatacgtcggcgatttacattctgatattactgaggccatgctttttgagaaattttcaaccgcgggtcctgtgctttcgattcgcgtgtgtagagacttgattacacgtcgatccttgggttatgcatatgtgaacttccaacaacctgcagatgctgagcgtgctttggataccatgaattttgacttgataaaaggtaggcctatccgcatcatgtggtctcaacgtgatccatcattgagaaaatctggcgttggaaatgtttttatcaagaatttagatcgttccattgacaacaaggccatgtacgatactttctcagcttttggtaacattcttagttgtaaggtagcccaagatgaaaacagctctagtaaaggttatgggtttgtccattttgaaaccgaagaagctgcaaataagtctattgaaaaggtaaatggtatgttgttgaacggaaaaaaagtatatgtaggtcgctttattccacacaaagaaagagaaaaggaactgggagaaaaagccaagctgttcacaaatgtttatgttaaaaattttggtgaagattttgctgaggaacagttaaaggttatgtttgaaaagtatggtaaaattaccagctacaagataatgagtaaagaagatggtaaatcaaaaggatttggttttgtagcctttgaaagttcagaggcagcagaagcagcagttgaagctttaaatggaaaagagttggttgaaggaaaacctttgtatgttggaagagcccaaaagagagctgagcgtcaacaagaactaaaacgtcgctttgaagccttaaaaatggaaagacttaatcgctatcagggtgtaaatctctatgttaaaaatctagatgatacaatagatgatgaacgtctccgtaaagagtttactccttttggaaccataacatctgccaaagtgatgatggaagaaggtagaagcaagggttttggtttcgtctgtttttcctccccggaagaagctacaaaagcagtaacagaaatgaacggcagaattgtcggttctaagcctttatatgttgccttagctcagagtaaagaagatcgcaaagcacatttaacatctcagtacatgcagcgcatatatgagtatatgagttcttcatttcgatacgtttattaataaaacatttgctaaaaaaaataaaaaagggggaaaacaaaaaaaaaaaaggggggaaagaaaatttgtggttttttttacactcctttttttttttgtttttctttcttttccccccgcac

SEQ ID NO: 3569 - DNA, 1241 bp, Diabrotica virgifera
gtatattctacaataagggctatgaaagttgataaccgtcaattaattggaatttgagatgatcctgaataaggatgtgatccattcaactttcgagtacgaaaacagaacattaattagaaatacaacaaagtacgtttcatccaaatagccaaaatttaaaacatgtggatggagattttgaaaggtacttatgccaacattttaatgctttgaatgattatgtttagatcaatacgaagaaaaattatggaagtggaatgagtgtttacacggtttattgaatgggtttgtatgatattgttcataaaattgtgtatgtaaagtgattttgacgagactatggagtgaatctaagattgagtgatacaaaataagtatatgtaccccacagtccaagtgcaagacataatttacaacggttttgtgagtgtttttgcgagaacgatggatgcatcagaagatatttgtatgattctaagagaagtaagaaagatgtagcagatgcagcattgtaaaaatgattgggagatcttagcaggagctagtttgtaatcagagggtgcgagttatcgatcaaatctaaattgtttgatacatctctgaaggtggtacaagattccagtggtggagaattaaatttaaatgaggcgagtgatttgtctacattaggaggtatgaaatgagtatgctaatgtgtgtctaggtgagatgtttgaatggtaagataaaatgttggcaacatataagaaatcagaaaatctattacaaaattataacaaaactatgaaacaaagattggtgaataattcctgcctacgaaaattatggaccttgatagaaaaacgtactgaagtaatagcactgatgcatcatcgcacatcactgtgtgactttctgtaaaagagaacagcgagaaaagcttttcagttccatccaaaaatagccctttcagctttttcaaaatttaaaactatatacctcatataaacttaaaaaaaagaaaaattgggaaaaaggttccacaccacttgtgaaaaaggcaaaaaaggaaggtaattttttagccctaggaaaattaaggcgcgccattaaatttccaaattttattaatttatggcggtaaaaaaatggttggctaacctgtttcctaatccttattcttttccccatgaaaagcgcgattcttctaatataccgacctttatgggggggtgcttcaaaaaattttcaattttgaa

SEQ ID NO: 3570 - DNA, 2776 bp, Diabrotica virgifera
gcaaggtgatcaaggtccgatgaagaacgactagattcatgagacaacatgtggagtatctccgtggaaagaagagtaagatggataggattccaggaagaccaacatcgagcggattccagggaagaaaaacgactgcatgtatgaagaggattccaggaagaggaacataaagtatgatcccagaaagaacaccaacataggataaggttgccaggaaaaagacgaacgtggaagatgattcttgcatccagtaagaagtactggatgaaaaggagtccaggaaaaggaccaacgggaagaggtttccatccaggaagaggaggatgtagaggatgtccaggaatataggagatcaatagaccaacacgtgcagagcattgcaggaagaagtgcaagatggaggagtgccaggaagaacgacgagatcaagagaccaacatggtagaggattccaggaaagataccaacatggagaggattccatccaggaagaagagcaagatgaagaggattccatccaggaagaagagtaaaatcaagaggattccatccagggagaagagcaagatgaagaggattccatccaggaagaagagcaagatcaataggattccatccaggaagaagagcaagatgaagaggatcccagtaggaaaaagtcttttgcagggggaaaatatggtttcaggagtaggagtaagaggttctaggagtagcgaggcggatgcggcttgaggtgtacgaggtatttcgtggttctagggataggagttttttgctcgtcattccagaacggaaagtgctgttccagatctacggcgcgtttgctgttccaaggtgaaggctgcctttccggaggtaggagattctcctttaaggatgaagagttctttttttagagatacgagctgtttgcgagcccgggaagaatgttccagaagtacgaggcgtttgcggttccagggggaagaatgctgttctagaggtacgagctgtttgtggttccaggaaggaggatgctgttccagatgcacgaggcgtctgcggttctgtactaggtacgaggtgttgacggttccgggaaggagaatgctgttccagatgttgcggttccaggaacgaagactgtctttcatgaaggaagagtgctgttctacgagttacgagctgtttgtggttccgggaaagagaatgctgttccagatgtgcgaggttccagggaggaagaatgcagatgtatttttcagagaaagactgcgattccagaggtaggccttgcggttcaagaaggaataatgctgttctaggagtaggagctgtttgcgggtccaagagggagaatggaatttcagatgtacgaggcagaagtaggcgtttgcggtacaaggaagaagaatgctgtgtccgagggacgtggtctttgcaggtgcgggaggaatgctgtttcaggtgtacaaggctgttaggttccagtagaaagatttctgttacagaggcaggaggtggattgctgtttcatgtgtaggaggcggatgcagctcaaggtttgaggcaggtacgaggttccggttccagaagtatgaggtgtttacgattctgagtaaaatgctgtggcaagcggttagggcgtttgcggttccaaaggcagaaaacgcttgttattacagaagcacgaggcgattgaggttccagccttatgacgggtatggcgcttccaggtgtatgagcgatggcagttctagaagtggttctaggagaaataagcgattccttagttccaaattgaagttatggcttccaggctagggagtacggcatgagtcatagattttagcatactatttctgttcaatggttttgcgagaatggtgcatcagaagagagagatttgtatgattccaagagaaaaaatattgcagcaggagaaatcagtatgctaagcaagataaattgtttaggtatattctacaataagggctatgaaagttgataaccgtcaattaattggaatttgagatgatcctgaataaggatgtgatccattcaactttcgagtacgaaaacagaacattaattagaaatacaacaaagtacgtttcatccaaatagccaaaatttaaaacatgtggatggagattttgaaaggtacttatgccaacattttaatgctttgaatgattatgtttagatcaatacgaagaaaaattatggaagtggaatgagtgtttacacggtttattgaatgggtttgtatgatattgttcataaaattgtgtatgtaaagtgattttgacgagactatggagtgaatctaagattgagtgatacaaaataagtatatgtaccccacagtccaagtgcaagacataatttacaacggtttttgtgagtgtttttgcgagaacgatggatgcatcccaaaaaatttttatgttttttttttaaaaaaataaaaaaaatgtaccaaatgtcccttttgaaaaaatatttgtggaaattttttccgggggtttttttgttattttaagggggggggagtttttcaaattaaatttaaaattgttttttataatttttttagagggggggaaaaaaatttctccgggggggggaaaaaataaattttttaatggggggggggggggattttttttcttcctcttaatggagggattttaaaaaaagagaaagagtcttctatggggggggggcgggtctcgggggcggaaggaggtgttttttttattagtggttctaaaaaaaaaaataaaaa

SEQ ID NO: 3571 - DNA, 1134 bp, Diabrotica virgifera
atcgctgaaagagttcctttaaatttaaacaaattttaaggattgaaagaaattttcagtgatctataaatacgaagctggcctataaagggttatcgtagctcccccgtcaccaaggaaaagtgattttgatgaacttctttgactttgcaagggttaaatactatcttatcagtaatagcttggaacttgcttcgcttcaactaattagcaatagaacaaaatagttttgccaaataattttaccatcagaagacaaaaaatgccgccaaatacagattttgttccaccatcatcgttagggataaaaccaattccttctagaggtaagggtagggttgtgacgacgcatatgtggataaaagagaaacagatagatgatggtgctgaaggattatggagagtacatgataaaatttatgatttaactgactttattcacaaacatccgggaggttctgactggcttacactaacaaagggtactgatataacagaagcttttgaagtccaccacttaacagaatttccaaacgaaatactcaaaaaatattttgttaaaaatgccacttcagagagaaattctccctatacgtttgaagaagatggattatataggatattaaaaaagaaaatacaaccagttttaagaaactgtcccaaggaaagttacaccaaatcaaagcttattatagattctttgttggtgttgagttttttgttttcaatctttgcagtgaaattttggaacttcggattgggtgtatttggtggtgtgtctttaggaatggttacggtagctgcccataattatttccatatgaaggataattttagaatgtattatttccagttttcattgcttcaagtgagggaatggagaataagccatgctttaagtcaccatttgtatacaaacactataacagatctggaaatttctatgttcgaaccacttcttaattatttgccagtggagaaaaaaccattacaaaaggttgtgtcagtaatgttggcgccaataatgtggttaacatttttccataaaccagctattgaaagaataattaatttgccgaaccaatacaaggaattgaggtttactgatttattaggcctacttcttccatctgc

SEQ ID NO: 3572 - DNA, 1762 bp, Diabrotica virgifera
gatttacgtccatatctgtttatttcaattgcacgtactcagtactgtgttgaaattatctttagttatctggtataagaagtaattgttttcggaatttgccatcagtgaaagaaagatgcggccactattagctgtctttaacaacgggaatttgttgttttgcagatttcccaaggagtttggaaggctaacgaagacattcgggactccggaagttgtcttcgtgagcagacaagtcagaggaatcagtgtagtgcatggagacttgaaggatttgcctgaaaaagtgcaatcttacgttcaagaaaatgttaatctgtgccaaccagataaacttcacatctgtgatggaaccgatgctgaaaatgaaaagttgatccagctaatgttacaacaaggaaccatcaaacctttgccaaaatatgaaaactgttggttagccagcactaaccctgctgatacagccagggtggaatcaaaaacgttcatttgcaccgactcgaagtcagaaactattccaacgcccaaaaatggagttcaaggaactttgggtaattggctgtcccctaaggatatggacgtagctgttaaagaaaggtttacgtcgtgtatgtcgggaaggactatgtatatcgttccattttctatgggacctattggatctccattatcaaaaataggaattgaaataactgactcaccatacgtcgttgcttccatgaggataatgaccagaatgggcgcaccggtcttaagaaaactaagagaaagccaagaatttgtgaaatgccttcattcggtaggaacaccaagtaatggagttctagaaaatccgagttggccctgcgatcctgaaaggaccatcatccttcacagaccaaaaaacaacgagattgttccctacggaagtggctatggaggcaactcgctgttgggaaagaaatgttttgctttgagaattggatccactattgccagaagggagggatggttagcagaacatatgttgattctgggcatcaccagtccttcaggcaaaaaacgttacatagcagctgccttcccttcagcctgcggaaaaaccaacttagcgatgatgactcctacgttacctggttataagattgagtgtgtaggtgacgatatcgcatggatgagatttgacaaacacggacaattaagagcaatcaacccagagaatgggttctttggtgttgctccaggaacttcaagaagtagtaacccaattgccatggacaccgtcttcaagaacaccatgttcacaaatgtaggatctacaagcgacggaggagtctactgggaaggtatggaaaaggaagtaagcgataatattgcaataactgactggaaaggtgtcccctggaccaaaggtcaaaagacgcctgctgctcatccaaattcaagattttgcacacctgctaaccaatgtcccataatagacccagcttgggaagacccggaaggagtacctatttcagctattttgttcgggggaagacgaccagctggagttcctttagtatatgaagcaagggattggaaacacggtgtgtttattggatctaccatgagatcagaagcaactgctgcagctgaacacaagggaaaagtaattatgcacgatccattcgctatgagacccttctttggctacaactttggacactatttgagccactggttgtccatggagcaaaaatcaagcaaccttccaaaaatcttccatgtaaactggttc

SEQ ID NO: 3573 - DNA, 1032 bp, Diabrotica virgifera
caagagtgctcactgaagagaagttcttaagaatatttcaagtttataagacattttccaagatgatggggccaatgtctcaacctactaacattataaaaaataatgagaagaaaactgttgatatgccgatgggcagtccacctgatatacccaaactaatgcccggtggaaactacatcaggatcggtaaggattcagcgcacagcacctgcatcgtcttcgcacctccagcagaagaagtaggagttcttgccaaattcttgtcaatcttcaagaaacatgaagtcaatctattacacattgaatctagaccatcgtcgaaaacccccgacaactacgaatttatggtagaatgtgctccaaccggtaatcttggagctgcaattgccgatatgaaagagattagcgagtactttcagatcatttccagagactacagagataacaaagataccgtaccatggtttccaaggcgtataagagatcttgacaggtttgctaaccagattttatcctatggtgctgagctagattctgatcatcctggtttcactgatcccgtctacagggcacgccggaaatactttgccgacatagccttcaattacaaacatggccaaaaacttcctcacgtagattacactaaagaagaaactgaaacatggggcaaagtatttaggcaactgacaactttatatcccacacatgcttgcaaagaacataatcatgtttttcccctgctagtagaaaactgcggatacagagcagacaacattccacaattagaagatatctcaaattttcttaaagattgtactggttttacgcttagacctgtagcaggtctgctttcttccagagatttcttagctggattagcatttagagtcttccactcccacccatatattagacatcccagtaaaccttactacacaccaggaaccagatgtttgtcatgagttgctaggacacgtaccacttttttgctgatcctgaatttgcacagttttcacaagaaattggact

SEQ ID NO: 3574 - DNA, 1194 bp, Diabrotica virgifera
ctaacttattaaaaatattcggtggtacgtggtgtagtgagtacgactttgtgcagtgatacgggaagtaagtcaagtaactaagctcagagaagagaagcaaatttaagcacatttaggaacgtactggttttcttatagaaaatatcatcgccaatcaggaagccatttttctcttatgtttcctcgtctatatggatcagtcgaggagctcgtgaaattctagtcaaggaaactgtgtccgatcaggaagaaagtcgtagtggttatcaagaaatcacacaagtaatattcaaaatattgtagactttttagaacgagtaaaataacctagaaaaaatggaaaactctacaaatatttttgacgaactgcacaaagtgataaacgtgcatgaagattccagaaccaaagatttctttctaatagccagtccaattccttcaattgctttatcagtagtatatttaatctcagtgacggttcttataccaacttttatgaaaaacagaaaaccatatgagctcaaaaattttgttatattttacaatggtttccaagttttgttcagtgcgtggttgttttacgcatttttagttggtggctggtactctccggtattcactggaaaatgtttccttccaggatctggaagtaatatggtgttggctgcttactgttatttcctgtcaaaattcactgaattcgtagatacgatcctctttgcgttgagaaagaaggacaaccaaatcactcgcctccatttatatcatcacagcattatgccgtttggatcttggcttgccgcgaagtatgctcctgatggtcccatgacattcctgggattaatcaactcatgggtccacatcgtcatgtactcctactacatgctaagtgccatgggaccaaaagtacaaaaatacttgtggtggaagaaatatatcactattatgcaactgatccagtttgtcctgacgttaactcagtcaatattgaccttcttttacggttgcaacttgcccacagcgattagcatctttatattacgcaaagtgttgtcttctttcgtatgttctttgacttctacatgcagtcgtacaagaagaaatcttcttcaaaactagcaactaatgaagtagccaagacagttccagttgaaggaattggagaaccagtaaatttataattataagact

SEQ ID NO: 3575 - DNA, 1070 bp, Diabrotica virgifera
cggacccgtgggtgatcccacaagagagttagtgttctttgactttttttaatagtttgaaactattgaagtaagtcaagtaactaagctcagagaagagaagcaaatttaagcacatttaggaacgtactggttttcttatagaaaatatcatcgccaatcaggaagccaattttctcgtaaatcttcacttctgcatagataaaacgacagtctaaaaggtataattactgatagtagcaccaaccacgatcaattagtgatatttagtatataggttcagtatctatcctggtgctaatttgacataaacttataagaaaatatcaaaatggaaaacgtatcgacttctcttcttgatgggtttcacgaaatgttcgacaggaatcaagatcacaggacaaaggactatttcctaatgtcatctcctattcctaccatgattacagtagcaatatatttatatacaattaaagtattgctgccagcttatatgaaaaacaaaaaaccatatgatcttaaaaatgtaatattgatccataattttatacaagtactcataagcactgcattattcttagggttcttatttgccggatggtaccctatcaaatatgacttaaaatgccaatcgccaaggttaccagatttaatagagggagctggtattaagataatgcatgtttcgtatggctactatttatcaaagtttgtagaattgtttgatacagtatttttcgttttacgaaaaaaagatcagcacgtatcttttcttcacgtctatcaccacgccgttatgccgttatggtgctggggtgcagtaaaatattttccagaaagtcagatgaccctatatggaatgataaactgctttatacacattgtgatgtacacgtactacatgcttagtgcggtcggaccttcagttcagaaatatttgtggtggaagaagcatatcacagtattacagttgattcagtttgcaataggtgctgttcattcactccacttactcatcaagggctgcatggtacctcgattgctcagtatatcccttgtttttggaagcg

SEQ ID NO: 3576 - DNA, 1260 bp, Diabrotica virgifera
gtcacgggaaggaattttaccgaatcgattccagtcgacgtttagagcatgttgatagcgaaatttaaagttgtgagcgcaggaattattagttaatggttttaaaagttgacaagtgcggacatcaggtagatttttaaacgaaagtaaaagtgatactgctaaaccagtttattaacatttaaaaaaatatatcaaaatgaatctcagttgcggttcaaggactataaaatacctaatttttactttcaatttttttttcgtgataactggtataattttaattgcagttggagctagtatacatacctactatacaaaatatgattttttccttaacagcgaatatttttcattaccaaatatgttaattgctactggaacatttatctttcttatatgctttttgggatgctacggagcaattaagaacagttggatcatgctaatggcattttcattactgttgggtattatattcatttttgaattttccgctggaattgctggttacgtattaagagacaaaacagaaaaatatttgacagattcgctaaccacagcgatggataaatataacagttcgtcatcaactgctaccatgtgggatctcgttcaaacaaccttcacatgctgtggagttaacagttataaagactgggagccagttatgaaaaataccgatttacccatatcttgctgtcctacgaaggcgggtacatctggttcattctattgcaacgctgttactcctactattagtacaactaccaatgagactagcacacaacatcccaatccaaaaacaggtgcaaggaaacgacgagatgtttcacaaccagccaccaccacatctccctacaatattggatgtgagacggcatttggaaaatgggttaaagctcatgctgtagacatcggagcagtgtgtttcacattagcagtgttacaactcatcggaattggattctcctgtcatttgtccaaacaactgaagaattcatattatagtacataaagtagttatcaaatcactaattatgttattttctaagaattattgttatttttgtaattttttttccgtatttttatttttaagtatagatattttatttcaatatttcaagaggaacgaataaaacagattattttgatgtaccgaatgtaagatttttgattttgtacttaaattttttggtaaagaaaaatcataattttggtattaaaaattgaagcacaattaaatttttcacaata

SEQ ID NO: 3577 - DNA, 1147 bp, Diabrotica virgifera
  misc_feature (1119)..(1119): n is a, c, g, or t
ataacaatcagcaaatgaacagcagtattgaaataatgttttgaaatatttcgtatttgttgatataatatattagtatcaaaatgggaaagaaaaagaacgaattctctcatcttgctgtggaagaaagaaaagtaattactgttgcagaggttgttcaagaacttataaaagcccaccaagacagaaaagatgtgaatttaaactctttgaaaaataaaatagcatcaaaatacaatctagaaactgctcctaggttggtggatataattgcagcagtaccaattgattataagaaaattctggttccaaaactactagccaagcctatcagaactgctagtgggatcgctgttgtagcagtaatgtgcaagccccatcgttgtccccacatcaatttaactggaaatatatgtgtttattgtccaggaggaccagattcagattttgaatactcaactcaaagttacactggctacgaacctacctcaatgagagctattagagcaagatatgatccttatcttcaaaccagacacagagtcgaacaactcaaacaattgggacattcggtagataaagttgaattcattgtaatgggtggtacttttatgagtttgcctgatgagtatagggattattttataaggaatctacacgatgctctgtctggtcacaagagtagttctgttgaagaagctgttatttattcagagaggagtaatactaaatgtataggaatcacaattgaaactaggcctgattattgtctagaaaaacatttgtcagatatgttaaaatatggatgtactaggcttgaaattggagtccaatctgtgtatgaagatgtagctttagatacaaataggggacacacagtgaaagcagtatgtggcacctttcatctagctaaagacgcaggttttaaagtagtagctcatatgatgcctgatttaccaaatgttgatcttgaaagagatattgaacaatatattgaattttttgaaaatccagcatttagatctgacggattaaagatttatcctacccttgtaatcagaggaactggattatatgaactttggaaaacaggaagatataacagttaccctccttcgntacttgtcgatcttatagctaaaatttt

SEQ ID NO: 3578 - DNA, 1140 bp, Diabrotica virgifera
cgcgtccgaagaaaggttaattcttgtcttgaaatagcaagttaatcttatccacaaaccacttataatcttcggggtataaaagcgaaaaaatcgtttcacgcatccgcccacgcgtccgattcaccaaaatgaatactttattggtagcttcagtcttctgcgccatcttcgccatcggcctgaccgtacctgttctgacaggtccaggtccagctttccaagttaccgatggagaatgtgagaatgtctcaagagacgaattggtccgccaagagcaagtaaataagggtggttttccatttgttaccaaacaggctgatgttgaatacttaggagatccttcaaaagttatttactgcgttcaagctctcagctctgatgacccaagcgttggttctattgctgaaattacagttggtggagttggtcacgatttcgtaaatgtacatttgacatctaagaaaggaggacccctacattacgatgttgaaatttacgccagggcaccaaataataatattaaataataaatacattaatcgccctaaaccacttgtgaaaatatatttatatgaataataccgataaacagatcaaatatagttaatgtataaatgatcaaaaaaaagcaaaataaataaaaagagcatgactgaaataaaaaaaacggaaaaaaaacaaaaagcggggcccctctaaacaatccggctgccccgctcagatagaccaagcctcacctgaagggggttgccactgacaagacgccagatattctcacaaaaaaaactattatttgtcccccttttaaaagggaccaaatgaaaaaccccggggggagcccaataaaacttcttttaaaaaaaaccaaattttatcccacggggggctttttaaaaaaggcggcctgggaaaaacttgcggaaaaaaaaaaaaaatccccttggaaaccccccccccccccttgggggggggagaaaaaaggaagggggggccgcacgcccccccccccccccaccccccccccccggggggggggtgggggcccccccccctcatctctttattccccgcggggggggggggggtggagcattctcaaacactcttttactacaccagacgccccccgctcgcccc

SEQ ID NO: 3579 - DNA, 998 bp, Diabrotica virgifera
ccacgcgtccggagctagtttgacgttgatgaagtatattcaaagttgaatactatacgagtattcaagttgaatatttttttgttaccgaaagctctattattgcacaactatggaatggaaaataatcaccatggctataatcctgtttcaggtttcatgtgtttcgccagcagtaataccagaggaatataatagtcaactccatagtctacatgaagaaatcgtaacagaaatcacagaattttctctaattttagttaacggcaaagataggttgaaatcaattgtctacggagctaaagaatcacttgagtctgaattagaacaactcaaacaatacatgagagaaaccaaggtggatgcagcagatgaaaataaagatatttctagttgcttagatgaaaatgttttagatacgatagacataagtaacatagatatttgtgatcatatacctttcacacaacgcattgaaggtatggccaacgatttagatatcagacaaaaagagttttattcggatatgaacagttgtacgaaagaaaaaactgaagaaggtacaaatgactgtttggatgggaaaatagacgaatggaaaagaaatctcaaatcgtgtaaacttttggaaacaactttgctggaaactgcatacgaattaagtttgcgatgtacggagataagtttaaatcagatcgataaaaatattattttcatagccagaaatttcaccagctgtgtagatgaaattctagaatattaaaattatcactatttacgaatgtacctggctgtgtgatatttattataaaaataaaggacagcgtacgcatcagaaaatgtaatgcgacaaaatgtagataataattgcgccaactctgaatttttatcaatgacggcgtaaattgatataaaaaaatctaaagtccaaatggtaggtacatactaaaaataagagaaaaaaaaaaaaagatttttgggggaaagggacttcctaa

SEQ ID NO: 3580 - DNA, 959 bp, Diabrotica virgifera
cgtcgttcgaagtgaaagctttacagagataaatcgtagtgatttttcatttttacgtttgaattttttcaactttattgtgcaaaatgttcggttttggacttttgttaactgtttgtgtggtttttggacaatctcatggttcggctatacctatgtgggaatacttaagtaagcaggaaaaaacttctttcctttactcaatgttcgctacccaagtggagaaaatctgtgaatcgtccagcattcaaaactgcaacagagaattgcttaaatatggccttaacaaactaaagaacttgcccgaagaatatttggactcaatggacccctaccaaagaggaggaagctcaatagtttgggacaccatgatggcaggccaccctctagccaacgctatcccccgcccccgatccactactacagcaaaacccaacagttatgaagatgaacctttcagcgactttgacttcggttctcaaggctcagcttcagcaaaaatcgataacgtggtagtagtagcagctccaaaagacatcctcaaccaatacagagtacagccaagcggataccgcccacaaaacattttcagttacttgaacagcattggaagcgacaaaaagggaccttaccgtagattccaagagcaatatcaaaccactactaccagtactactactgaaagagctctagtagatcccatggatgaagggatgtacgacgatgctccacttactggtcctatggttgtaagagtttacccagatggtacaccagtcaaggaagacttgcctcttcctcaagacgatgacttaaggcagtaccaaatgtctcaagtcaaaatccccaactttttaagcttcataatgcaaaaactcgttgttaaaaattgtgatatttttgtaaatatttattttcgttggctgtatgaatggatggatggatgaatatttattatt

SEQ ID NO: 3581 - DNA, 1089 bp, Diabrotica virgifera
gtcagttcaactttaaggttctacgacagatatggtgaaagctaaagtttggaaacaaatcagacctttcgatggtttgccagaaaggtctgattttgagctggttgaggaaaatctgcgtcctatcgaagatggggagtttcttgtaaaagccatgtatttaagcgttgacccatgtacagcagggcctcatatagacaaaaacaataacaccacaagacaaacgcaaatcgccaggattattcaaagtaagaatgaagactttccagaaggtaaattggtcgttgtaagaagcagctggaggacttattctatcgtagacggtactgtggatcccgcaataccagagccatatttgctaccaaatatgggagggttatgcccttctgttgctttggggatgctaggagtacctggaaacatcgcttactttacatttttggaattgtgcgaccctaaaaaaggcgaaacagttgttgtgtcaggagctgctagtttggttggcagtattgtatgccaaatagctaaaatcaaagaatgtactgtaattggaatagtagaaactgacgacgaaggaaaatggttgaaagacttaggaatagatcattttataaaccgcaacaatcaggacgtagataaggagttgactgggatagccaagcaaggagtggattgttatttcgataatgttggcggtaaaagtttctgcagtagtctgtgaacatttgaatactgaaggcaggatagcaaaaaagtaaaaatattgtgtacaaatcgaaccggctaatgttatcgctgggaaccaagaagctccaaaaatatccgagaagaagaaccttgaaattaaaaaaaatgggacgtatacaggccaaccattccaagggatggttgggagttttcaactacaaacttggatgcccaatgaaaaaatttaatttcaggaatctattggcgaagggtttgaaaaaaattaaacttttttcttgcttgtccaaaagggaaaggtttcggaaaaccctgttccccagggtttccaaaatcttggggggcgcctcaacgatattttactcccttttttccagtggggcg

SEQ ID NO: 3582 - DNA, 1262 bp, Diabrotica virgifera
aaaaaaaaaaaagggcggccgctcgcgatctagaactagtcttgtttatcagcgagaagatgtggaggactgatgtggtggtgtgtcttgttttagtaaaactagtggggtgttatgccaatagagagctcattcccctggatcctccaggaaacctaagacttatcgaatttgaagagaaagacgttctaatagaatgggatggtatagaaccagcatcagttcgaggcacctttaaaggatacttggtgaggatatggaaccacgtttggagccaagtctatgctattccccccgaaatgaacaaaactgccattcagttctatccctattcacgaaattttattaccgtagctgtcaggaatgataagtatgtaggaccaagaagcaatgccattagttttgatgctccacaaacagagccgaatatgccattcttattcgaacactttcaactgggagcaagttcagttcttcttcaatggaacaagcccactcaaccaaatggtgttctacttggttacaatatctattgtagtgagatggacggcgacatcgtcaatgaaaaatcaactattagatattttgtcactggagtagataatttccaagcaaaattaactggactgaaggagggaacgaaatacttcgtggaaataggagctcttaattgcgcgggagaaagtgaaaggaaatctattgaagtcgatctagagatgcacattccatacgcaccagcaatgccttcatttaaatacaccatcgacttcaactcgacagacttaaaacaagcaacgaaagataactgtcacaagtcaagatctttctacttatatgacttcaatgccacatctgcgcccggagagataaactatccgaacgacaacgaaaagagacccaccacccacaacgtaacccacaaagactgggtccatatcaacaccaactgcttggtaaatactatgataaaatggatacccgatatcgataacaaccctggagagcacttttacatcaaatataagataaagggagaacaggaatatttgaaagctggtccagaactggaagaggactatctgattttggaaaacttcaacgcctgcgtgaattacgagatcattctggttgctgttgatggggagtttgagacggaaagcgaaatgcaagagactccagctgttatgtttaagttttaacaaagctctaatttaatatatttatatattcgctaattttatttaataaaatttaattttcct

SEQ ID NO: 3583 - DNA, 940 bp, Diabrotica virgifera
gtatctagcaattctagcattttctataataattatttataatattaatataattctttaaaatatgtctaaacgattactcttagcccttgaatatccaaatgcagacaatgtaaatttagatgatgaaaacacattcaaatccataattatttggttggaaaccaataaaatacgaaaagctccaaatgatgtggtaaatcaattaaagaataacaacagagactggcataatactttttccaaatataaagatggaattggctgtcctcctttgaaaaatcgaactgaagaattgcagtggattttgggttatgcagtacagttggaaacacaaaagaataaaaacgtttatttgaaacatgcagtggaaaacttacaagccaagaatgttccagctgtagttgcagagaatatattggataaattagactttcgcagtccagagtttgctgaaggtataaaagaacttgctaaagttctaaatgtagtttgtcatcccgatccccttgttacactgaaagcagtacgaaaagtggtaattcaaagaatgtcaccagattgtgttgaacatcccgaaaaatatgtgttaaagggaacaccctttcctattcaagacgctgatctgggctttgatttaaatgatccagttttgaatcaagcagcaaaaatattgaggatgatctacatccaagatatgcgaaatttgcagacgagagctaacgaacttattgtagctgtacaatctgttacagctaaccctaagacggacaccaaactaggaaaagttggtttctaaataaacaaattaactaataaatatttaattgaatattggaatgaatatttaatttaatatataaggtgtcccaaaagtaggcggaacagtttgaatatttctcgaaataaacatctaaacacgacgccccactctggagtt

SEQ ID NO: 3584 - DNA, 968 bp, Diabrotica virgifera
caaatacaatggctgctaaatttttagttctcgccgcattcgttgtagtagctagtggctacgaacatcatgatgaaaatttcggtcatggagctcaacatgctatctccacctactccaccgttcaacatcacgccccagcagtccacgcatatgctgctcacgttcccgcagtccaaacctacgctgctcaaccacttgtccaacaatatgctgctccagtagtccacgcctatgctgctccagttgccaaaactgtttatgctgaaccatctgcaccagctcattacgattttgcctacggcgtagctgacccacacactggcgactccaaacaccaacacgagtctcgtcgtggagattttgttcacggaagttactccctcttggaatccgatggaaccaaacgtgtcgtagactacactgctgatccacaccacggatttaacgctgtcgtacataacgaaccagctgtacacgctgtagccccagttgtagccaaagcgatcgttcccaatgtagcatattctgcaccagtgcatcaggcttacgctgctccagtagctcatactacatactccgttccaacacatgcttatgccgctccagtagctcatgccgcttatgccgctccacttgctcaaacctactccacctcagtcgcccatggttatgctgctcctttaggccatgctaaagctggtcattatggatatgctgcccaggctccagttgtgtcatacaatgtctattaatttaaatattaaatgtagattttgtatataatttattttgtaaagttgcaatgcaattaaagataatggtgactggaaaaacaaaaacgaatttaatattaaaaactgaaaagatttaaatttctcaaaaaaaccgccaaaaacccaaaaaaaaattaaaaaaaattttaaataaaaaaaaatgggggggggcccgcctctcaaaaaaaacaa

SEQ ID NO: 3585 - DNA, 931 bp, Diabrotica virgifera
ctaacaaacaagatggcaaccaaatttttagttctcgccgcattcattgcagtagctaatgccggttcctgtggatcaggtttcggctacgccgcaccagctgttgtcgctcacggatctcacgatgccatctctacctactccactgtgcaacatcatgctccagccgtacactcctatgctgctcacgctcccctcgttcatgctccagttgcccattcctacgcagctcctttggttcaagctccagtcgctcacgcttacgctgctcccgttgctcacgttcacgctgaaccctctgcaccagcccattacgacttcgcatatggagtaagtgacccccacaccggagatgctaagagccaacacgaatctcgtcgtggagatgttgttcacggaagctactccctcgtagaatccgatggaaccaaacgtaccgtagactacactgctgatccacaccatggatttaatgctgttgtacacaaagaacctaccgtacatgctgttgctccagttgttgccaaaatcgtagccccagtagcacatgctgctccagtagctcatgctgcttatgctgctccagcggttcatgccgcttactctgctccagcagttcatgctgcttactctgctccagcagttcatgccgcttactctgctccagttgtccatgctgcccacgctgccccagttgcccatgctgcttatgctggtccagttgcccacgccgcttatgcagcaccagctctacatggatacgctagctctgttgctcatggttacgctgctcctttggctcatggtcatcatgcttatgctgctcatgctccagtcctttcacataacttgtggtaattctagaaaggaaaaattgtagattttgtatataaattatttatactgcttgcattacaataaaagattgtct

SEQ ID NO: 3586 - DNA, 1092 bp, Diabrotica virgifera
agaattttgtgatcaagagtatcagtaagaatagatcatgaagttgctacttgctattgcgtgtcttgttgcgggaatcaccgcagatttgaacgattatgaccaatacgtccattttaaggcgaaacattcgaaacaatacagaatcacagaagataaacttagattccaaatcttccaaaacaaccttcaagaaatcgaagagcacaacgcaagatacgccaaaggagaggtgggatggttcaagggtgtcactccatttgccgattggaccaaagaagagttcaaggctctactaacacgccaggctgcttcaaagcccaagcttacttatcgccaatcgtgtatcgccgattccaatgttactttaccattatctgttgattggaggttaaaagacgtagtactacctgtaagagaccagggtaaatgtggatcgtgctgggcctttagtgtcgtcggtgccctggagggacaggtagcaattcaccaaaaccaaagagttcctctgagtcctcaatatcttgtcgactgcagtaggacaaattatggttgtagtggtggtattcaagaggatgctttcgaagaaattcgaaatataggtatatgtgccgacgcagattatccatacgaaggtcaaaatcaggattgtcgtaaagatgttaaaaaagcgattagttctatttctggatataaggaatgtaatccaaccgaagaagatttgatttctgctgttgctactgtgggacccatatcttctactgtcgatgcatccacatggtcattgtatgcaggaggtatcctggatgacacgaattgtggagattggctcaatcatgctgtgcttgctgtaggttacaccgatgactacatcctgatcaaaaattcttggggtgaagactggggtgaagaaggatacataaagctagctcgagggcataacatatgcgcaattaacgaagataattcctatcccgttttgtaaattttaaatttaaatttggaccaacaacaatgaaaaatgtgatataaatgtataataaactaataatagtaccaaaaaaaaaaaaaaagggcggcctagaactagtc

SEQ ID NO: 3587 - DNA, 1528 bp, Diabrotica virgifera
agttgaacacatcgcaatctaatctgataggctcttaaaaaattaaaataacacttaattataatgaagtatataacagttgcacgaaatttataaaaatattctagacgatagttgttgtcaagaataagataatacacaatgaaagtgattgttgttattgcttgtcttattgtggcaattactgccaaattgaacaattatgatcactgggtctctttcaaggctaaacattcaaaacaatacaaactactagaagataaactaagattccaaattttccaagacaaccttcgcgaaatcgaagagcacaacgcaagatacgccaaaggagaggtgggatggttcaagggggtcactaaattcgccgattggaccaaagaagaattcgaggctctattaaaacgccaatctgcttcaaaacccaaacttgacaagagtttgggagtgtatactgccgatccaaacgttaaggtgccttcgtctgttgattggaggaccgagaatgcagtactgcctgtaagggaccaaggatcctgtgggtcgtgttgggcattcagtagcgttggagctctagagggacaactagcaatcaactacaaccaaagagttcctttgagtcctcaatatcttgtcgactgttctgaggaaaacaatggatgtggtggtggagaccaaaggttagctttcaggtttcttaaacataaccgtatgccctccgaagaggattatccatatactatgaaagatgatgtttgccgagaagatgtcaaaatgtctctcggtcccatctcgggatacacacatctgaatgcaacggaagaatctttaatttcagctctcgctaccgttggcccaatcgctgtttccgctgatgcaactaaatggtcattatatggaggaggagtttttgatgacgaagaatgtggaaaaaatataaaccatgccatacttgctacaggttacactgatgagtacattgttatcaaaaattcatggggagcagattggggtgaagatggatacatgaagctagcaagaggacaaaatacgtgccaaattaacgtagataattcatatcccactttataaattttaaacacaaacttgttaggtattgtcatataaaattttgtaaataaatatgatgtgtatacaaaaaaaaaaaaaaaaataaaagaaaaaaaaaaaaaaaaaaaaaaaagaaaaaaaaaaaaaaaaaaaaaaaaaatataaaaaaaaaaaaaaaaaagagatgaaaaaaaaaaaaagggggggcgccctgaaaagaaccaaaattaaatactcggtggagggactggtaaaattatttataagagacaccaaaaatcaaatcccagggccgacatataaaccacctgaagagggaaaaccccggggtaacccaacttaaatacctttgaagaacacccccttttcacagggggatatattaaataatgaccccccccgtacccccttcccaaaatttatcaaattataaatggaaaactgtatgaccccttga

SEQ ID NO: 3588 - DNA, 1595 bp, Diabrotica virgifera
  misc_feature (1577)..(1577): n is a, c, g, or t
ctattctcttatgccatagtaattaatagccctcgaagaaatgctctgaagaactgatgaaactttgaaaaattagttatcttaaaagccaataaaattaatcattgagtgtaggtggtgttatactgattacagtaaaacctgtgttaccggccacctgtacttacggtcggtttcaaattccccaaaccaattatatgtatattcccttacttatgacctgctatttacggccacccttataatacgaacgcggccaaataatcacatatttttaaagcccattttattgaaattaaatgtgaatgtcggccaaaataattttgttaaaataattttgtctattaatttgttgatggaaattcttagtactatttattaggacctattgtatctagtggtcacaaggtttttaaaatcctataataataaaatgtcgtaaaagagaaacgtttgacactatttataagtatgatttaaattcacaaaagttggccgaaaaatatgatgtaaaaactcaaattatcaaaggatatgaaaaaataaaattgagttgaaaaattctttaaaaaagcttaacaatctgttttttccgtagtatagtatgtacctacctagttttgttttatattaggatattaaagtaattttagtagtttccgtttttgtatagaattatatttgcttttattaacaaaataaacaaagttccaattatcttttatgtatttgtggactacaaatactggaaataccggccacctttctatatcggccaatagttccttcatttttagtgcccttactgacaggttttactgtattaatcaatgatcaatttttaaaattcctatttttttcatttaagttggagttgtacgttattttatgttttcatgactcataaataagtatgtttagagaggcagagataattattaccttcttaccttttttcgggctctacattcaaatggacttgaaataagtacccgagaaattcgggtaattgtgctttgagtattgtactctgagtactttttttgagcaatgtactcggtactctgtactcgttcctcaaatatgaaaagtacccggtactctgtactcaagtacaatttatcagtacccggcccagctctgccgcaaatgcatcgtttttgagataataataataataataatataataataatggcgtaaaaaagtcgtggttgagaactaacaggattaactagatgatttgacggtttgaagtaaggctacaatctttgaaatatagcaataaatatatagcttttaaagcaataaataaatttgtcagtttgtaaaaaaaattgaacatcccgtatctcgggaacgaagcgtttgcggacatatgattataaagcaaattgtcattattttctcatgtaaaattaccccttaaaatttgtcgcacttatttagaaagcaccctgtactgatgacgaacatggccagttgttaagtacctaacttttttgttatccaacataagcgaatgaatcgaagacaaatgttgagaaaacctgaggctatagttgggttttaatttncggtatttatgaatgata

SEQ ID NO: 3589 - DNA, 1673 bp, Diabrotica virgifera
  misc_feature (1581)..(1581): n is a, c, g, or t
  misc_feature (1600)..(1600): n is a, c, g, or t
aagttttcttttggaaacgaaatcccatttttttttcccctcaaattctttcccttttattataaaggggaaagcagaatgggatttttgttctttttaattaatatccccgaaaaatttgggtttttctccttctttatgtgccttaggagcaagcctttagaatttcatcctttggaagaaccatttttcatgggaaaggcgggggaaattcccacggaatattcttttaggattggtcgaatagcccccacaattcgaaatgccttttattttggtttagcattgtgattttttaaagtccatttctcacaaccatatgagatagaccacacataacatttcagtacattctttcgaatattcatcgaaaaggtttctgttacataagacttgtttccaggtcataaaagccttccgtgatatttcgatcttagttattatctcttcatcagagtcacaatttacatttaaccagctgccaaggtacttgaaattattcacccgttctaactcctctccatcaagagaaagctgaccttgatctatattaatctttccaactaccatccactttgtttttgaaatgttgattttaaggcctctccgataacttgcttcactgactagatttagtagtgtctgaagatcttttaaattttctgcaagaaaggctgtatcgtcagcgtatctaatattgttgattacttctccgcctggccttactccctcttgtctgtcatccaaagcctcgctaaagatttcttcagagtacagattaaaaagggtaggtgataaaacacaatactgtcgcactccacgttttatgggtagtttttcagtacgactatctccaacttgaatagaggctacttgattgtaatataagtatttcagcagtcttatatcgtagtggtcaagtcctgctgcctgcaggcaattgaaaagtatatcgtgttgtactcggtcgaatgccttctcgaagtggatgaaacaaacataaacgttctttcggaattcacagcttttttgtaaaagaacgcgcatacaaaatagtgcctctctagttcctagaccatctctaaatccaaattgcttattacccattctactttcacacagaaggaatactcggttttgtataattcgtaaaaatatgttaagtgcgtgactgatcaaacttattccgatgggtgagttgcggaatttaattaaaaatggatataataaaacaaacggtaattttatttttgcaacgaaaatgtgttcgtttaggtctctcggagagggtcgcgtcggtatgtgtgaatggttcgcatgctgcgtagtgactaaagaaagcaaccacaaacgaagataatgtttgtattccttttcccctgaccagatgatcacataaatcactatcaagtctggcgtctacttttacggttttaagaaaaataatttcgaatgcaagctagcatgttgacacattaactgtctgataaaatacttaattaatgagggtgcagtttgttgccgcatagacgaacaacagatgtcacaggatggataacgtaaaaatacgaggtatattangcacattacattttattangttccaacgagtggaatgaaaaattttcttagtctggcgaaatacaaaggtatggcaaaactagtaaccacag

SEQ ID NO: 3590 - DNA, 894 bp, Diabrotica virgifera
gtcatgtattacatgttacacttcctttcgtgattgtagattatcattggataaaaacttttgatagctgcattttggatttctagctggcctacatttaaaacgtgtagaagtcaattctttcgacatttttcaatggcgccacacagttgtaaaggttgtttaagagacgtaatggcagctaggatgtctaagaaaaacacggatccaccaatggaagttaacggtgtcgatgaagcccatacagtccacaatttgtcaatgccatggtttggtatggacataggtggctcgctatgcaagttagtgtattttgaacctaaggagcttccaggaaccagggaagaggcagcttcccaagtagagactctaatgaacattaggaggtaccttacaaagaattctgcatatggaaagactggtcatcgagacatgcatttacagatggataacgtaaaaatacgaggtatattaggcacattacattttattaggttcccaacgagtggaatgaaaaattttcttagtctggcgaaatacaaaggtatggcaaaactagtaaccacagtatccgccactggcggaggagcgtacaaatttgaagaagatttcaggcgggaagtgaatttaaagcttgccaaattcgacgaatttgactcactattagcaggattacattacatagatagaaataatccctccgagtgttattactgggcgaactcaacagatgaagaaaggtgtagtaaagtgaactacgattttttcaaggccttatcccttcctcattgtaaatataggatctggagttagcgttttagcagtatattcagaaacccaatataaacgtatttcaggtactagtataggaggaaggacattcttaggactttg

SEQ ID NO: 3591 - DNA, 1071 bp, Diabrotica virgifera
  misc_feature (1033)..(1033): n is a, c, g, or t
cttgtccttgatattaactcacctacttaaacctctgtttttcagtttttctgtaatttactgcatatatgcgttcgcgataattagttttataggtgttgaacattcatataatctcaagtgattaaaggttattagactgtcatatctaaaacgtttgacgaaatccattccttcatcctaatctgatcatcatggttaaagttctttcgacatttttcaatggcgccacacagttgtaaaggttgtttaagagacgtaatggcagctaggatgtctaagaaaaacacggatccaccaatggaagttaacggtgtcgatgaagcccatacagtccacaatttgtcaatgccatggtttggtatggacataggtggctcgctatgcaagttagtgtattttgaacctaaggagcttccaggaaccagggaagaggcagcttcccaagtagagactctaatgaacattaggaggtaccttacaaagaattctgcatatggaaagactggtcatcgagacatgcatttacagatggataacgtaaaaatacgaggtatattaggcacattacattttattaggttcccaacgagtggaatgaaaaattttcttagtctggcgaaatacaaaggtatggcaaaactagtaaccacagtatccgccactggcggaggagcgtacaaatttgaagaagatttcaggcgggaagtgaatttaaagcttgccaaattcgacgaatttgactcactattagcaggattacattacatagatagaaataatccctccgagtgttattactgggcgaactcaacagatgaagaaaggtgtagtaaagtgaactacgatttttcaaggccttatcccttcctcattgtaaatataggatctggagttagcgttttagcagtatattcagaaacccaatataaacgtatttcaggtactagtataggaggaggtacattctttaggactttgtgtcttttactggctgtatacattcgaagaagcataggattagctgctgaangtgacatcgaaacgtaaacaactcgttagggaaatata

SEQ ID NO: 3592 - DNA, 1626 bp, Diabrotica virgifera
aaaactatcgtcagagtgtcacaacacaaaatacctccaaccaaagcacttcaacaaacagagagaaattgtgattttgatattgaaatacatatcgacattatcaagctatctgtgatttattagcgcatgccagcgttatatattttgaccagtgcgtcactttactggcgtttattgaaattaaattgatattcaagccggttttgagactcaaggtgctgcttctcagttgaatctacctctctctttttgatatcaagtttacagttcgtgatcagaaggctacttttggaataaacactacacaaagttacaccatggtatcacccttggtcggcatagccgttttgtgtttagtttgttcgataaatggacaacaaggtgaagacctagattctctaataaactccgtgttctccagaccagcagaggataaaccgacaactgaagcgacaaagccagtaacttcttctccaggaatcaacttacaacccgtagaaagccacggcggggaaactggtattccaggtattggggaatgcaattgtgtaccgtattacctttgcaataatggcagtatcaataccaatggagagggaattattgacattagaataaacgagggtccttgtggtaaccaatatattgatgtatgctgtgataagaaaaatacagtcgatgaacccataactccaactcccaacacaaatactgttggatgtggccatagaaactcaagaggagctggagtaagaattaccggggcgactgatggagaagctgaattcggagagtttccttggatggtggcaatcttaagagaggaatcggtagaaggtaacccgctaaaactgaacgtgtaccaatgcggtggttcattgatccatcctcaggttgcgcttaccgcggcccactgtgtcgcaggtaaaaataaagtatttaaggttagagctggagagtgggacacccagcacgagaaggagctttacccgttccaagacagagaggtgcaatcgattgttgttcatccacagttctacgctggagccctctacaatgatatagctcttctctttttaaaatcccctgtcagtgccgctgaacatatatccacagtgtgtttaccttcacaaaatcaagcgccatctggatctgggtttgccactggttggggaaaagatcagtttggcaaaaaaggaaaataccaggttattctaaagaagattgaattaccggtagtatcaaataatatttgccaagataaactaagaacgactcgtttgggtaggttctttgaacttcacaatagttttatgtgcgcgggaggagagcctggtaaagatacttgtaagggagatggaggaagtcctttcgtgcttagtactggtacagaagaggataaattttaccaggctggtattgtagcttggggaattggttgtggtgaaaatggcaccccaggtgtttacgtaaatattgctaagtttaggagttggatcgatgagcaaatggccaaacagaatttggatacttctacttataaatactaaatttaggtgacttattatgtaattatgattgacttttatacgctttatttcaataaaagttaaaatttttacc

SEQ ID NO: 3593 - DNA, 1388 bp, Diabrotica virgifera
tgtgaacaaagaacttcaggaactgcaagaactaagtagatcgacagagacaagaaaattttatcagaaactgaacaaaagcagaaaagacttcaaaccaagaacgacgatgtgtagagataaggaaggtaatatattgacagaacagcaagagatactaagaagatggacagaacattttacggaaaagcttgaaggagatgggagtgagacaaaccctgatataccattagaccaagcagacaacagagaaaagagtccaccaacaatagccgagattagaacagcagtagacaaattaaagaacaataaatcaccgggatcggatcaagtagcatcggaattactgaaggaaggaggagacgcactacagaaaacaatacatgtattgataacaaagatatggtcaaataaacagctaccagcggagtggaatagtggtattattgtaccattacataaaaaagggaatcagttagaatgtggaaactaccgtggaatcacgctgctgaatgcagcattcaaaataatgtccaacgtcatttatgaaagacttagaccacactctgaaaaaatagttggcaggtaccaaagttgcttctgtagacagaagtcaacaatagaccagatatttgtctgcgacagatcctcgaaaaaacaagtgaacataacatcgacacacatcatctcttcatagacttcgaaagcgcatatgacaatataaaccgagaattcttaataaaagcaatgaaagaatttaatataccaacacaactaatagaactgataaaagaatctctaaaagtagaaagtaaaatccggatacaaaacgaactaacggaaacagatgtgaaaaagggactacgccagagagacgttctatcatgcatcttgttcaacatcgtactcgagaaaataatgagggacacaacactcaatactcgaggaacaatcattaataaaagcgtgcaaatactagcatttgcagatgatgttgacataatcgcaagatcaagaagagaaatgatagaggcattcaatcaaaagaacgagctgcacaaaatagtggccttaaaatcaaccagaacaaaacaaaatatatgcagttaagtaaaaacgcagaaataaggcagccacaaaatataacaatagtagaatacaacattgagggggtaaaaaactttacatacttgggatccctagtcacgtctgataataacgctgcggaggaagtgaaaaggcgaatatttattgccaataaaagttaccatggcttaattcggcaactaagatcagataacgtcgcaagaaaaacaaaattccaaatatacaaaaccttaataagaccggtactcacatacggctcagaaacctggacactggacacc

SEQ ID NO: 3594 - DNA, 1771 bp, Diabrotica virgifera
ggaacaagtattataataattaatttagttcaaacttatttcattttttaaaatgtgggcatatctgaaggtacctgtgaaaattactggctttagaccagcaatttggagtacatcgcagatggtatttacaagcattagttctagatctataacacatcaggctgctttcgaaaagaagggcttagtggatcggaagccaagcagttttatcgacaggagtcaactgaagtacgccaggagattggttgtaaaactaggaagtgcagttatcaccagagaagacgagcacggattagcattaggaagactcgcttcgattgtagaacaagttgcagaatgtcagaatgaaggacgagaatgtattatggttacaagtggagctgtggcctttggcaagcaaagattaactcaggaattactgatgtccctctcaatgagggagaccttatctccaacggatcacacccgtgaggaagccccaacacttgtggagcctagagcagcagctgcagtaggacaatcaggccttatgtctctctatgatgccatgttttcccaatatggtgtcaaaattgcccaagtattagtaacgaaagcagacttttacaacgaagaaacgagaaaaaatctaatcagtactcttactgagttaataagtctaaacattgtgccaattattaatacgaacgatgccgtttcccctccaccacaaatagatgaaccaataggaggaaaggctggaaaaaaaggaatttcgcttaaggataatgatagcttagcggctatgctagcagctgaaattcagtctgatcttcttattcttatgtctgatgtagatggaatttatgataaaccaccatgggaagctggagcgaaatttttgcatacgtttacctcaaatttaagtcacactattgaatttggtcaaaaaagtaaagttggtacaggaggaatggactctaaagtaacttctgctacatgggcattagaaagaggagtttcagttattatatgtaacggcactttagataaagctataagatctatcatggctggaagaaaagttggtactttctttactgagcattcactgggaggacctgtttcatctgaagttgtggccgaaaatgcacgacttggaggccgcattctcgctactttaactcctgaccaacgagcatcatgcgttcataacttagctgatctccttatttcaagacaagcagaaattctagatgcaaatcaaaaagatcttcaagaaggagccaagatgggcctagccaagccacttatgtcgagactgtctttgacgccagcaaaactaagaaacctttctattggtttaaaacaaattgctgatagcagccacaacaatgttggacggattttaaaaagaacaaaattggctgacggtctgattttaaagcaaatcacagtacccattggtgttcttttggttatttttgaatctagaccggattccttacctcaagtagcggcccttgcaattgcatcaggcaatggtttattactgaaaggtggaaaggaagccatgcatagcaataaagctcttatgcaactagtactgattcattgaaaaactattggggcagacaatgcgatttctttggtatcttccagagaagaaataagcgatttattgaccatggaaaatcccatagatccttattattcctaggggttccaacgattaatccgcagaattcagatcaaagccacatataccagtggttgggcccggcttgaa

SEQ ID NO: 3595 - DNA, 887 bp, Diabrotica virgifera
aggttatgttcaacctgttcagctgtttgttacggtagttctttaataattaaaaaatacataatagtaacaaattaatacaacatgaattttctctccttacgtaccttccagactaccgtttttcagactctacaaaacaatgtaatcagatcagcccctgaatctttaaatataatacaagccaggtgctatgcagctaggaaaggaaccagagatcgtaagaagaaggctaaagtaaaagtagaaatccaaaaagttggatttataccacataatcaaagaaatagagagaagttcctagctagtcggcccaaactaaaatttgatgattcgggaatgagagatccagtagatgatgtgtttgtttgtaaatactataaatgggttgtgtatcctttccaagaggctgttaaagctcatagagaaactcatcaccctgaaatgtataatagacctgaaacagatttacatgtcactgtagaattaaatatggagggtgaaaagaagactcgattgctagataattttacaagaactgttggaattccccaccggttcgaccaaggagaaattccgtctgtggctgcgttcgccaaaacccaagaaatacaaaaacttgccattgatgctggtgcccagctggtcggtgggtttgacatgatcaagaaaattcaagttggggaactcaatcttaatgacttcaaatatatagttgctcatcctgagattctaccggaaatggtggttctgagaggtttgttaaagaagaagtttcctaatccaaaaagtgggagttttggatgttaatctaggaactgcacgggagaaagttctatatggtattaattacacagctagtaaagatgagtacgagaaagattatg

SEQ ID NO: 3596 - DNA, 445 bp, Diabrotica virgifera
ctcacgggtccacgcacgcgtctgtactgacgtactattcctgtacactttccttcgagtggtactgaattagaaatttcgtgtttattgatagattgcgatgataatgtcacagcgaagataactgcaggaattggatttcaggttacagtagatgaattggtttttgaatcatgggaaccatcaacctgtaaaatacaaatttatacttcacatgcagatcttacatctgcttaaattacactacaaaaaaaatattttaataacaaattatcacatttcatttaccattttcaaatttatcaatttaaatttattaaaaatgaataaccattttcaatttattaatttatgaaatgtaggcaccaatgggcttatttgtcgagctactttgtgtacatgaaaaaataaataaattagtaaactatgacaaaaaaaacaaaaa

SEQ ID NO: 3597 - DNA, 1945 bp, Diabrotica virgifera
  misc_feature (1133)..(1133): n is a, c, g, or t
gtttgacaacgagtaacgtttttggcggattttattagttttacatattttattaaaaaacaattctatttagacctaaatgtttaggtaaatcatattttgagatatacaaatcttccattagttgatctgatggctggaaaacgtggcgccacaagtgatttaaatcacgaaaattgggacaaggaagaaccccctgaagatgctggtacatttcaaagagcttctgaggattctttgaaaagtagagttataaaaactgcaagaaggagaaatcctatatcttcagttagggatggtggtgatggtgaaaagaaaagtgccttcaccagttttacaggttttggaaaagcagcaccgccaacatccacagctttttcttttctatccaatctggctaaacctaatacccctccaaaagtaaatggtacaggtggaatttcagaaaaatctaagaatgatgcttcagcattcaagtatagtagtagtcctataacagggagtgggaaattaaatgaaaaagtgacaacaaatgtttttggtgcaagcacagctaatactggtaataaagataacaatcctactaactcaccttcagagaaatcaaatgaatattactcaaagttgaaaggtctgaatgagagtgtgtcaaaatggataaaaagtcatgtagatgcaaacccactaataaatttgcagccaatatttcgagattatgaaaaatactttgcagaattagaaaaggagaaagacctaaaaccccctgatacgaacaataaaaccgactcttctatgagctcttttgcttttaagcctacaactaatgttccagatagtaccactgaaaaattccaatcgatttccaaaaatgaatccagtaagacttcagaaaataatattccaaaattgacttttggaacttctagcacaagttcagctacaccaacatttagttttggaagcaaggccagcacagattctggaaataagtcattttcttttgccagtacaaataacgaagcatcaaaaacaacagcggccataccatcattctcatttggagcaaaaccatccatctctacggcagtgacaaccagtgaaccagcaaaaagcataagtacaaccacaccggncttttcatttggagctcaacaagcttccaaagaaattccatccttcagttttggtagtaaagcttcaccagtttcatcgcctgtaggatctggcgcaagcacaactgtaccaccagtttctttaggaacggagtccagtgccaaagaggctacaaaacctataccgtcattttccttcggtacaagcatgtccagttccacatctgcaggtaccacagcaaatgataccacgaaaactacagctataccatccttctcttttgggaaatctgttaccccattctcttctgctacccctttcacattcgcaaatgcagtaaaaccagtttctactgataataaggataaagatgcagaggaagatgaggagccgcctacaaatgaatttacaccagttgtagaaaaggatcatgttttcacaacgaggtgcaaagtattcgtcaaaaaagaagacaaattcggcgatcgaggtgtaggtaacctatatttgaaacccataccagatagtgaaaaagtccagatgatagttagagctgacaccaacctcggaaacctattgttgaattgcattttgtcggaaagtatccctaccgaagagactagggacgaaaagacgttatgttggtatgcgttcccactccggaatcggagcccccaccggttcctgttttgttaagggtaaagtcttcggaagaagctgataagttgttggagacgttgaatgagagatacgaaaaagagttgttgatttttgattctttttatttctcctgtgattatggtcgaatgatacggatgattgttttttaacg

SEQ ID NO: 3598 - DNA, 1751 bp, Diabrotica virgifera
ggtttgaagaagacggtcaaaaccttgtaaccagtaaatatgccggtcttgcaaggacttctacttttattattggcgggatctttgacagcaatgcctaatcccctttcaacatcggggttagaaggtgctgttgtgagcaatgcaccaggatgtgcagaagttggaagggatattttaaaaaaaggaaaaaatgcgatagatgcagtaattgccactgccttctgtgaaggtgtaggaaatcctacaacgatgggtgtaggtggaggattccttgctacctattacaacagagccgaaaatatagtatactctatcaattcaagagaaatggcaccttctggagctactgaagatatgtttgttagtaatcaatctctggctcagagaggtggtctatctgtagcagttcctggcgagactcggggatactggatactatataacaaattcggaggtggagttccatggagtgccttagtagaacctacgattaaaatctgcgaagaaggaattgaaatgaacgaacttacatacaataacgtaagagatcaaatcgatgttgtgagggctgaccctggattaagagaaatttttattaatccagctacaaaccaagtttacaagaaaggagaaacatataaaagagtgaaattggctcaaacattgagagtaattgcaagagaaggtggaaatgccctgcataatggatctcttactaagaaatttgtcgcagatatcaaagctaatggtggcattattaccgcaaaagatttagctgatttcaaagtggaattccttacgccagttaatacaacaatcagcggaaaacaaatatattctgttcccttacctggtgcaggtatcataatgacatatattttaaatatactcgaaaactatttacctcgcaatgatcatctttcagtgaaaacttaccaaagaatagtcgaagccctgaagtacggttatgctatgagaagcagcctcggagaccaagattttgttcctggactggatgatttgattaccaagctctcttccaaacgttatgctgcagatacaagaaagaaaatcactgatttaaaaacattcaatgaggccacacactatggtgctacattccaatctattcaagatcatggtacagctaacctctgtgtctggggtccaaatggtgacggaatatctcttacaagcagtattaattatatcttgggagcaggattcgtatcggaaagcactggcatcatactcaatgattctatggatgatttctcgacaccgggattagtcaatgaatacggttatcctccatctccatcaaatttcattcgtccgggaaaacgaccacagtcctcaatgtgtccgacaatcatattggatggaagaaacgaccttttcatggttgttggtggtgcgggaggaagtaaaattacttcaagtgtaatgcaggttatacttaatcgtttatactttaacatggatgtggaaagtgcatccggtctacaaagagtacatcaccaacttttcccaatgacattagatatggaggacgaatggatatatgagaatccagaaattgtaaaaggtcttcaaagtaaaggtcacaatattactttctcttatccagacgggtttgtagcagtaactgcgatatcattagataaggatagcagacacctcgttggggtccatgacaaaagaagacgtggttcagttgcctatatgtaggtagaatatgaataatt

SEQ ID NO: 3599 - DNA, 974 bp, Diabrotica virgifera
ggctctcgcagcactaccgacgtcatatgaatattacacggatggtggtatcaccgctgggttgtctgataaacagccctattttacacttaataataagaatattactatatacagtggcgcttttcactattttcgggttccaagagcctactggagggatagattaaggaaaatgagggcggctggacttaataccgtagaaacctatgttccatggaatttgcacgaaccacagtcaggtgtatatgactttggaaacggtggctccgattttgaggactttcttcatgtagaagaatttctgaaaatcgcgaaagaggaggatctctttgcccttgttcgagcaggtccatacatatgctcagaatgggaatttggaggattacctagctggatactaagaaacacttcatcagtaagaaactccaaagatcaaaattacttaagttacgttaagagatattttaatattttgctgccattattagctcttttacaatttcaaaaggggggcccaattatcggattccaaattgaaaacgaatacggaaatactggaaatgacgatgttgaatacctaaaatacattcaacaaatttttgaagacaataatctcattgaattgtactatacttcagacccacctagcgcaaatggacttggtgctattccgggtattttacaaactgctaatttcaattctaattcaaagtggcaactagacaagcttaaccaacttcaacataataaacccacaatgactatggagttttggacaggctggtttgatcattggttagaagatcatcataccgtaagcgctcagcaatttaaaagtcttctagaagaaatttttgattatccctcttctgtaaccattacatgttttgtagtagtaccaacttcggtttcaccaatgggagctaacagtcttaaatctggtatggacaatactggacttcacccactac

SEQ ID NO: 3600 - DNA, 633 bp, Diabrotica virgifera
ccaaaaatgaagctaacaggtgtatgttttttaatcgtggctttttgcgctatcaacgcattagcaagcccttccgatccggatgatccatcaccagatgaacaaactaatgcaccatctgtttcaacatcagattctccacctgacacagtaactgattcatcatctactgcacctacagattctacacctgacccagcaactgattcatcatctactgcacctacagattctccacctaacccagcaactgattcatctgcctcacctacagattctccatgcgtccggagtcaactacgaaaggttcagctgcaagtttatttacaggcacgaaatattttatggctacatttgtaatcgtggttttaaattacttcttaatgtaagttaaatcaaaataaatatttttgtatttatgcacgattgtaaatgaatatagttgtaaagtcatttcgaattaaattataatttttgtaaaattaattttgtaaataaaattttatttttaacaaaaaaaaaaaaaaaaaaaaaaaaaaaaaaaaaaaaaaaaaaaaaaaaaaaaaaaaagaaaaataaatgagtaaaataaaaaaaaaaaattaaaattgaaaacaaaaaaagggggggccc

SEQ ID NO: 3601 - DNA, 612 bp, Diabrotica virgifera
ctcgcgggtcgacacaacactctacactcacggcgtccggaggttaacttcatcgtgtgcaaaaatgcctatttcccgctgtgtttcatcagagttttttagtctggtggaaacacaactaattttgttgtggattccagacaaaaacagccgttccagttaccaaaccacaggggaagaaaccccaaattagaggaaaaggtctaaagaaaaagaaggttgctttgaaatttgtgattgactgtacccatcctagtgaagacaatcttctagatgttgcaaactttgaaaattatttgaaagagaggattaagatcaatggcaaaacaggaaactttggtgctggaaaaagtggtcaacattcagttaccgtaagcagagacaaaaatgttaaaattgccctgtccgctgaaattccattttcaaaaaggtaccttaaataccttacgaaaaagtatttaaagaagaacaatcttcgtgattggttaagagtagtagcttctggaaaggactcttacgaactcagatacttccagattgacagtcaagaagacgatgatgaagaagataatgaataatttattcagttatttttttattaaatagattatt

SEQ ID NO: 3602 - DNA, 630 bp, Diabrotica virgifera
taacttcatcgtgtgcaaaaatgcctacaaaaacagccgttccagttaccaagccacaggggaaaaaaccccaaattagaggaaaaggtctaaagaaaaagaaggttgctttgaaatttgtgattgactgtacccatcctagtgaagacaatcttctagatgttgcaaactttgaaaattatttgaaagagaggattaagatcaatggcaaaacaggaaactttggtgctggaaaaagtggtcaacattcagttaccgtaagcagagacaaaaatgttaaaattgccctgtccgctgaaattccattttcaaaaaggtaccttaaataccttacgaaaaagtatttaaagaagaacaatcttcgtgattggttaagagtagtagcttctggaaaggactcttacgaactcagatacttccagatcgacagtcaagaagacgatgatgaagaagataatgaataatttattcagttatttttttattaaatagattataaaaaaaaaaaaaaaaaaaaaaaaaaaaaggacgcgtgggcgttttaaaacaggacagttctgatgatccaaatataaagaacaagtgtatagaaagcccataaattattgggaaaagaaaaaaaaagggggg

SEQ ID NO: 3603 - DNA, 1310 bp, Diabrotica virgifera
attctttattacaaagccaaaaatgaagctaacaggtgcatgttttttaatcgtggctttatgcgctatcaatgcatcagcgagaacgatcagcaataaatgggagtccgggaataatcaagatgatctaccaacttctatagtaactaatccacctgatccagcgactgattcttcatctgtttcaccttcggattctccacctgagccagtaacagattcatcatctactgcacctacagattctccacctgacccagctactaatcaatcatctactgcacctacagattctccacctgcgccagtaacagattcatcatctactgcacctacagattctccacctgacccagcaactgattccgcatctactgcacctacagattctccacctgagccagtaactgattcatcatctactgcacctacagattctccacctgacccagcaactgatccatcatccactgcacctactgattctccacctgagccagtaacagattcatcatctactgcacctacagattctccacctgacccagctactgattcatcatctactgcacctacagattcttcacctgagccagtaactgattcatcatctactgcacctacagattctccacctgacccagcaactgatccatcatctactgcacctacagattctacatctgagccagtaacagattcatcatctactgcacctacagattctccacctgacccagcaactgattcatcatctacagcacctacaaattctccacctgagccagtaacagattcatcatctactgcacctacagattctccacctgacccagctactgattcatcatctactgcacctacagctcccgtccgtgagccagtaacagactcatcatctactgcacctacagattctccacctgagccagtaactgattcatcatctactgcacctacagattctccacctgagccagtaacagattcatcatctactgcgcctacagattctccacctgatccagtaacagattcatcatctactgcacctacagattctccacctgacccagcaactgatccatcatctactgcacctacagatactccacctgagccagtaacagattcatcatctactgcacctacatattctccacctgagccaataacagattcatcatctactgcacctacagattctccacctgagccagtaacagattcatcatctacagcacctacagattctccacctgagccagtaacagattcatcatctactgcacctaccgattccccacctg

SEQ ID NO: 3604 - DNA, 1779 bp, Diabrotica virgifera
  misc_feature (28)..(29): n is a, c, g, or t
aaataaagacagtttttttttcatccanncccttcatttcagctttcaataaaaaaactaatgattatgtaccttagcacggtcaaaataccgcggccattcaaattaatcagtgggcaggcgagactttatatttaatacaaaaagaccatgtttttaataaacaggtgaaaaaaatgttgccgaattcctttattaaacctatatatttttactaaatatacaattttttaatactaatattatcatcattactaaatttaaataatttaaatttatattttaataaaaaatttataaaaaataaaaataataatatataaaaataaaggttaacttcatcgtgtgcaaaaatgcctacaaaaacagccgttccagttaccaaaccacaggggaagaaaccccaaattagaggaaaaggtctaaagaaaaagaaggttgctttgaaatttgtgattgactgtacccatcctagtgaagacaatcttctagatgttgcaaactttgaaaattatttgaaagagaggattaagatcaatggcaaaacaggaaactttggtgctggaaaaagtggtcaacattcagttaccgtaagcagagacaaaaatgttaaaattgccctgtccgctgaaattccattttcaaaaaggtaccttaaataccttacgaaaaagtatttaaagaagaacaatcttcgtgattggttaagagtagtagcttctggaaaggactcttacgaactcagatacttccagattgacagtcaagaagacgatgatgaagaagataatgaataatttattcagttatttttttattaaatagattataaaaacgattggaatcaattattacaaagccaaaaatgaagctaacaggtgtatgttttttaatcgtggctttttgcgctatcaacgcattagcaagcccttccgatccggatgatccatcaccagatgaacaaactaatgcaccatctgtttcaacatcagattctccacctgacacagtaactgattcatcatctactgcacctacagattctacacctgacccagcaactgattcatcatctactgcacctacagattctccacctaacccagcaactgattcatcatctactgcacctacagattcttcacctgacccagcaactgattcatcatctactgcacctacagattctacacctgacccagcaactgattcatcatctactgcacctacagattcttcacctaacccagcaactgattcatcatctgcttcacctacagattctccacctgagccagcaacggattcatcatctgcctcacctacagattctccatctgactcaacaactgcttcgtcatctggttcatcgacagatttatcaagtgactcaactggtgcaacacctgagtcaactacgaaaggttcagctgcaagtttatttacaggcacgaaatattttatggctacatttgtaatcgtggttttaaattacttcttaatgtaagttaaatcaaaataaatatttttgtatttatgcacgattgtaaatgaatatagttgtaaagtcatttcgaattaaattataatttttgtaaaattaattttgtaaataaaattttatttttacataaataaattaagctgataaccgttggaatcgaccaatattaagcggcgtttagacacagcgataaatcaaacaacttatcaatatatcatcgaataacttgcacttatcattgtgtgtaaaacgtgcatcgcacgacttatccaagt

SEQ ID NO: 3605 - DNA, 1504 bp, Diabrotica virgifera
  misc_feature (980)..(980): n is a, c, g, or t
ctactaaataatatgactttgtcaaaatgtttgagtcaaatttctcttttttaatcttgcagttgggaggttaacttcatcgtgtgcaaaaatgcctgtaagttttacatttttttatatctaaaattatattaatatacataagccatcgcattatataaattaactgtaatatttccaaattaatgtctttatagcaatagagatttatttttgtgaaattattctgaaatcacatgttattgttggatatttgtaatttttattctgctatagatttcccgctgtgtttcatcagagttttttagtctggtggaaacacaactaattttgttgtggattccagacaaaaacagccgttccagttaccaaaccacaggggaagaaaccccaaattagaggaaaaggtctaaagaaaaagaaggttgctttgaaatttgtgattgactgtacccatcctagtgaagacaatcttctagatgttgcaaactttgaaaattatttgaaagagaggattaagatcaatggcaaaacaggaaactttggtgctggcataatacagtgaactcgagaacaaggagattatgaggtttcgcttataatgaggtatactgtccgtcttgtggtcctcctattatactataacatctttataactggtcatactcggtccagttactgattcatcatcctgcaattctgacccactgaaagccactgcacctgattcactctgtgccattaacagtttcaccatctatgcacctactattacaaagccaaaaatgaagctaacaggtctatgtttttttacctgtctttttgcagtatcaacgcattgattcatcattccgattccctagatattctaccccatggacaaactaagatacctcctctaccacaatcgcagattccacctgttcatcaaacctaaaaatttccaactttacttaccattgaatggctaaaataaatancccaactgcgtgtatatagaaatgcccaacatctgtgttattattgatgccagtggtgtaataaactccaccacctgtaataaacttcctgttaatctatcgaatcgtctgatattgaatattgtaagaaaatttatgttgttttattaaatttccattgttcaggccggccatcaacaaataaaaaactacgaaagaaaaaatcaaaaaattttcaatattgttgcctgatattacgaagggaaattaatccccccctttttatttccccttttaaaaaaggaagtttctggaagttacagtttaagttttttgtatgggccctttttctaaaaaagttattgcaaaccaaaatttttaaaaaaaaattttttgttgggttttttattaccccttggtaggatatggaaaaaaaaaaaaaaaaaaaaaaatttttttccccccggggtttacttttcccaaaaaaaaaattttttttaaataaaaaaaataaaccccaaagccgttttttttttttttttttt

SEQ ID NO: 3606 - DNA, 1170 bp, Diabrotica virgifera
  misc_feature (1065)..(1065): n is a, c, g, or t
gaaagtccaaatcatgtccaaataaaaatacatgtgttgtgaaatgtaattttaaaagttttattataacaatgacttcattttattcaaatgaagaaaacagcttggaaaaagtcgttgtttcaaaccatcccctaattgaaactaaagctgatgatatagatgaagtttatgaaataaaaagatgtgcagaatggatacagtctaatggatttaaaaaggtttgtttacaatttccagattatttattacaagatgccagtgaagtagttttaaaattggagagtatcgtgaatgaaacaatttatttattaggggatactgtttacgaaagttgttgcattgattttattgctgctgcacatataaacgctgatgcgattattcattttggtcctgtatgtttttcaaaatttgcagaaaatgttccatttatgtatgtttatgagaagcgcccgcttgatattgcccatttaaagaagattgtagagacaaattttgatgattatcatgttgcatttttggtagattttggataccttcacttattcgataaactggtggaagcatttaaagattacaaataccttgagttcataagaattgacaatcttaaagacgttcgacagggtcataccatatttttttatggtaaagatgaaagaaaaatgtttaatattacttccctaataaccccattggctgtattctattacgatattggaaaatcgagagtacaagcatttgctgatgatattaaatctttaacaaaaagaaggtattatcttatagagagaataaaagatagtgatactattggaataattgtaggaagtataggaatacagaattgtctaaagttaattgataggttgaagtctttgattagcagaagtggaaagaaatactatcttttgaatattggtaagccagctgttgagaaattggctaatttcccagagtttgatgtgtatgtggttattgcatgctcgatgagtgaaatatatgatagaagagacttctataaaccgatagctactccatttgatgtcgaaactgctctanacgtagacttagaaacaaatcccgaatggattcacaaattttcttatgatttcaccgattatctagacatttgtggggatatatcgactacttataagcaactga

SEQ ID NO: 3607 - DNA, 874 bp, Diabrotica virgifera
tccagctgcatcaactaaaagatcatgtggtttgcacgagcatcattcgcaatcgccttattgacatgtgtttttgccgaagaacttaaacataatagtgacagaagtgattataaaaggtcgttcgctaaagactgtgataatacgttttcgctaacatgtttaaagttgaatatcgtcggttgggttgacaaacttaacgaaaatgaaaacttaagtgtgttccctggtgtttcgatagtgcgtgaaaatgctagtgcagcgggtaataacgcggaggtagtggcggatctcgctcgggaatttcccaacgatcctgataagaggctggatgcttttttactaaacaaggtccaagggttcctcaacagccactctatcaaagttaacttcggcggagaggagcctgaagacgaaaatgctgtcgtcggccgtaagaagaaaggaaggagaggaggtggaatgggaatgatgttcgctgcagctgccatgatgaaaagtaccctgttcgccattggtatgggagccctagccgcccttgccggtaaggctttgatgacaagtttaatcgccttgatgttatctgctatcattggtcttaaatctttgtctggaggagattccaaaaccacgtatgaggtagtttccaaaccagtgtacactcattctagttcgcattcgtctggacatgaggactaccaccatgggtctgggggatatggtaggagttttgatgtgatgccattaccactcggtttgcagccaggatacaaaccagcttaggatttttcaatttatttattgttatttattttgacttaataaattatttatttatttttttcaaaaaaaaaagactagttctagatcgcga

SEQ ID NO: 3608 - DNA, 1329 bp, Diabrotica virgifera
agagattgaacgagtcactgatcacgagtgtatgcagatttagaaacaccaaatcttaatcaatttttgtcttacagaaaaaaaaacatacaagatattcagaaaagcaatgctgacttttttgttttttgagatttttggtatctctaacaatttttaagttatttcgaaaaaaccatttttttttcaaaatcataaattttaagaattttattttaaaaccaaattttattcaaaaataagcactttgaatcggtgaaacttacagttcataatataaacacaacataataagtaaaataatttgtgaagcggtagcgattaatttaatttaagttgctaattaggggttgatcttcctgcttttttttgccaaaacaaaagggaccaactttattttgagcgtaactggcttacatttgattctagaaacttgttataaaaacagaaataaagcttaatcttggtcaaaaattaacatagaaacatttaccaaagcttaaaatgttcgttttgagttgttctataacttagattagttagatttttaaattgtatctcttaattttgtttaaatctattataaatcggttaagttgcgaataattcgcaacttagtagtgacatctttaatacttaattgttatatcttttttatttaaaaaaataaataaataaaatataaattaattttgcaattttatttaaagataaaaaattacagagggatttagaaagttaatcgcagctaagaaagccgagttttacttcaaaaagtctattctattttgccattgtttttcacgaaatttgttataacttaggttctaacaatcggaataaaatttagcaaacaccattttgttgattttttcaaaataaacaattttcacgttaataaaattactaacagtttaggatgttcaataatttaaacaattaaactgttaatgacgaattgtgtgacgtattttcagcaggatcatctaaaaaatctacacaccaaaaaacatacaaaacgtcaagacacagaggggacataaaagtacatacccgacccccctgccgtggctcccagactaatattgaacgccgctgttttctaaattgttgcaatagttatttattaaagacagttatttttggatttggggtaaatagatataggagcggataattacttgcatcatctgccaaacctcattgttttatgaatctagatttaaatttgtttttgagaatataatagtgtcaaaaagttggtatttttttattttcagcaatatgtactgtaatcacattctaatttatttaggagggtcttgaatt

SEQ ID NO: 3609 - DNA, 1217 bp, Diabrotica virgifera
cctttacgcgtccgcatctgtcaatatcagttgattaatttgcggcgaggttgctataaaacttatgttttaaaaaatgtcgattttagcaagtccactgtctgtagccggctccagaacaacgggagcttcggttcgcactcaaaatgttatggcagcctctactatcgcaaatgttgtaaagagttcattgggaccagttggtctagataaaatgttggttgatgacattggagatgtgacagtaactaatgacggagctaccattttacgtcttttagaagttgaacatcctgccgccagagtattagtagaattggctcagttacaggatgaagaagtaggagatggtacaacttcagttgttatcatagctgcagaattactaaagaatgctgatgaactcgtgaaacaaaagatacatccaacttcaattataagtggatacagattagcatgcaaagaggcttgtaggtacattcaggatcatttgactattccagtcgaagaattgggaaaggagtgcatcataaatgttgccaaaacctcgatgagctcaaaaattattggagctgatgctgatcttttttcacaaatcgttgtcgatgccgccaatgctgttaaagtgacagattcaagaggaaatagcatgtatcccataaaggctgtcaatgtcttgaaagcacatggtaaaagcgccagagagagcttccttgtaccaggttatgcattaaactgcaccgttgccagccaagcgatgcccaaaaaaattgttaacgccaaaatcgcatgtttagatttttcattgcagaaggctaaaatgaagatgggtgttcaggttttgattactgatccaaatcaactggaagcaatccgcacaagagagctcgacatcaccaaagaacgcatccagaaaatcctctctaccggtgttaatgttattcttgcgagtggtggtatcgatgatctttgcctaaaatacttcgttgaaaatggagcgatgggtgtaagaagagtaaagaaagctgacttaaaacgcattgccaaagcaactggtgccactttcctaacttctcttagtaacatggagggagatgaaagttttgattctagcatggtaggagaggcagcggaagttgttcaagaaagaatttctgacgatgaattgataattattaaaggaccaaatatataaaataatttttatatttagataa

SEQ ID NO: 3610 - DNA, 909 bp, Diabrotica virgifera
cctcgcgatctagaactagttttttttccctcgcgtccgccgacgtttaaagaagtgtgtgcttctggttcagcgctggtcaattatccaatactgaattgattacctcgaccagaaatattttaaaatggcatctgttgagaaagctaatcctgaaaagcccggacaggaatctgccccaatccatcacattaggattacattgacttctcgcaatgtccgctcattggagaaagtatgttcagacctaattgatgctgccaagaggcaaaaacttaaagtgaagggaccagtacgtatgccaaccaagatcttaagaattaccactcgtaagacaccttgtggagaaggttccaaaacttgggatagattccagatgagaattcacaagagagttattgacttacattccccatctgaaattgtcaaacaaatcacttccatcaacattgaacctggtgtagaagttgaagttaccatcgcagatgcttaaatatatttttctaagatacaaaatgttacttcgtaagtaataaaatgtgttcttaacaaaaaaaaaaaaaaaggaaaaaaagcaaaaaaaaaaaaaaaaaaaaaaaaaaaaaaaaaaaaaaaaaaaaaaaaaaaaaaaaaaaaaaaaaaaaaaaaaaaaaaaaaaagaaaaaaataaaaaaaaaaaaaaagatgggggggccccttaaaagaaccaaattttttttaagggggttggcaacgttatattctttttatggggtcccaaaaattcaatacaggggccgcctttttaaaaccccgggatgggaaaaccccgggggttccccatttaaaccgcttgggaaaaattccccttttcccaagttggggaaatacgaaaaaggcccgccccatgcccctttcccaaaatttgcc

SEQ ID NO: 3611 - DNA, 1110 bp, Diabrotica virgifera
gatctttgagatattcctttattcctaattttttaaatattcattgttgattttgagtactaagcattcgtcaaaagttcgattaggactgtaaaatcaggaattacgtccatattctgaattcgcatggttggttgattagtcactactaaatttatataaataaatgtgtgatcacatcaaaactgaaaaacaataaaaattatcaattattggtattttatgaataatcacacagtaatatgtgtaatcgctttcataacagcaattgtccttaaagatggtcagcttgtcacgaagttttaatacaaattctggaggtgcaacattttttagcgaatctgtaaatatggatgacagacaacatcttcagcctatattggactcttatgggggtttcaaaccactgaaaactgtttccttgtttagtgttcacttgttagttatatttatcttggatctactagctattggttatgctgtaaagcatcctgatgaaaaaagcagatgccgggaatactttgttgttatttacttacatataggactgtggttcgcaacgcttattgttgatcaagttgccaaatgtcagcatcatggtttaagattgaatggttatttagatttttaccatcaaacgaaacttcatattagtttacccttttatatagtaagtttatggagtgttgctctaatgtttgtacaagcattgatgcaacatttttacccagacgattttgcagagaggtgcgttaaaggaggaagtctgtcacctatgtcttatttatgtgccattattacactggagacttgcctcatatttggtgttaacgttaactatattgcgaaagtgattaaattcaacaaacataaacctctgcctgatgttcaaaaagaagactggattagtacgactgcacctgacactgtgaccccaaatgaagtaggttatagccagttgggaggcaaaatttatgacttattggagaaacaggccgatttaatccgattcctcaaggaaaacaatgaactattagcgaaaaaaacatggttttgacagctcaatacaacaattacgggctcaaagagagattaaaattttttggaaaa

SEQ ID NO: 3612 - DNA, 313 bp, Diabrotica virgifera
ctttttacctggtttcgcgagaaaaggtattagaagcaaacgatcagtagacgatgaggaagaaaatgattctgaaagaactaagagaaacattggatttttaccaggttttgctagaaaaggaatcagaagttaagctgaatgatctttgatttcaaaatgtactaactgttaatatgcaatttcaaaaaataccaaaaaattttcacatgtaaatgtatttatttctagattagggatttgtgtataattttttagataataaatcttttgtaatatagttacaagctggggtcttattggtgtaaggtac

SEQ ID NO: 3613 - DNA, 1597 bp, Diabrotica virgifera
cttcctctgtgtcttctaactctgcgaatcgtctgcttcttatgcctttacttactgaagccgatgctggactacctggtggtgagagaatatcaaaacgatctctcttcactgaagctgatcctgctctgcctggtttcgagcgaatctctaagaggtctttgttaactgaagcagagtctgcgttacctggtggtgagcgaatctccaaaagatctttgttcagcgaagcagatcctgctttacctagttctgagcgaatttccaagaggtctctgttaaccgaagctgagcctggtttacctggtggtgagcatatatccaaaaggtctctatttagagaagctgattatggtttgattggtagcgagaaaatatcaaagaggtcgacagatgaaggtgttgaaagaatttccaaacgggcagtggaagaagaccaagaagcagctgaacaattctggttaccgaaatttgccagaaaaaatttggaaagagctagaaggtctgacgatagtttagaagcagctgaatctacattcgcctttcgtcccaactttgccaggcgagaattcagaagaatcaagagaaatattggatttttacctggttttgccagaaaaggtattagaggtataagatcagcagagttagaagacacagaacaagaaaacaatgaaagaagcaaaagaaatattggcttcctacctggatttgcaagaaaaggtatacgaagcagacgatcagctgaattagatgacgcagtagaagaaaacaatgaaagaagtaaaagaaatattggtttcctgcctggttttgcaagaaaaggtataagaagcagacgatcagcagagttagaagacacagaggaagaaaataatgaaagaagcaaaagaaatattggcttcctacctggttttgctagaaaagggatacgaagcagacgatcagctgagctagatgacgcagaagaagaaaacaatgaaagaagcaaaagaaatattggctttttacctggtttcgcaagaaaaggtatcagaaatagacgttcagttgagatagaagacgatgaagaagaaaacaatgaaagaagtaaaagaaatattggcttcctacctggatttgcaagaaaaggtataaggagtagacgatcagctgaattagaacaaccagaagaaaataacgaaagagcaaagagaaacattggtttcttgcctggctttgcaaggaaaggtatcagaagcagacgttccatatacttagaagatacagaagatgaagaatctggtaacagagaaaggagaaatatcggctttttacctggtttcgcgagaaaaggtattagaagcaaacgatcagtagatgatgaagaagaaaaggattctgaaagaactaagagaaatatttggatttttaccaggtttttgctagaaaaagaaatcagaagttaagcctaaacgattttttgatttcaaaatgtactacctggtaatatgcaatttcaaaaaataccaaaaaattttcccaggtatttgaatttattttctagaaaagatttgtgattaattttttaaaaataaaatcttttgtaaattgtctt

SEQ ID NO: 3614 - DNA, 1484 bp, Diabrotica virgifera
cattacgcgtccgagtgttcatacaatcaacttgttatagaagtcagtgaaaaagtgcaatgaaattattcgtcctcgccctagtggcaggtgcggcaacactatccttatgtaaccccttcgaggggttagaagaggatagatggagacgatccctgctgacagacgccgataccagcctcaccggaggcgaaaagatatccaaaaggtctttacttactgaagccgatgctggactacctggtggtgagagaatatccaaacgatctctcttcactgaagctgatcctgctctgcctggtttcgagcgaatctctaagaggtctttgttaactgaagcagagtctgcgttacctggtggtgagcgaatctccaaaagatctttgttcagagaagcagatcctgctttacctagttttgagcgaatttccaagaggtctctgttaaccgaagctgagcctggtttacctggtggtgagcatatatccaaaaggtctctatttagagaagctgattatggtttgattggtagcgagaaaatatcaaagaggtcgacagatgaaggcgttgaaagaatttccaaacgggcagtggaagaagaccaagaagcagctgaacaattctggttaccgaaatttgccagaaaaaatttggaaagagctagaaggtctgacgatagtttagaagcagctgaatctacattcgcctttcgtcccaactttgccaggcgagaattcagaagaatcaagagaaatattggatttttaccaggttttgccagaaaaggtattagaagtagaagatcagcagagttagaagacacagaacaagaaaacaatgaaagaagcaaaagaaatattggcttcctacctggatttgcaagaaaaggtatacgaagcagacgatcagctgaattagatgacgcagaagaagaaaacaatgaaagaagtaaaagaaatattggtttcctacctggttttgcaagaaaaggtataagaagcagacgatcagcagagttagaagacacagaggaagaaaataatgaaagaagcaaaagaaatattggcttcctacctggttttgctagaaaagggatacgaagcagacgatcagctgagctagatgacgcagaagaagaaaacaatgaaagaagcaaaagaaatattggctttttacctggtttcgcaagaaaaggtatcagaagtagacgttcagttgagatagaagacgatgaagaaaaaaacatgaaagaagtaaacgaatttttggcttcctaccggatttgcaaaaaaggtttaagggataaaaaatcagctgaaaatatttttaaggcggggttgcggacgtctaagttcttttatataggtccccaaaattaaattacttgggccgccttttttcaacctcctccgtggggaaaacccctggtggctgcccaaactttattctccttgtcagtccattccccccttttccccaggtgg

SEQ ID NO: 3615 - DNA, 1526 bp, Diabrotica virgifera
atcctctccataactgttttatgtactataatttttaagttttttacagtctttgtacaaatcagcagtcagataaatcgaaacaaacaacaatcaataaatagccgtgtcttaatgagtattaaaatttttcacaacactaatgttcctttgtaggaaagagtttatcgaagagaccgaacgcataacactcactgtaccactgaccagcagatagtcttaagtccctaaaaatatttttgaattcgtccaaatcacaatccaaatcgcaaccagcaacgttgatgggtattggtgtctgctcaactgatggcttgtagaaagtgttcacataatacggtccgttggttttgcttttctttaattcgaagaaaatactacttgcaaaccctggttgagctatttctgggtatttgaaagactgtaggaagcagatgagattgaggtcgtggagactgaatattagggttttggcttcctttttgccgctaataatgctgtcgaaattttcgatgatgtggttcatcagagaccccagtccaagcttttgcatctctttggtgtagcagaaaaactctgcagcagttttacttacttgctgcatggtatctcccataacgttattcgcccactctggcaattccagattggcgtcttgttcaatttttagagtatccaatacaccagatgctctaaacaatcctccaaccggaagctttgtatggttagataagtattggtacagatccttatttttttcatttatgtccacgatatctggatctgagagttctgatctcttgtataaatagtcaaactttaaacatgtgataatttggttggctacagctgtttctttttttatcggtatttctatccctccgtataaacctgacataaatgattttgctgagttttcggttctagacatatgggttgacattactattatttcatctgggttataagcgtttccaaggaaatccttgtagcggtctttaaattgttggcctagattgtagagttgctgtgatcctttctctgtgaggtctccttccttgaggccattccaatattttggatcttggtagggatcgtttggataaaagaaagctggagttctgtctccatgtctaaatatttctacaactgataccaactcatcctctgccttacacctacaccacaaatacaccaacggcactaccaaactcaaccaagtcgtcattctgatagtaaagacctgtgctaatagaaaattaacgcaggtcacaagcgattttacccgttttttaaaacccatttttgttaatgactgtgtgattgactatcatcaaacaatactttgaatcaattagtaaaatttaaaaattaacgtaaatttatatcgtagttgaaatacatttagtaaaaaatgtttttcgttagttttattagaaatattgacatttttaaagacctgtagttacacattcaatgaatcaaattagattagggaacaatacacttttttccggacgcgtggg

SEQ ID NO: 3616 - DNA, 2216 bp, Diabrotica virgifera
  misc_feature (1883)..(1883): n is a, c, g, or t
ttcccattcctcaattcctcatgctagtcggaaattggaggccgcagcatgctgctagcagttaaaactaaaacagtacagagttatcttatctacacacagtgaagcatattataaaacagtgtatgaaaatgtgaatacgaagagatatttaaagaagagaactgtgtcattaatatcgcagtcatcgcagtgtatttttaaatatggcgcagaatgagtttccccttcattcagccacaaaaattgggcagctgaaaaaagtaaaacagttgattgaaggaggagcaataatcaatgaagtggattctaatggttttacgtcactacatatagctgcaaatgccaaagccagacatataaaagtagtcaaatacttattggcacagggtgcagatgtaaatgcaatcgaaacttctgagggaaggagcgctttacattttgctacgcgcaagaatgatcttgaaatggttcgattattcacagaagctggagcaaatatacagtgttcaaatatctacggacatatgcctattcatgttgctgctgaagtaggatacgtagaaattgtgaaacattttttagaacgtgggatagatgtagatattctaaatgaaagcagtaaaatgacgcctcttcatatggctgcatgtggtggttacatcgaagtagtagactatttactgttaaataatgctaacgttcgtctcaaagattgtcagaaacgaggttcgattcatcatggtgttttaggagggaatgcaaaaattgttcatggccttatagaaaaaggagttaatataaatgctaaagatatcttcaagatgactcctttagatttagcgtgtagagatgggaatttagaaattgtccagttacttttagaaaccggtgcagtgtttaacctacaggagagatgccggaattattctccactccattgggcatctgaaacgtgtagtctagatgttgtaaagtattttatcagcttaggggtagacgcgaatttcggtacaattcaagaatttactcttctccatgtagctgttaaatgggatcacattacaatggttaaatatttggttgaaattggtgctgatgttaacaagaaaactatacccaagggagctactccactatattatgcgataaaaaatatatacacagatgttgcagagttcttaattctaaatggagctgatctaaaagaagctgaatataaaggcaaatctactttatcgatagccttaaaagatgtgtcaagtgattatccagagtcagaccagacagagtatatggtacttgcaaaactaataatcaaatacaccgtgttaatttacagtcccattgaaacatttattccgaaaggttgtcctttcttcaaagaattatcgcaatactataacgactgccaaaaagaaataacaagtatgagcggtgtgacaataaaaaatagtactgtttcattacataaaataatttgcggctccaataaaggcaacgcgtttgttcaatatctatgtaacgacaatattaaaaacgagttggaaaatattgaagattaccttaaagactttttgatatatggtaatattcttccgttggtacaacttagggttaagaaagggtttcaaagaatggcattacttacagatgctgacttaataatgaaaaaagtttcacctaagttaccatcagaaataagatggagagtattcgactacttagacatgactgatcttaaaactgtgatacaatcagattttatttaaataaaaattattatttgtttgtttgtttttaaaaacgttatgatttgaggggagggtggtagagaaataccgcgctcggggaatagattacaggatcaacccatacgtaanagtaaaatttctccctaccagttcaggttcagcgatgctgttggtacgagagaggctttgttcttaatacaagtcttattccagagatgcagaaacgtcaattgcgacgtatacccatgtatggttgattacaagaaagcgttttatagaatacagcccgccaagatgatgcaaaaaccaaaaaaaagcaggaattttcaaatccaagatctggaaaaaaataaaataccctttacccgcaattcccaaaagggaaaaccccccgaaaatagggaaaaatctgggggggaaaaaaaaaaagggttatattttttttttcctttttaatttttc

SEQ ID NO: 3617 - DNA, 1746 bp, Diabrotica virgifera
  misc_feature (1703)..(1703): n is a, c, g, or t
cggacgcgtgggattttttgctacgaacaatcatataagtgtacacaacaaaattttaagtatataactttgttcgagcctaaggcctcatgtaatctttacaattttatactgtagtagataaaactgagataattgacgtactaatcaaaataagctcaaaatttaatcaaataatactctgtgtgttagcatctaagtagaaaataaataaatatttaagaaaatatgtcgtaaagtgttatatctatgggatgttgtcaagggattccttaaagaagaaaactgaaaatttttaaggtatttttgtggtaatttgaggtcagtatccttgttcaaaaggtgaaagagatatttatttaaaagatatctaatataatttcggtttaatttaaaaatattcaaaaagattacattcattcaccggtatatactttttttaattgccatgttaccagactccagtacaagcctaagaagatatcgattgaattctggcagggaatggtggggaaaatcttttttagacatctaatgtcatggagcaagacaccctgacatcatttgaccgagcatgacacttttgatatgacacatgattggtaagaccacttaatgaagacctcctgctccttcttattcatcacccctgagatcaaacagtgtacctctctcaattctttctctcctctcatcaccatatttgccatgtccctttcatccggcctgaaacccatttgcccaaatatagaagaaataaagaaaaagaggttaacagaaagcccaagaagcctagacaatacaaaagaacgtatgtataacaaataacaactgttcaaaaatagaaaatatttttcatccgaggaaaggatgtacagaatgacatttggccctcaaagagatgaagtgacaggccgtaaagctgaattggtaactctgtatggtactcaaaacatcgtcagacatataaaagctaaccggataaaatgggcaggtcatgtggtaaggtcagaggaagatagtgttaaagacagtattttttgagaaaccagacagtagaagatcagtaggccgtatcagaaaaagaggggaaggatgatgttttagccgatttatctaggattggggtacaacgatggcaaatggaagcgcaagatcgtagaagatggaaggctatagtggatgtggtgaagagtcaccccgagttgtaaagccagttaagaagaagaagaaagcgatgtacacaaataggggtggggtggaataaatattaaagaaaaagcacaatctcgtttataagaatgctaggatggtgtctatggcttatagaagtggataaaataattttaaagcaaaaatattactttagtgatggtgtaaatttttatttacacttcgatggcttggtcacgttagacgtagaaatggaaactatgtgggttgaaggacagtgctattagaacttgatggaaggagaggtagagcaaaactgagaagatggaaggactgtgtgacaagggacttgggagagaaagatttaggtaaaggaggcaggacagacagaaatgagagtaatgaacagcaacccccgaaaagggaaaacctgagtaagaggaagaaggtgtaattttttatttaaaaagaatgatttagaagatatctgaattaaccttaaagagttttggatttgatatatgattaangggacgtgccgtcaaaagtaactataaaattatcagttttctt

SEQ ID NO: 3618 - DNA, 1175 bp, Diabrotica virgifera
attttcgactacatttttgacaagatatttacaagatgaagaacttgctggtcttttgagagaccattcctatattattggttgggacgttgaaaatagcaattatcacacagcgctttgtggagcattagaagatgctaacttcgattatctaatcggattagttcagtctcaagcatgctctgcggttattattcagaatataaacggctccctcaggactatttcatttttaaggagaataaatgatgtggattcgagccgggactcagttttattgtatctacaaaattgtcgcgactatttaattgtcgatcgcatgttagcaaatggattagataattcttcacagagcaacgaaatgacttcggaagcttttcaaaaaattatggcagacagactaggcgatagagactacgatagtttcgcttttgaccaacatgatctgttgaagaagaaaattggttatgcattatttggtcaaccagttcaagaaataggaaatggatatgacgaagctcaaaattcgcaaattgaacatttattcaaggctattttaaaacacaataatttatatgccgaataccaagatcaggttgaactagcttttatctacgtcgtcttagagccaactgataaacaagcaacagaccgtagaaaacaagacccaaactataatccacgtactgatatatctcctattccgatatttgttttaagaaagtgtcgagtagaaagaggtgaagcttgcagaatttttatagatcacggtggcagagtgtattcggattggcaagattttttaaaaaataacaaattacctgaaagtgtaatggtgttaccattaaatggaagataccaagtagaggatgacagggtattactcgaaagacacgaaactcccagctgtggggtactaaacacagttctaagagttggtgatataagcagtgcggttgctggtcttggatctggtactcttatgtttgcaggtgctgtaacaagtgtcattggtgctccccttctgatgggtgcagctgccgtaggagctacagctggtgtttatagcattactagaagtgcttttggtttggccgataaatatacccatgacgagggtttggagtatttccaactcagaagcgcgaggaatatatattaatattctggctgga

SEQ ID NO: 3619 - DNA, 918 bp, Diabrotica virgifera
  misc_feature (890)..(890): n is a, c, g, or t
tcccggaattcccagggtccccctattacgtccgcaaaaaagttgacgtcacttaggtgacaccacaccagttgatacaaactcgcctattgctattcatttgtttaaataagtaaaacaaaccaaagcaggtattccaccggtgtcttgtcttacctgttggttccaccacatagtttcattaacatacgagaagttcgttggtgttttgtattctataaatttttcaaccggtaaaatgattagcaatattagaaacataactaacgactttctgcataatgaaaggaatatttttggtgaggtgggctgtgtgcaaaatgaaagtgaaggtgtaatgattcagaccattgagtcgaaaacagttgaaactgttaatacagatgttatccaaagagaagaatcgatgttatcaaacgactgcttggaaacctcagaaataaatataaccatagatgaaaggactgattactcaggagaaacaccaaagagatttactacaaaatgttatttaacaccaaagactgttccctattggtacaacgaaaatctacttctgttcctaaattccacgaagagagtatatgaagagagaatatattgtaaggaaaaattcttcccacgtaaatggtcagaaaggatgtggacggaagtaatgtataaagaacggcccacgcattttgtttcatccgtggatattcctgtaccggatatttatatacctttaggaaaagttgctgcatgagctctatagataccaaagagtaatggacttccttacattccttagtgtacaacagttaccagtatataaatagccatattaaatttgatataatagttttttgtcatttcttactttatatgtatatttcagaattataaaatanaacccaaaaaaaaaaaaaaaagggccgc

SEQ ID NO: 3620 - DNA, 1201 bp, Diabrotica virgifera
attcaaatcgtttaaagattctcttgaaaatcctgagataccaattactgattattcaaaaatggattttcctacgcagcttcatctagcttttaccaccttacataagtttgtagaaaagtctgcaaggctacctaaaccatggaacaatgaagatgcaacagaatttgttaatttagctaaatcgttagctgcaaagggtgattctgaaggagaagttaatgtagacctcttagacacatttgccaaggtatcggctggagatttaaatcctataaatgctactattggtggtattgtagcccaagaagtaatgaaggcatgttctggaaaattccatcccattttccaatggttctactatgatgccatagaatgcctaccacaagataaatcagaaatcactgaagaactagctgcacccactggtagcagatatgatggccaagttgctgtttttggaaaagaattccaaaagaagttagcatcactgaaatattttattgttggtgctggagctattggttgtgaattgttgaagaactttgctatgatgggtgtaggaacacaaggagaagttacagtaactgatatggatttaattgaaaaatctaatttgaacaggcagttccttttcagaccacataacgtccaacaaccaaaatctgccacagctgcaaaggtcattaaaaagatgaatcctgatatcaatgttgttgcacatgaaaatcgtgttggacctgaaactgaaagtgtctacaatgacgatttctttgaaaagcttgatggagttgctaatgcactggataacgtagatgctagaatttatatggatagaagatgtgtctactaccgcaagcctcttctatagtctggaaccctaggaactaagggaaatactcaagtggtggcacctttcctctctgaatcatacagctcttctcaagatcctccagagaaaagcattccaatctgtactttaaagaatttccctaatgctatcgaacatactctacaatgcgcaagagatatgtttgaaggattgtttaaaacaaaatgccgaaaatgcttcgctgtacataacagaccctgatttcctcgataggactgttaagctacctggcgtacaacctttataggtattggaatctgtagaggctgccttaattgatgatagacctagagatttatatgattgcat

SEQ ID NO: 3621 - DNA, 1128 bp, Diabrotica virgifera
taatcgataaccaggagttgatctatataagcccagaatatgtaattttgaccagcggacgcgtgcatttcgaatatgaatatcagacttttgacactcctcctagttaccgtaggttcctcctatggaggcctcctcttcggaaaaaacagcatcttgcagaaagtaggcgacgccgtcggtattggcaatctcgtaagcgttagcgctgacgctgaagctaaccttcttggaaacaaagtaggtgttgacggagctgtaggcgttggttcagaaggtattggtgctcacctcgcaggagatgctgatgttttgggacagaaggttaatgtccatggtgatattctcgatggacacgctatcgaccaacaccaacacgaagtttacagagacagcagaggccgtcaatacacccttcaacgtcaatacatcggctccaactcggtcttggtcagaaaatacctagacgacggacagatctacgtcgaaggcaaagacgacgacaacgagatccaacacagacaatcagacgcaggtaactactgggatgacagaactggacaagttgtactcatcgatccctctaaactcgcacaaaacaacaacatcaatgttggtggacaaaatcttgtctgggacccagccagcaatggttacatcgtcatcggtggcaacagtaacgtcgtctatgatagagacagcaacggacagctcgtaattagacaaccaagcaacaaccaggttgtttacgaaagagatgctaatggcaatattgtcgtcagacaaatttctagcggaaatcccggaaatattatcatcagagatgacggagctcccgcgtcaagtgctcaagaccaacagtacctacagtggctgttacaacaacaacaacaacaacaacaacaacaacaacaacaacaacaacaatattatccacaacaacaacagcaactacagcagcaatggaccatccaacgtgttgcaaaataatgaaacaatctagtcaatttgttgtaatattttaatttttttctttgtttaaataaaaaattttttttttattaaaaaaaaaaaaaaaaaaaaaaaaaagggggaaaaaaaaaaatttttgggggggggggggggggc

SEQ ID NO: 3622 - DNA, 457 bp, Diabrotica virgifera
  misc_feature (427)..(427): n is a, c, g, or t
ctagtctcgagtttttttttttttttgagttttttttagttctagcgcaaaccttaggacgacattttggcaattattgctataaatttattatataaaatgaagtatttatctgttctatctattttttgctttgtgggaatagcgtttgctgctatttctttctccaaggaaaatggtctaggaagcatatcggattgcctgttttgtacaggtgttggaaatcaagttagattgctgcaaaaacacaatctttcaatcgaagaaataagagacgttatattccaagaatgtactttgcccacggattggattttcttcgttagctgcgaagcctatataggcgagatcataaacggagtatttaattcaaccaatttggaagtacatgaagcatgccagaatatttaatactgttggtaaacantatattgtaatgttttaaagaatttaatat

SEQ ID NO: 3623 - DNA, 946 bp, Diabrotica virgifera
  misc_feature (823)..(823): n is a, c, g, or t
ttctagatcgcgagcggccgcccttttttttttttttttggtgaagaaggttcaggaagaagcatcgtgtatcggcaacgtcagtgcgcgtatgttttcatacgaccaatacacgttgtgcggtaaacaaggcttggattggatgcgagtcgatccgttcggtattttttgtttgttatgattgtgttttgtgataattagaaaaaacggtaaacctgtgttagtgtcaccaaacaaactgtaccggagcagttagtggatatttttctggattagggattgtcagcaaggcatgaacatatccaagaaaaagacgacaacacaatcattatcagcaatactaatgcacacatatcaggaatatccatactgtgataatccacagaatcttatctgattagacctgtgttattttatcaaaagatgtttacactcaactacagataaagctcactcggaatacagtgtcatctagtcaacgttagtgtcgcgtagttttagtaatttatcgataaaatgggaatgttgtacaggaagagatctctgcttctgaaattagcagttatagtaacgaccgcatggttcacgatagcctttttactctacacagacaatagctcgcctcaatctgacgtggtggcgctccctctagatggcgaacatatcagaaaaaacgaagtagcgcccgaaagagtgattccgttccaagaatcgcgaaggacttcgtccaaaagtgtaaataaaaacaataataataataatgactatggtggtgtgctagtgccgcctgataacgtggcaggagagatggggaaaccagttngtttgcctacgaatttatcagcggatataaaaaaattagtggacgagggctggatgaaaacgccttcaccagtatgccagtgacctgattatgtacataaaagtttgcctgaccctagggatg

SEQ ID NO: 3624 - DNA, 1613 bp, Diabrotica virgifera
  misc_feature (1499)..(1499): n is a, c, g, or t
  misc_feature (1580)..(1580): n is a, c, g, or t
  misc_feature (1593)..(1593): n is a, c, g, or t
ataactgatatagaaattaaaattactgtgtagttggtgaaaatgataaagatcgtgtcaaaaagagcatgaacatatccaagaaaaagacgacaacacaatcattatcagcaatactaatgcacacatatcaggaatatccatactgtgataatccacagaatcttatctgattagacctgtgttattttatcaaaagatgtttacactcaactacagataaagctcactcggaatacagtgtcatctagtcaacattagtgtcgcgtagttttagtaatttatcgataaaatgggaatgttgtacaggaagagatctctgcttctgaaattagcagttatagtaacgaccgcatggttcacgatagcctttttactctacacagacaatagctcgcctcaatccgacgtggtggcgctccctctagatggcgaacatatcagaaaaaacgaagtagcgcccgaaagagtgattccgttccaagaatcgcgaaggacttcgtccaaaagtgtaaataaaaacaataataataataatgactatggtggtgtgctagtgccgcctgataacgtggcaggagagatggggaaaccagttgttttgcctacgaatttatcagcggatataaaaaaattagtggacgagggctggatgaaaaacgccttcaaccagtatgccagtgacctgattagtgtacatagaagtttgcctgaccctagggatgaatggtgtaaagaagatggacgtttcctcgacgtcagcaagcttccctccacatccgttatcatctgtttccacaacgaagcatggtcggtgctacttaggaccgttcatacggtgttggataggtctcctagagatctcattgaagaagttatcctcgtagacgattattcggacatgccgcacaccaaaaagcaattagaggattattggaaagatgaaccgaaggtgaaaattgtaagggcgcaaaagagagagggattaattagggctcgattattaggtgccaaacatgctaatggcaaagtcttgacctacctcgattcgcattgtgaatgtaccgtgggatggttagaaccgcttttggatagaatagcgagagattccacaaccgtagtgtgtcctgttatcgacgtaatcgacgattccacattagagtatcactaccacgatagttctggcgttaacgtcggtggattcgactggaacctacagttcaactggcatgcagttcctgaacacgaaaagaagaggcacaagaacactgccgagcctgtttggagtcctacgatggcaggaggactgtttagtatagataaggaattcttcgagaaacttggtacttatgacgatggatttgatatttggggaggagaaaacttagaaatatcttttaagacttggatgtgtggtggcacactcgaaatcattccatgttcacacgttggacacatttttagaaaaagatctccttacaaatggagaagcggagtanatgtgctacgtagaaattccgtgagactagcagaaagtttggtagatgaatacgccccatattatttatgataggataggnagggagaaagggnagactatgggagatctcagt

SEQ ID NO: 3625 - DNA, 799 bp, Diabrotica virgifera
aaacaaccaaattttgaatcaaccggagggggtttttctactacagcagcttgcctgtaccaggttaattgttagttaaattgtatttagttaaacttttaatttacattttaaatttacttacatacatcatacatcttgagaatataaaaattattataaagtatgctttaaaacagctgaatgttaaatgtatcagccaaattatttattaatataaatagtatttactggtgtcacaaaagctggtaatacttttgtagttgaaatttttgtaacaattttttatattttaaatcatacatcttgagaatataaaaattattataaagtatgctttaaaacagctgaatgttaaatgtatcagccaaattatttattaatataaatagtatttactggtgtcacaaaagctggtaatacttttgtagttgaaatttttgtaacaattttttatattttaaattttaattttttaaccgaaaaatttttggatatgacatttgttttgggcgaaaccattagaaattattaccagcttttgtgacactagtaggtacatagatactatttacttcttaatatacttccataacgttcatttgtttcaaagcatactttatatgttctcaagatgtaggtaaattaaagaagttattaactgatcttactcgtaaatacaatataactaacagttaatttggtacaggggagttgctgcggtggaagattactgcggtgatttgaagttggttgtttgttgatttggaactgatttatgcattcattagatggtaaa

SEQ ID NO: 3626 - DNA, 974 bp, Diabrotica virgifera
cgtgatcgacgttcatttagcttgatagttgtttaaatcattaatttgcagcaattgcttttttttaaaacttatctgcgtaagcgggaatgttgtagttttgtagttgcttgaattcgcagaaaaataacctaaattccttgaattttccagccatggctttaacatttactagatcctttgttggaaaaggactgaagtgtttgtccaagttacaggagacctcttcaaagaagaaattgacatcagttttaatattttctgcccaaatgaggtttatatcaacgattgaagtatcaaaaaatatatctctcattagcaatgaaaagaaaaattgtaaagtgatcaactttgagctgagtgaaccacaagacaagccacttgtggtgttgatatcttggctactggccaagaagaaatattcatataaatatgcagatatatacttaaaacaaggattcgacgtgcttaacatcaatgtcagtccatggcaattcctctggcccaccaaaggaacacagatggtggccaaagacattgtcaaatttctagacgtaaatgcaagttatagccccctgttactacatggcttttcagttgcagcgtacctctggggtgaagctttggtacttatgtctgccgaaaggcaaaaatacgaccacatcataaacagaatcgtaggacaggtctgggacagtgcagccgatgtcacagaaataccagtgggatttcccaaagcagtctttcctaataattccgtattacaaaacacgctcaagcagtacatattatatcatttaaaaacgtttgataaaactgtaactgttcattatgtacgctcaagccagatgttccacaccaacatagtgagagcacctgctctggtggtcgtcagcaaatcagatcccattggcagtgaaaactcgaatagaagagttacagataactggggaaatatggggatgcaggttact

SEQ ID NO: 3627 - DNA, 1381 bp, Diabrotica virgifera
gctacgacctacgactttattttattatttatttataaataaaattacactgacactgactgaattttacacacacacagcacagacaaagacacacacactcacacattaacgattaataattggtcattggtccatgtccatgttcattggtggtaaaacaagtaaacacatcaacaacaaaaatagaagaagtaagaagtcaattttctttagttaaataaaatatagtatgatggtaaaaacatagaaattgctttaccgtatattttaattataattgcaagcttcattttttaacaccatggctttaacatttactagatcctttgttggaaaaggactgaagtgtttgtccaagttacaggagacctcttcaaagaagaaattgacatcagttttaatattttctgcccaaatgaggtttatatcaacgattgaagtatcaaaaaatatatctctcattagcaatgaaaagaaaaattgtaaagtgatcaactttgagctgagtgaaccacaagacaagccacttgtggtgttgatatcttggctactggccaagaagaaatattcatataaatatgcagatatatacttaaaacaaggattcgacgtgcttaacatcaatgtcagtccatggcaattcctctggcccaccaaaggaacacagatggtggccaaagacattgtcaaatttctagacgtaaatgcaagttatagccccctgttactacatggcttttcagttgcagcgtacctctggggtgaagctttggtacttatgtctgccgaaaggcaaaaatacgaccacatcataaacagaatcgtaggacaggtctgggacagtgcagccgatgtcacagaaataccagtgggatttcccaaagcagtctttcctaataattccgtattacaaaacacgctcaagcagtacatattatatcatttaaaaacgtttgataaaactgtaactgttcattatgtacgctcaagccagatgttccacaccaacatagtgagagcacctgctctggtgttcgtcagcaaatcagatcccattggcagtgaaacctcgaatagaagagttacagataactgggaaaatatggggatgcaggttacttttaaaacttgggagaatacaccacacgttggacattatcaggcacaccctaaagaatacttatcggagttgaattctttcttaggatcgctgaatattaaacaaccgtccaaaattgaagagaaggtaaaagcttccgcgaagctttgatgtgatttatatgtatactacatttatataaaatttgtgctggttgatagttaagggatttttttgactcccaagagaaatttataataaaaaaatatacattttttt

SEQ ID NO: 3628 - DNA, 867 bp, Diabrotica virgifera
  misc_feature (728)..(728): n is a, c, g, or t
aatttgtcgaaagattgaagtttgggaacaaatgaaaccttttctttaaaagttgaagtggtttaaatggcttccaagctgtggagtgttcgaacagcccttcagttccttcacagaacatcgaggtccaaagagaatcaagaacaacaacaagacgaagacaacttagctgctaaattattttacctacctaagttaaacgaagtacaggatcccagtgatgaatttatcgattgtggcccttctccacctacagagaacctgcctttgatttgggatacctacgaagttccagaaaacggaaacgaagtcaaaatatgctaccacaccatcgagcaaaacattctggagcatatgagcaacgcttatggaagaataagtcttttagatgaaattagttctaaaagagtagattccaagaacatagtaggtgtgttttttggagcatcccacatagagttaaacatagcctttctttgggcagcgtttgtgaaaagatatgacattttggaaaatttgttataccttggagctgaaattaattattttgagcctgctcaaggtcttagcgctcttcacttagcagctttcagcaactgtattagcggtatgcagtttttaatatccaaaggctgcgatatcaatgctctatataagttttatacacccttacattgtgctgcttttggagatagcattgaggccaccttatttctcattagacatgnagtaaaaatcgatcaattcaccaacacaatttatgaggagaacgaaagtgccctgcattgtgctgtacgagctaattctaataattgtgtaaaaaattcttatttgtcatggtgcaagtgttgattgaagtgagttttc

SEQ ID NO: 3629 - DNA, 859 bp, Diabrotica virgifera
aaaatttccccccggggttccattttatcgcgtccgaaaataacaaactacaaaagccgcttccttcttttcagttttcatgttgataaatgtttttgcattaatgttaaataattaattaagatacaagtaaagagttactaagtaatatacaatatttcatgcatttaaaatgtatcgaactgacaagcaatttatgaaaaacccagctactgcagcatgccgcatttatattggaggtttagcaaaaactgttattgctaatgatctggaagaaaagttcaaaccacacggtactattgccggtttgtctttaaacactggctttgcctttatccaattcgaatcagagaatgaagcacaagcagcaattaaaggagaaaatggaacgatgttgtgtggcagaaaaatcattgtaaaacaagctatggacaagtcaaaaccgaatcaaaatcaacagagacctaaccaaggacctcctcaaagatcgccgattcaaaatgtaccccccaaaacctattccacaaaagacgccaccaccacctccacaaaatttgaagtcagatgaaccagattttgatcaagaatctggagatgactttcctgaggatgacagaccaaatattacaccaccagtcatacaaaggcataatgaagacaaaggttttaacagaggaggcaagagagacggagggaacagagataaatccagagatcaggactacaacagatttggtgacagatttgagccaccacctataatacattcatatagagataacagagacagagatagcgatatgacggatatggacttccagccaactacaagaaatgacccttatatgcatgctcctat

SEQ ID NO: 3630 - DNA, 1211 bp, Diabrotica virgifera
tacacacgcgttctggtcggaccaaaggataacaatggaaaagaaagaatcacaaaattgccgaagaagcataatcaagataaaacggaaagcagaaaatctttcactgcaccattagatgatgacgatgagaatgatggagataatgaagaaagcgatgtcaaaccaacggataacgatagaaaagaaataatcacaaaattaccgaatagccacaatcgagataaaatggaaaacagaaagtcattcactgaaccattagacgaagatgctgaaaatgatgaagataatgaagctaacgatatgcaaaataaaaacaacgaagcagaaactgtaacaaaaccatcccataaaagtaataaacagaagaataacgaagaaaccgatgaagatgagattgtagttcctgtacatccgagaaaaccaaataaaaatcacaagaaaaccactcaaaagaacggctggatggtagatgacaatgaagaaaataaaaaagctgataatagcaaaccaaatattaaatatgttgaagtttgcaataataaaactgcgaaacaaacaaaaaatgcagaggatctatttaaaaataaattagacaaaatggctatgaaagtaatccaaatttctccatcaggatttgtagtacttagcatgttgcttggagtaatggttggtgtgattgctagcaatacgggcaaatcaggagatttaaaaaaacgtatcaacaattgaacgatgcactcgaaaaggttcaacaaaaatattttcctaatgcaaaaaatccattcaaaaagggtggaggtggtaataatgaaaatctacccaaagatgatgtaaaagaagaggtaccaaaagaaaaaaaagatccccaattttcgacacccccaaaacctaagaagaaagattcagtcgaattaaatatccagtctgactgttcggattgcctggatgatctagctaagtttaaaccacgtcctaaaagtaggagaattccagagcaacaatcattattagatgaagaagagccaccattgggttcgactccagctatgagcaaaagaatacctccacagaggattcagcggtctccgagagattctggatctgaatgggatgaaaccttaaaacctacagcatttcctccaagaagagacgcagtttaggaaaatcagataagtctgattcagaaattctgactccaacctatatat

SEQ ID NO: 3631 - DNA, 687 bp, Diabrotica virgifera
ccctttcccgcgtccgcttataaaacttcaataaaatttcttgtcgtatttttagactccaaattaaattgagaaagaacacacaaattacatattacgaagaatggaaaatgcaatgaatatcatgaagactgtaagtgtcagtaactggggagctgatccaaacatatcaatattactatacagaaatttgataagatcaatcttagactatggatctattttttatggctcagcatcaaactctgtactccatgaaatgcagaggatcaaaaataaggcacgtaggttatgcactggttatcttcgtagcacacctatattggtcatggaatgtgagcttaatgaacctccattttcattacgcagggaatacctaagtgagaaatttatagttaaaatagcggttaacgataaactgctattaaataaaattgttcatttaaccacctcatacctaactcattattactgggaaaaaaagaaactgtttttagttgtggaaagcttcctcaacgtttctaattccattggcgacatacaccaaatagaacaaagctcgtctcgaaagctaaattatgaagattatttatctccagttatttaactgtcatttaagtaatattcgtgcgacagacttccttactaaaatagaccaccttcagtgtgtacaaaaaaactggggga

SEQ ID NO: 3632 - DNA, 1013 bp, Diabrotica virgifera
cgtatttcttttttaattgtttggatgatttcttggtatttcttcgcgtccctgttcttcattaatctcctttgatccatcatctgcagaatgttatcagtcatccattctttattttttactcttgttttctttcccagatgttattttcccgcattcagcacgacgtctttgatataactccgtttttgttctacactctactcttgttgtatctcttacgttctgacgaactacggggtcttttagagtgtcataatccaggtacctatatcttactattgaaggttatctccaactactgtcttctatggtgtattcgttaatttttcataaaatacctgctatttggaagtggtttataatatctttattaactgaacgtgcccttgcttttaactttatattctttaatgcataatttacataaactatgcctattaactaattttgtagatatcctgtatatataataatgtgcaatgcgttacaaaaaaaggaattaaagatataatttaaatttgacaacattgcatagctacagtaacgactgcagcgatgccgatgtgagaagttgctatgttgccactgaatcacagtgatccttttcgattcaacattttattactcagtagttatagaattctagtgcacagggtttcgtaattgcatgtatgattccatgtcagagtaagattgcaccagtttgaagatgtaaaaaatcacgactgattcagttttatcgttattcactatttccataatcaatacgcaagaaatacgtttacttctgaaaggtttctatctttgtagtgttgttccactcatcaaaagatatttttatcgtgtaattcaaaggtgtttaaaaaaatcaaagatgcatattttatatatacggcttagtatgaaaacgtcatatctcattttacaggagagacaaaaaacatcatttctgcatactcacaagatactatctgtacgtatttttaattctgagtatgttaaagatcgta

SEQ ID NO: 3633 - DNA, 1807 bp, Diabrotica virgifera
gactttcatctgtgtgatactatgtttaaattttgttagggcagatgatttaatagtacaaacgttaaatttagtaagactttcatctgtgtgatactatgtttaaattttgttagggcagatgatttaatagtacaaacgttaaatggaaaagtacgaggacgaatggaatactccctgaggaaacctggtgttccattttatgcatttcaacaaataccgtacggaaaagctcctgtaggccacttaagattcaaggaaccacaacctgttaactattggtggggtgtattagatgctacaaagaacacgaagacttgctaccaggtgcaaaattttttaggtttggaaaaacttcaaacggaagattgtttgtttcttaatgtatacacacccaaaaaaccagttcatcaaaagaatctacctgtgttggtatggatatatggaggaggatttattactggaagttcaaactttgatatatcaggacctcactatttaatggaaaatgaagtaattgtggtatctataaattatcgtcttggtgcgtttggcttcttggctactgatgatttatccagtccaggaaactatggtcttaaagatcagaggcttgcgctaaaatggatccaaaataacattgaatattttggtggtgatcccaataaggtaaccattatgggaactagtgctggagcagcttcggttacctaccatttcatgaatccaaggtcaaagggtctcttctgggcaggtatagctggaagtggatcgctgttaacaccatgggcgtatcaaaaagactccaaggctattgcatacaaattagcaaaagctattaatccatcattcaacccatatgcgtcaactgctgaattggtagcgtacttaagatctgttcctgctgatgtcttgaacaacgcctctgcgacggctgtttcggagacagttggcaacgaacaaatcgtccaaggatatttctacgcccctgtgattgaaccgaaacacagaaatgctttcattacagaaaatatgtatacagctgttgaacaaggaaaaatgaatcaagttccattgctgatgggtattgaaagtgaagaaggactagctagagctctggatccaaactggacaagcgtacttcctatcctcgacaatgacgttaaacttctcgtcaaccataatatgcgcataagttgtaataaaactctggatgaagttggtcagaaaataagagaaattgttacgaacggattattgcaaaacaatcactcagcagcaattaggtatttcagtgacatgtcatttaacagaccccttattcgtcatggtgaactacaatccaaattcagcgatgtttatttctaccaattttcctatgatggtaaactgggcggaggcggattcaagcactacgtagaaggcgcagatcgggtactacattctgaagacaccaattactttttgacttctggaaataggtccaatttgaacacttacgatcctgaagacattctgactagcgacagatggagactgttacttaccaattttgcaaaatacaggaatccaactccagaagagagcaaaatcttgcaaaatataacctggcccaaagtacaaccaaacaacttcgtctacctgaacctcaataattctttgtctattgtgcaggatcatccaaaaagcaacacttatttcaaatgggtagaattatatgagcagtatgctcgaaaaccgtatattaacttctaggaacatattgtttgttgtaactccttcttaaataaatttttcttgttggttt

SEQ ID NO: 3634 - DNA, 1315 bp, Diabrotica virgifera
gtgagtagtgacgaatttgatgtgccagaaacagaaaaactcattagaatggttccgtgtacgcgaacagtagaaaattcaagtataagaaacctagcaaagaaacgacttccaatattaacatggctcccatcttatgatctagaaacgttttcacaggatcttctggctggatttaccgttggtcttacagaaattccacaaggtatcgcatatgcagtcgttgcaggtcttccttctcaatatggactctacgccggattcatgggttgtttcatgtactttgttatcggtagctgcaaagacatcaatattggacctacggcaattatggcactaatgatacagccctacgtaactgccttgggagttgcaggagggattttgataacattcctgtcgggttgtcttatcttcctatgtggactttttaatttaggttttatagttgaattcttttcatatccagtgatagcaggatttacgacggcagcagctttaaacatagcatcttctcaaataaaatcgcttttgggaattactgggaaatcagatacattcctgactgcttggatatctgtttttgaaaacatcaaacaaacgagactggcagattccttgatgggattattcactattatattcttagtgatggcaaaggaaatcagaagatttggatcattaaaaaggcgatccgattggtcaagaagaagaaatatctttggaatatccatttttatgttttcgttggcaagtaatgcccttgtggtcattttctgcagtttgcttgcctacatatacaagcaaaatggagaaacgcccttcaaacttacaggtgaagtcaaaggcggactgccgtctttcggtttgccaccatttagtactgattttaatggtacacatttttctttcaaagatatgatgaatgaatatggatcactagttgtattttgtccattaattgccgtcctagaacatattgccattgccaaggctttttccaagggtcgatctttagacgccacccaagaaatgttggctctgggaatatgcaacatcatgggctcgttaattcaatcaatgccagtaaccggttcctttacgagaacagcagtaaaccacgcatctggtgcaaagactccaacatgtggaataatcacaggtatcatggtgctactcgctctcggatttttgacctccacttttcaatacattccaaagagtacattagctggtgttataatggtagctatgtactatctgtgtgattttgctgcatttaaactgttgtggaaatcaaaaaaactcgatctca

SEQ ID NO: 3635 - DNA, 1297 bp, Diabrotica virgifera
cagttatttgcgggcatgtttaaatttgtgtcaatattgtgttgtatcaatctgtttgtggtacgtgtatatggtcaagagggttcacaatgctacacatcaagaaaagagtttggttcttgcataaatataaagacttgcaattatatggttcagcttttaattaatcgtaaacaagatccagaaatcttgaactatcttcgaagttcaacatgcggattcataggcaaagatcctcttatatgttgtcctcaaacaaaggaagaggaggaaagtgaagaaaatctcattgttagtaatggcaatcagaatacaaagctaccacttaaacctcaatgtggtctaagcaatgtaacaaatccaagaattgttggaggagttccagcaaaattaaacgagtttccttttatggttattctaggatacagaaataaacttaatccaactattccaaaatggctatgcggaggtactttgataacagaaaagcatgtattgacagctgctcattgtgcttataacagaaatgatttgtatttggtaagagttggggagctaatactttatgatgacatggacagtgcttctcctgaggatatatccatctcaaagataaaaatgcatgaaagtttcagtcctactgaatttaccaatgatattgcaataataacattatcaagcaaaccaaaaaatccattggtttggcctgtttgtctaccagtagaagatccaatgaaatctagttcgtacattggagaaaatggagtcgtagcaggatggggatctttatattttgatggaccaagaagctcatcactgcaagtagctgacatgcctgtattaaaccaaaacagttgccaacgggtatttggtcagaatacagttattgacaatagaataatttgcgctggttggctttctggagcaaaagatacttgtcaaggggactcaggtgggcctttaatggtttgctgtaaaagaacagaagcatttttggtactatcaaattggtatcatatcctacggatttagatgtgccgaaataggctatcctggtgtttttacaagagtaacaaattatttagattggatccaaactaacgttgtgtgatatttatatgctatattttttaatttattcgataacatatatattatgtagtagtttctaattgtaatttttgtacctaatatttttccgtttagattagaataatagttttgcttacattttgtaatctgtttatttgtaataattgcatatttgtattatcgccatatttttgcttgtaacctt

SEQ ID NO: 3636 - DNA, 935 bp, Diabrotica virgifera
gaaagaagcacataaacgagggataaaagttgttttggactatgttcccaatcatacgagtgaccagcatgaatggtttaaaaaatctgaaaatggagagaagccttatgatgaatactatatttggaaagatggaaaaaatggatcaaaaactgaacccccaaataattggcttagtgtttttggacattctgggtggacttggagcgaaaaaagacaacaattttattaccacgcatttcttaaagaacaacctgatttggattatcgcaatccattggtcagacaggaaatgaaagacgttttatcattctggttagatactcataacgtcgatggtgtcaggatggatgcagtcagtaaactagttgaagatgctgcatttcttgatgaacctaagtctaatgcacctggtgtagctgactttatgtacgactatctaactcacacttatacagaaaatcaaccagaaggttacgacgtggtttatgaatggagaagtcatttagaaagtatttctaagaaaaaggaaagttcaagaatatgcatggctgaagatggggcaaatttcacactaacattgccttattatggtactcttaacggatctgtattaggagcccacttccccttcaatttcttctttctgccactaaacaccacttctaacggagggcaaatagcgaatataataaacgaatggttaattagacttccaaagatatatactttgaactgggtgctaggtaaccacgatctgcacagaatagcttcaagagtaggcaaagaaaaggttgacgccttaaatatgctcacagcagttttaccaggcatccaaataacttacaacggtgaggaaattggtatggaagaatggagaagtgacttgtgaaacaggcgatgacctgaaaaagtattgtactctctatccttct

SEQ ID NO: 3637 - DNA, 1293 bp, Diabrotica virgifera
cacagtaaaaaatgtgctaggtatgtacgctcatagtatcatttgaacaagataattatagctgtattacgatttagtttttagaaggtatatgaaattgagaacatgtggaaattaacaattttcttctacctttggatttgctgtttacaatctagtaaggcatatcatttatcgaccgacgatgaatggtggaagacagctacattttatcaaatctatccaaaatcctttaaagattctgatggtaatgggataggtgatctacaaggtgtgatcgaaaagttggattatattaaagatctaggagtcactggcgtttggttgtctcctattttcaaatctccacaagctgataatggatatgatataagtgactacagagatattgatccgcagtttgggactctggaaatatttttggagctattgaaagaagcacataaacgagggataaaagttgttttggactatgttcccaatcatacgagtgaccagcatgaatggtttaaaaaatctgaaaatggagagaagccttatgatgaatactatatttggaaagatggaaaaaatggatcaaaaactgaacccccaaataattggcttagtgtttttggacattctgggtggacttggagcgaaaaaagacaacaattttattaccacgcatttcttaaagaacaacctgatttggattatcgcaatccattggtcagacaggaaatgaaagacgttttatcattctggttagatactcataacgtcgatggtgtcaggatggatgcagtcagtaaactagttgaagatgctgcatttcttgatgaacctaagtctaatgcacctggtgtagctgactttatgtacgactatctaactcacacttatacagaaaatcaaccagaaggttacgacgtggtttatgaatggagaagtcatttagaaagtatttctaagaaaaaggaaagttcaagtaaatgctttttttaaagaaaggaagggctaaaattatggggggggggggagggggggaaattttccccctactttttttttttttatgtttttttctaaggggtttgtttaagggggccccccttccccctctttttttttttttttcccccccccccccccctcttttccggggggggaaaaataaaaaaaaaaaaaaaaaatggtgttttttttcttcttctacaaaaaattatatttttttttttgtgggggggtgtggggggcgccccccccccccccctcccacaacaaaaaatataaccaagaaaaggaagagag

SEQ ID NO: 3638 - DNA, 709 bp, Diabrotica virgifera
  misc_feature (688)..(688): n is a, c, g, or t
  misc_feature (690)..(693): n is a, c, g, or t
  misc_feature (695)..(695): n is a, c, g, or t
  misc_feature (697)..(700): n is a, c, g, or t
tctttttaactccctttttgccccttttgacaaacccgtggctccacctttaacaagtctgatcaacaatggcgcccgtagctaagccaaaagatggaaaagagaaaagagaagttaaagacaaaacaaaaaatagtatgcgagagttacacattcgcaaactctgccttaacatttgtgtaggagaatctggtgacaggcttactagagctgctaaggtattggaacaacttacaggacaacaacctgtattctcaaaagccagatacactgtcaggtcttttggtatccgtcgtaatgaaaaaattgctgtacactgcacagtaaggggagccaaagctgaagaaattttagaaagaggcttaaaagttagagaatatgaattgagacgtgataacttctctgcatctggaaactttggatttggtattcaggaacacatcgatcttggtatcaaatatgatccaagtataggtatttacggtcttgacttttacgtagtattaggaagacccggattcaacgtagcccacaggaggtcaaagactggtaaagttggattctcacacagattgacaaaagaggatgccatgaagtggttccaacagaaatacgacggtataattttagctagtaaaaaataagttgttaagtaaaattgacatcaaaatataaaaattttcacatnannnnanannnncggccttta

SEQ ID NO: 3639 - DNA, 929 bp, Diabrotica virgifera
  misc_feature (900)..(900): n is a, c, g, or t
aaatgtaaacatgtgattatgatgatgtgatgttgttaataaatctacctaattgttgaataaagcgaaactagtgaaacaatggcacagaaaccttcattttccgaccttaagcttaataattggataattaggcaatgcgcaacaataggtgtaaaatcccctactcccattcagtcaaactgtattccacaaattttagaagctcgtgattgtgtgggcgctgcaaagactggtagtggtaaaactttggcttttgctttacccattatacagaaactatgtgaagatccctatggtgtgtatgccttagttctgacaccaactagagagttggcttatcaaatagcagagcagtttgccgttattggaaaacctatgaatttaagacactgtgtagttgtcggaggaattgatatggtagaccaaggtatacaactgtctaaacatccccacatagttgtggctacaccaggccgtttagcagatcatttagaaagttgcaaaacattttcgctttctaaaatcaagttccttgttttggatgaagcagacaggcttcttagtggccagtttgacgagcagatcaaaactatatttaaagaattaccaaaaagtcgccaaaatttatttttttcagcaactatcacagatacgttagagaattaaaggaagtcagcaataaagacatgttctattatgaagctccttccatctcagatgctgttactgttgaacagttagaacaaaagtatgtgttatgtcctaaagatgttaaagatgcttatctagctcaagtgattagggagtttagagccgaaaatgaagatggcaacattatgatttttacagatacttgcaaaaattgccaagtactctcaatgacctttaccgatgtangatttgaaaatgtatctctgcatgcgatg

SEQ ID NO: 3640 - DNA, 865 bp, Diabrotica virgifera
gacttttatagtaattggtgtggcttctgtagaagagcagttccgagagtaaaagcttttggaactgatattaaaggatggaatgacttagttgtactagcagtattagattgtgccaatgaacgaaatgctccagtttgtgaatttttcggaataaccaggtatccaacgttcaggtatattcatgaacattatatggaagggcctgagaacataggactaccagtggtggctgactcccataccaatttttcagagcacagaaaaaatttagtcgatatcttaattaaagaacaaagagaaggtagagctaaaatgttaccaaatttacagccatttaaaagttcagctatatcaaacatatatagtacaaatggaggcaatccagacttagcatttttgattgtacaggaaccaggtgatgatacaggtccttctattataatggattttcatagtgtaaaggaaatagttattagatacactcataataatgaaactaatgtcacaactgaggaactacctgctttatatttaatttataaaagtggtgatttacagcacttgaatatatcttctccaaatcgagaaggaattaaatttaagctgcgtgagcttttattctcaagaaatattgaagttccaccggcagtcttgagaaatattactattacagatgaggttacagaacctgtaaatctaactgaagaatatttggaatttgagaaaaaaataagagcagctggtgatacagttttccaactagatctggaaaatgctcttagatactcattaaaaagagaagttggaggaattcaaaaatctcgggagagaattagatgctttaaaaaatatatgaacgttt

SEQ ID NO: 3641 - DNA, 971 bp, Diabrotica virgifera
ccaaaacaataatgtaccagttcaaaattttagaccagcttcacaaaattctaattcgtataaccaagaaagatattatgtgagggaaccaaatgtgaattatccaaggtttgatagtagtgcaaatagggcaaaccaaaatacgtataatcggggaggtagttatgcaagacctgctggagtaaatactgttgtttcttcagggtcttttctaactggttcagatgatgctagaggatctaaccaaggatctagtgctaatttcaacgtagaagttgatgataatgaattgcgtcaattctcagaagatttgttgaataaagatactgttaataatgctcctcagtatgttactattaattggcaaggacttactacttcaagatctactagagatgaagctcctttaccccttttgtctgtaagtcccgcagcgtattccttgactacaatctcaaaactcttaccgttatatgataactacattttggaagcaaacaaaaatgaagttacttcacagcaagagaaaaacgaagagggagatcttttgaacgccatagttcaaactcctgtgatgcaatatacaaggaattttctcatgagtaaaggaaaaataggaagagatgttcaagaatttaaagacctcttgaatcttatctggtttaatatgtattcaaggcaaggaggaaagcttggctcaagcgcgtttgaacatgtctttttggcagagataaaaaacaaccaagtgtctggattacataactgggtgtacttcaacgaagaagagaacaagaatcatgctaattatttgggttatatgaagaaaatcgatttgggtggtaaagggtatatagttaaattccactttactctcaatggtgtagacaaaccagtaaactccatgtttattggtaacagccctgaactggaaatgggcgtatatcctacctgttttcttctgagacctgaca

SEQ ID NO: 3642 - DNA, 1197 bp, Diabrotica virgifera
tttgatattgataaattaattaattaacggatatcatgatcttgataagttttttaattttaatcagaataacctttgtggcaacctaagatgtctgcaagggcaatcgtaatatttgtttttacaatatttgcaacaaatgctatatgtgctgataactcattcaagcaaaatccttggcagaatgtgaacaattccagttataattataacactcaggacaaaaattttgtcacgccatggccagcactgggtggtcggagaaaccaacagaacaatttgcaaagtactagggctcctcagtgggttcgtccaaataatggaccgaattgggtgagaaatacttcgccaactaactctcagggaagtaaccaaaacaataatgtaccagttcaaaattttagaccagcttcacaaaattctaattcgtataaccaagaaagatattatgtgagggaaccaaatgtgaattatccaaggtttgatagtagtgcaaatagggcaaaccaaaatacgtataatcggggaggtagttatgcaagacctgctggagtaaatactgttgtttcttcagggtcttttctaactggttcagatgatgctagaggatctaaccaaggatctagtgctaattctaacgtagaagttgatgataatgaattgcgtcaattctcagaagatttgttgaataaagatactgttaataatgctgctcagtatgttactattaattggcaaggacttactacttcaagatctactagagatgaagctcctttaccccttttgtctgtaagtcccgcagcgtattccttgactacaatctcaaaactcttaccgttatatgataactacattttggaagcaaacaaaaatgaagttacttcacagcaagagaaaaacgaagagggagatcttttgaacgccatagttcaaactcctgtgatgcaatatacaaggaattttctcatgagtaaaggaaaaatagaaagagatgtcaagaattaagacctctgatctattagctgtttaaaattgtattcaaggcagggaggaaagtttggttcaagcgcgtttgaactaggctttttgggcaaaaaaaaaaaaaacccaaggggcgggtttaccttaattgggggggcctttcaacaaaaaaaaaaaaaaaaaaaactctggtaaattttttttggttttttt

SEQ ID NO: 3643 - DNA, 905 bp, Diabrotica virgifera
ccaaagccaagaatgggccacacatggtcccttaatataagatccagcttcacatttacccagaaaactcccaatatttttcgttcatcataatctagtagtttgctatcatatactgtcctcaccctcaaaactgtcttttaactgcagagatcaaaggtggtctttggaacaatgcaccttttagtttttcaagtgattgtactactttcttaaattcgacagctgaatgtaatttgaacacagagacatactcctttcctgcggcttgttgtgactttactaagcgagttgccctttcaatacaaacaattaaacaaccagtagttttgggatccagagtaccagaatgacctgttttatccacccgtaaaattcttttaatccaagcaacaacttcatggctactgggattactgggcttatctaaattaataaatccggattttacatactctgagatatccctcttcaaaggagaagctccatttggcagtggtacatagtgattagttcttatattcaaacgatcaaagtgcttcaacaaaaggggccaatttgaggcatcaagcttggctgttttttctgaagactcgagcgcaaagtccttttcggtttgtattttgcttatatcgagctgctttgactttttctttttagtttttgtggtatcctccatgctgatgcttacaggaaaaacacgtgttgttatttgaggttatttaccacgttatggtatttcttgcactagtctcttatttaatgttttgttttaatacacactatactatttagttccaacacactttcaactgtagttcataataattactttattaataacacaacaataaataattcaaaaccaatacaccgcatagggggccacaagcatgaagcatgcc

SEQ ID NO: 3644 - DNA, 1080 bp, Diabrotica virgifera
gatttttcaccatctttatccttcttcctcttctttttctttttttctgttactacactttttcagcttcaggtgctggtcaggaaactgattcagcttcttcctcagcatctactttccttttctttttcttcttcttttctgttcttacttcagaatcttcagttgttgtatctaaaacagaattgctgagtttacgtttcttttcttctgagctctcttgggtgtctgtatcttgtttatctttagatgcagaataatcaacataactgttgagccactccttgggtgtgttctcgtttggttttccatgctggtccaattgaccttgagcaataaggattttcttttggctagccctcggccccaaaccccattttctgggatacaagtctctttccataattaccctttttatttttgcagctataccatgactacaactagcaatagttgatgttgtcattaaagctatacctaatgcaatggcttcaccctttgtggttacaattactatttcttcgtttagctcaattccgtcttcatacctcaatataccagggattagaattttagctccgtagcatacagcatttatggagctatctttcatgattattctcttgtgctgtatcagtaaaccttctagtggtttgattactcttctgaggtaggtttcatctttatgattgtcaaaaatccactgggcatctaaaacatcatgtaatgtagctgtttggtccatttctccctgtatgcctgatctaactcttcttaattccaacatctgacctcctacacctgacagcaaaccaagatggacacacatggtcctaatataagatccagcttcacattttacccagaaaactcccatatttctcgtttcatcataatctagtagtttgctatcatatactgtcccctcactcctccaaaaaaggattattcttttgccatgctatatggatttttatgaaaaaacacccgtacgtaataacataaagaaaaaatattgacatggagcgatgtcgaaaatgacctagaaagagaaatttactagaaaatattacacaactt

SEQ ID NO: 3645 - DNA, 512 bp, Diabrotica virgifera
gcacaatcaaataacttacaaaatgttcaaatcgttcgcccttttcttcttcgccgccgtattggccttggctactgctgctccccagccaggacctgcccctaaagcacaaccaaacccctatttggtctctccagttgcttactcagcagtgccagcatactccgcttactcctacgccgcccctgtagcatactcagcatactctgcccccgcagtagtaggatacagcggataccccgcatacggagcctattatgtgtagaatagttttatctagttttataaaccgcctgaattttattatgtgttgaaaataaatattttttgtaataaaaagaatatgaaatgatgatcgctctacacgagccacgtttacagagactacgagcgtgccacggcatagctctgctatgctgcaccgtatttccatcactggacggagactgtaatactgccgactgggagaaccctgtcgttgctgactcaatcttcttgcagcacctccccct

SEQ ID NO: 3646 - DNA, 2462 bp, Diabrotica virgifera
cactcgctggcgttcagaagaaattacaagagtaccgtacgtatcgtcgcaaacataaaccaccacgtgtggaacaaaaagcaaaactggagactaacttcaacaccctccaaaccaagttaagactgtcaaacagacccgcctacatgccaacagaaggaaaaatggtttcggatattgctaacgcctggaaaggccttgaacatgccgaaaaatccttcgaagaatggctcttatctgaaatgatgcgtctagaacgtttggaacatttagcccagaaattcaaacacaaggcagatgcgcacgaagaatggacccgcggaaaagaagaaatgctccagagccaagacttcagacaatgccgtcttaacgaattgaaggcgttgaagaagaagcacgaagctttcgaatctgacttagctgcccatcaagaccgcgttgaacagatcgccgccattgcacaggaattaaatactcttgaataccacgacagcgtgagcgtcaatgcaagatgccagcgtatctgcgaccaatgggacaggctcggagctctaacccaacgtcgtcgccaagctttagatgaagcagaaagaatcttggagaagatcgacatcctccatctcgaattcgccaagcgtgcagctcctttcaacaactggttggacggtactagagaagacttggttgacatcttcattgtacacacggtcgaagaaattcaaggcttgattgatgcccaccatcactttaaggcaacactaggagaggccgacaaagaataccaaagcattgtaggacttgttagagaagtagaatctattgttaagcaacatcaagtacctggtggactagaaaatccctacacgacattgacagctcacgatttgaccagaaaatggggagaagttaggcagttggtgcctcagagagatgccacactccaagccgaacttaggaaacaacagaataatgaaatgctcaggcgtcaattcgccgagaaggctaacggtgttggaccatggatagaacgtcaattggacgctgtaactgctatcggtatgggactccacggtacactagaagatcaattgcatagacttaaggaatacgaacagggtgtatatgcttacaaaccacacattgaggaattggagaagatccatcaagccgtacaagaaagcatgatctttgaaaacagatatactcaatacacaatggaaactctccgtgtcggatgggagcaactcctaacctcaatcaaccgcaatatcaatgaagtcgaaaaccaaattttgacccgtgattctaagggtattacacaagaacagctcaacgaattcagatcttccttcaatcacttcgataagaacagaactggtcgcttgacacccgaagaattcaaatcgtgcctagtctctttgggctattccattggaaaagacagacaaggagacatcgatttccagagaattttagccgtcgtagatccaaatagcactggatatgtacacttcgatgcgttcttagatttcatgactagggagagcacagacacagatacagctgaacaagtcattgatagtttccgtattttagctgcagacaagccatacatcttgcccgatgaattgagaagagaactaccaccagaccaagctgaatactgcatccaacgtatgcccccatacaagggacccaacggtgttcccggagctcttgactacatgtccttctcaacggctctttatggagaatcagacctttaaacgttgttttaaatataaatatatcaaaaacacccatcgtactcacggtgatattatcaaagccatattagggttgtcaaaagatcccttacattaacaaaaaatgttacatatatttatttttcttaaaaaatattgaaatatcgatttgtaatgctaaatttcacacatatcagttgtagtgatagaacctactgaatgttgtaatattgctgtgagacaactacactaccaacgagtttctacaaactagtgttgatagataccaactgtatcagatattgtgccaatactttttgatttttgcaaaaattgttattgtctatgttaaattaagtcttcgtaagatgatgttgctatgatatagcgtggtataaacggtatagttgttgcattgtgatattaccttgtttagtgggatgtcccttgtttaaaacaggcttgccagctaaacgacacttgataaaatcagttgaaaatcgaattcatcgaatttttttttgttttggcttctttttttttctttcacgttggaaacacgttcactctttcatcatctttcatgaccgtatagaccacctttattatgtactttgtttttgcagtattcaggtatttactaatttactttgtcacttatcactggatagtacaccaacgagatattattaatacatatgtttaaaatttactatt

SEQ ID NO: 3647 - DNA, 581 bp, Diabrotica virgifera
acccacgcgtccgcccacgcgtccggcgataacgcttaacctaaagggcagacgcaagattgcaggttatataaaaaccttggttactacttggttaccgacactcacaactagagggtttataacttcgatccggtgtaaaaagaaatccattaaaagagcagccgaagatgagtgataacgagaatccaccaccagaaaacaacaccgagcagactcctccacaggatgcgactgatgacgtacgataagagagccaaaaacctcattctaggggaaaacgatcgattgtggatgttcccaataggaacaatattggaccagatggaggagaggaagtagatttttaaaatcgattagatgcacaagtattttttattaaacatatgtctttttttattatttatgttaatatattagttattaggttcttttgactgcaataaaaattattccttattagattaaaaaaaaatgaaatacaaaaaaaattctacaaaaaaaccaatagaataaaaaaaattaaaattaagttaaacaaaacataatataaaaaaaaaaggggggccgcccaaaaggtt

SEQ ID NO: 3648 - DNA, 1381 bp, Diabrotica virgifera
  misc_feature (50)..(50): n is a, c, g, or t
  misc_feature (102)..(102): n is a, c, g, or t
taaaattcacaaggaaaaattaaaaattactaaaaatccttttataggcngtgttctcaaatctgtggtacatgtaccactgggtggtacatttcattattngaggtagtacagaaaactcaaaacagtcaaaatatcagcaccactattggcacaattataggtaattagatcacctagctagataggtattttagttaggtggtaccaaaaataataaaaagtatttggtggtacctgactcaaaaagattgagaaccgctgctttatagaatacatatttcatttaaaaccccttaaagggctacatcctacatcacaacgttttcgaactaaaaagttcatcatcagtgtcaaaacctgtaaacagcactgatgattaattttttagttcgaaaacgttctgtgctgtagccctttaagggatatttaataaaatataccttttataaacgattttaggaagtttttaaattttgtaatttcgagcatcaaagatagatgtcgctaacgggcaaacattgcatagagcttgtcaattgtgacgtcatgtcattaagtttattttcaatgaagtgcagtaccggatttaggtagtgatcgagtttaaaagtaaattgaaaaacaatattttaactagtcaaactcgacaaatggttttaaatataacgtcaaatgcttttaaacatagagaggaaaataattaggggtacttaatattccactagataaaatgtaggaaagaataaatgctgcaatatgtaatatgctgtgtgtgacaaagaaatgtcagctttgcagcagaacaaaaatatattatgatataatataataggaacagttgtatctctgcttgcagcagaaacatggaccctaattcagaagaatgaaaaacttttgggaatattcatgcgcaaaatacttcgcaaaacattgtcactatttccaaaagtggcgcaaaagaaataactttgaattatactaactctttaatgcgccacatatcgtaacattcattaaaacatagcgattcagatggactggacacatcccacataacaatttcatgttcttagtagatccatagaacatacttttcagaaaaagtatatgctcagaatatgcgtaattaccattacgaatgtgcagagcagatgctaagtatgtactacattacagtacttaaacgttctatctatatacttagaatgtactaacgcacttctttgtagtatataccaaaaatatactttttagaatattccaaggaagtgctataaaccttctatttatatacttagctactatttatatactaccgcacatatttttagtatatgggaagaatatacttttaggaatgttccaagcaagttctagc

SEQ ID NO: 3649 - DNA, 2266 bp, Diabrotica virgifera
ctgaatatagacagtttttaatttacacaggtccagttgttttgaaagatataatagaaaagcaaaaatatcaaaattttttaatgctttccgtttcaatacatttattattaagtttgacagatagcaacaatgtagatgtaatagattatgcagaggctttattaagaaaatttgtcgaaaccgttcagaggttatatggtaaacaaataatgtcacacaattttcataatctgctgcatttagctgatgactgtcgaaaatttggttcattagagaatttcagtaatttttctagtgaaaattttttgcagagtttacttaagcaggttagaaagcatgacaaacctcttcagcaaattattcggcgtaattatgaactaaacactaataaaattcaatttactccacaaaatagaaataaggaaattcctttccaattttgtttagaaagagaatatgtagggggtgttttaatagacgatactacagggcctgaatttaaaaaaatatgctttgagaaatttgcattatctctttctttaaaagattcttgttgcatcctaaaagataagtcaattattgaaattaaaaatattgtatattgccctagattacatcagaatgtagtaataggttcagaatatcagagtaaatctgacttttttaacattccttgtaattcatcaaacttggatatatttttagtagaaaatttaagtactttaaaatattggccaatatcagatatagcattaaaatgctgtagaatgccttacaataacaaatttgtagttgcacctctactgcactgaatagtaatatatgtaacaattaagatgcttcctgcatggtgattcggtatttattaaggttgatcttaccctactgagaaatgttccttgaccattttttaaatactttttaattttcttttaaaattacttttaaatagtcccagttccagttatttaaaagagttccatcatatatattgattcagtataggctcgtagttaaaattagaataaattattatacgtaaaccttttacaccaactaactctcaattacataaaaaagaaattacaaaagattgttgaagaatggtggagaaatgttcgtcattatagtgagatcaaccttaaagttggtttattttttattatcaagaaagagttgttatatttgtagcttctgtatttgtgaaataaaaaaagtggagatatgcatgcatgttaggctgatattaaaaaaattaaaactgcacctatggttattttgggtatatgcagcctgtattttattgtttttattatttttattaccttatttattgaagagcactactgaactattatcaggaagcaatcttattgcacataaaatcataaaattctacaatattttaataagttacatatcttttttttatggaacactggaaacctacaaagaatttgttgaagaaatgccttggctggttttgagatttccagaaagtgaaacaattgaggcagtaccagctaagtggtatgacaaagcaaacaaactttgtaaatttcctcccgtggacgatcatactgagaaggagttatccaactttattattgaagaatatgaccccttagaggaatggccaatacatgaggcagtgttagaaagccagacagaatttgtactgtttaacaaagctcacattagagctagtaaagcgtgcaatagccagaattacaaatcagataaagaaactgtgttaccacaaaagagacctcctaaaccaaggaaaatagcgagcagtagtagtgagcaggactcagatgggtcagatctggtttttgaacattcatttcctaagtctaagaaagaacaacatgaaaagtgtaccccatctaaatcaagaactcatccaaatattggattagaaaacaaacaggaagtaaaaaccgtgcaagaaacttccaaacccacaccaacaaatgccaatgctcaagaaactgcaatttcatatttaataagaataaaaagaacgttagaattacaagaacaaaaacttagtgaaattgacagaaaagtggatgaattgtccactataatcagagggcaacaaaaaagtacagatataactgatgatgaagttcataagaaattacctctatccaccttaaaaaaaactaggagacgttgaaaagctactataaaaagctaccaatctaaaacaattttgttatttacatgcggcaggtggcaggttttggtaacaaga

SEQ ID NO: 3650 - DNA, 1769 bp, Diabrotica virgifera
cctttcgcgtccgaattaaaattaatttccacatttgtttcttctttttgcttttcccaggacaaatatttttttaaatatattgttttacagtaaaaatatttgtgttaagtacacttgatatcagtgatagtgagtttaatagactgttaaggagaggaacaagatgttgtttacttcgtcatggtttatggacatattgctagcactgagttttgtctgctttctagtctacaaatatctgacacgacactttgattattggaaaaagagaaatgttcaacatccacctcctattcctttattcggaaatatgtacaatgtgctggcaatgaaatcagttactccagagtatatacaaagcatatggaacgaaatagatgcaccctattttggaatgtttatgtttgatgagccagtattagttttaaaatctcctaaattgattaaagatgttctaataaaacattcgtccactttttacaatagaaggattgctatacctgcgcatccagatatggcacgtggactgtttttcttaaaagacgagcagtggaaaaccatgaggaacacaatttcacccctttttacatccggcatgataaaacaattagaacctcattttatcgagaccaatagaatactgtctgagtttcttattaaaaatagtggagtttttgatacttcaaaaattgcaaggaatttgaccagtgagtttctgattcgaagcttctttaatgtcgaagcaaaatcttttgaagaccaaccatccgtcattatggaacagattgacaagatgttcaagtattccttacggaatgttttagttcagaattcatttttctttaaacccggcttgatctctgcttttaaattaaatttcattccagagtctgtgattatgttttttgaaggtatctttaagaattcgatgatggctagagagagttatattggtaagccacaaaacctagttgatatagcaaacaaatctttaagggataatccaaatggtggatatacatcagatgttgaagtgtttgtgtccaatgccctactgttcttaatagccggacaggatactacaagtacaacagtaaaatttagtttatacgaacttgctatgaaccagaaaatacaaaataaattaagaaatgaggttagggctaacgttcaaaaatatggatcgcttacatttgaaggagtacaagaaaataaatatttaggaatgtgtattgatgaaacattgcgaaaatatcccgcgttgccatttattgaccgaacggctagaactgatttccaatttgaagatacagatctgatagtggagaagaatatgtcagtactcattccctcctttttctctacagagagatgaaaacttgttcagtaatcctgaactgtttgacccctgaacgattttcagatgaccgcattaattcagatggactcagttttataccatttgggagaaaggacaaaatattgtataagtaaaccactccgaattttttgatagggtctatggcttttatccctaatagctttaaatttcaaacaaaaaaatggacaaaaactcccaaaaaaaacgaatttaaaccaaaaagttttgtgcctcccccctaaagttgggtctttccaataaaggaaaaaccctaaaaaaggagtgaaattttagacccaaaatttttttttggttaaaaattccctccccaaaaaaacccccaaaagggaaaaaaaagggaaaattttaatttatttttttttaa

SEQ ID NO: 3651 - DNA, 463 bp, Diabrotica virgifera
atttgagattattttctggatctacgacatggttgtgtaaaatatacgtactttttaactttaatactcacaattaagtattattaaaatgcgtttagttgccataggactgtttgtggtacttccgtcacttgtattgtcggagttttctacagaagattgttgggctcttggatttcacaaagcaaacttactgtgttcgtcatgtgatcaattagtcaaatttcaattagatgaacttgtaaatcattgtaaagaatgctgtcacccagatgaagttaattcatcagaaaaagtttattataaagcggttctagaagtttgtacttgcaaatttggtgcatatccacaaatccaagcctttatcaaaagtgatagacctgataaattccccaacttacaaattaaatacctcagaggactcgattccatcataaaactgtatgataaggaatgacatctg

SEQ ID NO: 3652 - DNA, 1546 bp, Diabrotica virgifera
  misc_feature (1329)..(1329): n is a, c, g, or t
  misc_feature (1375)..(1375): n is a, c, g, or t
  misc_feature (1418)..(1419): n is a, c, g, or t
  misc_feature (1452)..(1453): n is a, c, g, or t
atattttactatttaaaacacttgaatttatatatttattgacaaaatcctgaggttatcatgcgaacgaagatatttccaaatttagtggtcgatatgtatattcaaaaattatgtcttctgattattgttgaatctttttcggtggtagcctctctaatttgaggttcagcttatatagaaactattccagatgagacaagtaagattagcagttacatttgcgggatgtatactttttgatttgaacttaaggctatttttaaaagagcaaagtagaatcaaaaacggacttttgagaataattagtctaagaaaatttatttatactcatcaattgattatcgtaagacctggttttaggccataataaacaagagaccataggaaaaaataaaagatttgctgcgggcaaaatattgaccaagaatcactcgagattgaatacatgaaaaaacagttagcaacaaatagactacataagtatagtgaaggtagaatcaaatagcaacattatattttcatttcttttgctactgatattttgctcttcgacccttacctcggtttagtatttttgtaaatcggatgaaaagtgcagtttctgtccttatgacttaattcttgcaaacgtttgatgtgtttctcatttttgggaacattcttattgcttaatttactcttctgtgacatccatccatttcagtcatgaatcattacaatccgtaggtattatagcatagctaacttcatggcgttcaaaatcctattttttattaaggtggattactcctctgcgtcattaatagcttgctgtgtatctttgctgctgttgtgactcttttccatttcttcctctccttgcacggaactttccagtttcattgctcttatgtcttcttctacgtcatccagccatcttcttttaggtattcctctacacctgggctgcagtggtgtccaattagttaccctcctcaacatatctatccatttcaagcgaagaggttttatgtatcggactatattttctcctctttctcttcttcaatttcggcgtttgttttcattcttatttctcgttctcttgttacattgtggcccagtattgttccaattatttttctttcaaactttagaaggctatcctcctcttttttttgaatattcgttgtttccatccgatatgtaactacaggtgacatacagcacaaatatatttttattttcttttgtcttttagtatataaatagcttataaataaattcccatatcaggagacttcttaacttctcagtcggagataaagatgcgattactataacaanctgatcttttttgtggcatgcctcttgacataagttcatccacttngtatttttattgcaattttattcgatttatttatttgtcttgnntagtgtagcttgaagtaaaatgaccaaacattnngtgtaaatatctttttaatcagaactaaaaagtctaactaaagtattatcccatcatagatgatgaattctaaagaaaaatgagatgttaaat

SEQ ID NO: 3653 - DNA, 1330 bp, Diabrotica virgifera
ggaaggagcgcttttttagatcaaaaccaatcggtggcgggttcgctcgtcatcgtataacttggtgactctgaataactttaagctgatcgcacggtctcgcaccggcgacgcatctttcaaatgtctgccttatcaactgtcgatggtaggttctgcgcctaccatggttgtaacgggtaacggggaatcagggttcgattccggagagggagcctgagaaacggctaccacatccaaggaaggcagcaggcgcgcaaattacccactcccggcacggggaggtagtgacgaaaaataacgatacgggactcatccgaggccccgtaatcggaatgagtacactctaaaccctttaacgaggatcaattggagggcaagtctggtgccagcagccgcggtaattccagctccaatagcgtatattaaagttgttgcggttaaaaagctcgtagtcgaatctgtgtcccacgtcgctggttcatcgtacgcggtgtcaactggcgtgtcgtgggacgtcctaccggtgggcttagctcgcaagggcggtccaactcaatcccgccgcggtgctcttgactgagtgtcgaggtgggccggtacgtttactttgaacaaattagagtgcttaaagcaggccaaaacttcgcctgaatactgtgtgcatggaataatggaatgggacctcggttctattttgttggttttcggaaccccgaggtaatgattaataggaacggatggggggattcatattgcgaagttaagagttgcaattcttggaccggcgcaagatttacagaggcaaaagctatttggccacaaaggattatcatttatctataacgataatctaagagacgaaacgctacagaacacggcacggattgtaaaccttaatctcgtttcctgtagtcatgtctctgaacctccctaacaagtcttttttgtaatcgtccggtatatggatgcatttttagcccgtatagaaggcaccatttctgtacttgatgtgttttgcatttgcttgtttcttctctacctgcaccggaacaagcaactttgtacattcctttaaccactctgatctacatggataggcgcaattttaccttttccgagaccgttacttaagaattgacggaccgttgttgcgatccagcctccaattagggtccaaaatcactactattttgccatatttttgggattgatattccagttttagggagttgtcacctcacccctttaattgaaatttctggatgatgaagagttgttgcccaagctgggggttctgctggactgacctgcagctgggtaatttttc

SEQ ID NO: 3654 - DNA, 938 bp, Diabrotica virgifera
cctcggtgcggttacatcggccaacagttccatatcaaataggtacatccacttacatctgcccacatgaccataaaacagacagttcagtgttaatctacatttaaagggtgcttcaccatgaaacatatctttatatgggttctatctgcacactgtttagcatctttagctcaaaatgtacctgaaaccagtgaccaaaaagactttctcaaccaaaacatccacggtaccgtcattcaaacagaagtcaattctttaggggatgtccaaggtaaaaactttgaaaattttcccgctaaattcaatgtagatggcagtcaatatcctgaaccgtacaatatagagtataagtaccacaattatgaaaagatgacttcctttcttagacagacgactgcaagatatccagagctgactgctctttattctattggtaaatctgtccaaggtagagacctatgggtgatggtggtatcagcatctccatatgaacatatgattggtaagcctgatgtaaaatatattgctaatatgcatggaaatgaagctgtgagtagagaactcatgctgcaattgatacattatctagtaacaaattattcgtcagattcctatatacgctggttgttagataataccaggattcatataatgccgtcgatgaatcctgatggatttgaggtttcaaaagaaggcaattgtgatggaagtcaaggaaggtacaacgcaagaggttttgatttaaaccgtaatttcccagactatttcaagcaaaataacaaaagaactcagccggaaaccgaagccgtcaaggagtggatctcaaagattcagttcgttctcagcggaagtttgcatggaggagcactggtagcaaggtatccatttgatagtactcccaattctctatttcagagcttttcaacgccatctct

SEQ ID NO: 3655 - DNA, 1575 bp, Diabrotica virgifera
  misc_feature (1469)..(1469): n is a, c, g, or t
gagaatcgcccagtaataacaatgcagaagttactactaaatcatcaatttcaaaaagcttgtacgagagagtattaagtaaagctataaaaaatactcctacttcgactggtaaaaacagaaataccatctttagaaatagcagaggaccacaaagtgagaaaacagaagacgaactcaaagaagaaactaaaccaaaagtcgaaaggggaaaattgcaatacacatcgatttcaagatttagaccatcagttgcccgtgagaaaaaagctgaatccgtcgagaacgatgaagatatcgaagataacgaagatcaaaccaccaaaaggtcatctgacaaattcccagcttacacgaatataagaagagctagaatcagtacaacaagtgaaccatcaagtgatagaaataaaattttgggagaactgccagaagagagcgatgatgaggatagtgaagaagatgatgacgacgaagatgatgatgatataaaaagcgtatatacaccaaccaccaaaaaggcgaatattcctcattacataaacattagacggcaaagaccttcgaccacagaagaatcttccacatctcaatacaacgaaatcaaaagaggaagcactgcagaggctacgtctaaagaagaaaacagtcctacaactgcaaaatacaaacaaattcgacgtggcaccactacagcttctactacgacaacaaatacaccgtctacgtctgaaaacacaacagttcagcactgctacagaaaacagtacggaaacgtcgtctgcctcatcaatatctgattcagaattaggatccagtgtcgaagcggttacagaaaacagatcaacagaagatattagaaatgactatgtatctagtgtaataacaacaaccggaacatacgtaacttcaacagatgacattaatgccattaaatctgaaaataacgtttcgaaatctcccaacaagtcatcttcactgactaaaccacactttttaaattctatccaaagaaaaagaccgcaacttttcgagccaagaccgtttacaaagccaacagagtcaaccacgtcaagagcatcgacgagtcaagtcacaaagattccatttagaaactttttaagaggaactaacagaagaagtcctttcacgactagatctccgactacgaaaacaccaataactaacaccaccgctacagcagcaataacttcttcaccttcttcgaccagattctcgagaccgactggaccatcgcgaagaaaattcctaacgagaacaacaacggctacgatattagaaagtcaagaatcgacttcgtcgacaaccaaaagaccccgtccaaacattttcgatggtacttctcgaagaccttttctacgcagaactgccaaaactacaactacaaccgaaaatccaacctcaggaatacttccacaaacaacgttgtttgaaaatgattcagtggngaaacccattgaactaagggacgtagtggtagcaatccaaaaactacaaaacgctccagttccttctcgtaccttaagaccactaatggaacagaatttgattgat

SEQ ID NO: 3656 - DNA, 806 bp, Diabrotica virgifera
agtagctttaaaacaaaaactttactttacaatgaaaagcatagttatctttgctttctgcatttccgcagtcgtatctctacctttggatgtcattgaagatgagagtggacaggaatatcttttagttccagtacacagagaaagaagagacttaacctggggcgccaaccaaaatggatacactcttggtcaaaaaggaaatctctgggaaaatggtgcccacaaatttgacggtgcttacactggttcgaaagcttgggattcacatggactgaaaccagattcttttggaggtcgtgtagaatacactaacaagccaacaaaaactactgcttttgtaggcgcagacagaacgcctgggtatggtactgatgtcaatgctggagttaaatacaactttgttcaagataaaaaacttaacatagatttaacaggacaagtaagtcagcaccacggtggacctggaggaaatggtaaacccgaagcaggagtatttttaaattttgaggctagaccctaattcacaacaaagataaaaaagactgtacctactaaatatttaaaataaattattatttttttaaattgatttataaattctataaatcctcagagttttatctcaaatttttttcatgaaatgtatagtttacaaatacataatacgataaacacaatttcagcaccaaggcggaccctttggaaatacaaaacctgaagcaggagtatatttaaattttaatgctagaccttaaatcaaaataaagactgtacatttttttaaataaaatatttttgttttg

SEQ ID NO: 3657 - DNA, 1476 bp, Diabrotica virgifera
  misc_feature (1398)..(1398): n is a, c, g, or t
cttagaaagaagccagatgagaaaagatagtttggaagaaagtggcagtgatttagaaaatgctgtcaaacaacttagtgttactgaatcagaaattaccagcaaacagaaagaatatcaagatttgttaaacaatttcgatcagctgcaagttgagtatgaatcgttgaaaagagaattagaagaagttaaagaaaatttagtattcactgatgaagaaaattccgaactaaaatctgcaaatgaaaaactaaaaacagacaatgaaaatatggaatatcagcttagtgaacttaacatcaattctgatagtatgaaagatgaaatacaggaatacaaacaaaaatttaagatgatactcagcgaaaattcaaatataaaactgcagagtgacgaaaatttaaagaaatatcttgactttgaaagtaaaataaacgttttggaagaaaaactagcttcagaggaacatgataaaaaagctttggaatcgcaggttgaaagtatcactgaaaagttaaaaaatgctaaaatgacagaaactacattaaaattacaacttgaacagaagaacaaggaattggcatcccaagcagaagaacgatataatatagaaatagccttagacaaaacaaatagagatgtggctgaattccaaaataattttgtcgaattgcaaaaccaaaatgataaattgttaatagaacaagaacaattaaggacacttaaggataatgatcaacagaggatagaagaactagagcacttggtgacagatttagaaaaacagttggaagttgccaagactgaaagtgtgcaaaaagtacagaatgtaactgaagatatatcagagaatatagattataacaacttaaagctaatgttagaccaaactgttttagaaaaagcaaatttgcaggcagagctgaacaaactaacccaaattcagtcacagctaaaagaaactacagaaaaaatctcggtgctccaaaatcaactccaagaaatcacaaattcccgcaatgaactcatcaacatggtcaccatgaaacaccaggaaaatgttacttaccacaacgaaatccaaaaactgaaccaagtgctgatagctgaagccgaaaaatataaaaatttggaagtgcaattgaaagcggctgtgtcccccgaagatatcgaagccaaaaacaatgaaatagaaaaattaacggaccaaaacagttttcttaaggaaaaatgtgaagttctggctaagaatcttctcgaagaacaagctcaaacacagaagttgttagcagagagatcggttccttctgagaaagaaacgtcgcttcaaaagaaggtagataggcttcaagctcatttgatagagctggaagagcattacactcaagaactgctccnagctgagcagaagaacgcatcattgaaggcgaaggtagcagatatcgaagagagggagaagagtccagtacatgtata

SEQ ID NO: 3658 - DNA, 1608 bp, Diabrotica virgifera
cgggccccccccccacccctcctctctgggcctttaaagtcttaaaaagtgtgaaagttttaaaatattcccgaattagttttgtttgaatgaaattacacaccacaataattaatgcattaacttaattgctttgcctaaaccaagaaatggcgttacagacaggctacaaattaacaagagcgctactaccaaagaatcagcatcagttatggaatgcatcgaaaactgtagaatattgtctagccaaacaatacacatcaacagatcgcactgatttaacaggaggggcaaaatccaaagtaactgacatgcctcctatgagcgaagctgtaaaaggactgccacaagctgtctacgcgaatttcaaagaggaagaccaaaagacgaaggtaaccatcctctccaatggcttaacagtggcgtcagaaaacagattcggtgctttctgcacagtcggtgttgtcatagattcaggatcgaggtacgaagtggcttatcccagcggtatctcacattttttggaaaaactagcatttaattcaaccaaattttatccagacaaagacgaaatgatcaataaattggagaaacatggaggtatttgtgacagtcaggcttctagggacactttcatatacgctgcttctgcatacacatcaggattgaatgacgttattcaattactagcagaagctacgttgagaccaaatataacatctgaagagttattaaatgcaaaacaagcaataaattttgaattagaaaccttaaatatgagacctgaacaagaaaccattcttatggatatgattcatgctgctgcttataacgacaacacattaggactaccaaaactttgcccatatgaaaatgttaacacaatcaatagaaatgtgattttgacatacttaaaaaatcattatactcccaaaagaatcgttgtggctggagtaggagtagaacattcgaaattagttgatgcagtacaaaaattcttcgttgatataaaacctatctggactgaaagtaattctgaggttatcaaagatgttagtgttgatttaagtgtttcacaatataccggaggaatagtgcatgaagaatgtgaaatccctcagtttgcatctgctggtcttccagtgctgtctcacgtggtcgtaggactagaaagttgttctcatcaagacaaagacttcattgcaacgtgtgtgcttaatataatgatgggaggtggtggttcttttagtgctggaggccctggtaaaggcatgtacacgagactatacaccaaatgttttaaataggtatcattggatgtacagtgcaacggcatgcaaccatgcatactctgatagtggtcttttctgtatacatgcaagtgcaccctcctacgcatgttagagacatggttcaaagtgatagtaaaagaaattagtgaacatgccgaagaaatattacagatgaaaaactgagaagagctaaaaacacagctgcagtcgatgctttttgatgaatctagagtccaggccggttatgtttgaagataataggaagaacaagtactccgctttcaggccaaagaaaggagaccctaagcacttttat

SEQ ID NO: 3659 - DNA, 424 bp, Diabrotica virgifera
gtgacaacagaaaaatatagaaaatcatcctctgtgtttccgttttgaacttaacttgtatttagtttaaaaaataatcatgtctagaggaagcagtgcaggttttgaccgacacataacaattttctcgcccgaaggccgactctatcaagtagagtatgcttttaaagccattaaccaagccggccccacttcggtagcagtccgaggagtagatgctgcggcgtgtgtgacccagagaaagatcccggataagctgattgatcccaacacaattacacatctgttccagttaacagaacacactggatgtgtgatgactggcatgattgccgacagcaagtcccaggtgcagagagctagatatgaggctgccgagttcaaatataagtttggatatgagatgccaatcgatgccttgtgt

SEQ ID NO: 3660 - DNA, 1131 bp, Diabrotica virgifera
tactcgtcccacgcgtccggctagacacttattaatattttccacggatgcagaatttcacatagctggcgatggaaaattgggaggagtaacagaaccaaatccaggaacatgctattctagtgacgacgaattcttaatctacgattatccttcagtatcccacataaattatgtagcacagcaaaacaaggttaacataatttttgctattgtaaaaaagggatctggaataaaagcgtcataccaacaactgtctaacaacattgacaactcaaaattcggtgaaataagcgagggcaaagatagtaatatcataaagttaatagtggataattataatacaatagcgcaaaccgttagttttagatccaacgctacagatgaagtagatgtcacattttcgtcaagttgtggaacaggccacacaaatcgttgcagcaacgttacagtaggtcaaattattgactttacggcaactattgaactaaggcagtgtccccaagatggccagaagacaaaaattatagctatccaaccagatggtattaatgagagtttaatgattgagttaaaccttttgtgcgactgtccatgttccgaaacaaacattgaacaaaattcaggaaaatgtaacggaacaggtgctttgacatgcggagtatgcgactgtccaccaggaaaatcgggcaaattctgtgagtgcgaccttctcacacaaagtaaagtagaaaatgtcacaaaatgtatgaaagaaggcagtaatgaagtgtgctcaggagcaggaatatgtaaatgtgaacaatgtgtatgtaatataattccccagagtaatgatccaaaatatacaggaaaatactgtgaatgtgataatctatcatgtaaaagagaaaaaggtttactatgttccaacagaaggaaattgtaattgcaattaatggcgactgttttcctgggaataatggggaaaagcgggggggaaggggaaaacaacctggtaacgaaattgccaaacgtttcttagaaaggggacaaaattttggttccaacaaaatggaaaaaaggggggtatgtgaaccccggggcgccaaggggggcatataaaaggaaaataaaaaaaaaaaatttttt

SEQ ID NO: 3661 - DNA, 1825 bp, Diabrotica virgifera
ctgacattacttaaatatttgtgaaacaacaaacattttataaataaaattttgtttttattataaagttttttagtgttttggtgaaatttacagtgacaatcaaaatttttaaatttgacgttttattttgacagttttgtcaagaggtgttgttattgaccctgatataggtacataaaagacataaatttattaatacttatattatattacaatatatccgaagtagggtatctcatattgtagcgttttgctctatatgtaaggtattacgaaccaaacctataacaattgatataaaatttaagagcaagagtgggagtacttccaagttgatacaatgatttatttgatatactttgaagaccatcagagcaacttcgataaacatggatctgaacatgtagtgctggtagttgttccacaatagttgaattacgatatagaagtgtacttgccatattcttatagaaaacagattacaaaatacaataatcaaatcatatgcctcaaaaaaggacatagaaaagtagattgataagaactaacactctatggttggcgaacaaactgcccaattgaatgaaaatgatgcttacgttctagaaatccttgaattttgtcctatatattatatattacacagatgacaatgcgtcgtcttaactcgcgagcggccgcccgcgatctagaactagtccggacgcgtggggaccagtagtattaaggagcccagtcccgatttcgaccagttaaactcacagatcgaggaagcaagatacaattcgtttctattggaacagcgcagaaagagcataaaggataaaatagccaagaaagagaaaaagcgggagaagaagcgcaaaaagatactggaatcaggcggagttttaccaccagaacttacagataacgtaacaatggccgacacagaagcagtgaacggacaaacgcaacttccctcagatcaagcactagcgatggaagaagaagaaagacgggaggaggaagctaagaagaaagccagggatccaccaatagtttataaagacataattgacgtaaaagcagaatttgacgctttggtcgccctaatcgacggaaaactaacaccagaagaacagagagcaacggaagaacttcaacaatacatgattggcgatgaaggaagctgggccttaagtgatgggtttttggatttcgtaggacgattgctcaacgatccccaactgtctgttgacgttagagtgaagactgtcaatgttttggctatggcggccttgaaagatgacgtcatattagttctgcatcaggatcggaaggaccacgttttgatgaactacgcttttgaaatcgacagattgagcatgccagaacaggaagcgattgctgtttttatggcgaatatgtttgagaatttgagctcttcggaatggttgctgtacatttctgaatggtcatacaataaccaacagaccagcaatatcagggtgacgaccaaagtagcagtccattcccttttatcggactctccagttttgcaagaccgaggctcggctattatccacaatcttgcttgcaaggaggtaaaaaccgtggtgttcgatgacgtggccgtcgagcttaccatggctctgctgcagtatttcaactcccaaccaccagaggaacaactcttcaggcgcttaaaagcgctaggcaagttcgtcaaagtctcccggaagaagtggctcaacttatcaagttgatcggtcccgacccccgacgctttaaggcccgcctcacgaagaattgatgttataccacgaatcaactccccgcc

SEQ ID NO: 3662 - DNA, 1253 bp, Diabrotica virgifera
gagttctctgtgtgtttaagtgttcagagtgatatacagtctgctccatttattcagaaactacattgtgaaacctgactagtcttagttgggcacttttgctcatatagcagctcacagaagtatcaggtaacaatgccaccattacgagatgacccagtccttcatcaccgagaaataccaaccaacaatgtgtctgcgcaattaccagaaaaacagaaaaaaagaaatggttactttgaacaagatttagtactaccaaatgttagtgtatatattattctgcacgcattaacaatttatggattttatagaataactactactgaagttaaggggtcagccatattattcagtacttttatcggcatgttggcaatattgggggtcacagctggagcccatcgtctttgggctcatagaacttacaaagcaaaactgccattacgagtatttttaatgttgttgcagacagcggcccttcagaatgatcttttcatttgggttagagatcacagaatgcaccacaaatatacagacaccaatgctgatcctcacaactcgaacagaggattcttcttttgtcatgttggatggctattaatgaaaaaacacccggacgtcataaacaaaggaaagaatattgacatgagcgatgttgcaaatgaccctgtagtgaaatttcagagaaaatattacacacttctgatattagctttgacgttcattttacctacaatagccatggtccatttctttcatgaaacgactgtaaatgctctcttaatttgtattggaaaattagtcctcactctaaatggaacttggtgcgtcaacagttttgcacatatgtatggatggaggcccttttgacagctccatcaatccagttgaaaatcttactgtttcaatagtaggcttaggagaaggctggcacaactaccatcataccttcccatgggattacaaagctgccgaacttggaaattaccgagctaacttaacaactggcttcttggatctcatggcttatttaggacaagcatacgatctcaaaacagtatcgccagagatgatcaagaaacgagctgcacgaacaggagatggatcatacaatttcgataaagtgcccttagagaatggtaatgttaaagacaccacaactccatgaggactgtgtatggggttgggacgacaaagatatgaaagaagagtttaaaaagctactattccatattaagtaaaaagctagc

SEQ ID NO: 3663 - DNA, 1477 bp, Diabrotica virgifera
  misc_feature (1258)..(1258): n is a, c, g, or t
  misc_feature (1399)..(1399): n is a, c, g, or t
agcagagagaaattgggcatatgcaatgcaattgagacaagaggccaatactgagcctagaaagaagtttcatttagttcagaagatgagaaaagcttgtgtgtatgctctacagttggatgagctgtgtaagcaagaccgatgtgatgttcggactaagctagaatcacaagcatatcttgcttggattcaaggctctcttcaatttgaacttcaactctggcagcaagctgctgaaaatttgaagaaagcccaagtaatctatgaaaagatatcgtctacactgcctgaagaggaacagctaccttataaacagagagtggaagaaattagtccaagtttgagatattgtgcctataatatcggggatgaaaaagctgtagatcttttggaactacgtagtcagggagtattggagaactttgatgctcttgtatcccagaataaagaaaagaatgaggatgttctgtatgaggtgaaatggtttaacctgaacattccagtcagaatagaaagaataagattatttttagtcagtattgaaggtttaaacgaatctttaaaccatgctgaagataatcagggaaagattaagattttagagaatctatttattgatttgagagatataatatcattggcaagagataattctaggtctgataagttaacagccaagcaaacaaaggaatatcagcagctgattgcttatctgttgtctatacgtattgagcgtacttcccagagaaatgttttgctaattttacagacaagaaaatcacaagattgtgtccgtcttttagacatcaacattcaacagactaatgaattatcacagaatgacataataaaggacaatactaatgcccaaaaatactatgagtcccaaatcgcagcgtataaaactcttagatattattatctagcgaaatctcaaggagctcaaaaacgttggaaagaagctgctgttctctttgatactgcctacaattctgcgcaagttttaaaacaaggtaaatttgaattggaagttaaagaaattttacaaaggattgaggacaaatcacaaattgaaatcgcaacggctaaagctaacatggtattggatcttaaacaggatgaatcaacgatacaatttccacaaagccaaaaaacttacaaaagcaagaaaccgttggtcgaaagattggatgagtttagagaagatccgcagttgctgtccaaaaatcccaatcttgttactctgccacctgctatnggaccagtgccagcaaaaccattattcttcgatttagctttgaattttgccgaatttcccgatctttctgagaagttggatgatggaaaaccccaacagaaacagggagctggtatttctggtttcgttaagggactttgnggatggggaaaataggaattagttaatacagatgggttttataagattttcacattgtttaataatttaatattaccg

SEQ ID NO: 3664 - DNA, 1134 bp, Diabrotica virgifera
gggacgagggacgtcaggtaacgtgagtttaataaaattaaataaaattcaaatgggaactgaaaacatagataatgtatcaggagatacacaaaataaaccagtgcagcaagaacctcttctaccatttactttagaaattttgaagttaataaaagactgtcagcaacaacacggtcttcgacatggagattatcagagatacagaggttactgctccagaaggatcagcagactgcgtaaagtactcaaaattcctcaaggagatcgtcgacacttcaaaaaacgagacgttactgaagctcacataataaatccaaaatctgacgatagatttctacacattcctcttatactagcagagagaaattgggcatatgcaatgcaattgagacaagaggccaatactgagcctagaaagaagtttcatttagttcagaagatgagaaaagcttgtgtgtatgctctacagttggatgagctgtgtaagcaagaccgatgtgatgttcggactaagctagaatcacaagcatatcttgcttggattcaaggctctcttcaatttgaacttcaactctggcagcaagctgctgaaaatttgaagaaagcccaagtaatctatgaaaagatatcgtctacactgcctgaagaggaacagctaccttataaacagagagtggaagaaattagtccaagtttgagatattgtgcctataatatcggggatgaaaaagctgtagatcttttggaactacgtagtcagggagtattggagaactttgatgctcttgtatcccagaataaagaaaagaatgaggatgttctgtatgaggtgaaatggtttaacctgaacattccagtcagaatagaaagaataagattatttttagtcagaattgaaggggttaaacgaatctttaaaccatgctgaaaatatcaggaaaaaataaaatttttaaaaaactttttattggttttgagaaaattaattatctttgggaaaaaaataatttttaggctatgaaaaaataaacaacccaaacaaaaaaaggaaaaattcgaaaatctgattggttttatttggtttgcttatacggatttgaagcgcatctttccccaaaaaaaaggtttttt

SEQ ID NO: 3665 - DNA, 795 bp, Diabrotica virgifera
gttgttgcgttttaggggtgtgctacaccatcaaaataaaataatttaattgattacagggtaatgagcgtgaatttgtgaaaattattgagtgttatacgagtttgttgatatcctgaatcagtagtgtcaattttaagtccccggaaagtgagaatttaacacacgtggagtggaaaacagtaataaaggtgaatgatccaaatacctacatgtgggcctgaaaacagtagttctgcgtgttaataactatgagtgatttattgttagttattattttaacctagatttggtttaatttatcaatgtgctatgcgtgcacatttgttattgttttgctcagtagtgcttccgagttttttcttgtgtacagtgaagtgctgtgactgtcttgtcgtcaatcgagaacgatcagtccattccttgcgacaaggggagtgaactttgatacattcaatcaggtttagtcggttggttttcaattcatataaaattaaatatgtgtatatcatgcggcctaagcaatataccccaattgtgccgcaatatttcttaagtaccagagagaatcgtataatcgaagtatgttgtgtccctcagattgactggttgttgtttttctgtcttcgtctcttctcgaaacggaagtggctgtgtctgtgaaagcataatatcggctgcccttggaaaagcggggaaggttatggtccttaagcaacgcgggatctgtttaacccagtgaccaacaatgaaatttggtttggcattaagccggaatctccttttgtcttcccc

SEQ ID NO: 3666 - DNA, 795 bp, Diabrotica virgifera
gaagagtacctacaaggcggctccttgtttttattgtggtattttaaaaacacgggtagtgtaggcattttaattccgcagtgtgttgtaaaagtttgtgttctatcatgaacacaatgaataaccatcttgctctatatgtcaaggatgtagaaaaatcgtttggttcaaacaaagtgctggacaaattatgtttaaacgttcaaaaaggtaccatatacggacttttgggatccagtggttgtggtaaaacaactttattaaggtgtataattggaaggagtaatgtaaataaaggggatatatatgtactgggagaaaaacaggatggtagtgtagtcctagcagatagagtggggtatatgccacaggatatatcattagttggagaattaagtgcaagggattctatttatttctttggaagaatctacaatttaaaggatgacataataaaaagtcgttgtgatgaactgattgaattattagaccttccaacggataacagatgtgtaagagattgtagcggaggagaacagagaagagtgtcctttgctgtaacgttagttcataaaccagagttacttatattggatgaacctactgttggtacagattcaattcttagaaatagaatatggaagtatttaacgaaaataactgaagaggacaaaacgactgtgataataacaacacattatatagaagaaactagacaagctgataagattgctctaatgagaaagggaaagttattaacagaagaacacccggagacgctcttagaaaggtacg

SEQ ID NO: 3667 - DNA, 923 bp, Diabrotica virgifera
catttgccaaattgattgaattcatcagaaagaaggaaattgaccaaataagacatacctcaataataaaggctctaactataaccttcaacatcgcactatcacgagcggctattcttgtatgcattttaacatacatattatcaggaaacgttctcacagcatcgtatgcctttacagtaacgtcatattatacatacatgagagccataatcactttgcagtttcctaagctatgacccagtttgctgagacattagtatccatatccaggatacagaagttcttattatttgaagaactagatgtaaaatatacaccaatgcacaaacaaatcaacaacaacgagattttacaaaacaacaagccagatgtcatcgaagtacggcctgtaggtattaaaataaaaaatgcagctgtaaaatggatcaaaaaacatccagaaaacacaatagaacaaatcaactttgaagccagatcaaatcaacttgtagccttagtaggtccagtgggtgcaggaaaatcaacccttctacaagttattttgaaagagctaaaaccattagaaggcacagtcaaagtaactggaactgtttcctttgcttcacaagaaccttgggtattcgcatccagtgttcgccaaaatatcctctttggagagacttacaatgaaaataaatattatgaagtgttacgagtgcgtgctctagaaaaagacctaaaattgtttccacatggtgatagaactcttattggggaaagaggtacgtctttaagagggggacaaagagctagaaatcatctagccagagctatttacaaggaaacgggcctatatcttctttatgatcccttatctcctgatgatattcgacgtggcaccaacaaaataacagatgcatttgcaactatctcaggaaaaa

SEQ ID NO: 3668 - DNA, 968 bp, Diabrotica virgifera
caaggttcgagttggttgtgtcgttgtgtcaggaatttcgtaccttcgggcttttagactttttttatttctgaaaacaaaataaatatcaaagcaataaaattctgttgagttgaactagtttattctaatttcgagcgagtgaagacggtactactagaacagcaagtgtggatacagtgatcaggcgaaacactagcatatcacgtttctatcatgtcccaccatagcgacgacaacatgctcatagcgaccagcgactcgttctgggaaccaggcaactacaaaaagactacgaagcggatcgaggacggatacaaactctgccaagaactgatttcgttggtgggcgaacgggccgacatcgagaggaactacgccaaatcgctgaaggcctggtcgaaaaagtggaacgatgccatcgagaagggaccagagtacggtaccacggaggcggcttggaagggagcactcgtcgaggccgacaggagatgcgatcttcattctcggatccgagacagtttaactaacgacgtgataaataaagttaaacagtggcagaaggacagttatcataagtcgatgatgaatattaaagagaaaaaagatatggacgataattttaagaaagctcaaaaaccttggacgaaactgctacagaaagtagaaaaaaccaagaatgactatcacacggcctgcaaaacagaaaagtcagcctcaaatcaagaaagaaacgctacgggcgacacatctttttctgcagatcaggttaaaaaaatgcaagagagggtacaaaagtctaaagatgaagttcagaaatgtcgagaaaaatacgaattatctctacaggaaatcaatcaatataaccccaaatatatggaagatatgactgtcgtcttcgataatatgtcaagaaaaggaagggttcaacgggttccacttcattaaaaacagttttttttccaaat

SEQ ID NO: 3669 - DNA, 989 bp, Diabrotica virgifera
  misc_feature (941)..(942): n is a, c, g, or t
  misc_feature (967)..(967): n is a, c, g, or t
ggctgcagcagtggtacagcaatcaaatgtaaacgattatttactaaaaaaacaacaagaaagtcctaaagaattaggctcagaatgggccgaacttgaagaacttcataataaaaaattgtggcatcagttgactctaaaattgctgaattttattaagaaaccagaactacagaagaatgataacctcatacaactgtacaataactttattcaaagttttgaaaataaaatcaatcctttgtcattggttgaaattgttgctatagtagtccaacaattcaaaaatccaaaagatgctgtcgcttttcttgaaaagactgaacctaaggttaaaattaattcagatgcccaaaacttgtgcaaagttttagctgggcagatatatatcgaaaagttgaacgatttagatgctactaaaaagataattgaagaagtggaatctacattggacaatgctgatggtgttactccagttcatggaagattttatttacttgcctcacaatattatagaattcaaggaaaccatgctcaatattataggacagcattgagatatcttggatgcatagagttggatacaataacatcagaagtgaaagtgcaacacgctttctttttgggtttggctgctctattaggcgaaggtgtctataacttaggtgaattactcgcacatcccgttttggagtccctaaaatcaacagaaaatgcgtggttggtagaattgttgtatgcttttaattctggcaatattaaaaagtttgagtccatgaaaccgcagtgggaagctatagcagatcttgcagctgaagaattatttttacgacaaaaaatatccctgttgtgtcttatggagatgacatttaatagaccatcgcacaacaggcaattaacatttgcagaaatcgcaaaagaaacaaaattacctttgaatnngaatgaattatttgatatgaaagcngtgtcccaagactagtcaaagg

SEQ ID NO: 3670 - DNA, 1979 bp, Diabrotica virgifera
  misc_feature (1061)..(1061): n is a, c, g, or t
  misc_feature (1178)..(1178): n is a, c, g, or t
attagttttgactattttggaaggacgtccgaaccacaacaaacacagatcgtccaagacatgttctttaccctcaacagcaacggtttcatgttcactcagtccgtggaacaactccactgtgaaaaatgcaacaaattcttggctgatcgattcgtggaaggtggttgtccgaatgttggttgtaattatgaggatgctagaggtgaccaatgtgatggttgtggaaaactagtcaatgccgtggaattgaaaaatccccggtgtaagatatgtaacaatacccctgctttgaagtgctctgatcaattctacattgatttacctaagctggaacctttgctgtatcattggataaaattgcgaaattcaggttggtcgcacaactcgcaagtaatagccaaagcctggttgaaagaaggtcttaaaccgcgatgtattacccgtgatctaaaatggggggttcccgtaccacttgacggctatcgagataaagtattctacgtttggtttgacgcacctttagggtacatttcgatcactaaagcttacacggaagattacgcaagatggtggacgccgacaaaaggagaagaagtcactttgtatcagttcatggccaaagataacgtacctttccattccgttttgtttcctgctatgttgttgggtgccaaccagggttatattactgttaatcatctaatggctacagaatacttaaattatgaagatggtaaattttcgaaatccagaggtgtgggagtattcggaacagacgctcagagtacaggaattccaagtgacgtatggagattttatttactctatgtcagaccggaatctcaagattccagttttagttggaacgatctcgttactaaaaataattccgaattgttaaataatttaggaaacttcattaacagggcgttagtgtttgcgaaaaacaacttcaaaggaacggtacctgcaataaaacccaccgaagaagatttcaatctgttggcgttatgtaccagagaactgaaaggttacgtagaagctctcgaaaagtctanattgcgagatggaattaggcatattctatcgatatccagacttggtaatcaatacatgcaatcgaatcaaccatgggtattactaaaaggttccgacgatgaaaaagtacgcgctgngaccgttattggcatgtgttgcaatttgtcatgtttgatagccaccttgttgcaaccatatatgcctgaaaccagtgagaatttgaagaagcagttgaatacatctaacattgttttgattcctagtgacccagaaatagttaacatgcttccagcaggtcataagttaggagaaccctcgcctttgtttgccaaaattgaaccaagcgttgcagaagagttaaagaaaaaattcgcaggcaaacaacaatctaaagaaaccagccccagtggagatttcaaaagcgcggcagatctagaagcagcagtagccagtcagggtgataaagtgagacaactgaaatcaagtggtgttgagaaatcagtctggcaacccgaagtaaaaatccttttggatttaaagaaacagttggaatcattgaaaataagttcagctcctcaatctgcacctaccaaaactgacgttgtagattccaatgcagtacagaagattgaagaagaagtggccaagcaggctttggttgtaagaacattgaaagaaggcggagcagaaaagtctaaatggcaaccagaagtagacaaactattggctttgaagaaacaattagcttcagcaagcggtaccccagtggctgctccccaaaaaaaagcaaaaagggcaagaaataagaataaaaataatataagttgataaataaaagtattgcgtgtgatctgggtagaaaaatatttattttatttattcaatattctaaatattgataataaatatggtatatttaaatacagttttcatatttt

SEQ ID NO: 3671 - DNA, 1100 bp, Diabrotica virgifera
  misc_feature (1017)..(1017): n is a, c, g, or t
  misc_feature (1087)..(1087): n is a, c, g, or t
cccacgcgtccgcggacgcgtgggtttttgttttaaaaaaagctgaccacaaggtttgctgtctttttttaggattgatgaagtaatcataagggctttcccacctattgaaacaacgataatcaagatgaaatatcttctttgcaccgtcttatttgttagtaccgtcgcattttctagtgcttcagtattgtgcgatttgaaatggccgcggtgtggtttaacagtagagaatacagtttgcgaaaaggacgaaaaatgtcttcctgaaccaggttgccaggacgtgccaacggatcctgaattcttgaagttcatcctacacgagcacaaccgcttgaggaaccaggttgccagcggggcagaaaccagaggctacactggagtcgctgctaacatgatggcgctttcttacgacaaggatctggaatatacagctagatgccatataaacagttgtaagttcgagcacgataaatgcagaggtaccagtaaattccttttggccggtcaaaatctgtattatactagcgaatctcaggaagcattgaaagaagcagtgaatacgtggtacgaagaaattcagcaaatgactccagacgtaattgataattttccaaaaggaagacacgacattggtcacttttctcaatctatatgggccacaacaacccacgtaggatgtgctctctctaaatctgtcccaactgaagaagacgaagaagtaaaatactacatagcttgtaattatggaccaataggaaacaagattggcaaaaccgtctacgaaaggggagcagggtgttccaaatgtccactcggtgtagcatgtaatgcggaatttcctgcactatgtggagaagtcgacgaaactcaaatatatgccaacgtgtctagcggtggagacgttcttaatattggaaacactggagtcagtgatgctgctactgttactgtcggtggagataacacactgatgtaactgtttcaggtaatactgaagccgattctgcatcntaagatgctgctacaaatgcagctacgaaagatagcagtaatggagcaactttactgtcacaaatgctgngaatactgaaaat

SEQ ID NO: 3672 - DNA, 1274 bp, Diabrotica virgifera
tttttcgaaaaagctgaccacaaggtttgctgtcttttttttagattgatgaagtaatcataagggctttcccacctgttgaaacaacgaaaatcaagatgaaatatcttctttgcaccgtcttatttgttagtaccgtcgcattttctagtgcttcagtattgtgcgatttgaaatggccgcggtgtggtttaacagtagagaatacaggttgcgaaaaggacgaaaaatgtcttcctgaaccaggttgccaggacgtgccaacggatcctgaattcttgaagttcatcctacacgagcacaaccgcttgaggaaccaggttgccagcggggcagaaaccagaggctacactggagtcgctgttaacatgatgacactgtcttacgacaaggagctgtaatatacccgtataaacaaaataaatctaatattttaagatataaattttaacaatataataatctgaatatcttcgaggtattcctattaatcctaaaaaatgttgagggaagaaggttaaatttacaccaataaatataataaaaaattgaatttttaaataaaaattatttaaaaagttatacctgtaaataaaggaaatcattggataaatcccgctataatagcaaatacagctcctatagataatacataatgaaaatgtgcaacaacataataggtatcatgaagtacaatatcaattgaggagtttgctaaaactacccctgctaatcctccaactgtaaataaaaaaataaaacctaaagctcagagtgttactggactatatgtaatagcagtcccatgataagtagctaatcatctaaatactttaattccagatggaaaccaataattatagttgctgaggaaaataagcccgggaacaacatccattccaacctgcaaatatatgatgagctcaaacaataaaacctaataaagcaattgctataatagcataaaatatccctaaagaaccaaaagtttctttttttcctctctcttgcctaacaaaatgagaaattaactcaaaccctggaaaaattaaaataaatacttcaggatgacccaaaaaaaccaaaataaatggtggtaaaaaaatgggatcccctccccagttggatcaaaaaaaggatgcatttaaattttcaattgttaatataatggtaaaagctcccgctaaaaatgggtaaagataataaaaaaaaggaatggtttgcaatcaccaaccgctcaaacaaaaaaggggtattccaactaaagggtttcc

SEQ ID NO: 3673 - DNA, 1771 bp, Diabrotica virgifera
tgggacggctgcagctaccgcgccccacgctttgtgactgtagcagggatatagattggagaaatgtgggtaaaattggttttagttctagttgctacccaactgtcctctgagattgtatcagctactacatccagagtggtgtgttatcatggaacatgggctcgttatagaaacggaaaagggtcttaccaacttacggacatacctacttcattatgtacccatttaatctacagttttatcggattatctgcgtctggagaaatggtttccttagactcttatttggacaatgatttaaataatctaaataaatttactggcttgaaatcatcaaactcaaatttaaagactctcgttgccatcggaggctggaacgaaggttctgttaaattctcaactcttgctgcatcagcatctcttagaagtacatttatacaaaatgctttacaatattgtcaaaatcataattttgatggacttgatttcgattgggaatatccagctcaacgtggtggagccgcagctgacaaggaaaacttcataactctactaaaagaaaccaaagcagtttttgaagcaaatggtctattagtatcagttgctgttgccgctggttctgcatctgtggcactatcgtacgatattcctcgtatatcccaatatgtcgacatgattaacgtaatgacatacgatttacacggttcttgggatggagtattgggacataatgcacccttgtatgcatcttccgttgacaccactgcggcgagtaaacaactcaacgttgatgctgctatttcaaactggattgctcaaggcgctgatccccaaaaaatcaaccttggtgtacctttgtatggaagaactttcacaatcaccagtagcaccaacgtcgctgtaggagcagtttctagcggagcaggtatttcaggtccctacacattggaagctggatatttaggatataatgaaattgttgaaaaagaattacaaggaggatggacctatgtctgggacaatgaacagcaagttccccatatgtacaaaggagaccaatgggtaggatttgatgatccaaaagccgtacaagttaaaaccaaatatgcacaagataaaggacttggtggtgttatggcttgggctatcgaaacagatgatttccaaggattatctggagttaaaaatccactcttaagagctattaatgaacaattggcaacatcttcaaacgctgctgctgaaacaaatgaaattgcagctgcagctgcggaatcctcagcttccgctgcagaatcttcggcttcagctgcagaatcatcagcttccgctgcagagtcgtcagcttcggctgcagaatcctcagcttctaacacaaacagtgaggctgcttcaaatacctcaaacaatgaagccgcgtcaaattcaaaagttcagaacagtgtgtgctctaaggctggatatgttagggatcccagcgattgctccaaattctactattgcgctgctaataccagtggtgttttagttggtgttcaaatgtcatgttacggtggtctttattttgatactaacagtaacgtatgtaactggaaggcgttagttactaactgtaactaatagaagaaatcattgtacttttaaagttttcctttgttggacagatggtgatagtaaaacacttaaaagctttatgcaaaatatatttttgtgaacttttataatgtacgttaaaaaatatagaacttaaacgctaggctactttttc

SEQ ID NO: 3674 - DNA, 902 bp, Diabrotica virgifera
ctcaacaagcaatttaaagaaagcaacatgatctctaagactttaacaacacttcttctagtcacctacgtagtagctgttgaggacattccaacgtcgtatgctaattataatgattaccataacacggtaaagcacatccaatctgcatatgcaaagaaagctgaaccagttcaatacgcctatgcccagccacagcagtactcaaagccagaagcgccctccaaagcgtattcaagtcattcgtctggctatgccacgcaaccactacttaccctacagtccaacccagcacctgccataaaatacacccattcacaagtaccctcccaagaacgagactacactgttggcttaggtgcatacggacaacaagcatcttctttaggtggctacgaacagtactcagcagatttgagttcacataatgttcagtacgctgttccagctcaagccgttcagtactcagcacccaagcagcagattcttcagtacgcagcacctcaacagcctcaatacagtggacataaatatgaagaagaaaatacccaccccaaatacgaattttcctacggagtagaagaccaccactctggagatatccactcccacaaagaatctcgtgatggtgacgttacacaaggagaatactccctccatgaagctgacggcacagtcagaactgtcaaataccgcgtagacaaacatagtggtttccaagcagtagttgaaaagtctggccatcctcaacaacaagctcaccaagcgaagaacgcgtattattaattgttggtgttagagatctcacaaacgcagaattaactaattttaaagggttgtttttattttgtgtatatgtatttatgctttaaaataataaaatttgccaaagtaagtgtttc

SEQ ID NO: 3675 - DNA, 1095 bp, Diabrotica virgifera
  misc_feature (913)..(913): n is a, c, g, or t
  misc_feature (1012)..(1012): n is a, c, g, or t
  misc_feature (1019)..(1019): n is a, c, g, or t
caaagatattccggttggtactgtggttggtacgctgacaaaaacaaacttggtttctttttcttgattattaattattattaaccttaaaatatattttaaaggaaataaaagcattaattttattgcatgaagattatatagttttttgaaataatctgtgtaaatatggccacagaagttttaagaaaatcaccccaaaaatccaaggagccggaaaatggagccgaaccttttgctcctattacgaaaaagggtattctcacctcatttctgactggtaaacaaatgaacattcctgaggccgacttgttggggcgttgcagattcgtttcagaatttgataaattaaatagaattggggaaggaacttacggaatcgtttatagagcaaaggaccaatcatctgacaaaattgttgctcttaagaaggtgagaatggacctagagagagatggtattccaatcagtagtttaagggaaatacaagtgttgttgaactgccagcatgaaaatattgttcatcttaaggaagtagttgtaggacgcagtttagaaagcatttttttggttatggaatactgcgaacaagatttggcttcattattagacaacatgcagactccatttactgaatctcaagtaaaatgtattatgctgcaagtattacggggattaaagtatttacaccataattttgtggtccatagagatttaaaggtttccaatttgcttatgacagacaagggctgtgttaaaatagctgattttggtcttgcaagatggtttggagtgcctttaaagccaatgactccccatgttgttactctgtggtacagagcaccagaactattgctccaagctccaacacaaactaccagtgttgatatgtgggcagctggttgtatcttgngagagttgctaggacataaacctctattgccaggacgatcagaaattcaacagttagagctcattgtagatttgctaggtacaccatctgatgcaattntggcagnatttagtcaattgccagctcttcaaaactacaccttaaaacaacaaccgtacaataattttgaaagcaagggtttc

SEQ ID NO: 3676 - DNA, 1318 bp, Diabrotica virgifera
gattcattgatatggaagctcctccgatattagcttctgtagaaagtgaattaaagaagtacattttatccccagaaaacttaccaatccatcagtatgaaaaaaatcagaaattttggtctcgtgagccaatacccaaagaattactatggtttgaagagtctccttcaattaccacactccaagttcaaagagatccaaacagtggccaaatcatggattttaaagaagtctccctccaatcagcaggggctacagcaaaaaattcgatgtcattaaatagagctccagcccctccatctgaagcaactaggggcagtgcttcattcaagccattttggccgggtagttttccagctccagagtcctatgagaacgaacaaactctttgtgaatctgaaccattacttactgtaccacctggatttgacagagggcttacattcggtaaagataataggaccttacgtactgaagatgaaacgttagatgaaattcaagaaatcaaaaatgattcaccaaatgtagttaatttacttaaaactgttctaaaagaagaagaactattgggagcatttgaatctgaatacgccgttgaatcaaattctaagacagttgaggaattattaccagaagaagaagaaattatgtctaaagagaccccagtattaattataagtaaaactgttccaaaaaacttatatacacatggtagtgaatgggcaattttacttgatacatccgaacctgtaactgattttaaggaaaggataccagaaatggctattgaatatcctttcgagttggacacatttcagaagctagcaattttgcagctggaacagcataatcatgtatttgtagcagctcacacttccgcgggaaaaacagttgtagcagaatatgctatagctctttctcagaagcacatgacgaagtcaatctacacttcacccattaaagcactttctaatcagaaatacagagactttaaggaaaagtttaatgatgttggacttattactggagattttcaaattaaccaaaaagcatcttgtcttattatgacaactgaaattttacgatctatgctctactgtggaagtgatattactagggacttggaatatgttatttttgatgaggtgcattacataaacgacagagaacgaggacacgtatgggaacaagttcttataatgcttccggcacaagtatgtgtggtcttgcttagcgccacagtaccgaaaaacatcgaatttgcggattgggtaggcagcaaccatctcccacaagttatgtagtgtcgacacatcaa

SEQ ID NO: 3677 - DNA, 416 bp, Diabrotica virgifera
  misc_feature (299)..(299): n is a, c, g, or t
attatagctcaaccgacttacaaggtattttatcgattacctcgtatctcgataaccgaattaaagggtgttttatcgattttgcccatttatttcagggcccataacttaagaaccccttgtatattttttttgatagtaatttggtacacataatatgtcacatttagaactcgaaccatccaactactaatcacaagaaaaatccaggtccggattaaacaaaattataaatccattgtgaccttgaaacagcatcctgtatgttgaaattttcaaaacccgtttgcacatttganaagagctttaatggagcttttaatttttgcgcagacaactcaatgactttgattttgaaattatgtcgaaatttttaagaactcaaacattcgaaacaaaaatttcgatataatttt

SEQ ID NO: 3678 - DNA, 1020 bp, Diabrotica virgifera
ggttataaaactcataaaattactgttttgaatgaaatttattgtccacgttttcttttctagtctagttttagtttccacccagtgagatataaacaggaatctgtgatttgggtactttgtaaattatttagcattaataataaactagataaaatgtctaaagtaaatcatacattgcccccaaaatatggacttaagttaagtttagattatgtttatccagagaagaggactcagaactatacacctagtctaagagttatttggaatatgttacctcttatattaaggtatttattgtattatataaagtcaaagtggaaaggccataaggttgttatggattacatttccccaagaaaaccggaacaaatttatggtgttccaattggtggtattggttgtggcactataggacgaggttacaaaggacagttttgtagatttcagctgaaaccaggaatttacgaatggaacacagttgacgccgatgattttcttgtagttattaaagatgaaaacggttttacgctatttgagagctggatctctacatatcagaaaaggagtttatcttcttgtattagtaaaattcccgaatacaaaattaaatatactggcttataccccagatcatggacagaatatgatctgactgaatttaatggtatatctgtcggaattaaacttacatgtagacagattagtcctgttattccacacaactataaggatagtgccttaccttgtgctgtatttgtatggacagtggagaatgtttgcagtagtgatagaactgtgacaattgctttcactttcgaaaatggaacaggcagtaaagatgataaaaaatctgcttgtagttccaaattattttcatatgagaataccgaaggtgtgatcctataccacatgataaataaatgccttgtgcttatgccctcgcagcgaaaaccaaccaagatgtatcgatatcgaaatgtttatattttgatcctaatcccaacggatttgatg

SEQ ID NO: 3679 - DNA, 2183 bp, Diabrotica virgifera
gtgaaaggataagcatggtctacttaaattattaacctccatatggtttgttgaatgatatcgcgctaagcaaaactttttgcttttactttattttttttgctgcgtatggtcacaagtaaatctgccacatatctaaataatgaaatcataaaacaaggagatgctgttcgcaagttaaaggagcaaaaagcagcgaaggctgatattgacacggccgtaaaagtattattgacattaaaagctgaatataaagctgtagctaatactgactggaaacctggttgtgtacctcctacagcttcagtttctaagaacgattctgctattggtgacgagatcaatgcgaaaatcgcagcccagggcgaaaaggtgcgacagctaaaatcacaaaaagccgacaaagcagcagtagaggccgaagtgaggcaattgttatcattaaaagctgagtacaagtctgctactggaaaagattggactccaagtcaggcatcttctaccaacaaaattacaaatcagacatcttctactaccaaaccaaaacaagaaaacgtgtccttagacgaaaattcaattctccagcaaatagctctacaaggtgagaaagttagaaccttaaaatctcaaaaggccgataaatcaactgtcgaccacgaagtcaaggcgctgttatctctaaaggctgattataagacattaactggtaaagattggaagcctggagcagttgcggcgccaccatctctaaatacctcaacttcttccgcttcagcgaatgtaacggtggatgaaaatagtctacttttagacatttcttcacagggcgacgttgtaagaaaacttaagtcagaaaaagctgataagtcccaagttgacgttgaagtaaaaaaactgctcaatttaaaagaaaactttaagaatttaactggcaaagattggaaacccaatatgaaacctgaaccagcagtacccaacaaccaaaacgtcagtgctggaggtgataacgccaaggaagtattaaccgctaagattactgatcaaggcaatctggttcgagatttaaaaacacaaaaagctgataaggaaaaagtagatgccgctgtaaaaatactcttagcccttaaggttgaatataaaaatctaacaggtacagattttcctgtagcgggcagaaccccaaaagaaaccaaacctgcggcacctaaggaaaaagtagtaaagcaaaaaccagcagcaaaagagaaaaaacctgaggttgttgaggccaacgatagtggtgctaaaaaacaaactagacttggtctggaagcgaaaaaagaagaacaattgtctgactggtactctcaagttatcacgaaaggagaactaatagaatattatgatgtttccggatgttacatctttagaccatggtcattcgcgatatgggaagctatcaaagattggttcgatggcgaaattaagaaactaggtgttcaaaactgctatttcccaatatttgtttccaaagctgctttagaaaaggagaagacccatattgaagacttcgccccagaggtggcatgggttaccaaatcgggtgactctgatatggcagaacctattgcagttagaccaacttctgaaactgtaatgtatcctgcatatgcgaaatggattcagtcatatcgtgaccttcctattaaattgaatcaatggaacaatgttgttagatgggaattcaaacatcctcaacctttcttaagaactagagaatttttgtggcaagagggtcatacagcttttgctttggaagaagaagccgatgtagaagttagacaaattttagatttatatgcaagagtatacaccgatttactagccataccagtggttaaaggtagaaaaacagaaaaggaaaaattcgctggtggagactacactttaacagtcgaagcctatgtttcagctagcggaagagctattcaaggagccacgtcgcatcatctaggtcaaaaacttttcaagatgttcgatattacgtacgaacatccagatagtcaggagaagactcatgtataccagaatttcttgggtattacaacgcgaacaatttggtgtggtggtgatgattcacggcgacaatcaaaggttgggtatacccccacgagtggcagctatacaaattgtcatcgtaccat

SEQ ID NO: 3680 - DNA, 1205 bp, Diabrotica virgifera
ctaagctaaaattaatcgtgaagtgaaatccattttaagaaaaaaatggtttaataagaataatttatacaaaagtgatatttatatattttcgttgacgcgttgaggatactgtgaaatatatcaaatagtgtcaacatttgaacaaatgactatatatgtgtaaaagactgtagtgatcaccagatccaaaaaagggtgtcttcaagaaatgtgttaaacccatgaatctttagaaaagagttaaattgaagatatgagtggccgaccaagaactacttcttttgcagagggcaacaagcaagctaagaatccacctttagggggtatgaaaatcagcaataaaatataaaatggcgtcgaaaagtaaaagaggaaaaagtaaagaaatggaagatgatattagtaaacttgtatctacactcaaagttaggccaggtaaggatggaagcaaagtgactacagtagttgcgacgcccggccaaggaccagacagacctcaggaggtatcatacactgacaccaaagttatcggcaatggcagcttcggtgtggtctatcaggcgaaattgtgcgaaacttcagaattggtagcgattaagaaagtactgcaggacaaacggtttaagaatcgggagttacaaatcatgcgaaaattagaacattgtaatatagtgaaacttaaatatttcttttactctagtggagataagaaagacgaggtgtacctgaatttggttttggaatacatccctgagacggtatataaaagtgcacgacactacagcaaatcgaagcaaactataccaattagcttcatcaagttatacatgtaccagttggttcggtcactagcatacattcactctttagggatattgcattaggaacataaaaccgcaaaatttgtttgtagatccagagactggagttttaaattattgtgattttgaaagggcaaaacatctcgtcaaaagggaaaccgaacgtttcttacttttgcagccaatattacaaagcacccaaagttaatatttcggagggatcgactaccccacaaaaaatcaacgaatggaagcgctggggggggtttttgccccaactccctttttgggtcaccccaaattttccccgggaaaatccgggggggaaaaaccaattgggaaaaaaaattttttagggggggggggggccccccccccccc

SEQ ID NO: 3681 - DNA, 2739 bp, Diabrotica virgifera
  misc_feature (1739)..(1739): n is a, c, g, or t
  misc_feature (1747)..(1747): n is a, c, g, or t
cggacgcgtggggcagtcttaaagaacaataaagcattaacgccttattgtcgagttggacacttccctttctagcgaattccaaggagacaataagttttatgaatcagttgatttctaattttgccgatttggcggagcggcgcatgactatttcattctgttgtttaataatatggcaactcaagtatcgaagcacatttctcatgtaatgttgcggttttttgtttgtctttggttataacagtgagtcagtgcccttaagttgttttatcaagcattttttaatcaaataacaacaatgtcgtacggaactttaaacggcaccaccaaagagattcccgaaaatggagacatccaggaaattgaggaggaggaggaagaggaagaaatcatccacttggagtacttcgacgaggccctccaggtccacctgttaaagtctctgaacaggatgaggaaaagtcgccacttctgcgatgttattcttcacgttggcaatacagaagtacacgcccacagatctgttctggccagcatatcgccatatctttttgaactgtttactactgaccaagatcaaaagcggaccgaaaatgtgatcacctacagattgaatggaggttttgatacgacagctttacaaattttgatcgactacgcctacaccggcaagcttcgcgtccactacaataacgtaaaagcagtgttttcgtctgcaaacaacctaaaaatggaacgagtaaccagaatatgtgctcaacatcttatcaaacatctctctgctgagaactgcgttgaaattagatctctgccgggtattgccagaaataaagaatttatccaacaagtggataccttcattgccaaagagtttgcagaaatcagcaaatcttccacagtgctaaatctctattgcgctcggatagaagtcctaaatcaatctcgcgaagaaatgtctctggtaaacgagaactcactctgtagactagttcttgagtggatcaggcgacagatcagcgacgagcacctcctaatatctgatctgtctgaaaagacatttatgttgtacctcgctttagataattctctacaagactgttctagcctcccttcgggcgatattagcgacactgagatggttcaggactacaagaagctctcgttaaaggacaaacagggagtgtcgaaaccaaaaaggaaagtcctcggacaaccttctaaaccacgggtgttaatttataatagggagatcggagaagaattagataatgaaatggaacctgattggaatcttatagcgacaaccgccgtgagtgaacacagctttttgggtttggtcaccttggctggaaagctgtctacactttccatacagttaaagttaaacacaccttctactccttctccggtccaaacaccagatgccagtagatctgctagtgaagacaaacctgatctctattgtgcggtagctaacatgttgtgtcataggtgtgctcatggatgtggtaattacaacaatactctgatagtgtgtggtggttatgataggacagaatgcttaagatctgcagaacaatacattccagaaacgaatacttggaaaaatcttcctccaatgagagaaagccggggtcgtttcaaaattgccgttctagacgacaaaatttatgccataggtggtagtaacgggactacggaattggattctgtggaaatgcttgacttttccgtgnggaagtgngtgaaacttccgaggatgcctctcgcccgaagtaatctgggtgtatgtacgttggacaagaagatatactgtatcggtggttggaatggacaagttggtatcaaacagtgccacgtatacaatccagaaactgccgcttggacctccatagcgtcattgaatgcaggccgatatcaagctggtgtcacagcatacaacaaccttgtatacgccataggaggctcagacgcatggaactgtctgtcgtccgtggaatactacaacccggtagataacacttggcatttatccaagccgatcattacagccagaagaggctgtggattgactgtattcaacaacaagatgtacgtcatcggaggttcggacggctcacattccttgaatacgactgaaatttttgatgacgagacgcagacttggacgttcggaccagccatgacaacttcgagggcaaatatggaggtggcggttgtcggggataggttgtatgccgttgggggattttcaggtaagacattcctgaacacgatagaatacttggacctaaattcgaacgagtggaccacatttgtaccaaaaggtacctgtgaatttctgaacaggaggaaacctaggagtcgcaagaactccagaaagagcatgtcagaggacaagaaatcgttaaactcccccagtacaccatcagacataatggaaaaccccatggtctcccaagcgatccagctatcaatggaagaagcagttattgacaattcgtaaaaaaattagataatatatatcttatattatatctttaatcatcagtatacatctgataggtatatatttaatccagaataagtattatattcatgttgtactgaagaataactcagcttcatcttcattgattatattttttttagaaaatttctaaaatatcaaattgctttccttttaggaaagtatgtagtaattttaagtttttaataaaattgatttattaaggg

SEQ ID NO: 3682 - DNA, 2402 bp, Diabrotica virgifera
attttataaccttttcttattttcccacgtctaaaatccgttgaaaatttgttcatagttcaaaattttctaaaggaatagatcctgactgcgctaatagacctgatattactttttacttcattaaactttatattaaagtatcaaaatgttttggggtcttattatggaaccgcaaaggcggtacttacatgttgttaagaaagcattccacatttcaatggcatcactagacgtaggcacatcatcagacgaaccagcccaagttatgtgcagttttgaaggaagaaactaccttttgtgtactcttagtaaaacagtgttgcaatgtcctttggatttaaattttgaggtcggagatgaaatagcattaaccacaaatggaaagtgtcacatacatctaacaggttatttcgttgaagaagcacaagatttcttaggagaagaggaagaagaggaggaaattgaagaagaagttgaggagaaagaagtcaagaagaagaataaaaaacggaacaaacaagaactaaatgggccttctccgaagaaggtaaaaaaagaacagaaacaagaagaatcagaagatgatgatgatagcgaaatggacgttactgatctccttgaaaataccttggatagtgatgatgatgatgaatcattcaatggagaagaaaatgcagaggaagaagaaagtggtgatggtggtgaagaagaagatgatgatgaggatgaatctggcgatgagcaggaacaagaatcagagtctgatgatgagagtgaggaagaagtagtagaaaacaagaaaaaagcgcaactgaatggccatgttaaaaaacaagaacaacaaacaccaaaacagaaagataagaaaaacaaaaaacagcaacaaaataaagaagaaaaaagttcaccaactaaagaaaaccagtcccccaaaaaagattcaccaaagaaagttgttcaaggtggaatgattattgaggatttaaaggaaggacaaggtcaaccagctaaaaatggcagatttgttcatgtatactatgaaggaagactgaagaacaataacaagatgtttgattcacataagcaaggccaaggttttgcttttaaactaggttctggtgaagtaataaaaggatgggatgtgggactagtgggaatgaaagttggaggaaagaggcgaattacttgtcctccccagatggcatacggtgttaaaggatcccctccagccattccaggaaattcgacacttgtttttgaagtggaattaaagaaaattcgttgatttgcataatgcatgcatacttctgttttttatacaatacttgtttaatataagaaaccagttaaacggaacttttttccaattttgcagagcgggtctaaaatcgaatgaaattattttcatgtttgttaattggtattttgtacattttgattatccggaatccgaattttacgagaaaagaacaggtttcttttggcacgttaataaactttgttattattccactcaagtttgtttactctttttaacggttattcctagtgtgtatcttttcttgtttagtttatttagttaacagacataaatattgaggatacacgatatgaaaagtacagaagtacaaaaatgtgttcgaaagatacacagaaggataaaatatttttatatcattggttttataacaaggtttagcattgtatggattaatcacagatgcttaaaagtgtaggtactacagttcgccaaaatatattcaaaaattatgtttgaaataatttgataacaaataatctataaaaattatgatcttactacttgataattagttcacaaacgataaaaatgttccaattacggatatcgacgccgtaattagagcagatgaggtcaagcacttatctcaataagtataatattttccattcttacaatgttactattgtaacatacaactaatttttgtattgaatatttttcattacttgtatattatttggcaagttttgatttaggtccaatttgtgaagttaaaattaataatttacaatatattatttatttgaaagacttttgtattttttaataattatattttaattgtccgtaagaagtatttcttacgctataaaaattacatatatctcaaaagtgtatctcaaaaaggtttcttttggcacattatgaaactttgttattattccactaaattttgtttactcttacggtaattcctagtgtgtatctttcttacttagttatgacgcatctatttttaaaatcgttaaggttaatcaatttccagtgtatttcctcgatattcatgttgccattttttcaataaatgtattttttaataaaaaaaaaaaaaaagggcggccgctcgcgatctaga

SEQ ID NO: 3683 - DNA, 778 bp, Diabrotica virgifera
aaaatagataagatatcgattgacgggatcgtttagtcaatcttacaaataggtacatctttaagtaagtatcatcaacatggcgaacttattgggaacaataattttatttggattttttgcactggggtttgcaactcaagaactaatatcctgttacgattgcaagccaagtgcagacaaacctgatgaatgtgtttatccagaaaagaatcttgctcccgttagtaactgccaaccaccgtcaaatggaacggcggtgtgcgtttcgtcttacgttcaaaatataaatgctgctagaactggagtctaccgaggctgctttaacataacagcagaaataggcaacgcgtgtgatttgtttgtagaagaactctcgtctaatacatcaacaattaaattttgtcgatcatgtactacagatagatgcaacacagattatttgaatgaaaaaggtgcagccaattataattacaacctggaatctttaataatcattaacatactagcgatattggttgctagtatttggaaataatatttaaagttacatagaaccagttgtagcctgtgttggataagagtacttgtatcttttgattaataactagagttaaggataaattataaattacaatgttttatatttttttgtattcaatttttaatattttttaataattgctaaaattggattaaaaattttataatgggttaaaacaaatatttaaaaaatatatcatttggaacatcaaaattgaataaataactgtttgta

SEQ ID NO: 3684 - DNA, 1324 bp, Diabrotica virgifera
agtgattctaaccataacttcaaaacgctttagttttaaatatttgtgaacattaataacagaaacagttcattcaaaataatctataagaatgggcgatacaaaggtagaacctacaaaggtggataaaacaaaggggactgaggacaaaaacaaaaatgaactgtcggaagaagacaaacagcttcaagatgaattaaatttgtgtgttgagaaactccaggataacgatgaaaagagatacctacttgctttgcaagctttatcaaatcatattcaagcctcaactacttcgatgacttctgttcctaagccgttaaaatttatgaggccccattacgaaaccatgaagacagtacatgaaaaaattactgatcctgatactaaaaaagtctgtgcagatattatatctgttttagctatgacaatgggagaaggcagagaatgtttgaaataccgtcttctttctaatttggataaaattggcgaatggggacatgaatatgttaggcatttggcaggagagattgcaggagaatgggccgagactgattttatagtgaacactgaaattagggaaaaacttatcttactaacaaaacaaattgtgccatataatatggcacacaatgcagaagcagaagcatgtgacttgcttatggaaattgaaaggcttgatctactagaacagtatgttgatgaaaacatctaccatagagtgtgcttatatctcaccagctgtgtaccctatgtggcagatcctgagaatactactctactgcagactgctcttttactgtttagaaagtttgatcagtatccccaggcactgagattagcaatgcagttaaatgactttggattaattgaagaaatttttgtcaactgcccagattcggacgtacaaaaacaactggcatttatgctaggacgacaacagatatatgttgaaattcctgagcatacgcctgaatacgaagatctaatcgagataatggcaaactgtcatcttaataaccacttcttgaacctcgctcgcgagttggacattatggatcctaaaacccccgaagacgtttacaaatcccatttaaaaaatagtcgtcctccatttggtggaaacccagttgattccagcccgaacaaaactttagctgccagctttgttaacgggttttggtaaagggtggtttttggccaaaaaaagccccttaatgggaaaaaggggaaaaaatgggggttttacaaaaaaaaaaaaacatggaagggcttaggggcaccggctttttttggggactaattttttttttggggatgggaaacg

SEQ ID NO: 3685 - DNA, 1140 bp, Diabrotica virgifera
  misc_feature (1030)..(1030): n is a, c, g, or t
ccatattacttgtgacgatgatcgtccggttttcggctctagctctctgtctattatcctatgtttgggaaatataacaagccagtatatttatttttggcagtatgtatgttattcttgcaggtattgttggttgttgtctttgcctatcgagttgtcaatacccattgtaatcaaattagctatgatatattagacgaattttttgaataagcgaaaattttagtttaacataatgttcatcagataaggtaactatagtttctgttttttcttagaaatggaagatttatcatatcgttctatattaccagacagacagaactgttgactatttttaagctccgctcaagttgttaataaatctaatatatttaaaaatgaaaataggatataaatcgaaatttttacctctaaaatctgtgttttttcttgattacgtgattggaatgtctgcaaggtattacgttatataacaatatagaattattttttaatcgattattttatacttgacaaatgtgattctactattagtcagtaagtatttttttaaagttaggttctcgatgcatttacaatagttatataaaagtttcgtattaatttattatagtttcgaggtaatacatctatgtaagttcactgtttctagtctgttttctctattacacaggatgactcgatacctaacactatgcctccattcaccaaaaaaatcaaaatttaaacattttaattaatataattgaaacatattaacgactatatttaatgatacagtaattaaaaatggatttagctgacttttctgaagtcttgtatacatgcattcttcaaataaattattttaaccaaattttaatctcttatcccgaaattttgaggaactttctgggttgcattttctttgttcaagtcgttgtttttctgtgggaaagaaaaaggacgtcatacagctctcattagaatcacgggaacattttaataatgatattttataatatttatttgatacttactactttanagaaatagattctttcagagtgtaatatcaaattttggacatccattttagtgattttgtacgatccctttgtcacattagcccagtcataatttattatacgaatgggc

SEQ ID NO: 3686 - DNA, 1086 bp, Diabrotica virgifera
cattttgtgtctttttatttacaaagttaaactatggcttatctaagattgttggttttttgtgctattatttattttgccaaaacaggagttacttcaccagcagatggatctactaatgatgatttaatagttacattatctacaggaagtaaagtacgagggcatgtacttcaaagttttgaagggagtgacttccatgcttttgagaatataccatatgcagaacctcccactggcaagagaaggtttcagccacccataccaaaaacaccatgggaaggaatatttaatgcaacttctaccaataaagtttgtcctcagtatggttatgatactgctgaagaggactgtcttgttgtaaatgtgtataggccagtgaaatctaatcatcaagagttattacctgtatttttctggatatacggaggaggtttcactaatggacttggtagtctctatgatcccaaattttttattgattatgatattgttattgtaacatttaactatagggtaggagctttaggtttcttaaccacaatcgatgataatattcctggaaacttgggtcttaaggatcaacttcttgctcttcaatgggtacacgacaacattaatgtctttgggggcgatcccaaacaagttacagtaggaggtgaaagtgctggaagtatgtctgctggattccatttgctcagcaaattagcccgtggtttatatagtggaataatccaacaaagtggttcaccattatattcaggcttctatccatcaaataatcgagaaaaggcatttgagtttggaagacagttaaatagttcgttcacttctagtaaatcgagtgatttattaacactattacaagaagtaccgctctcagaaataatgaagcatcaatcaacgcaacctatgtcatgggctccagtcatggaggaaaaaactcacgataatgttttttgtagtggacccatgtacagcagcgttctcaacggggaaattaaattttgttccatccttattgtggggattaatttctgaaaaaaattttgttgtttggtggtaattaaaaggggaatgattttt

SEQ ID NO: 3687 - DNA, 1202 bp, Diabrotica virgifera
gcgtcaattataaaatcaagcaatggcacatctaaaattatttattcattgtgtacttatattttttgtccatgaagggctaacttctcctgtggctgaatcgactgatgatgacttaatcgtaacattgtctacagggagcaaagtccgcggacatgtccttcagagttttgaagggaatgatttccaagcatttgaaaatattccatatgcagaacctcctactggaaagaacagatttcagcccgctattccaaaaacaccatgggaaggagtatttaatgcaacttttgcatataaattctgtccacagtttggtgtagttgcagctgtagaggattgtcttgttttaaatgtatataaaccagtgaatgctaatgatcaacagctattgcctgtatttttctggattcacggagggagtttcataaatggagctggtagtctctatgatcctaaattattgattgattatgatattgtaattgttacgattaactacaggctgggagcattaggatttttaacaacccttgatgataatattcctggaaacttgggtcttaaggatcaacttcttgctcttcagtgggtacacgataacattaatgcctttggaggcgatcccaagcaagttacagtaggtggtgaaagtgctggaagcatgtctgctggatttcatttgcttagcagattagcacatggtttatatagcggaatcatccaacaaagtggctcaccgttgagttcggctttctatccaaacaaaaatcgtgagcaggcttttgaatttggaagaaaattaaatagttcctttgcttctagtaaatctagtgatttattgaaactgttacaagaagcaccattgtcagatatagtgactcagcaggcattgtcacccactgcatgtattccaactatggaaaaaaaatttaacgacaaagcttttgttagtggggcaatgcagcaaaaaaacccttctcccagggggaaaattcaattttttttccttgttttaaaaaagataaaaattcccaagaaaaattccggggtgtgtttggggggggcaacaaggggagccattttttaaaaaaaaaagagcaaaatattttttaaacaaaatccaccaaaaaaaagcgggccccctcgcccttttctcttgtgaatatagaaaaaaaaaaaaaaaaaaaaatatgttttgg

SEQ ID NO: 3688 - DNA, 1629 bp, Diabrotica virgifera
ctgagacacatgtacgagttagctttttgcccaacgttagtggaggaaaggacaacactttaaacaaaatcgttctatccgctttacaggaattgccgtcagaaaaagcattgcctctggttatatcattgttaaaggatgatgctgctgctacaaaattataaaatggagaaaaactggatcttcctgattgaagtctagttccaatatattaatgacccgaggagactcaatttgaaaaatgttaaggatttattgtcaaagagtactacagcatgaaagaaagtcgaaggtcagtcatagctaatggaagaggtcttggacctctggaggaaaatgaggagtttacttctgaagattttagtcttttatatagatttagctcttctacgtattgggagaaaattaaggctgctttggataaaaattctgatgacgaagatgatatttccagcaactcattaatgaaattaatatctctgcttatcgcaagacctcagagtagatcccggttcgaaattaacttctctggcgacgaacattcagtaataaagattcctccagctcatcccgaccgagtagccttcgatattgccgcaatcgtcgatcccgtttcgagaggtgcccaaaagttgggtcccattttacaggtgctgcaggaagttttgaactgcagaattagagtatttttgaacagcgtggaaaagaatagtgacatgccggttaaaagtttttaccgatttgtattggaaccggaaatacaatttggagaagatgggaagcaattaccaggtccaattgcaaggtttaacaacatgcctacctctccactgttgacccaaaactatcacgttcctgaaaattggttggtagaagtagtaagatcagtatatgatttggataacattcgattagaaaatgtggaaagcaatgtccacagtgaatatgaacttgaatatttactgctagaaggtcactgtttcgaacaaagctcaggcagtcctccacgaggcctgcaaataaccctgggtaccgaaagtcagcctgtgatcgtagatactattgttatggctaatttgggctacttccaacttaaagctaatcctggtgcttggcttctaagattacgacaaggtagaagtgctgacatatatgacattgttagtcatgaaggaagcgatactccagagaattcgactgacatcaaggtacttattagttctttaagatcacatatcgttaaattaagagtacaaaagaagccagataaagcaaatgtagatttattatcagacgatgataataataacggtatttggagttccataactagctctttcaaaggcagcgaggacgagagtgacgaaaaattaaatatattctctttggcttctggtcacttatatgaaaggttcctgagaattatgatgttgtcagtgttaaaacacacaaagagacctgttaaattttggtttttaaagaattatctctctccacaagttaaggatttccttccatacatggcgaaagaatatggcttcgaatatgaattagtacaatacaaatgggcctagatgggtacatcaacaaactgaaaaacagagaaattattttggggttacaaaatat

SEQ ID NO: 3689 - DNA, 1210 bp, Diabrotica virgifera
gtaatttttcataaatatcctaatcgcttaagatggtctgatctctgtacattttaagatatgtatataatagtagtacgatataaaatcaactgaagaacgttaccgtcattttttgaatataattctttgttatagactgagagcccgtgacagccagaagcaccttagagtatgaaattctagattttctgtgaagtgtgtatatccttaataataaaaatgtttttggactataaatgttgactaaaaattacatacgggtaagtgacgtatccaaaaatgttcgttttttacacgagataacttaattaagcctgtattaaatgtcatattttataacctttaaaacaaatgtaagaaacattgcgaaaattggagatatcaaataatattagtaaaaatgctacgaaaaactgcaagttcactaatgttgaccacctgtaaactgctttatttatagaattagaaaaaaatgtaaaatacaaaagttacacgattttttgtgtaattttcgaaaatgatagtggaaaaaaaaagaaggttaaaatagaatggccacagatgtttactttgttagtttaaatgaaacactctgtataaggttacacatttgagtagaacgttctgtaacgaacatttttatattgaatttggagggcctgtctggaaaaataggcgagatactggatattttgaacgtatctcagtcgtgatggtgggctatgagagtgataggaatatcatgacaacaatgatatttttttacaatttataatatttaattagaatgggttacacggaagctgaaaagtttaaaatattataggtaataaataaattactgtagggaatggaacagttataaattatagtaggggagaaaagaatgctaatttgcagtcactcaagcgctttggggggcttattgggttggggtattaggtcctaaaaccaaaaaaagttaaataaaaattttccattttagggaggactttcctttttttaattaattttcctttcccaaaattttttttttcattaaacccccttctttccatatttaaaaaaaggtttccaaaaaaaagtggtttttttttaccaaaaagaaatccaaatctaaaaaaaaaaaaggggggggtccctcattgaaaaattttataaaaacccccccccccccccccccgcgggggggggggggggggctttt

SEQ ID NO: 3690 - DNA, 1457 bp, Diabrotica virgifera
cccttgacgtcctattaattgttacacatattcgattcgattgtttttgttcaaagtgaataatacaatagatacagctgtaaaacatggtagatgctgaggaaaaaaagagatacaatgtgctggaaaacgtgcttaaagatataaatcaaaaatacatttcgtttcctgaagaaatgaggaaaagaaacaataaaattcttcttgagcttttggacgccttaattccaaaaatgaaggaaaagaatactctttttaagcaactgtatttcaccacattttttggaggtagcttctatgatggcttaagagtcggcgcaccagacgaattcgatttggatttgcttatgactctgccaaagatgcttaacatagatttaaatgttagtaacattccaggcttcgttcatgtgaagataactaaccttttagaacttttcaatcaacctcacttaaaggaacgctttaacggtttggaaaaattagtagataaccaacaccatcttgataatctgaaggttcgtcagtggatggaacgtatagtgacgctgaccataaacgattttccccaagagaagggctcccatgtcataaacattaaaagtggcaagtttttggcgaaatttagcaaagcaggtccagcctttacactgaaagtaaatggacgagtcggaaaggataatgtcgttttagacatagacttggtaccctgttttagatttgcgcaagataaatggcctaagagtccgttcagacccaatccaactccagcaaagtcaaccttcttcattgtgcccaaaccacagaagaacggaaatctggtaggcgaacactattggaggttgtcgttcccagagcaggaaagagaactaattgacaaaaagcagtatttgaaaccatctatcaagtttttaaagaaaaatgagggatacctctaaccccgcctgcatagctagttactacctccaaactattagcactgtgggaaaaggagaaaagacccgaagccttctggtcaagctctttacgttatgtattcctgacactccctaaaacctactacgaaagtattaaaaatgggaaagatttttttattacctggaataaaaacaaaaaccttatcatgggcgcctccgccccaccattaactaaaggttgaaaaaaaattgaagaaattaaaaaaggccattgaaaaaaatttttgccggccgatccctaaccgtgttttgcaaaaaaaattttttgtgccgccccggaaaacccctccgaattttaaaaagtgccaaaaatgtaaaagggaagagggtagggtgggacccaaaaaaaattcattaaaaaaaagcattaaaagggaaaatttttttttttttatctttttgtctctggaaaaattttttaaaaaaataaaaaaaaaatgggggaaattgtccacaaaaaaaaacaaaaaaaaagggggg

SEQ ID NO: 3691 - DNA, 928 bp, Diabrotica virgifera
gaaccagggaagagtgagaatataatcgcggcagacggcaacaacgtttgagcgtttgctcggctattgtcatttttactaaaaataaatcccggcattgataaaaatctcgatttggcatttcggctgcaaaaagtctcaggtgcttaactggaatcattcaaagaagaggaaaaggtcttcctaagagcagacaatgctaccagttgtatcctgcaacttctgaaactttaaagacttcgaaaaggctgtgtttttcattaagtagtattacctggactgttattgatgatcggtcacgggaatatcatttactgtagtcaatacaaaaaccaacaaatcggtaaagatccaaggcaacgactccagagctggtccaagcggtggatgcaaaataaaaaccagatacactttatattgtatacgataccaatcaattgaatagctgtatatttttttaatatggagagtccgaccaaggaagcaccactagcaacactatcaggtgtagctccatcactagaatctagcccgaagaaaagcgaagagctgatcctgatcaatccatacgaaaaaccagaagtcacgttcaaaaccgacagtctttgctcgtcttcgtcttcatcatcctccgcttcagagtctggagatgaggctgcgaaaccaaaaattcctgacggagggtgggggtgggttggtagtgttttcatcactcttagtctcgatgatagcagatggagttagtttatcgttcggcctactattctcagagttcctcatagagttcaaagcttctagttccgatactgcttggatcggtagtttattcttggctgttcctttaatttcagggcctattatgagcgccttagtggataagtatggatgcagaatgatgacctgtgtaagcggcactattgctgccgct

SEQ ID NO: 3692 - DNA, 1525 bp, Diabrotica virgifera
gagcgctaaacatttttcattcttcaaaaaccgattttaataacagtattataaaacttttccagtaaatattccagaaccgcgttgttaatatcttgcagtagccgtagtaaattaaaatttgatccaatggcctctccggtagatatttcaccgaataaagacggaggtgtgttgaaagaaatactccaggaaggtactggagaggaactaccaccccaaggaagcaaagttacagtacactatactggtaccttaactgatggaaccaaattcgattctagcagggacagaaatgacccattccaattcgatttgggaaaaggtaatgtaatcaaagcatgggatattggtgtagctaccatgaagaaaggggagcgggccatgttgacatgtgcccctcaatatgcttatggtgaaagtggcagtcctccgactattcctccaaattctactctcaaatttgatgttgaagtattaagctggaaaggagaagatttgagtccgaatagagatggaggcatagagagaatccaaatcactgctggcgaaggatattcgactcctaatgatggggctcaagttgaagttcatctcattggaaaacacgacggtaggatttttgatgagagggatgcagcttttgctgttggagaagcatcagaagctaatgtaatctcagccattgacatagcgatacaaaaattcaagaaaaacgagacctctagacttattgttcatcctaaatatgcctttggagctaatgcttcacaagaattcaacattccagctaatgctacagtagagtatacagttacactaagaaacttcgagaaattaaaagaaagctggtcacttgattccgaagaaaaaattcaacaatgcaaattgtttaaggaaaaaggaacaaactactttaaaaatgggaagtatgaatctgccgtgaagttgtacaagaggatacatagttatttggagaaggatactgatactgacactcaagaagacagaaatgccttgctactagctgcacatttaaacatcgccctatgtcaattgaaacttaaagagtacttttgaagctcgctcagctgctacctctgcctttaatatcgatcccgaccacgaaaaagctctctttagaccgagaacagcatacatttcatttgcaagagcccgaaatgggccaggcaagactttaccagggggttagagatagaatccgaaaaaacaccagctgcgaaaatctccacttaaccactttggttccaaaaacgtttgaagggaaaaactacccaaaaaaaaaaaaaaaatttacccccaaaattgtctcaaaaaattcccccaaaaatggaaaaccccaggggggaaaaaaccaattaaaaataatacccctttttttcttggggtggttattttggaaaaaaatttttcttttttttggtctccttcccaaaaaaaaataaagaaaaaaaaaagataataaaaaaaaaaaaaaaaaaaaaaagaagaggggggggggggg

SEQ ID NO: 3693 - DNA, 1230 bp, Diabrotica virgifera
gcaccagctccaaaagctcaacccaaaccttggttatcctatgctgctcccgtcgcttacgcaggagttccagcttactctgcatactcttatagcgctccattagcttactctgcatactctgctccagtagcataccctggagtagtaggatacagcggatggggtggatggcccgtagtgtactaaagagattttaatctgtgttaatgataagagcttgtaaatttgtaaaaataaaaattgttttttaaaaaaaaaaaaaaagggcggccgctcgcgatctagaactagtccgacaatgaacatgaactaccaaatgtggcatgtggtatgcgtgctcttcactacaagtgtgcttcaaggttgtgttctcgcggattactggtcagatcgagaggatttgattgagaatgataggagctacggtttgggagcaacccttaagcttacagagaaggaacagagggtgaacaatgttcttatgaagtacaaactctcggagtatgatgctggattggaagatctggatacgtttctggccgctcaacattactttaaggtgaaggataagattcagtattcgaaagtgtttgatataataaagaggattcctaaaggtgcgtctctgcattcgcatgatgaagctcttgtgtcagaagactatttattcagcttaaccttcagagacaatctttatggttgtatagatggagatgacttcaagttatacttctttcaaaagaataacatcagcgattcgtgtaactggaaattgctcagtgacataagaaaatctgatgccaggtttaaccgttttttgaaaacaaaattgacgataatcacagatgatccagagaagagctatcctgacataaacaaagtctggaaaacttttcaggcgattttcaaatcgattaatggcttaataacatacaaaccagtatttgaagattacttctacatggcacttaaagaactttacaacgataacatcaagtacatggaacttcgaggttttcttccgacactatatgacttagaaggaaacatctacagccaagaagaagtggtagggatctactcagacgttttaaagagattccaaagagacttccccgatttttttggcgccaaatttatctatgcccccagtcgacactgcgataactctacaatggatacatttgttgaaacttttaggaaatcaaaaactgtatcctgaatttc

SEQ ID NO: 3694 - DNA, 1128 bp, Diabrotica virgifera
cctttccccacgcgtccggtgagaaagtagaagacagaggtgttaaatagcaataattataaaacagaccatgaagcgtgccatcattttagcactcgctatagctacaacactagcagctccatctgacgtccaaggtccacttcaacaattagcaattggaaatcaacaactaacgtcaaatgtatacaaagaaattcttaaaactaagaatggaagtattatcttcagtcctttttctgctgaaaccgtattagcgctgacctctgaaggagcgaaaggtgacactagaagccagctaatatctgcgctacaccttccagaatcacaagagactatccaacaaggatttaaggaacttttaccacaactgaatatcaataatgagtacgcagtattagcttcagctaataaaatatatgtagccaacggtatcaagctagaagacgattttaaaaagaccgctgaaagcatttacgcatcaggactggaacaagtagatttctcaaacagtgcaaaggcagccaacataattaaccagtgggtggaaagccaaacaaacaaaaaaattaaagatctcattaaacctgagtatattaccagcgacactataatggctttaattaatgcattatatctaagcgctgaatggtctacagtttttcaagattataacactgtaacagataaattctacataacagcttccgaacagatagatcaaccaaccatggcaatgactgaaatatttaaatattctgaaaacaaagacctcgacactcaatttttggaaattccgttcaaagcgaatggtcttgtttttagcgttgctttacccaacaaaaaagatggcatagctgccttagaaaataacattgaaaaagtatttgaacctcagcaatatactcataaacctgtacatttgaggctaccaaaatttaccgttgaaaccgagttgaatttgaaaaccattcttaaatcgttgggtgttcaaaagctcttcaactttgacgctgatcttagtggattggcaaagaacgcccaaagagtacgtgtgtcagagggattcaaaaagaaactttcaagttggttaaagtggcgtcgaagcagcggctcggactccccttt

SEQ ID NO: 3695 - DNA, 1119 bp, Diabrotica virgifera
gggtttaagaagtctttgaatttgttattattgtttggtttgggattagaaatagatctacataaatcacaatgaattctgcgaatgatgaaaagcctcgtgttatattggaagaatataaaacgtccaaaaacttacctacagctcctacagttctgaatgaagttttctcagtcaaaaatttcaagaagaaattcagaatagtcgtagttagaaatgaaaactatgaaatggaattcgatatgattggcattcatccctttctagcaaatacattccgcagattaatgttgagtgatgttccaagcatggctatcgagaaagtttatattcacaataatacttccataattcaagatgaagttttagctcataggttgggactaattccattaaaagctgatgcaaggttatttgagtacaaagaagatagttcagcagcttcaaatgaaaatgattccttagaatatgaacttaagatcaagtgcagttacaataaagaagccaacaagaaggattcatcaagagaggaagatatgtataaaaataataatgtatattccaaacatataaaatgggtaccagttggaaatcagaaagagaggttcaaagaggcagatgtggggcccatcgaaactgatattcttatagcaaaaatgagacctggacatgaactagatttaaaactagtagctgttaaaggagtcggtagagatcatgcaaagttttcacctgtagcgactgcattttacagactaatgcctgacataaaattagtgagggaagtaacaggcgatgctgcttacaaacttccaagctgtttttctccgggagtaatagggatcagaaacaaaaaagatgggcggaaaattgctgttgtcaataatgctagatatgatactggtagtagaaatgtatttagatatgatgatcttaaagatactgtaagtatgacgaagattcaagacattttatatttacgattgaatctgtgggagtatgcaggcagatgtcttttttaaagaagttgtaatacctttaaggaaaaatgttctttattattaaaagaattgaatagtttttaaataatttattataaacattggatttttttttttc

SEQ ID NO: 3696 - DNA, 946 bp, Diabrotica virgifera
cggttcacgcgttgaacatttgattgaacttttcattattaaactgtaatttcttctgtgaggtgttagtgtagtgcataaaaaatgatgtcttcaaagaatctgatgtttaaccggtccagccgagagctgctaaagaatattagaagacacatcagtaaaacatccagcgctccaaatagcgatgccatatccagacaagatcataaacttggggtgaaaaatctggacttaaacggctctgaacaaaagtttgccaacgaaaaatggtctgtccacagcaaacagaacaatataagagctctatccacgattcaaacaaaagcaaaaccgtcagtaaacaacaccccgatgttctcgaaagaggaaagcagagagttcatggctatatttccagatatagtacgcgatttaacggatgccggaaggcacacagacattccggaagtaaccaaaaggttcgctaaagtactacagtataacgtacccactggaaaaaagaccagaggtctatccactgtcatcgcctacaagatgttggaacgaccagaaaacctcactcctgaaaatattaggctggccaatattttgggatggtgtgtagaattgcttagagcatgtggtcaagtattagacgatatgatagatagatccgaaattagacataacaagctcagctggtacaaaaacgatcaagtaggtttcaacgctatagctgacagtaccatgatggaaaacagcgtgtatgctattttgagaaagtatttttctgatcattccttatatgtgcctttactagaactgtttcaagatatcacaataagaagtgccttgggcaaatctctcgaaggagagatttaccatgggaatcgacacgacctatcgaaaatgaccatgacgaatttttcgttgatatctaaatataggaaccggatactttaatcta

SEQ ID NO: 3697 - DNA, 833 bp, Diabrotica virgifera
cacagttaccatactttattttattagggctctcacatagcatatattattgtgaaatagctaactataatgacgatgtgtgtacaccagaaaaagtacaggcaaaacaattactactaaatgagtgccttaacaggagagaaggtgcctatgcattttcccaaacgctcatgagaccaagtggttcaatagctgagtttttaaaaaaacgatgtgcaatgaaaccacatttagacgattgtctagatctttggttagatctgataaaagaatgtgttaatgccgatgatctcagagggctggaagtttggaaaaaaatcgatgcagaaattatcaactatgtttgtgctcacgacgctgaggcaatgactagtcttttaaagaacagataccatagttgtcgtcaaggtttatcccgaattttaacagattgttctcgaagtctggggataactgttccattttatcaagtagataaagtacggcaaaaatgcaataaaatagggacaatggaatcatgtgtaacaagcaagctagaacgaaattgcatgaggaatgccacagaattggcaaaacccctatttcatattgttaaaacaaatttatgcagcaataactaaaatgtcattgtttaaactttcctctttccaaaaggaatggggaaagtaattaaaagtactaaaagttaattcataaatactttgtgtgtagttaatctataataacctaaaaatattagttttgtatgtatttctaaaaaaattaaattatcttctaaccagcaaaaaaagctttttaaaaaccagtttgaggtaaccttacataaaacaaga

SEQ ID NO: 3698 - DNA, 1916 bp, Diabrotica virgifera
ggtagtcgtgttggaggggttgaatctttctttgcgaaaaccaaagaaagtgacagttcttcagtaaggcagtctatgagcttaatccttaatcacttcttaacggtgttgcattggtgcgcgttaccgttgttttttgtggtactcattggtactctcgattggtactgattaccgttcgtacatctgcggcgcgattttaacaggactaattaacgcttataaaagaaatttaacacaggcatggagatgacgagggtgatgatgccctgtgttcggtggctcacgttactaggtttaatatcgtccaatgtagtgtttggaattcaactacaatcacttgacgtccctttcaatggagaaggggaatgtgcattaattttggatggacccggaaagagcagcaactttgattattcattaaacctgttaagaggaagttcactaaactacgatggacctaatacgtgtataacatttgatgcgattaacgcagcctatttagatgcacgaaaacggatacatgttgcttcacctgatgacgctcactttaagaatgaatacgttgcttcggtgggtgaactggtttttgatatatctttgaacttggcaaagacgtatggacttagttatcaagaaatagaaaaaggattacctttaatagacaccagcaaaactttgatacgagacgtgtgtcctgcgtttttgtccaatgtcgagtgtagagcaggaaagtatagaagatatgatggtctgtgtacaaaccttgaacatcctacatggggagcaagtcatacaccatttacgaggctcctaggaccagtttatgcagatggtatccaagcaccacgtataagcataacaggaagaccattacctttagcaagagttgtatccagaacaatacatcctgatgaaggctaccatgatcatgcaggaactgttatgataatagcatggggtcaatttatggaccacgattacacattgcaaggcacgccattagatccacttaacaagaatgaccctgaagaatgctgcaatcgacccgcgcatcttaagcatccatactgtaacgaaatttacatacccgaagatgactttttctacaaactcttcaaggttaattgcatagatttcgtgaggacattcccagctccacgtccaggatgcaggttaggttctaaggttccctttaatacactcaccggtgttttagatggcaacactgtatacggtgtaacggaatcacatgctaaaaaactaagaatgtttgaagggggacttttaaggatgcacccagcgtttgaacattttggtctcaaagacttacttcccttaaaagtggaaattcctgacgaaggctgtactagacctaattcttctatgtactgttttgaagcaggtgaaattagagtaaacgaacaactggtgttggcatgcatgcatacgctgatggcacgtgaacacaacagattagctaaaggattggctgaaattaatcctcattgggacgatgaaacgcttttccaagaagcaaggcgtataaacatagctatcattcaacatgttacttataacgaatttttgcctattttgcttggaaaagatgttatggaaaagtttggactaactttacaaaaacaaggatactgggatggctatgattccaatgttaatccaggagttatagatgcctttgcagctgcagcattcagatttggtcattcactattaccaactgcagtagagaggtggagtaaggcacataaatttatatcttctaaacgtctgtcggacttaatccgtcgtccctacgaccttttccgagctggagtattcgatgatactccatgggtctgatgaacaagttgccaggctatggatgattcatcacacaagagtcacaaccatct

SEQ ID NO: 3699 - DNA, 1367 bp, Diabrotica virgifera
  misc_feature (1173)..(1173): n is a, c, g, or t
  misc_feature (1199)..(1199): n is a, c, g, or t
  misc_feature (1234)..(1234): n is a, c, g, or t
  misc_feature (1316)..(1316): n is a, c, g, or t
aaaaccaaaaaatggtttgggagtaatattcaaggttggcattattgttaagaaattgttattagtttgtttaaatttctaaacatattgtaaagcagtattaattgtttaattcacttcgtttattgcaggctcaatccatcaagatgaattaatgtaatattgcaataagaagttttatcatagctctcaaatgacaatcatatttgtgaatatgtactgtgttgtaatattttcagtctaatctttttaatttcgttattaatctcgatttaatttgttccaattgaaatatatttgaatttatcttgaatacttatttaccagctatgcctgatatgcactattgattgaactttttattaaaaaagataaatttttcttatatttcttatctttctccaatgtaatgttgtaaaggggttacagctttttagttaaattttcaggtgttttcttatttagacttttttgtggtacaatatcttctagaatattcctataaattgtgccaaaaatttagaaatgtgacatatgaagaagtatcttgagctctgcagttaatattaaacaaagatgcgttattgtgccttttttcctgattgtataatttttaataaccaaggtataaacttaattccaataataacgattgattctaaactaaattatgagatcttgattctaaaccaaattccctatattagtttcatagtagttcatattatctgttaatttgagtgttactttacttcaataaactattaagatttcaagatttctttagaagatctggcgagagagaaataggaaaaaacttttttacatatttaagattccattccttaatttacagtcatcttaaatatgaaattatatgcgtgctgttactttattttatagcggtagaaattgtaaagcatttattaatttgttatagcatcacatcactcttcatcataaataagtttatatttaaattgtataaaattatgataagtttatattatgaacataagttttgaagactactttattgagttttagacaattgaggggcttggaagtaaaggggtttaagtgcacttttttcaaattctgacctaagtacagattcgcatacctaaatggtttatacccttggtggtaaattgatctaagcatatttcgggntcgcggacgtttccccaactgtcatncatacgactaacatcacgcgtaactttgatactanaatatttgatacactttgatactaatttataaaaaaaaatatgcattgaaatccagttcccgtaattcgttaaacgtgatancagtgagtacaagacatacatatttgtttctttgtattacagcttcaaata

SEQ ID NO: 3700 - DNA, 1003 bp, Diabrotica virgifera
gccaaaacaaaaagtcaaaactcatttaacaactttgcaaatttattgaaagtttcgccggaatttatattttaaattttctaggctcagtatttttagctatattgagtatcaactaaaactatggctcgtcgatatgataccagaaccacaatattctctcctgaagggaggttgtatcaggtggagtatgccatggaggctatttctcatgcaggtacttgtctgggcattttagcaaatgatggaattttgttggctgctgagaggcgtaacactaacaaattattagatgaagtttttatttcagaaaaaatatacaaactaaatgatgatatggtttgtagtgtggctggaataacatcagatgctaatgttttaacaaatgaattgagacttataggtcaaagatatttatttcagtatgccgaatctattccttgcgaacagttagtttcctggctttgtgatgtcaagcaggcatacactcagtatggaggtaaacgtccatttggtgtttcaatattatatatgggatgggataaacattatggataccagctatatcagtcagatcccagtggcaactattctggttggaaagctacctgcataggcaacaacagttcagcagcaatttcaagtttgaaacaagaatataaagaaggtcaaatgactttgaaggatgcaaagacgttagcagtaaaggttctggcaaaaacattggatatggcaaaactaacttcagaaaaagtggaaatggctacacttacccgcaaaaatgataaaaccatgattaaaattttaagcggcaaggaagtagaagaactgatttcagagtatgaaaaaagtgaagctgccgcagaagctagcaaaaaagagcagaaggcatcagcttaattacatttatttggttttgtttaggttcactaagtatgtcattgtcacaatatgaataaatgatttttataaaggccgaacacaaaaaaaaaaaccccggggc

SEQ ID NO: 3701 - DNA, 1023 bp, Diabrotica virgifera
gttttgagaagtgtaatatcgtcaagtaaacgttcgaaaaatctaaaaataagtaagtcgataccgagacactagaaatgaccgaatatagaaattcgtagagcccggcaccaaaaatatcttaactatgaaggctaccgaagcgctacgatcgttagtctttccatgatatctctcggagccgcaagaagccctaatagttacgtcgtagtttttttgtttatccaaaatgggtgaagtatcagatgccgtgaagaaatgttgcaatatattaaagaattcagccagtgataccgaaaagttcgcggctttgtttatggttacaaaattagtgaaaggaaaacatgcaacacccaacgccaagaaagctatatttgaatccattggattcgacttcttgcggagattactgcttactactgatgtacctgtcgactgtccaccttcaatatataaatcagtagcattatctataataagtgtattttgcaatgaagaagaattggctaccaaaaaggaaatgttagagtttgttcctgcgtttctggaaatcgtaaaagctgcagatgatgatgcgaatgatgacagtcttatggctattggtgaggcttacaattgtttaaagggcatagcgtcatacgaaccaggacagaaaaaacttatcgaatcgcaagctgttgataaattgggtgaaatatactcacagggtagcttccagtcagatgaggccctcaatattatggcagtattaattgcaaaatatcctacctcctggacaaataaagacccaaaagcatatcatgccctattaaataaaattgctgttgatttcgaaactgatcaagataaaagaaaatttgaaatttgtgaagtgctccatgctctagtgtataattgtcccaaaacgcaaatatcggagttttctgcaagtgaaacatggcctcaaagcatttacaaaggtttgtctgatattcttcaaaggaaaataggtgctgctcaaagaaatcctgcattgttgcttac

SEQ ID NO: 3702 - DNA, 1827 bp, Diabrotica virgifera
tatctctcggtgccgcaagaagccctcatcgttacgtcgtagttttttcgtttatccaaaatcgggcgaagtatcagaacgccgtgaagaaaacgttcgcaatctattaaagaattcagccagtgataccgaaaagttcgcggctttcgtttcacggttacaaaattagtgaaaggaaaacatcgcaacacccaacagccaagaaaagctcatatcttcgaattccattcggatctcgactttcttcggcggtagattcactcgcttcactcactcgatcgtacctcgtcgactcggtccacctctcaataatatcaaatttcagttagcattcattctatcaatcaagtggtatttttcagcaatcggaagaaagaaattgggctcaaccaaaaagggaaatggttagatgtttggttcctggcgtttctagcgaaatcgtaaaagctgcagatgatgatgcgaatgatgacagtcttatggctattggtgaggcttacaattgtttaaagggcatagcgtcatacgaaccaggacagaaaaaacttatcgaatcgcaagctgttgataaattgggtgaaatatactcacagggtagcttccagtcagatgaggccctcaatattatggcagtattaattgcaaaatatcctacctcctggacaaataaagacccaaaagcatatcatgccctattaaataaaattgctgttgatttcgaaactgatcaagataaaagaaaatttgaaatttgtgaagtgctccatgctctagtgtataattgtcccaaaacgcaaatatcggagttttctgcaagtgaaacatggcctcaaagcatttacaaaggtttgtctgatattcttcaaagtaaaataggtgctgctcaaagaaatcctgcattgttgcttacttcaagtgtgttagaattactaggaattgactggattttttctgacgaggaaaaaggtaaacaaatatttcttctacttatccaattagctgcgatcgaggttagaatgcagttagaaggaaaaaatttgaagtcgttagcacctcaacagaatctcattacagcatgctacttgattctggaagtatgtataaattttataaccgatgaccaaatagatcttgaacagaaagaacggcaaactgtatacacaggtttaaaaggtgcttttactgcagttgtcaacttattgataaaaattgatgcagataaatccaagccatcagctgaagataaattatttatttgtgcaactgttagagttttggcagcttggcttgcacaagaaactacagctatgaggcctcaaatataccaactgcttccatttattttgaacctagctaatgaaacattttatgcatatagggataggagagttgctgagaaagcgaatcaaccacacgataatcatcctcttagcaacataaacttattaagagtcatgctcccttctctttgtcacttagctgttgaagacgatgcgagaaaattaatgctaaagattaaagaagaaaaggtcttactagatgtgcttaaatttcattggaccattgtacattacaaaagaccacctgttcctagatctgagaggttaaaagttaataaccaacctgcacctcaatcactcctgagaacctagaagatatgaaggaactcagaacagctatgataagcacatgtaatttaaaaaccatttttattttttgttttttaacggtttttaaaaaaaaacaaatacatagaaaaatctgaaacctgtaacgaataatttatttataatttttttattttgtgaaaaattttactcctaatat

SEQ ID NO: 3703 - DNA, 782 bp, Diabrotica virgifera
acaagaagcaagcaaaggtttatgtatgttttggtgttgcgaataaaaaaaaatattgaaatttagcattattgtttaatgaatgacggtaaaatatcacgtccgtttttttagacttaatcaaatagcatggcaaacagttcaaataacgttgattcgtttaatttcaaagttgtcttgttaggggaaggctgtgttggtaaaacaagtttggtcatacgatacattgaagataaatttaatcccaagcatatatccactattcaggcttcgtttttaacgaaaaaattgaatttagacggcaatcgcgtaaatctttccatatgggatacagcaggtcaagagaaattccatgccctaggtccgatttactatagatcatcgaatggagccgttctggtctacgacatcaccgacgaagactcctttcagaaggtgaaaagttgggttaaggagctccggaaaatgttagggactgatatttcgttagttatcgttggaaacaagagtgatttggagaaggatcggcatgtggatgtggaggaggctaaatcatatgctgaaaaggggaaaagcgatgcattttcaaacgtctgcaaagttgaaccgaaaggcgtcgaaaaaatgttcctggcgcctcactcaaaaagatgctaaaagaagcgaaggttgaaagcagctccaagagaattatttaaccgggaaaaaaaattctccaaggggggcgcggcaagggtggggatgatgaacaggcgcaccaaatactaaataagggggttggt

SEQ ID NO: 3704 - DNA, 1278 bp, Diabrotica virgifera
acttgagcatttttcacattatgccgacgatttgttgtgttgtgctgtactatacttcgcttaatggtgcttattattttcggttctttgcagaactagatcataaaatattaaaaatgagctcactgtgtacacaccaaatgtgttcaaaagaactacataccaaaaaaaggtgaaagcttacttggtgatataactacagggtaacatattgattagtttgtatagtgtgtctcaaaaaatcgacgttaaataacatgtttatttgattcagactttctttacttctttctttctccccttccttttaccctattcagagtgtcggatttgggctcgctacttaagtttccattcacccattcatttctatttcctgtcattattttcaattcctcgagtgatttttctttaacttttctcgcctctactacttgctgtatccattttttcttggtctgcctcttttttcttttatgatgttctttgcttcgtggaattttcttgtaattctgttgggttgcatcctcatcaaatgcccataccagttatttatctctgctcgtttattcattattggttattcattctcctaatagtctcgttgcttagtctatcccattttgtctatttttcgagaattgtccagttttcacttgcatagagcacagtcggtatcactattgtgttttgggtctaacgcatagtataacttgttttatttcttttcctctatttgttatttcccggtatttctctttatttcagtatcttccttatctgatttgccgttgatgatcattatcttacctttttctcggttatttccatttttaggccttttatttgctccacccatatatccattacttatttcatattcttctcagaatctgctattaatactatctgtcgtccgaagacataaggattctatttttaccgctggaaactatgggaacccattattgtcccctagatgggtggggtcctactttaagggattctttattaattccgttccccaagcatttccccctaacaatttggcctttccttttcgggggcaaaagggctggctcttaagggtctaatgaaaggctaaatacccccccccccccccccccctttttctttaatttttaaatttttttttttaattttttatttttgctatcttttatttttttttttttttaaattcccaaaaagaaatttttttttttccgggaaaaaaaaaaaaaaatgatttatattttttttgttgggggccccccc

SEQ ID NO: 3705 - DNA, 925 bp, Diabrotica virgifera
agaaggtttaatatatatgaaaagtaaaatatccacagatccagatccattatatccagacatggaattgattctgcttggtggtaatttagcaagtgacaatggtcacttattgagacgaatgtttaatataccacgtgatatatacgaaaaagtttggaagatttatgaaagcaagccgatgtaccaaataatgccgatgttagttcatccaaaatctgtaggatacgtaaagttagcttctaagaatccattccactttcccaaattttatgctaactttttctcagatcccgaaaataaagatatcaaaacttttatagcggctctaagagaagttcaacggatgagccagagtccaaccataaaaaaattaggaacgaggttaattcaaacgcccataccaggttgtgagacaatgccattcgacagcgacgaatactgggagtgcgctcttcgatctctaacaagtagtctttggcaccaagtagctacatgtaagatgggtccaaaatctgatccagaagcagtggtagataacacaggaaaggtgcatggtttaaagcatctgcgagttgctgatacaagtattataccgatgccattgactgcgcatactgcaggaccatcgtatatggtcggagaaaggatctctgattttattaaagaggaatggagaagtaataagtactttaaatgatattaatgataatgtttatcgactgagtaggatataagttgaataaaattagttttgccatttaagaagtagtgtaattttaaatttaggtagtaaaaaatgaaaagttcttcgatctttggtacgtacggtttagctccaatagagttaaagcaaacattttattagtcaatttttgtaacaaatttaatgacgccaataaaagtttttaatttatttttaacg

SEQ ID NO: 3706 - DNA, 1790 bp, Diabrotica virgifera
ggtactcattacgcacatttcagctgctagtcaatgaatagcgtaccgatagtaccgaagacttgccacccgttttcatgatggtttccaaagcagcgctactggattttcgtatgttaaaccagtattttgtccatcaagatcatcaaccgcgataactcatatggtgtaaacagttattttggtgtgattttttagtttagaagtttgtgatattagttttaagtgaatcacagagatgtattatctgatcataacaggagtactttggcagatatgttttgtttctacacttattcctccatcttacattaatgtgcaaattgacaatgctttttccaaatccattacgaaccaaacatttgatttcatcgtgattggttctggacctacaggatcagtaatcgccaatagattatcagaggtaccagaatggaacgtactattaatcgaagcgggtaccataccaagtgcaatatccgacattcctgccatttgtggacactttcaattcactggatacgactggggttacagaaccgagaggcagaatggattttgtaaaggttgcataagaaattctttaaaatatggccatggaaaggtgcttggaggaacatctataataaacttcatgattcacgtccgaggaaaccgtcgtgattacgatcggtgggccaaaatgggtaatcccggttggtcgtaccaagaagtcctgccatattttcttaagtctgaagatgcgcacattgagagggctgatgctggctatcataagaaaggtggatatttaacaataagtgatgtcccttttaggactaaaatgatagatgctttggttcaaagtgcgcaagaatgcggacatccgtatgttgattataacggcaaagaacaactgggggtttcatacgtacaaacacatacaaggaatggaagacgatgtagtgccgagaaggcattcctacgaccagttgcgcacagatcaaatttgaaaatactgacaaatagcaaagtagtaaaaattcttattgatcctactacaaagagcgcttacggtgtgcaatatgccagaaagaagaaatattacaacgcctttgctagtaaagaagttattgtcagtgccggtggactgaattcgccccaacttttgatgctctctggtataggaccaaaggaacatttacaagaatttgatatacctgttattgcaaatttaccagttggaaagaagatgtacgatcatcccagttttatgggtatgggttttgaaatagacgaagagattgttttgaggcaagatgaagtcttaaccaacgttacggaaattctcacatttcttaaactgggaaatggaactatgactagtataggtggcgtagaaggtttaatatatatgaaaagtaaaatatccacagatccagatcccttatatccagacatggaattgatttctgcttgggggcaatttagcaagtgacaatggtcacttattgagacgaatgtttaatataccacgtgatatataccaaaaagtttggaaaaattaatgaaaagaagccgaagtaccaaataaggccgatgttagttcatcccaaacctgaagaaacgtaaagtaagcttttaaaaacccttccactttcccaaattttatggtaattttttccccaaaccccaaaaaaaaaaatatcaaaaattttttaagcggctcctaagaacaagctcatcgggtggggccccaaaccccacccctagaaaaaaattaggaaagcggggtaattttcaaccccccc

SEQ ID NO: 3707 - DNA, 1362 bp, Diabrotica virgifera
gtgcctcctaggggcagggtacggacaacgacacaccggctttaagggcagtccttacagtagggatcctggccttacagaattatttaagcagatacacggtattagtgtattttggttcaatttgtggtgtctcggctaaaacatacaataaaggaatagaagagccacgtggcttgaaatttagtagaacttaaactagtttatggagctatttggaaattgcttcagtagaaaatacttttggatatgatatagctgtacaagatttttcagaagggtatcttctgataaatatttacagcatacttatttaaaaggttttactcaaacaacttatcattgttttaaatagtttttccctgtcaacaatttatctcatggtctattttactttagtgttctgggaaaaccgttatagcaacttttcacatttttgtttaaacttgtttccgttatattaatatatgcgcttgcacactgaagaaaaacgttacaaatgtgaaagttgttataagcaggtcttccaaaattaatttaaaataccccatgagagaacacactgcagaaaaatctttagaatgtgcgatttgatcaaggcagttgtctcaaaagagcggtttaaataaatatgtgtttgcacactgaaaaaacaattacaaatattaaagctttcacgagttgtctgaacccaactgatacgttcatgtcataagtacttttcttgtgaaaagcatttgtttgatgaaatgccgaacgggttatgagaacttttcaaatttgtcatatttgtaaagtgtccctccagtgtgcaatcatatatttatttaaattgctctttttagaggactgctttgagcagatttcacattcgaaaggtttttctccagtgtgtgttctcatatggtttttcaattactttaggaagaactatttaaaacaaatttcacatttgtaaggtttttctccagtgtgcaatcgcatatatttatataaaatactcatttaattaaacaaactgttgattgtagaactaaaaacggttggattgtacactgggttaaaccttacaaatgttgaaataagttggaagtaattttatgtatgtaaaccttagggcattaaagtattcgtaaaaccttgtttatctacaataaaatacaaatattcaaaatagtgctccgtaaaactggttacagttcaagtagaaagaaaatatacattttaatttaatattaacttacattagattctaataattcacttagctcataaggccgctttactaacattaattttaatactgatttttatgtgctgtaatagtgttaaaattttgtcaaaaataaattcatctacaat

SEQ ID NO: 3708 - DNA, 883 bp, Diabrotica virgifera
gcggccgtgatggtgacatgtgtagaaactcctacaactaattcaacaaaaactagtttggagaaaatagaaggatttatgaatgaggctagctacaatgaagcaattgagagttccagcaatttcaatacaaggctatgtattgaaagacgattgcgcctccccttcatcgatactcaaacaggggtggcccaaaatcattgttctttatttatgaataagaggcaaagaatacctggattacatccagggcagatatattcttatcctagacaaagatggaggaaaaaaagacgacagtatttatcaatgaatgcacgagcatttgccagagcggctgaccatttattagatggaccagataccgatatgcatagcatttcccaaattgaaaatccagcactccaagatactgatagtaaagatagtcagttgctaaaggatgaggtttcaaaggaatggttttatgatgaggctgatatgctggaaatggatgcttatgatgaacctgatccagactctgacttggattatgaggaatgctacagtaaaagacggagaggacgtaggggtgtaggaagaggacgaagcggcaccgattcaccaagtacgcctaacaagagaaaaggagcaggcagaggaaggaaaaaagtcaagtcataattttgaacccacccctggagatcctgataaaccttttgcatgtgaactgtgcggcgcgcggtacaagacgaggccagggctgacttacactatggccactcacacaaagaaggcgcaagcgacgagaactctcgcgacagcaacgccccccatccccctctccgagaaaaacaccccccccccccccctctcctgcttagggggggggggggggtgtgtg

SEQ ID NO: 3709 - DNA, 868 bp, Diabrotica virgifera
  misc_feature (816)..(816): n is a, c, g, or t
  misc_feature (823)..(823): n is a, c, g, or t
cccacgcgtccgtgactagctgattttttacattcaacaatctttttttataaaataattagttaaaatgatgcaaacagctaataatgcatattatcccgattattccactgctccaatgcaacgtcaaattaacccctatgcagataatggagggagtgtagtagcaatagcaggtgaagactttgtaataattggtgcagatacacgtttgagtactggattttccatttataccagagaacaaaacaaacttttcccactatcaggcactactgttttgggttgtgcaggatgttggtgtgacactctaacattaaccagaatccttaaatctcgcatgcagatgtaccaacaagagcataacaaaacaatgtctacaactgcatgtgcccagatgttgtcaaccatgctctactacaagagattctttccttattatatatcaaacattctagtaggtttagataatgaaggaaagggctgtgtttacagctatgatcctattggacattgtgaaaaagctacgtatagagcaggtggttcagctggagctcttcttcagcctctgttggacaatcaaattggacagaagaacatgcttaaaacatctggggaacctcttagtcaggagaaagctttgtctacccttaaagatgtatttatttctgctgctgaaagagacatctacactggagatagcgtacttataaatattattactaaagatggagtaaaggaagagtccttccagttgagacgggattagaagcaagtggttttgtttatattttcttatgtgtaattcaaatatancttctanataaacaattttaagttaaaaaaaaaaaaaaagggcggccgctct

SEQ ID NO: 3710 - DNA, 1827 bp, Diabrotica virgifera
cggacgcgtgggcggacgcgtgggcggcgaaaaaccagttagaaataaattgtgttattaaagaatttacaaaagtaaaacgttaactcaactcttgaaatacttttctgtgatattagaacctatatcatattataatcaacatgccgcaatacaaaataaaagtaaaatggggaaaggaatcatatccagatattgaggttaatacagaagaaccccctcttttatttaaggcacagttgtttgctttaactggggttcaaccagaaaggcagaaagttatgattaaaggagttactctcaaggatagcgactggaataactttaaattgaaggatggagtgactattttgttaatgggcagcaaagaagaagatgtgcctaaagaaccggttgaaaaaactgtttttatggaagacatgaatgaaagtgaacttgccacagctcttgagttgccagcgggtttaacaaacttaggaaatacttgttacatgaatgcaactgtacaatgtttaaaagctgttcctgagttaagagaagctcttcagagttatcaggaagctatcaagctaactggtagtaatgttgtaccagctcaatcaataacagcagcacttagagatctttatagcaacatggacaaaggaaatacagttcctccaattctgttacttcaggttatgcatatggcattccctagatttgcagaaaagaatgagcatggaacattgtcccaacaggatgccaacgaatgctggactgaaatggttaggatgttacaacaaaaattaccagccagaaagaatggtggggcttcagcagaacagtttaaatcgtttatagatcaatactttggaggtacctttgatgttgaactgaaatgtgtagaagccgaagatgaaccagtgtcaaaaaacaaggaacaattcttgcagcttagttgttttatatcgcaagatgttagatatatgcattctggtttgaaaaataaattgcaagaacaaattacgaaaaattcgtcgatgttggatagggacgctgtttacacaaaaacttcaaaaattagtaggttgcctgcatacctaacagtacagtttgttaggttctattacaaggaaaaagaatcgatcaatgcaaaaattctgaaagatgttaaatttcctttagatttcgatgcatatgacctatgttcacctcagttgcaagaaaaattagcacctatgagagccaaattcaaggaatttgaagatgctcaagtagaacgagcatcaaaagaaaaagataaagctgttcaaggcgatagtaaggaagtgaagcaatatgctccttattcttttgaggatgatttaggaagtaataatagtggttactacaccttgcaagcggtactcactcatagaggaagatcttcgtctagtggccattatgtaggttgggttagacagtcgggagataaatggataatgtgtgacgacgataacgtctctcctgttactacagaggatatcttaaaactctctggaggaggtgattggcattgtgcctatggacttctttatggccccaaattgttgggaatcagtctaccgataaaaaaaaaaatcagtataatcaaaccgaactaaagaaccttggtgctttaaattattttttttttttgatttttgttttcccgcaaaccaacgcctcaacttttccaatcatttttaaaaacttttcctttttcataatacattttcttaactatctcatatatatcttaatattctttctgggggcggggcgctcttaagatttcacactatattccgtgggtcgctctccccc

SEQ ID NO: 3711 - DNA, 1333 bp, Diabrotica virgifera
cgtctggattttttaatgtaaatcattgttttagaggttttgttagttaaaaatacgtcgaactgttttatttgtttatttctaagccaagtggagtgattgttctaaatatagaaactaaaaatgattctattaaccatcctgattgtatcaggcattgcttttatcatctttgctctagctgttcagccgttgcgcaaaaaaagcattaatggaaaacatgtagttgttattggagggtccagtggaattgggaaaagcgtggccaagctagctgcccgtgaaggtgctcacgtaacaattattgcaagaaatgttgatagattggaagaggccaagcaagagatacagcagcatgttgtggatgccaatcaacaaatcatcagtagagtttctgtagatgttgctgattatgcaagtttggacaataatataacccaaatagaagatcaggtaggccccatttatatgatggtgaactgtgctggaatggcaatatgcggagtaatagaagacctaaccctacaagaaatcaaacagttgattgatgtcaattacttgggaagtatttattctgtaaaatccatcttgcccagattaaaagaaagaaaggatggaattgtggttcttacaggttcacaagcttcgttaatgggaatttatgggttttcgatatactcaggctgtaagtttgcagttcggggtcttgccgaagctgtacacatggaagcaaaaccctacaacgtatctgttaccttagctttgcctccagatactgacacccctggatttgccaatgaaaataaaaataaaccggaagaaacgagaattatatctgaagctgggggattggctaatcctgacgatgttgccaaaagactgctcgatgatgcattggttggaaaattctttagttattatggatttgagtcaagtgtcttaactactctttgtgttggtatgacaccaccccttcgatgtatcgacgtcattgtacagacccttgtattaggccccctgaggttacttggatgttactatgttacaaccttccataaggtggtacagaattgctacaatgatagaaaaaaccgtgagttagaacaagatacccaaaaagtacaatgaattgaaatgaggtacaagttgttgaagtgttgttcaatactaatatacttaagtaattcctaagtggcatttaaacccgtctggtcaaatatattttatgaaataataagttttggtacgcatacatattttttagtatttataataaagttttttgatgttaaaaaaaaaaaaaaagggcggccgctcgcgatctagaactagt

SEQ ID NO: 3712 - DNA, 2309 bp, Diabrotica virgifera
tgtgacacctccgcgtaccgcgccgcaattcccccggcgtcccccttcgcccggacccacgcgtccgaaaacggctagtggtgtgaaggtgatttttccaagatctaatatttaaacaactcatccaagatgtctttgggaacggatatgttttacatgtaccccaaggagaacgcaaagctacacaaaactgatcagtatgaattggttgatgaagaagacgttcctgtacttcgtagaggacaaaagtttactgtagctttaaggtttagcagagattatgatccaaagaccgacatgattagaatttcgtttaactttggtccacgccctcatccgattaagggtactgctggtatatttgtggttgatcctgctaaaagatcaaatattgatacagaaaaacctatgtggtttggaaacgttttagaagcgagaggacaaagcttaacattggagatctactctccccctggtattccagttggtctttgggctgtaaaagtcgaaacacgagtgcgaaacagttctgaagaaccagtggtctacgattatccaggagatctctacttcatttgcaatccatggaattgtcacgacatggtgtacatgcccgaaaccagattgttagaggaatacatattgaatgacactggaaagatctgggttggtccattaggaaccacaaaaggaagagaatggattttcggccaatttgatagttgcactcttccagccattcaacttatgtttgaaaaatctggtcttccttgggccagtcgtggtgatccaataaagctgacgagaattatctccaaaatggttaatagcaacgacgatgatggtattttggtaggacggtgggatgggcagtacgaggatggtactgctccttctgcttggacaggatctgtaccaattctgcaacagtatttagataccgaacaaccggtgagctatggtcaatgttgggttttctcaggagtttgcactacaattgctcgtgcgcttggtattccatcaagagtagtttccaacttagtttctgcccacgatgccaattctaccttaacggtggataaatacttcaacgaacacaacgaagagttgccttttgatccgaataacccagaaggagaggactccatttggaactaccatgtttggaacgatgtatacatggcacgtccagatcttcctccaggttatggtggttggcaagctattgacgcaactcctcaagaaccatcaagtggtttttaccagtgcggaccagcatctttggaagctatcaaaaagggacaagtcggttataacttcgatgttggcttcatggttgcttccgtcaatgcagatctgatgcgttggaaagtagatcattccaatgtactgggatacaagaggatttattgtaacaaatatcatgttggtcgctacattctcactaaacagccattcatgtacgattacaatggagacagagatcgtcaagatataactcgtttatataaaccggaggaaggatcaaaagcagaacgtttgtctctgctgaacgctgtccgaggaactgaagcagccaagaggttctttgatatgcctgatgaagaaaccgaagattgtgaattcacattacaagatttggatcaaattaaaatcggagaaaatttcagcgttgtggtgaaaatcaaaaacaacagtaatagccaacgtcacatcaaagtccatctctctgctggtacagtttactacaatggtcttaaagctcatccgatcagcaaagatgagggagaattcaatcttaaacctcattccactgaagaattaaggcttaacgtcacagctgatgaatatctggataagctggtggaatactgcatcatgaagatatacgccattgcttcggtttcagagactaaccaaacttgggctgatgaagatgatttccaagtcgttagaccaaatattgacattaaggtaccccatactattgtcaacaagaaaccaacaacagtaggtctgaaattcgtcaatccgttgaagaaagctctgaccaacggcaagttccacatttctggagcatcgcttcttaaaaaccaagttattggtgttcctgatgttaaacctggtaccgtgatcagaatcgaaaccagtattgttccaaaatacgaaggagaacagaaattggtggccactttcacttcgagagaattgcttgacatcaccggaacagctaaagtggaagtcgtgtctgaagaagagtaaaagattacatccatgacacaataagtacttatttggattttaggacg

SEQ ID NO: 3713 - DNA, 967 bp, Diabrotica virgifera
tgaagatgctgattgccaagatgtggaagatgaagaggaggctggtaatgaagttgaggtgatagacgattccagtgaagtgccaaatcaaagtgagagagaagaagataacgtggaagaagaaacttcagaacaaccacagtctgaagcaataagtagtggcactgatggtaccggaaggagcgtacccacgacaccgctacagtcttctccacaagaaggaattcccggtagtgaagagcaaggtactagccaacagtcagatgctgaaaccccatcgattgtaataagtggcgaagttgacgataatgaaaccataggtgaaagtagttcgggcgatatgggtcccccagctgtagctggcacctcatcagaaggcgcccagcagcacgaacaagccgaagaaatgctcgaaggtgacgatggtgtaagttctgaaggagagaagccacccatagccgaagaaggcgaagaagaaggacgtgaagcggaggcttctcccagttctaattcacggggcgtagctcaaagaggctcgaattctgctcgaagatctacaaggtcgtcactaccgagaggtgctaatcaacgatctggtccaactccgattgtttggagcgacagatcgccccaacgacatcaacatccccaagacagaaatagatcaccccaaggttaccaatcgaggacggtagcaaggagagcccgcaatcgtggccagaggccatttgatagacgtttctaaaccccatttcatttttaattcattccatgagcattgttaaggttttagtttcgtcttatatttttgtttataaatgtacggaaaataaatttattaataataggatttattattttttttgtgaaagagttttgatgttcgactgggaaagattattttatttattaccgatgggaaaggccatcccttctgtgtaggcgtttgtaataaattatttaatcc

SEQ ID NO: 3714 - DNA, 886 bp, Diabrotica virgifera
  misc_feature (867)..(867): n is a, c, g, or t
tagttttcctgtgatatagtcaactgcccaaaaacttaagatgagaaatctactgaatttcttcagcgttcttctcgtgctgcattgttattcagtcgtactaggtgagccttcttattacagacagtacagggtgctaggagattatccgtaccaaacctactacggaaacccttatgctgatcatccctacagatatgccagtaatagtgacgtttacataaccgacagatatggaagaacttcactacgatctggagacagttatagagttagttcctactcttcaacaacctgtacatccggtacatgtggacaaaatgcacaatgccaagtagtaggaggacgacctgtgtgttcgtgtcttagaggtcattctggagatcctctttcattatgtagaagggaagaatgcctggatgacggtgaatgcagaggtcaattagcgtgcagaggtggcaaatgtattgacccatgtgttggtacatgtggcgttaatgctaactgtgaagcaagaagaggagtacccgtttgtacctgtcctgctggatatactggagatcctattaccagctgtagaagatttaatcccgaggaactttgtcatccaagtccttgcggaccaaacacccattgtgaagtgaaaaacgaagtacccacttgctcttgcctaccaggattccacggatccccactggcaggatgccgtcatgaatgtgaaagtgatgttgaatgtggtcctacgcttgcttgcatcgaatttaaatgccagaatccttgtttgagccaatgcggtaaaaatgccgaatgcgaaacaattagcaaccacagagcagtttgtaaatgtcccaagaactactttggaantccttactcttcatgtcag

SEQ ID NO: 3715 - DNA, 1386 bp, Diabrotica virgifera
agttttcctgtgatatattcaactgcccccttattatgatgagaaatctactgaatttcttcagcgttcttctcgtgatgcattgttattcagtcgtactaggtgagtcttcttattactgactgttcagtgtgcgaggaggttatccgtaccgaacctactacggaaacccttatgctgatcatccctacagatatgccaggaatagagaggtttacacatccgactgatatggaagaacgtcactacgatctggagacagttataaagttagttccaactcttccacgacctgtacatccggtacatgtggacaaaatgctcgatgcctggaagtaagagagacgaactgggtggtcgtgtcttagaggtcaatatgcagatcctctttcattatgtagtagtgatattattgccagggtgaatgggttagtgtttagttttcctgtgatatagtcaactgcccaaaaacttaagatgagaaatctactgaatttcttcagcgttcttctcgtgctgcattgttattcagtcgtactagttagttcctactcttcaacaacctgtacatccggtacatgtggacaaaatgcacaatgccaagtagtaggaggacgacctgtgtgttcgtgtcttagaggtcattctggagatcctctttcattatgtagaagggaagaatgcctggatgacggtgaatgcagaggtcaattagcgtgcagaggtggcaaatgtattgacccatgtgttggtacatgtggcgttaatgctaactgtgaagcaagaagaggagtacccgtttgtacctgtcctgctggatatactggagatcctattaccagctgtagaagatttaatcccgaggaactttgtcatccaagtccttgcggaccaaacacccattgtgaagtaaaaaacgaagtacccacttgctcttgcctaccaggattccacggatccccactggcaggatgccgtcatgaatgtgaaagtgatgtcgaatgtggtcctacgcttgcttgcatcgaatttaaatgccagaatccttgtttgagccaatgcggtaaaaatgccgaatgcgaaacaattagcaaccatagagcagtttgtaaatgtcccaagaactactttggaaatccttactcttcatgtcagccagagtgttacggagacgtagactgtcctagttccaaacctgcttgttattatggtatttgcaagagcccttgcgaaggagcttgcggagttggtgctaactgtgaactcagaggactaacgcctgtatgttcctgtcccaaagacatgactggtgatccattcatccgttgcagaccttttgaaccaagagattatgcgaacccaatccctggggtagcaacgcccatt

SEQ ID NO: 3716 - DNA, 897 bp, Diabrotica virgifera
gaaaatggttgtgaataggagtttcttattgttcgggaaaaccgtggtgagaagatttcaacacaaagtggatgtaattgggagacaatactctactgaagggcctctttttcccggggccaaaacaacatggacggaaaatctggagttcactggatctcattcctacaaacccattccagtttacagagtactggatagacaggggaatgttattaaccccgaaaatgatccaaagttgcccgacaacattctggtaaagatgtacaaagatatgacgctactaggtgcattggacaaagtattatacgaagcccaaagacaaggacggatatccttctacctgaccaattacggggaagaagcaactcaggttggcagcgctgcagctttagacaccagtgacgtagtttatggacaatacagagaagtgggagtgttgatgtggagagggtattctctgcaacagttcgtagatcagtgttatggtaatatcgatgatcctggacagggaaagcagatgcctgtacattatggaagcaaagagctgaattttgtaacaatttccagtcctttgagtacccaaatcccacaagctgcaggttctgcgtacgctcttagaggaaaaaacagagttgtagcatgctacttcggtgatggtggagcatcagaaggagacgcgcatgcggcctttaatttcgctgctactctaaactgccctgtcatatttatttgcagaaacaatggctacgctatctcaactccagttgaggaacagtaccaaggagatggaattgcagctagaggtccaggatatggaatttatacactaagagtggatggtaacgacgttttggctatgtacaacgtgaccaagatggcgaaggagtatgctct

SEQ ID NO: 3717 - DNA, 2607 bp, Diabrotica virgifera
gtccataaagcacatactttctccttttctccgtctgtttggcggttgtatttcaacagcaggcatacatacatacaaaatttcatttttatatttatatttcaatcctttgaaaaaatctgttcgttagaacacattaattaagtaaccaagactttgctttatcatttgattttatcaagaaataatggattctatctaccgatctactacttcaaggagccttcaatcgacttcaacaagttctgaatttgtctcaggagcctgccacctctgcagcaaaatatttaaaaatgtaaaattacgaaatcgtcatatcaaaagaatacataaaatagatgtatcaattaagaaaattgatcatattgtttgtccgttatgtgagcaagaaactagtttacaaacccatgagaacttaagaaaacatattaaggagaatcaccaggtgagtattgaactaataactttggaattttctagcaaacaagaatatgagacatggaaagatatgcagaaaattgagaccagttatgcaacatctcgaacaggtaatgcaaaggaacacaagatcttatactatgagtgtaacagaagtgacacatatggatataagccccactctaaaattaggacagagaaatctggtggatcaattagaattaaaggggtgtgtccctccagactaatttgtaaactgacaaatcaaggacaagtttcggtcagttattggaaaacacatgctggacataaagaagaattaagagccatacatctgtcaaaagcagaagaaaaaacgattgtagaaaaattaaccgctggggtgccacccagtagaattttaaaagattcaagaaaactggaaataccacaactagatagacttgccctatcaacaagtaaggatctcgtaaatttgtccacaaagtataatatacacaagaaaagagatcaaaatgatatggtagctgtagccttaaaggttcaggaatggaatactaacaacaagaattatgctttcttattcaagaaagaaggagaagaacatgatgtgctgaggacagaagattttgccattggatttatgaacaagataatggaggataagttacgagaattccctaacataatatgtgtggacggaacccatggaactaataaaagacggatggacttaacaataatgcttattaaagatgaccgaaaccaaggatttccagttgccttcttactgtcaaacagactggaccaacaagttcaagaagtttttttaggtgccctcaagaataggatgaagacagagattcgcgcagatcatttcatgagtgatgatgatcccaagtattacaatgcatgggtgaatacaatgggaaatcaaccgaataagcttttatgtacctggcacgtgatcaaaaattggaattttcaagggaagagtaaaataaaggatacaactataaagaaggaaatgaaaaacgacctgaggcagattattacagaaacggatgaagaaaaatttatggaattacgggatatctacttaaccaaactgaaaaatgcaaatgagacagaattttgcaattatctggaaaagaaatactttaagtctatgaagagaacaaaaacgtgggcccattgttatagaagaaattctggaattaataccaacatgtccctggagtcgctgaacaatctactgaagaccaactacctaaatcggactgcaacaggaggaatcgagaaattattggatactatggatgagctagtggaggtaaaaatgtggaaaagaattgtggacataaaacggccaaacgcgaacaattatcaggacaggactataattcaggcacacagaggggcagaaaggatcaaaaggaaaatggaggttacgaagaatatggaggtatatgggcaatatcaggtaagatcccttacggatcctaatatattacaaaatgtaactttaagacaagtgtgtgaaagtgaatgtaagatgttgttttgtagagtttgtaaaatttgtatacaccgttatcagtgtgactgtagagtatatgcagtgagaaataccttgtgtcagcatgtgcacttggtaagaatgtatgaggagagcgtgggtactaactctgttttagatgatgctgcaaggtgtttgggagaaacttcaattatcaaatcaaggcatgaggaggaaattaatgaatttatcagagggacgctagaacagacaaatctaaccccaggaaaaaacccaaaacgaaatcttccacaggaatacgtcaataatatgatgaacaattagatgacgaaatcttttgccaatttatgaggggggtttcaggaccggtgggaaaaactttaatggagaaggcatggaacatttccaaaaaagcgaaaaatggggaaagccgcagtatttttccttcaaaaaaaaaaaaagaaagggtaaggaaatggttttttttaaaattttttagtccctagggggaaaatttaaaagggaggttttatttcccccctttggccccaaaaaaagggcttctcccttttttaaataaaaaaaaaaattaaaaaaaaaaaaaaaaaaaaaaaaaagggggggggggg

SEQ ID NO: 3718 - DNA, 1407 bp, Diabrotica virgifera
  misc_feature (1282)..(1282): n is a, c, g, or t
  misc_feature (1346)..(1346): n is a, c, g, or t
  misc_feature (1362)..(1362): n is a, c, g, or t
gacaagtgacaatttgtttgtgtaaattttcgtgtttggcgttttcataatattttataattgttgaaaaaagtatattaatattcaaaattattaaaataaactataattgtgatggctgcacgcaaaagtggaatttcttgtgtggttcgtggatgccagactagatctggggaacaaataagtcttttttcaataccacgagatcgtagcagagctgaattatggctaaaagctgcaattagggaagatttactttcaaaggatgtcaatgaattgcacaaaaattatagaatgtgtgagaaacattttcaaccacatttcatatcgaagggggaaacgtaagaaaaaatttatttatacaagctcatcctacgatattcccatacaaccaagatgtacaatctgcagatgaacccttaagaaaaatcataagacttgaaacacagtttgaagcttaaatgtggtccatttaacgtagctaaatgagtagcattatcctataaaggagttcttcaactcttgcaatggtaagaatcgatgaaatacaaaatggaagaactgattaagaagaatgtgaaggtatatgggcagtttcaggtaaaatcctttgtggatccgaatgaattatataatgtaggtttaagaaaagtatgtgaaagtgagtgttagacattgttttgtagagtgtgtaaaatttgtattctccgttaccagtgcagttgtgatgaatatttggtgaggaataccttgtgtaagcatgtgcacttggtaagaatgtatgagtagcatgtgggtactaattctgttttagatgatgctgcaaggtgtttggagaaacttcaattatcaaatcaaggcatgaggaggaaagtaatgagtttgtcagagggaaggtagaaaagataatttgattcaggaaaacaccaaacgaagtcttcaaagtgaaaacatcattaatgcggtggacgaattagacgaccaagattttatcaaatttacgagtgagtttcaaggaattatggaaaaatttcagaaaattacaaagaagcgaaaaatggaaaagcaggagtattttcaaataaagaaagaaattgagtaatcattaaatttgaacatttttttagctcacaagtattttgtcttctgtatctgtattgaatttttattatagttgtataggctttacaagaacgttagttaatttaacattattatagattttacttgattagcaatattagtaatatgtatgcatacttaggttatttctgaattttanagtcatgttatttatagacttttatatcagagttgtatttttatctggatgtactacgtcttcngcgaggttttagaggngttttacctttcgcattttacacataaggacgtcccctcctttga

SEQ ID NO: 3719 - DNA, 2783 bp, Diabrotica virgifera
gacttttgtgtttggcggttttttaagatcaaatttcctttgggctgccggttactttccaacttaacaccaattatacatacatacacatacaaaatttcaattttagcttttttcatttctatttttgtttttaatttgttcaatcgttttaaaaatctgttcgttagaacacttaatttaattacccaagactttttagcaattatggattctacctacccatctacttcaacaagttctcttccaggagcctgccatctttgcagcaaaatatttaaaaatgtggaattacgaaatcgtcatatcaaaagaatacacaaaacagatgttccgcccagggctaacaacaaaatgaatcaaaatcacatcatttgtccgttatgtgatcaagaaactaattttgaaagtcatgagaaattacgaaaacatctccaggactgccaccagctgagtattgaactaataacttttgaattttctagcaaacaagaatatgatacatggaaagatatgcagaaaattgagacaagttatgcatgtagtagaacaatccgtggaaaggaacataagataatgtactatgattgcaatagaagtgacatacatggatataagcccaactataaaattaggacagagaaatctggtggatcaattagaataaaaggagtgtgcccttccagactggcttgcaaactgagagaccaaggacaagtttctgtcagttattggaaaacacatgttggacataaagaagaattaagaacaatgcatctgtcaaaagcagaagaaaaaacggttgtagaaaaattaatggctggggtgccacccactagaattttaaaagattcaagaaaattggaagtaccacaattagatagacttgctgtaataacaagtcaggatctcagaaatttgaccagaaagtataatatacacaagaaacgagatcaaaatgatatgatagcagcagccctaaaggttcaggaatggaatgctaacaacaagaattatgctttcttattcaagaaggaaggagaagatcatgatatattgagaaaagaagattttgcggtagggttcatgaatgcggtgatggaagagaaactactagaattcccgaacataatttgtgtcgatgggacacatgggacaaataaaaaaggactggatttgacgattttgctggtgaaagacgatagaaatgctggattccctgttgcgttccttctgtcaaatagattggaccaacgaattcaagaagtttttttagatgccctcaagaataagatacagacagaagttaatgcggaatatttcatgagtgatgatgatcctaaatattataatgcatggaagaagataatgagacaagaaccaaggagactattatgtacgtggcatgtggtgaagaactggaacattagaggaaagaaaaaattacaggatccaactttgaaggcgcaaatgaaaaatgaactcaggcagattattcgagaaccagatgaagataaatttaaagaactatgtgacaaatatgtatccaaactagaagaggcaaatgagatagaatttgtcgattatctgaaaaaacaatacttggctgaacacagaaaaaaattgtggccctattgttacagaagaaatgccgggattaataccaacatggcaattgaatcactcaacaatctactaaagacgaattacctaaagagaaatgcagcactggggattgagaagctactggatacaatggatgagctagttgaagaaaaaatgtggacgaggatagttgatataatacgaccaagcgcaaataattatcaagacaggctttcaataagagcacacaaacgggcagcatcgatgaaaggcaaactagaagaactggttaaggagactgcatatggccattatgaggtaaaatcctttaaaggtatgaatatattacgttatgtaaattttagacaagtgtgtgagagtgagtgtaagacattgttttgtagagtgtgtaagatttgtattcaccgttattggtgtagttgtgatgactatatggtgaggaataccttgtgtcagcatgtgcacttggtaagaatgtatgaggagcgtttgggtagtaactctgttgtagatgatgctgcaaggtgtttaggagaaatgtcaactatcaaatcaaggcatgaggaggaaattaatgaatttgtcagagggaagctagaacagacaaatgtgacccaggaaaaaaccaaaagaagtcttcaacaggaatatctcaataatgtgttgaacggattagatgaccaaggttttaccgaatttataaggaggactcaaggaattctggaagaagttaataataaggcaaagaacattacgaagaagcgaaaaatggagactcaggagtattttccttcaaaaaaaaagaactgattaaacattttttattaacaatttttgtagctcacatgcattcttgatttgtacctgtattgattttttatttacaagatcattagttaatttaacattacagattttacttgaatagtaataaatacagtgaaattttataagattatagattatgttacttaagttaggtctgaattttaaagctatgttaagtaagatgtaatttgataacttttatatgagttgtatttttaaattgggatctactgggccgtaggcgaggtttagaggggttttaccttcgccattgcaccaataacggcgccccctctagggggtttttaataaagaaattttaaacagcc

SEQ ID NO: 3720 - DNA, 969 bp, Diabrotica virgifera
ataaactttatgttgttctgtttaaatttaaagatcaaacaaagtgtggttaaaccaaacgacattattaaaccattattaaactgataaataagcaaaatgaaggtagaggaggtgaaaagtactgtaaagacacaaagaataagtgctcatagtcatattaaaggtttaggtttggatgaagcaggttttgcaattccatcagctgccggcttggttggacaagaacaggcaagggaggctgccggcatagtagtggacatgataaaaagtaaaaaaatggctggaagggctgtgcttctagctggtccaccaggtactggtaaaacagcaattgcacttgcaatagcccaagagttgggaaataaagtacctttttgcccgatggtaggatctgaagtctacagttctgaaattaaaaagactgaagttcttatggagaactttcgaagagcaattggtttgaggattagggaaaccaaagaagtttatgagggggaagtcagtgaattgacaccagtagaaacggaaaaccctgctggaggttatggaaaaactgtaagtcatgttatcattggtctaagaactgcaaagggaagtaaacaactcaaactggatcccggtatatatgaagcactccagaaagagaaagttgaagtaggagacgtcatttatattgaagccacaagtggtgcagttaaaagacaaggaagatctgatgcttatgccaccgaatttgacttagaagctgaagaatatgtgccattaccaaaaggagatgtacataaaaagaaagaagttattcaggacgttacattacacgatctagatgccgctaatgctaaacctcaaggtggacaagacgttttgtcaatgatgggccaactttctaaaaccaagaaacagaatcacagataaacttagaaaagaaatcaacaaatagtagataatatattgatcaggtattgc

SEQ ID NO: 3721 - DNA, 1563 bp, Diabrotica virgifera
gaaaaacactttcgatatcatttagaaaaaagcagctgaaagggcttttagactttttaactaacgaagaggaaattatttgcaaagctttatacgatgatcttagaaagcctcgtcaggaatcgtctgataggagaaattgaaatagttaaggctcgagataaaaactactttaaaaaatttggatagttgggctaaaccacacaaagttaaagcgtctgtagtgaatttttttgatgatcttttgattgcaagtgatccttacggtgtagttttggttattggtgcttggaattatccgatttttgttctgtttcaacctgttgttggtgccatcgctgctggaaactgtgttgttattaaaccttcagaagtagcacaagctacttcaaacctcatcgctaaatatttgccaaagtatatagataccaattgctatcccgtttatacaggcgggccaaaagaaacaagtgaattgctagaacagagattcgactacatattttacacaggatctacagaggtaggaaaaattgttcacaaagctgcaagtaaatatctgacgcctacaaccttagaactaggagggaaaaatcctgtatatgttgacaaatccgccaatctaaaagcgacagctaaaagaatattatggggcaaatttcaaaacttgcgggcagatttgtatatcaccagattatatactatgtaccccagaagtacaggttaagcttttaggatttatggaagacgtaattaagttttttttggttcagttaaaacaacagattatgccagaattattaactcaagacactttaatagattagtaggattgctgaagaaccagaacattgccataggtggtcatctcgatgccgacgagcgctatatatctacaaatattatagtagatgttcatcctgaagatccagtgatgcaagaagaaatttttggtccaattcttccgtttattaatataaaggatgaggaagaagctatcaactttataaattctagagaaaaaccattagcgttgtatgtttttaccataaggttaaggtaaaaaagacctttatggaaaggacttcaagcggagcaatggttgtcaatgactctgttatgcatattataactgaaggcttgccatttggtggtgttggatattctggtatgggttcatacaagggaaagaaaacatttgacacatttagtcaccaaaaatctgttttgtcgaaaagttttaatgttatagcagacaaaattgaatcagtgcgatatcctcccaatattaattttacgacgtcatttttaaagggagtattaaaatatatcacgacgattcccactcaattattggcatcagtatttagttttgcattgggagtagcagttaccgtttcaggatactacataaacaagtcaattcgagaagaatagctagttatactttgtacataattaatcatagggatttttttattggctttagagcaacaaatgatgttataattttaagtttaatatgaatattttggtttcacaaaattatatcaaatattaagt

SEQ ID NO: 3722 - DNA, 1178 bp, Diabrotica virgifera
acaacatggatagtaagttgccaagggttaaactcaaccaatcgtcagtgatatacgtggataaagtgaattcaaacagttctgcagctcaacttgtataccataccagagatgtattcaaatcaggaaaaacactttcgatatcatttagaaaaaagcagctgaaagggcttttagactttttaactaacgaagaggaaattatttgcaaagctttatacgatgatcttagaaagcctcgtcaggaatgtctgataggagaaattgaaatagttaaggctgagataaaaactactttaaaaaatttggatagttgggctaaaccacacaaagttaaagcgtctgtagtgaatttttttgatgatcttttgattgcaagtgatccttacggtgtagttttggttattggtgcttggaattatccgatttttgttctgtttcaacccgttgttggtgccatcgctgctggaaactgtgttgttattaaaccttcagaagtagcacaagctacttcaaacctcatcgctaaatatttgccaaagtatatagataccaattgctatcccgtttatacaggcgggccaaaagaaacaagtgaattgctagaacagagattcgactacatattttacacaggatctacagaggtaggaaaaattgttcacaaagctgcaagtaaatatctgacgcctacaaccttagaactaggagggaaaaatcctgtatatgttgacaaatccgccaatctaaaagcgacagctaaaagaatattatggggcaaatttcaaaactgcgggcagatttgtatatcaccagattatatactatgtaccccagaagtacaggttaagcttttaggatttatggaagacgtaataaaggaattttttaaatggtcagcagttaaaacgtcaaatgattatgccagaatcattaaatccagatattttgatagattaaagggattgtgaaaaaccacgaactttggccatagggggttcttttccaaggccgacaagggctatatattttccaactaattcttgaaaaaagggtcatccctgaaaaaatcccagggattggaaaaaaaaaaaaattttttgggcccaaattttcttcccttttatttaaaataaaaaaaagaaggaagggaaaaaaaatttattacaatctttttt

SEQ ID NO: 3723 - DNA, 431 bp, Diabrotica virgifera
cacgattataataggcaacccacgctaaaaatatttgtcaatgtatgaaatttaataaaaaaaaatgtttcatccgcagagaagatgtgaggcaggtcgacctatattcggatcccgtactataaggtgttgataaactgtatagtatccagcggttttcaatctgtggtaaatgtaccactggtggtacatatcattatttgcggtggtacacaaaacacaaaaaaagacgtactaagtagtagtacttagtacgtcttgataatacaatctaaaatgtaggtggtaccaaaaataataaaaagaactgcaggtggtacatgactgaaaaagtttgagaaccgttggtataaactatatttgcatattttgtattttatatacatatatcaatgtattttttatttaacatttattaaacaatttttcat

SEQ ID NO: 3724 - DNA, 1165 bp, Diabrotica virgifera
gggccacgcaagcagggctgacgacacccggtaatcccgaatcccggtattttagtatttaacttactttcttaataggtgtacagtgtattcagtcaaactcaatcgtcatggcattgtcaattaaggttggaattataggaggtacaggatttgacgatccagacatcttaaaaaatcgcaaagaaaaagctgtgtcaacaccttttggaaacccatctgattcgttaattttaggagaaatagacggcgttccatgcgtattactagctcgtcatggtcgaaaacacgatattatgcccagtgatgtaaattatagagccaatatttgggccttaaaagaagaaggatgtacgcatattatagccactacagctgtaggctcgcttcaagaacattataagcctggaagtttagctttaacggatagctttattgatagaacgacaaatcgtaaacaaacattttatgacggcgaacctggacatcctgtaggagttagccacatccctatggaaccagcctactgcccgaaaactagagaattgattctagaagtagctgaaaaacttggaatttccataattaaaactggtactatggttattatagaaggtccacgattctctacaaaagctgagagtaaaatgtacagatctttgggcggcgatatcataggaatgacacaagttcctgaaagtgttcttgcgaaagaagctgccatttgttatgcaaatgtttctacccacgcgtccgtatgactgctggagggattctggtgttaaagtatgtgtacccgaagttatgaagacgtttagggaaaatatttctaaagttatcaagctggttttatccgttgtacctaaaattggcgagactgattggcataagacaattacagagttaaaggaagtgcagcaaagcagtgtgatgttgccacattagttgcccccaagttgaaggatccattctacattcctacctgcctaagtattttaaattaatgacattatttttctactactgttacatatacataaccaagatagatgaagactaattttacaatcttgaaataacattccgtactttcataaaatatatagcacacaatatttgtttgttatagcactgtattttgtcataataaaaaagtatcaatagg

SEQ ID NO: 3725 - DNA, 948 bp, Diabrotica virgifera
gacacaatgttatgaatgcttaccaaaaccacctcaaaagacttttccaggatgcactattagaaatactccctccgagcctgttcattgtattgtatgggccaaacatttatttaaccaactctttggagaattcgatcctgatcaagacgtttcaccagatacagaagacccagaagcaaaagttgagggcgaaggacatacttacactgaaagtggaaatatccaaagaacatctacgagatcttgggcagagtcaaatgactatgatccagaacaattgtttaacaaatttttccagactgatattgagtatttgctaaaaatggaaaacttatggaaaactcgtaaaccacctgttcctctatcttggcagcaagcactttcacttggagggactgccgaatcagatgcagaatctggcaccgccgcaaatatgcaagtttggtcaataagtaaatgtgccaaagtattcgaatcgacagtttccatactaaaaaaagatttatctggcaaatctttcctagtgtgggataaagatgaccaacccggaatggatttcgtcactgcctgtgccaatgttagggcgcacatattttccatacctaccaaatcgaggtttgagattaaatcaattgcgggaaatatcattccagccatcgctacagctaacgcgataatagctggcctagtagtccttcacgctttccgtgtcctgctgaaaaattacgaaaagtgtccagcgatctatctcaggcagaaatctatccactccaaattcgtcctggcagccgacaaacagatcgcacaagcgaatcctaactgttacgtacgcagtcatagtccttcagtgaatgttttcgttaatactacagtgatgacagtcaaagagtttgaaacggaggtcctacaaaaaatttaacatggtagctccggacgtgtgctgga

SEQ ID NO: 3726 - DNA, 1104 bp, Diabrotica virgifera
  misc_feature (1030)..(1030): n is a, c, g, or t
cagccattgagccattttctggctgtctggcaaacgtgttaaagtcttttattaagtttggaaatttaaaaatggttaagggtgtagtaataatattccatattttgatgaaatttatgaaaggcgtttgttaagtaaggaaaagccatggatgaagaaatacttgatacttgggaatgcattgtatgctttgaaagctttgcttgtaaaattcaattggccgcccatttaagaacccatgtaggtctcaagtcttttgtatgtgtgatatgttcaaagctatttatgaagaatagtcagttagaagaacacttaaaaagtcatgaaagggaagaaaaaattaaaaaggaagttattgatgattcagattatgttgaagatattaaaggggaattacaatttgaagatgatgaagaagaaatagaacatattaagtttgaactggttgaagatgatgatcagtttggtgaaactagtgatattgaagaatattcatctcagtgtgtcgtgtgttgtaaagacttttcatctcttaatgaattatctttgcatcttaagaaacacattggactgaaaccatttgattgtacttcctgcttaaaatcattctgttcaaaactagatctaattgaacatgttaaatattgtgaagataaaataaaacaagtaaactatcccacaatagatgagggtttcttaggatttaaagaggaagaaaaatatgatgttgagaaagaaaaggaaaaattagctgaaattattagaaaacaagaaacctctaaaggtgttaaaaggagacctgcaggaacaagaataaagtgcccaaattgtccactgacatttgataatatttgtcattttagaattcactacagaaaatatacaggagagaaaccatacaaatgtcctatttgctatagagcttttgctaaaaatagtaatttaacatcccatcttacaatccatactggagaaaagaggtttcaatgtccttactgtcctaaaaaagcagatcacaaaagtgctcttnaggtacatattagggtacatactggagagagacctataaatgtcacatatgtcatgaaagttttgttcataaaa

SEQ ID NO: 3727 - DNA, 1233 bp, Diabrotica virgifera
aaaaagaaaaaagtgaaaacctcattttataaccacactgaaaacttattatagttttccggaacttgctacaagcaagttactcattctacacctggccttcagcaccagttcttgcatggtttatctgggaaaatcgtgaagaattttgtggtaaaaaagttgttgaactaggagcgggtactgcccttcctggaatcgtcgctgctaagtgtggtgctgatgttatattgacagaatcagccacactaccaaaatctctatctcatactagaagaagttgccaagttaacaatctagtggttaatcaacacattaaagttattggactgacttggggattgtttttaggtaatttagatctgcttggtcctcttgattacatcattggttcagactgtttctttgaaccagcaacatttgaggatattcttgtcacagttgcatacttgctagatataaatattaacgctaaattcttctgtacttaccaagaaagaagttctgattggtctattgaacatttgctctcaaagtgggacttggagtgtattgtgcacaatataaacaatttagggaacagtataggtctcaacattcacgatttaattggagatcacagcattcacttgcttgaaatttcaagaaaatcataagtaatggctacgaatggtgttcgccaactctacagattgtatgtgagcaacattccttggaccgttggttcaaaagagttaagaacttatttcagtaagtttggacatctgcaacaagctactgttgtatttgatagaaaaacaggactgtctaaaaactacggctttattacatttagtaaccgtgaaggcttagaaagcgccacaaaaaataatttacataaattggagggaaatacaataagagtacagccatcaaatcctgaaaattaaaaaaagctgatgcagtagataattttagtgattttacaaaaaataagaaaaaatattaaaggggaaaaaagtttgatattttttttttaaaaagaaccaagcctttaaaaagacttttgcccaagggtgaaaacaaaacatcctttttcctttttgggttttaaaaaaagaggatagtaagggctttgtccaactctccaacccaatatgtgtttttattttcttgggaaaactcaaagggggaggggcttgggaaaaaaaaaaagagaaaaacatccccccccaaaaaaaaaaacaaatcaaa

SEQ ID NO: 3728 - DNA, 1046 bp, Diabrotica virgifera
  misc_feature (1014)..(1014): n is a, c, g, or t
cggggttcacggtggaagattgtgagtgaccgccggtatttgaaagatctacgaaaaacttaaaagtatcctcaatatgaaatttttaatttacgtcctggctacagtatttgtagccagtgtttcttcatttggaggcaacgatgaaaagtttttaaagaaatatgcaatgatgaagatatatgaaagttgttttggcgaagaagtagtgcgacaaatacgacaggaattaaaaaaggcatgcgcgaagtgctctagtttagaagctccgccaagctcgcctctccctgtgccttctgtaccagaagaaagacctctacatccacatccacttcaagagaccgccggacaacatcccttacaaccttctttcgaagcagaaaaattacaccaagctattttagctttcaggccgaatccaacacctcaacaatttaaaccattttatccaggatatggcaacagtccagctacattttacggatcaccttacggcaatccacagatttcaccagtacaaatgccattcttctacccaggatatccacaggtgccattttctccataccaacttccagcatcagttggccagcaactgtatggaaatagattatcgagaaacatggatgttcgaaaccagttagaaattttgactgccagaatgagtggaagagtacgaaacatcacctgtgttatgcaagaactgggttacttagatgaaaacttggaaccaaattatgttagaataaatgaaaggattagcaacctcccaatatccgaagaattgaaaaaagacatgcaagaaggggtcggattttgccaacaattttcgcaatgtgtacctgaggttaaaaaagataaatcaccactctcaagagaactgatccggccaatgttcttctttcaatgctacaaacacaaaaaactcgaagcctgtattatgaaagatgtcagggaaaagttctcaggagtctcggacgaagagttcgacagcgatttggatttgagaagggncagaaaggacatgaaatttcccaaactgacca

SEQ ID NO: 3729 - DNA, 2080 bp, Diabrotica virgifera
cctttacgtccgcaagaacatgctatttcttactctgagttttcgtcaactatcaaataattatttacaaatgtcattcaaactaaaattacacagtcatgccacctaaaactataaataacttaaaataactaaatgtggttgtattgaaaataaacatagttttatttttacatatttactatgaacataagaaaatcaggatgtatcattagtgttaaacttctggattaagataggtaggtaggtaatatcaacattctaggctgaagaataaaagatttctattttaaccttataatatgttgttttttcttactgtggtttaccgggtttgactccgcgttgaatagttttggtttttagaaaaaccattattttaacgtttcggcaaaatcacacttgccattgtcgtcaggtagttctgcttctcgctgctgcttgaagtaaactgtttactaaacataaatgtaaattatttttcgaagagagattgaaaaataaaagaatatcaataacagttgatcatattttaattgagaagaaaagaaatctgcttaacaaaggtgacactatatagaggatccgatatggacagataaattacttattttggcatcataaccctcgatgggtctttgcctgtctggttatgtccttccattcagatctctcttgtgcccttcttcttcattgccttatatttatggttttcaggtcgtctttcacgtcaaccatctcgttctgagccgtcctttttttctccttccattttaatatttggacatatttaaggaatgtagaatgcatgtggcgaacatgaagagatgtacctaattaaaaaatatttccagcgccaatgacaacacaaaggaaaaaagaatggtttaatgaagaatgtgaaaaagtattaatggaaatgcagaccaggctcaagaactcagggtgtatttaaaaagtcttggcgctgaaatttctgaagaaaagtctccgaaaggtatagaagacgatttacataaaattattggagtatgtgattcgtgttttaaagagggccaggaaaatgatgtggagatggtgttaaatgacatagtttccataatggttttgattccattggaaagatcagaaaacatcatcctagccttctgtgaaaaactcacaaaagcacagggccaaaagttaggtttagtatgtcttagagcattatggttactcttccaatcattggatgatcgttctccaatgcggtatcctgtatattaccacttaatacaaattgcgaaacaaacagaatctgtaaaattagtgtttcaagatatcaaccatctaaagcaacagtttgccaattgccttccgtctaatgaacagcttcaaaagctttataggcttttacatgaagtactggttaaatcaaatcaaagtgagcaggctgctttagtgatgattgaacttcttggtacatacactgacaaaaatgcttctcatgccagagaagacgccatccgttgcattgtatcagcactagctgatcccaacacattccttcttgatccattgttatcactaaaacctgtcagatttttggagggtgatttaatacatgaccttttaaacatctttgttagtgaaaatttgtccacctccctcaagttttacaatgaacataaggaatttgtgagtgcacaaggtttaaatcatgaacagaatatgcaaaaaatgagactgctttccttcatgcagcttgctgagagtaatcctgaaatatcttttgatgtcatcgaaaaggagttacagatgaaaccagacgaagttgaaagctttattattgaagtattaaaaaccaagttagttcgtgcaagaatggatcaatcttcccggaaagtctttgtgtccagcacaatgcacaggactttcggattaaaagttatgaaaacttcattatcattactgcactcttggaggggaaatataagttctgttcaagacggtatgaagactatcgccgctgctcagctagaacttatgaaccaacaacagtaatgataatgaagttttcataacgttttattaaaagtta

SEQ ID NO: 3730 - DNA, 1066 bp, Diabrotica virgifera
cccacgcccccccttttctttcgtttatggccagtgtggctaatagataaataataaatatattttatataaagtaaaacacaaatttcacgatgcaagtgcctcctgtatttatcgatatgtccctggaagaccaggcccaagaactcagggtgtatttaaaaagtcttggcgctgaaatttctgaagaaaagtctccgaaaggtatagaagacgatttacataaaattattggagtatgtgattcgtgttttaaagagggccaggaaaatgatgtggagatggtgttaaatgacatagtttccataatggttttgattccattggaaagatcagaaaacatcatcctagccttctgtgaaaaactcacaaaagcacagggccaaaagttaggtttagtatgtcttagagcattatggttactcttccaatcattggatgatcgttctccaatgcggtatcctgtatattaccacttaatacaaattgcgaaacagacagaatctgtaaaattagtgtttcaagatatcaaccatctaaagcaacagtttgccaattgccttccgtctaatgaacagcttcaaaagctttataggcttttacatgaagtactggttaaatcaaatcaaagtgagcaggctgctttagtgatgattgaacttcttggtacatacactgacaaaaatgcttctcatgccagagaagacgccatccgttgcattgtatcagcactagctgatcccaacacattccttcttgatccattgttatcactaaaacctgtcagatttttggagggtgatttaatacatgaccttttaaacatctttgttagtgaaaatttgtccacctacctcaagttttacaatgaacataaggaatttgtgagtgcacaaggtttaaatcatgaacagaatatgcaaaaaatgagactgctttccttcatgcagcttgctgagagtaatcctgaaatatcttttgatgtcatcgaaaaggagtgacagatgaaaaaaaaaagttccccaatgcaacccccacagaaattcgaaaacttttttttttttgg

SEQ ID NO: 3731 - DNA, 1178 bp, Diabrotica virgifera
ccccctttgggtgcacaagaccaagaccaagcttgcatgaacaagaccaagaccaagaccgaaccttgcaagaccacgcaagaacaagaccaacctgcaagactcttgcacttttttgagaaaaattggtttttattatttaactttattttttagttcaataatatatactgacattgtaagaaaccttaaacaatatcgaattttttaaatacataatattttggttatatttttaagtcgttttgattaagtcaaacggtttgcattttctcaaccttcaaagtgtccagaaggcaagttttcaaacggcgacagttcaaggacaattgaaattacttgtgagacaaaaaaatgtaattatagatagggtaatccatttaaaaagaaatgcaattaaaaacggtttttatgtaccagtagttttcgcttttctgtctaataaaaatactgacacttatttcaattcttttcgcataatcgaggaaaaatgtaggtcgttaaatttaaaattaatacaaaaaatatcataataaattttgaaaagggattcacaatgctgtgaaagcattgtggcctgaataaaagataactggttgtcgattgtaatgtgtcaagcttggtatcgcaaaatccaaagcttaggttcagtttctgaatattatgacaaaaatttcgatactgggaaatttttaaaattatttttttgggttaattttttacaatcaacgaaagttggaagttgaattatttgtgaaaatcccggatgacaaacgcgtaaagaagtttactgatttcattgttgaaaactatttggaagaatctaggttttccccagaaagggccagtactacaaatagtatgtgccgcacttgaaatgcatgcgcatcatttcagtgtgttttaaattctagtttttactacccacatccgaatattttcaactttttaaatgtcataatgggtattcaatccaaaaatatgtgaaaataaaaagtgcgaataactcgtgttacgagagcaatgtagtttaaataaaattaaagaactgcaagataacaaattacagaattaagcgtttataactccccattaggtatagttattatgttatagtattaggtctttaaataggtatggtaaatatgaacgtatttactaaaaagtatgttttagtt

SEQ ID NO: 3732 - DNA, 837 bp, Diabrotica virgifera
acccacgcgtccgcccacgcgtccgcgactgccggccattatttgtaagcggcgaaagattcggcgttgctttgtaaaattgttgtgaatctaccggcatcaaaagcctaaaaagcgtgtagcttttacgtagttatttaactgtagctactttacaaatttcatcaaaatgggcgatgaaaagaaggccagcgatagcgaacacattaatctcaaagtacttggtcaggataatgcagtggtacaattcaaaatcaaaaaacacaccccattaaaaaaattgatgaccgcctattgtgaacgtgctggtataagcacacaagtagtcagatttagatttgatggcaaccccataaacgacacagatactcctaattctttagagatggatgaaggagacacaattgaagtatatcaacaacagacaggtggtttcttctatcggtttctattcatttaaataatcacactgtattgttcttgtattttcttatttgctaaattaaactagttttaaataagtaagttaattttaatatagtttttatttcatgtcaactgaagttacaatagttctgtaagaattcgactatttgtgtttttggactcttattttgtaattaaaacacttagaatacaaacatttttcttataaaaaaaaaacctttgaaaaaaaaaataaaaaaaaataaaataaaaaaaaaaaaaaaaaaaaaataaaaaatttatataaaaaaaaaaattaaataatttttaagaaaaaagggggggccccccaaagggttcaaactttacttacccgtgaaggcaaattaaaaccccttcaaaagggtcccc

SEQ ID NO: 3733 - DNA, 996 bp, Diabrotica virgifera
  misc_feature (777)..(777): n is a, c, g, or t
  misc_feature (812)..(812): n is a, c, g, or t
  misc_feature (821)..(821): n is a, c, g, or t
  misc_feature (918)..(918): n is a, c, g, or t
acatctacaagttgtttaacaaaacaatattttaggttaagaattggacggagtaaaacagaataataatggtcagaatgtcaagaaattcttcccaaatattttgtgcgcctgtgcgaacttaaaacctccgcgaacgctcgattttgtaatgcgcagaatttccccctttgggtacgttcgggttgtccagcgcgaacaaagctgctataactattctatacagcgtttcaggttaagaaccgaacgttgcttagatagaccaatgtatgtcttatggaggatagaagcgcgccgatgccaagtcgtactgattagattgaatcgaatatcggcaatcgagtagccacctgtgcccgagaggtttggcaatactgatctccataagcgcaatgtttcgcacttaacgtgaaacaaagtatgtttagtaaatagttgacgttccttcaaaatttgaagccgatggagaagcttctggaatgtatattccgcagtagtatatcctggattaccctacaatatagtatctcgatttactttcgcgtcagtaagatcagttccctgtgcgaactattaagccttattttcgtatattccaatcatataatattccccattagccttattttcatctttgtcgttaatatcagagaaatagtcgattaaaactctgtaccatcgtaacataaatgtcttaatttttccattatgtgcgataacaacaaaaatggcggcccaagacgacatagttgttataaaaatgtagaatcttaattntttctaatatgattgtactgaatgtatttatttanataaattgntacatcattttgctgtatatataaaaaatttaaaatgcatttcttactttattgacgatattatatcgccccgttttaatgaaaagttttgtctggncttaaatccgggtcctgtacaaagctgtgcggtagacgtggaagagtaaaactgcgcatgcgtcaatcttacgatact

SEQ ID NO: 3734 - DNA, 1261 bp, Diabrotica virgifera
accttgcgtccgctcgcaacaagtaatgtttttctcgcatattgttatatattttgttaaaattaatatataaatgtaaccatgtaggacttttactaaattacttaaacaatatatatacagggtatagaattagtccgaataaaattgagggatatacttcaaatatagcaacagaaatccacaggcaagtggcccaagaggtgagaataaaagaggctggtgttgaaagacaaatggtcatacactgaagaaatataaaggaacataaaatatagagtctgaaataaataatgcggaataaaataatccaataaacaatccgaagtaccttatcagataagaagctttgtatagtgattgtttatcttcaatgaaactatatgtcaaaatcctgaagaaccctctacaaaacgtccagtacttggtgtatgtgtgattattggggtattcagtgaaacgaatttgggtttagaggagtttatatcactaaattgacaactcattactttattcttttctacatggttgtattggttaatatttctgttcagtttatttaaggaaaacttttattgccactacataaatgtggagcataccgcaaaatgaactgatatcaaattctaaacagattgtacacatttttttatatcgcctataaatagataacttgcttattataaaatgcatcaatgcgatcaataataccgttaggttttttactacataactattttttcaaatttatgtgtaggtcataacaaattttggtccatgagtgtatctactctagtctgtgatgttatttgagaaatatacttgtaaagattctgtaaggtgctaaaattaatatgacgagatattttcagtagtcttatgagcaagaacatttcaaatgcttcaactatctttattcaaaatatttccaaaaaagattttcgatttactttctggtgaacgtcaatcttgctatttctattctacttcccatttatctttgtatccagttaatctaataataacgaataccactattattttcgttttattggtattttgagtttggaatccaaaatatctccgtatttaaaatcatacacaaaatttggtacctactgttttctggatctgttttttcctagtatgtacagattactagtttatagatattccaatggcgttatttttaagtacttactttaccattgggtgctaccgcttttgtagaactctggtctcctgcactatctccctccat

SEQ ID NO: 3735 - DNA, 1171 bp, Diabrotica virgifera
ttttaaagttataatcattctttcattttttgacgttttgattatttaagccatgttccgcacatttttgagtgggaggatgactcaattattgttatatcagttggtttcaagcaatttcggcaaaacaatatgagttacttctcaacgtccatctcaaaacagatgcgccctggactaattatcttttgatatcttcaccgcttctgtttcttcaatttacaatcgggtaaatcgattttgtgagcttccagaatattttccgcgagaactgccgaatttagaagaccagagtattcgggaaaccttaaccttaaaagtcgaaaacaatgttctatcaacacgcgaaagtgaaaaaagaaaacataaaccactgtaacttgtaaactactgctccgatttattagctcaaattttggtaggtatcatttgagggataagaccttttaaaaacatgaatttgtgatcgtggcgtcatctatatgttagtccagaaacttattgattggtttggtacatgtgtagaatgcagttaaatttatttgcatgggtgcgtttaaatctcgcaacaagtaatgtttttctcgcatattgtgatatattttgttaaaattaatatataaatgtaaccatgtaggacttttactaaattacttaaacaatatatatacagggtatagaattagtccgaataaaattgagggatatacttcaaatatagcaacagaaatccacaggcaagtggcccaagaggtgagaataaaagaggctggtgttgaaagacaaatggtcatacactgaagaaatataaaggaacataaaatatagagtctgaaataaataatgcggaataaaataatccaataaacaatccgaagtaccttatcagaaaaaaagctttgtatagtgattgtttatctttcatgaaactatattgcaaaaccctggaaaaacccctctacaaaaacgccccataactttggggtatggtgggaatattgggggggattcaatgggaaacaaaattgggggtttaaaaggaattttaattcccctaaaatttaaaaaaccccttaccttttattttttttttcctcctgggtttgtttttgggtaaaaatttttctttttttcctgttttttttttaaaggaaaaaaattttttttattt

SEQ ID NO: 3736 - DNA, 713 bp, Diabrotica virgifera
aggttgtttgattaggaaagtaagatccgttttactaattaacaatgaaaaattttctagttctggcagcagtttttgcagttgcttatgcaaaccaagatgattatctccgttgggtaagctacgatggaacaataccagacaacgctgtaccagctggagaggatgctaacaataacactatatatattggacgtgtctacttaaacaccaatacaaaccagtccagttggaactataccacagatgcaaaaggatacgttcccgggaatcttagagaaggagttgtgtctttagatactgtgctattccaaaaggttcatacagctacagaaggaattgagattttaacagtagtaaacggtgcaagaatagaatggaaattcgttaaaaactatcagttcccacaactttttgacacagaagcttatcatgttgctagggtcggttgggaatatgaaggaatggaatttaattcgactacatatcttggaactgtcaattttaacgatcaaccaaatataggaaaaatttttaatgctgcagttctttgggcagaaaaccacgttttatatttcccttcacagggaacagttttgagcggatactcatattatgctttggtttattattattaagtgtattttaagtaaaatgaaatatttagtgtattataaatgcataatttaatatacaataaaaaaatataccat

SEQ ID NO: 3737 - DNA, 1176 bp, Diabrotica virgifera
caagcctggcgaaagtaggaattctagattcttcaagtcaagtttcagaaatttctacaaaaaactcaacgagtctacagaagattcggtcaaatttttcttggaattctacgaaagctgtaataaatttgagaattctgtgcatcgtctgaacagaactaaagctctttcaggtactggtggcgcagatgttactgaaacagtaattaaatctattttagcagaatcaatgccattttttgacttgggtttaaacattgtagaggacgaatttgtgtttgagatttctctacctggagttaattaccttaagacaaaagtcaagggatggtcggtggtagagcaatcaaaagacttttgtatcgcagccgaagcaggcacgatcagccaggacgttattgaattaaaaaaaagatcagaaaatattaattcttgtatcaaggaaataacaaatggatacattaacgagtttttgatagaaatgcaagagttaacttcatcactctcttcaggaaaggacaatctggaggctatcgtaaaatcaggacaaagcagtaacgacctaatagcaattctagatagcatacaggaaagctggaaggtatatagatctgacaaagatccctcagtaaagcagaaaatgatgaccttgacggagcttagtaccaaatacgctttgggatttgattggatagctgtattaagcaaagtgacaactggtgccattgctggtgataccaaagtctatttttctgaatatcttgatcagccttttacgacattagctagtaaaactgcgggtctaaaagacatgttggatttatggtacagtgttcaaatgtacaaaaaacgttgttatggagaaacagaccggcaatctaggacattactgcatgcaacttacttctgaacttattcccgaagttagttcccacataatatatgaggttaaaacaaaaaaaaagaaacgaaaaaatttttaggcctaattggatacgtatttaaaaatcttaaaacttctttttgaaaattccttggaaaaaagctaaatttggggaacaaatttttttcaaaaatttttaggaaaaaaaaattaattcaacgtggatttattcaaaaccccccaggaattttttttctcaaaaagtgttttcttttttaaaaaaaaaagggggg

SEQ ID NO: 3738 - DNA, 1071 bp, Diabrotica virgifera
gtgttaaaatatggcaggatcgggcagttatactgtcaataggagaaaagatgcctccttcaagaattttatttgtgcccttgtggccttcttggccatgttaatattaatctcaattctactttgggctttaagaaaccgaggcagtggaagtgagagtctattatccacaacgccagttccaaccaatgacacgggtgaacattcagcacacttaaatggatttataacaggcgaaaaaagtaaaaatgtctctacaacaacccatagaaacacccacaagccagaagaaaaagaccctaataaccaggaatctgcaaaaacaccagcatttgtaccaggaaatacatgcgaagagggcgtttgcaaacgtgccgcttctgtcatgcttgccatgatgaaccatgaagataatcccaaagtatgcgatgatacacaaaatatggactacttcagcgttatttgtgacaagcctggcgaaagtaggaattctagattcttcaagtcaagtttcagaaatttctacaaaaaactcaacgagtctacggaagattcggtcaaatttttcttggaattctacgaaagctgtaataaatttgagaattctgtgcatcgtctgaacagaactaaagctctttcaggtactggtggcgcagatgttactgaaacagtaattaaatctattttagcagaatcaatgccattttttgacttgggtttaaacattgtagaggacgaatttgtgtttgagatttctctacctggagttaattaccttaagacaaaagtcaaaggatggtcggtggtagagcaatcaaaagacttttgtatcgcagccgaagcaggcacgatcagccaggacgttattgaattaaacaaaagttaataaatttttttagtatttaatttaatttaaataataattttatttatttggggagattaaaaataaaattaaattttttttaatattattatattaattaataaatttttagatcccatttttttgattataaaaaaaaaattaccttaaagaataaccgcgcaattttttttaagtagaagttc

SEQ ID NO: 3739 - DNA, 1722 bp, Diabrotica virgifera
  misc_feature (1583)..(1583): n is a, c, g, or t
  misc_feature (1602)..(1602): n is a, c, g, or t
  misc_feature (1621)..(1621): n is a, c, g, or t
  misc_feature (1640)..(1640): n is a, c, g, or t
tgaaatagtcctcgcacagagtgaactaagaagtcgaaagtggtttagtgcattacgtgcttggatttattataacttttcttcaattaccgataattgtaaagcaaaatgactcttgttcaaccaagccctgaacttcaaatccatatcagacatgaactcaatgaggatgttaacacacgagaatcagatttagagcatatcaaagaatggttaaggaagcaaccgcatttaccagatacctgggatgagaaccgtttaatgacttttttgagaggttgcaagttttcattggaaaaatgcaaaagtaaattagatatgtatttcacaatgagaaccgcctgcccagaattattttcaaacagggacataacgaacccagaactgaagctcatacgtgaattggggcacattcctcctctaccaggtttgactgcaaacggtcgccgagtagtagtccttagatccaaaaaggtagacgtcgatacttacgatatagctgatattatgaaggttgttcttatgatcggtgacgtaagattagctgccgaagaagtgggtgtagctggagatgtttatatattagacgccacagtagccacagccgctcatttttccagaattaatccagcgatgatacgtaaatttttggttattgttcaagaagcatacccagtgaagctaaaagaagtccatgtagttaacgtttcaccgttggtagataaaattataacttgggtgaaacctttcttaaaggagaagattcgggaacgaatccacgtccattccaacttcgaatctctacataaatttataccaaaagatgtacttcccgaagagtttgatggaactgctggtccactacaagtattccatgatcaatggatggaaaaactaaaggaatacacaccttggttcaaagaacaagaaaacatcaaagccgacgaatcaaagcgaccaggcaaacctaccaactatgatgatctctttggagtagatggcagctttaagcaattaactattgactaactccaatcaatataacttgctgcaaagttttaataagtataggaaatgttattggttattgtaattatctttttatctgggtcgttggatacgcttattccaaatactaaaatttcaaagctgtaggaaagagttcaaaacaaatagatttaatagactacagtgtaggtaaagataatgacaagcaatgttgaatattaaatcttaaagtaactaaaataacagcccaataatgatagtcagatgatagaccttataatcaaaacgtttattaaatagtagtttcttttctataatttacaagtaaatgacccaatataattaaaataagaaaaaagagtataattgtgtcttgtctgtataaaatatcaaagatatgagtaatagaagtatataaaaattcaagttatatcatcggactaaagtgaaagcattgctaaagaaaaaattgttatcattgcactaaattgtgtttcaccttgatattcttgactatatcctgtttttaaactaggaggagtaaactcaaaaaacagatttatacccagtaaaanatataaggtgatggttccnaaaatgatgagcgaatcanataaatcataaaaaattgnggctaatgaatctaggtagatctagccctactcctttgcgtacttggtgtattttattataaaataactatcagcgcaagtc

SEQ ID NO: 3740 - DNA, 877 bp, Diabrotica virgifera
  misc_feature (774)..(774): n is a, c, g, or t
  misc_feature (844)..(844): n is a, c, g, or t
atttataaactcttcaaaatttcaaaccatcagtgtccgtcttatcaaaacattgtgcgttcttccgcttctgataagccagctccagtagttattgtgtttgctccaccagaagactgaaaattttgttgttaaagcgtaccaattgggcaggatgagagctacggtcatatggacatttatcatcctcgttcaatccacatcttcactagctccatggccgccagctcaaatgtcatgcttctatggaccaaggggctcacttactgccagatgtgttaacgccacggcatattacttcaaactaaccaactatagattcgattatctggacgaaaccttacaatgcatcaactgttctctaaaatctttggagcaaggcacgtttgacatacctggaaatgagatcaaaacactggatatcagaaacagcagtatcgtgaaaatctggcctaaagcgttcataggaatgatctatatggagcagcttctactggctcacaatccaatcgaagtagtctatccagaagcatttttgggcgtaagaaaagttaagtaccttgatatggaggacactgtccataacctagaacctaaagttttccaagatctttatcttttggagtctttaatcttaaaaaataacaaattgcaagacatcaaacctggcacttttgatggcttgcgtaatttaagaacgttagatttaagcgacaatgagctgaaacacgtaaataatagttttgatcctttagttaatttaaaggttcttanacttaggaacaattttatcaagactgtttatgcgagatgagtcaacacttaaagacattacttttactanatcagaatctaacacatgtacacttcactacta

SEQ ID NO: 3741 - DNA, 825 bp, Diabrotica virgifera
gtatttataaactcttcgaaaatttcaaaccatcagtgtccgtcttatcaaaacattgtgcgttcttccgcttctgataagccagctccagtatttattgtttttgctccaccagaagagtgaaaattttgtttttaaagcggaataattgggcaggatgagagccacgatgaggaaagaaatatggatgctactaatactgatgctagtggaacgaacagtacagacctctgtcggaccaggtgacttatccaaatgttcttatggagaaagaggctctctcacatcgacgtgtgtcaacgcctatccagcctattttagaagtactccatataggtttgatcagctggatgaaactgtcaaatgcgaacactgtaccttaaccgtaatagattctggaactttcgatatttccggcaaccagataaagaacctttggttgaataacagcaaaatagaaaagatcaatcctaaaggttttgttggcttgatcttcttagaacgtctcattatcagctacaacagtgttagatcaatttatccaggaacatttactggagtaaagaaaataaaaaccattgatctatctcacaatcagctagatatactgtcagatgatgggttcctggaactagttaatcttgaagagttgaacatggaagctaataacataaaaactatcgctcggaaagcatttaatggacttactaatattttgatattgattattcttaaaaatcaaatatcggggatgaaaggtgctgttttaaatatgacagagttgttgagtatgaacttagaaggcacccacatacaaacgttggg

SEQ ID NO: 3742 - DNA, 596 bp, Diabrotica virgifera
gcaattcttttaaattttttactaggacatttatgtattcatatatacgttattaaaaccagttaacataaggtcagcatggctcagttaattgagaatattttaaaatatatatccgataacggagatattaatacgttaaaattagcttccgcatttaacgaagaccatcagaaagttattggagccttaaaaagtattcaagcccatggagatttagttgtagcagagccagtcagtaataaaaaacttgaacttacagaagaaggaaagacaatagctgaaaaaggcagctatgaagctatgatatataatagtcttggtgaaaatggattacctcaagctgaagtaatgaaactaccaaatgccaaaataggttttagtaaagcaatgtcagcaggttgggtagaagtagataaatctgttacacctccaatggtgaaaagaaaagtgcctcaaattaaagacgtagttcatgaacatctcaaacaaattttggctgaagatatatcctcaatatccgataaagaaaaacaggagtataaaaagaggaaacttatttcagaagtgggtgtgaaaagctttgatttaaagaa

SEQ ID NO: 3743 - DNA, 1031 bp, Diabrotica virgifera
atagtttttgagctgttagtggctcattagttttttggtttcgtccgaagtcaggacgcttcgacgcttcagttaaagttctttgtgttcgtgctaaaatctcacgtaatattacacgtgagtccgagggatatattccaatcttgaccatttttcgacaacagcaacccccagcaggctggataccggctgttcattgttcatctttaaagtcgccgcaagacgactagccatccacccttcaaacataagttgatagcttcttccgcactatacctggcaggaaaagtcaaagatgatcccctgaaaattagagatattatcaacgtagctcacaatacactgcatagaggaagcagtctactggaaattggcgacgaatattggagtatgagagacgccattgttcaagccgaattgttaataatgagaatattgaagttcgaagtcagtacaactcatccccacaagttcatgttacattatctgaggtccatggaagggtggttgggtaaagaacagttggaaagcgtcccagtagcaagagcagcagcaactttccttcaggactaccaccacgatcccagtatccttgactatgaccctcgacacgtcgctatcgcttgtatatctttatctctttcaatgctatggaatacaattaccccttatagaagacacccgacgatgaggcctggcacaatatatttgttaaggatcttccccaagagaagaattgggaaataatggagaaaaaattggaagaagtgtaccagcaaacaaacagaattatatatattttacgtaactgtggaccaacccagtcgaatttttccaatggttcgaatttaggataaagggaaattacccaaattaaattaaagaaagggggggttgataatcctctgatggattttttttcatttttaataatatttaacatggaaatttatttcccttttccctttgcactggggaaattttaaaatattccattaaaagggtaatttttaggggtgtattttttgttg

SEQ ID NO: 3744 - DNA, 960 bp, Diabrotica virgifera
gtgttttggagaagctaggagactaagttttgggagatcccggaggaattggaagtcatgtcatccggtaaatttttttactcttaaaaaagtttgagaaaaaggaacgaatatggccgctctcatgtcatattaaattcctattgaatttatttctgtaaatgtatgaatcggagttgttctttgaatttagtatctttaattatatccatagttcgaaaatatacactcagatgaagattatcttgtcacatatcctgtaaattatatcatttgatttgtgtggttatgtcaacctcataatattgaattcaaattttacagattacattcattattctctattctattagattgtgtgtattctagccaccttaaattcgttccaaaagccagtatttttcttaaaatttacaacacattacattatcccataccatttttaataataaaaaaaataccctttatagacatatttttcagataaaaatcatattctgtattaaatattgaatttaaagttaaatcccaaattaatgtgtgtaatgtgaatcaaggtcaaatccatcattgtttttgctaatgatctttttgttgttcattctgaaaaaaaaatatctcatttcttttcctttggctctttgacctttccttagattctgacattgaaactaaaacgggacatgtttgtttttagccacttgggggaaatcttaaactgtaaccagtccgtcagctcccctcacaactgggagcaaccgttctactccaagccaggtcatttggagaccagcctggagaacctcccacatacctactttgtatcctgccctctgcaccccagaagggcatcggtatattaatttggtacagctagcaccatccctgggctaattcgctacccaggaatttttggaatcgaaacaggacactctcgggaccatttttggggtttgtttt

SEQ ID NO: 3745 - DNA, 848 bp, Diabrotica virgifera
agatgagatgctccacccagtagacattcataaaacttgtttgctagcacatgtctgccttatgtctagctgcttgcgtctctctcagcaccgtattcgcattgtatttcctcaacaatcggcatgtagtattagtgcggtcaataaaaataccatcagcatgtaatttatgtaaaacaatcgtcataatttaaattttatttggcaaaccttgaatttcatccacggcagttcgaattgtttgtataaatcgcaaagtgatattttgtttcatgattatcaatcagcttgaactctctctgataatgttaacgacgttgaattgaatggaattgatattatcacgagcgtctaggaaccgtgttaacaatcaaaggacatcaaaaaacagccggcgagacgcgggccaattaatctgatcagttctggaccaatgtagtgagcatctcaactcaacgtttcaagatgaaaaaaccaggagactttcaagaaatcgcgtccgcggaggaaaaaataaaactcaacggtcacgcagagttcgccattgcatacaagaaaaatgcaatggaaacagacaaattctacttggctcatatagtttttctagtttttggaatcatgcatttattacctgtgtccttttttgtaacggcaaatgattactggatgtacaaatttcggaacacgacgtcagacaacacggatccaaattacaggtctatccttcaatccaactttgcatcaggaacgaatgtagcgcaatcagttccgactgtgatatgtatggtcttagccgtggtgttcgcttacaaaatcaaggtgaagatcaagattctcacttctctcta

SEQ ID NO: 3746 - DNA, 893 bp, Diabrotica virgifera
ttcaatctaaagcatctttctcctctttctttctaattgcttgtttgctacatctaccatgcttctcggcttaccatcataactttctctagctgtcattatgcgttgaaaacatcctcaaaaaatttcatgcaattttttgccacaaagtttaattttaaagcatctgccaatgctggtttcagaaagaataaattctggacaactccattcctaaagttaaaagcaaacatcgtatgtatacatttcttgaatactgatggtttttcattaaaacaacgaggattggcttcataaaaacatctaactaggaactctattgcgaaatcttctccaatgtttgtaacatcaaaaataccacaattcttgtgtacgaagtctaacatcgtttgatttatttcgattatatgtggctgcaaataccttaacatgcccgaggtaaacactggactaagcatttttcttacttttctccattcattatattttaagaaaaacattccatgagccatattgggatgtgaaggtgtagcaactcttctgttgcaaaatgttgaagcatctttaatcaacacgtctttgattagtttgggagattttagaactaaaactggttcatcaaaaatgaacatcccgaaatagggagcattgattccatcccatatcttctttatacattcttgggtagtagttttaaacatcattacatcgtaaagattgccgaagaaagggacgggttttaaaaattgaacatttcttcttttccaatagttgaagtcccttgtagcgtaacaataagcagcaatgcataaaatgcttaaatatattaagccatcaagaaacggggaggaggtgagcaacattgtattaggagaccttttgcagaccaagca

SEQ ID NO: 3747 - DNA, 959 bp, Diabrotica virgifera
caataatcttataatttatttatgttacataaaacaggttaaaacaaaagttttcgaaaaatataggataaaaattaacttatattacactttagtaatttacaccctgttatacaactactggttggtaaacgtgttctgtgaccaaaggagcatctttttgggttgctctaggcgatgcaaaaccgctactgataaggaatatatttttccattttgtcacatccttctgctcatattcgtgaattgttattttactgcagcgcaaaattaccacaccaaggaagaatatcataacatcaacaaatccagatatgtcagatgttaagtccacacggttctccatattgtatctgtagatccagttgcaaatatacattgttttgtacagaaccaacaagaatagatacaccttcatgtgtctggtgatttttttactgtggaagatcatgtaaatctgagggatgataactactgcctccaagtactcactgaatgtccagagtatttcaatagcatctaaactgtgagaaaagaacactgcaaaaatcagtgccccggcaataaggacttcagaccaaaagctgtcatatttcttttcgtatgtgctctccattttgaacgcaagtaaaaacgtgattgctgagacaagtatgaagaacactttcattatagtgttgtaatatgatatgaaatacgaaaataagtcaagatatctggtaataaatactgcagtgtagagaagctgcgtcttagcagatacaccagcatatgacttctcctttaggatactccataataaatataacattgcaagggtgtgcgatgcatcaccagctattctaaagacattcatgtcttcaaatttggaaaacaaaaacagatctgaatggaccaaaataaataactagagagcaagcagcaagcatacacatccacagaacacgcgacgttctaac

SEQ ID NO: 3748 - DNA, 837 bp, Diabrotica virgifera
gatagtattaaattatatttatttgtaaatataatttgtatattttatataatttatatatttgtgaatagttataaacagtccgttgcttaagatggagaaaaataataaagaattgtatgaagttaaatatatttgtgaagaaccggaaactacaccagagttcaattctaataatgagtccaagaagcccgaaactgcgtttttatattttacaattataacagcaattttaacatggattgctggaggcagtgcaattgcatggtcatcatcggccgttttaaaattaacttcaaatgacaccagtataaatccgctaggaagaccaatatccacagtcgaaatatctacgttactggctatcccgggagtcatgggtattattggttccctagtttttccaaagttgggcgacattataggaagaaaaagaagtttatatcttgctggatggttgatgattgttagttttggtggagctgcattttcgactcgtatggatgtactggtttgtttcattactttattgaacttctttttttctgctgttcttggtatagttcctatatatttaacagaagtatgcgaaaatcataacagagctaaatttggttgttttatgagcctttgcatacctcttggacaactttactcctattgcattggacctatattttcgtttgctctatttactttcatgtcgtcagcttctttaattccctttttactatgttttccgtttgttccagagagtcctgtttacgtcttgtccaaagaaagaaatgtggaatgtataaatataataaaaaaatttacgtagtaataaaagattat

SEQ ID NO: 3749 - DNA, 917 bp, Diabrotica virgifera
  misc_feature (868)..(868): n is a, c, g, or t
cggacgcgtgggtcgtccgatggatttttacacggaagtgtacataatgaagttttcgcattagttgtaatgtaagtgaaaacgctaagtgagtgattccaaaagaacttgaggtttcttatttctcgtaaatgctcttatttctaaaaaactaaaactgaaaaagtcgctggaacttagggaatcgcacttacgcaatttagtgtacttagaaaactttataaacaatggatgtcgaagataacaaattggtatttagagatttgcccgtaggaccacttaccccttatagaagactatccaaattcgattggagaaagttgaagttattctttgaagatgcagaaatgttaaaagttcaaattcaagtatggaagacgctggaagcagatccactattccaaagaccacgggttgaaataagtacagacgaaaagcaaaggattgcagcgttgcagctgaagaaatatatagattataattttgtaaacccagatataaacaaagtaccatataaaaaaagaactcgaatacaactggcgtgcaatcaggcaatagcagtaacgtttccagatgtctctatcaaactagccataggccaaggtctatttactaatacaatagtcacattaggaacagaaagacatttcaaatatgcttatgcaggtaataagatgttgtcatgtctggcgctaacagaaatctcacatggaagtaatacgaaacagatgcgaacaactgccacatacgacccacaaaatcaagaatttgtaataaacacgccagattttgaagctgcaaagtgctgggtaggaaatttaggtaaacaatgcacgcacgcactactttttgcccaactgtataccanaggggaatgtcatggattacatgcatttatagttccaattagaaatcct

SEQ ID NO: 3750 - DNA, 2292 bp, Diabrotica virgifera
cccacgcgtccggtagtgtgtcctacctacccgctaaacgcccaatttaataatttcgagacaagtaacctgtgatttttttgtgaatttaaaagacaacaagttacattatctagcgtctcgcttcaacacgtggtatttagtgattcatgcaaaggaagaatcagaaaactttataaacaatggatgtcgaagataacaaattggtattcagagatttgcccgtaggaccacttaccccttatagaagactatccaaattcgattggagaaagttgaagttattctttgaagatgcagaaatgttaaaagtacaaattcaagtatggaagacgctagaagcagatccactattccaaagaccacgggttgaaataagtacagacgaaaagcaaaggatggcagcgttgcagttgaagaaatatatagattataattttgtaaacccagatataaacaaagtaccgtataaaaaaaggactcgaatacaattggcgtgcaatcaggcaatagcagtaacgtttccagatgtctctatcaaactagccctaggccaaggtctatttactaatacaatagtcacattaggaacagaaagacatttcaaatatgcttatgcaggtaataagatgttgtcatgtctggcgctaacagaaatctcacatggaagtaatacgaaacagatgcgaacaactgccacatacgacccacaaaatcaagaattcgtaataaacacgccagattttgaagctgcaaagtgctgggtaggaaatttaggtaaacaatgcacgcacgcactactttttgcccaactgtataccaaaggggaatgccatggtctacatgcatttatagttccaattagaaatcctaaaacaatgagtccgtatccgggtattacagtaggagatatgggtgaaaagattggattgaacggtattgataatggatttataatgttcaacaacttcaggatacccagagaaaacttacttaacagaacagcagacgtgacgcctagtggagactacgaaagctcgttcactgatcctggaaaaattctgggagcagctttagagaatttgtccatgggacgagtgggaatcatgcaagaaagctcgaataatctcatttgtgctattacgatagcattaaggtatgcggccgttaggaaacagtttgctccgaatggggaaggcaataacaatatgaacgagttacctattattgaatatcccttacatcaatggagactattcccatacatggcagcagcagctgtgttaagagtatttgtcagcggctttacagagacttatttaactgtagtggaaaaatctgcaacctcaatcgaattagaaaacttaagtgaaatggtatctgaaatgcatgctctcgtgtcaagcgcaaaaccattaatgacttgggcttgtcgagatgcaacgcaagaatgcagagaagcctgcggaggacatggattcttaaaagcttcgcgattaggagaactaagaagcatcatagacccgtgtgtaacctatgagggagacaacaatgtactagtgcaacaaaccagcaattggttgttgagacaatggcaggcgattctctccggtgatagattgtctacgcctctagaaagttgcaaatttttccttgatcataagagaattatgagtacaaaatgtattgctaggagtatatctgaagtacaaaccaaagaatttgtaatgacttcctatcaatggcttatcatatacctagttaatgaaactcacaaaaaacaagaggaagttcttcgtagaggtctggacagattcacagcacgtaacgaatcgcaagtttacagagcggccttgctgtctaaagcttacggcgaatatacagctctcagctatttttgggaaaaagtttccaaggctgacaagactttgcaggctgtgttacataaccttggacttttatatggtttatcatgtttagacaaaaacctagtgtacttttatcaaggcgaatatactagaggacctgaattttctcagaacatcaaagaggcaatattagatctatgcaagcacttaaaacctgacgctttgactgttattgatggacttgctccaccagattatgtagtgcattctgttttagccacatctgatggaaaattataccaaaatctccaaaaactattaatgggtaatccacaatcactatccagaccatcttggtggcaagaaaatgcttacgagcatcctaatttatcgcatttccctagcaaattgtaaatatcaaatc

SEQ ID NO: 3751 - DNA, 1090 bp, Diabrotica virgifera
  misc_feature (1064)..(1064): n is a, c, g, or t
cccacgcgtccgcccacgcgtccgcccacgcgtccgcgtttgctaaaatattttatgtgatatagactataagttgttgataaaggccatattacagtgtaaaaatggaaactaaacaggatagtcacgacattgaagcacagacagtaaaaggttttgaattcaatgacacttcaatacgaagaggattcattcgaaaggtttatgccatactttcactccaagtagcaataacaactggagtcatcagctggtttatattccacgaaccaaccaaactatatgttcaacgccatcctgtacttctattgattgctttggtactgattctagttacgatcattgctttggcatgttgtggacaactgaggagacagtacccggccaatcttatattcttatttatatttacaatagctgaaagcttcctcttggtacaatttcttcatattatgacatcgatgtagtggccatagctgcaggtgcaaccgtcatcatatgccttggacttactgtgtttgcctttcaatctagaatagattttagtgtttgctctggaattctcgtggctctatctctggtgattctcagtttcggcatcaccgccatcttctatcaaaatgacaaattccggttactgatagcagcgttcattgttattttcttttcaatatacttggtagttgatacgcaactgataattggaggagctgggaagatcagtctctctcctgaagagtacatatttgctgcacttaacctatacctggatgttattaacatttttttgtatatcttactcattgttggtcgtgctgcgcgataatattaaggttttgtatcagttagatataagttactgtaagctatcaagaaaatttagataagacaatgtttttatttagttttcctagtaataaaaactggttagattcaagacctctggcgtccatacaatgataaaggtttgtttgaaacgttcttccatattctgaagcattttcgtaatgattcgtaggcattcgtttacaattagttgacgtttatcttctaaaggtacgggntggtgttctacagattttactttttt

SEQ ID NO: 3752 - DNA, 799 bp, Diabrotica virgifera
gtagtatagtctctatagactgtcttctggtgcaattttcgattctagtttgatacacatatttttatttgttcactatacatatgggttgtgctttaaacagcttcgaacagaatttattaataagatggagataataaggctgtgttgaaaaatcaaaaaaatctttgtgcttatttttaacaacgtttttgtcgtctgtacaaaaatcttacacaaacgcaaagtgtgacttatatagatagatctatagatatagaaatatttgcttcaaaagttcgtacacaaaagtaagatgaaatttctttatatacacgacagtttctttgttagaattaaaaacgaatcattatatattcttactatataaaaactgctacgttagaaatatttatcaaatatatattctatgcatatatgcaacaaatggcagctcactcaacaaccaaagcaccaaggacagatgtattatgtagtgtttggtttttgaaatcatgctatttttgcaagtgttatatcaataaatactagcttgtttagaaagttttgtagcgaagtaaaccatcgttattccttaaaataaaatcattatttctattttcagtgccaaataaaacaaagctaacctacaaaatttgctaaataggatttgtgaatagttggtatgtctatggccatttactaagatttattattttttaacggggaatttggaaataagggcgctatgaaaaatgtgatccttccattggaaagattttgattttggttctttttatatggaaaaaccttattttga

SEQ ID NO: 3753 - DNA, 1458 bp, Diabrotica virgifera
cgggccgacccacgcgtcaagctaaaccaacatggcatgtacgtggcagcttcagattcaagagatcaccaaaaccagattgggaagtacaacctggagcaaacggtgatggaaatggtaacactaacgctggtgtagaagtaagaaataagggcaaagatcatgactttcaggctggatggaacaaagttgtccatggacccaatagagctaaaccgacatggcatgtaggtggtagcttcagattcaagagatcaccaaaaccagattgggaagtacaacctggagcaaacggtgatggtaatggtaacactaacgctggtgtagaagtaagaaataagggcaaagatcatgactttcaggctggatggaacaaagttgtccatggacccaacagagctaagccaacatggcatgtaggtggtagcttcagattcaagagatcaccaaaaccagattgggaagtacaacctggagcaaacggtgatggtaatggtaatactaacgctggtgtagaagtaagaaataagggcaaagatcatgacttccaggctggatggaacaaagttgtccatggacccaatagagctaaacccacatggcatgtaggtggtacattcagattcaagaactagttctagatcgcgagctagaactagccaggagctaacggtgatggaaatggtaacactaatgctggagtagaaataagaaataaggacaaagatcatgacttccaggctggatggaacaaagttgtccatggacccaacagagctaaaccaacatggcatgtaggtggtacctggagattcaagagatcacctaaaccagattgggaagtgaatccaggagctaaccgtgatgatgatggtaacactaatgctggcgtccaagtgaaaaatcatggaaatgaccacgattttgaagcaggatggagcaaagtagttagtggacccgatagagctaaaccaacatggcatgtaggtggtacatggagattcaagagatcgccaaaaccagattgggaagtgaatccaggagctaacggtgatggaaatggtaacactaatgctggagtagaaataagaaataaggacaaagatcatgacttccaggctggatggaacaaagttgtccatggacccaacagagctaaaccaacatggcatgtaggtggtacctggagattcaagagatcacctaaaccagattgggaagtgaatccaggagctaaccgtgatgatgatggtaacactaatgctggcgttcaagtgaaaaatcatggaaatgaccacgattttgaagcaggatggagcaaagtagttagcggacccgatagagctaaaccaacatggcatgtaggtggtacttggagattctagaatcctatagcaataggaatattaggaaatacaaatattctcgtattttgtactatttatttaatttatttgt

SEQ ID NO: 3754 - DNA, 1159 bp, Diabrotica virgifera
gtatattctaaaaagagatagtaatttaaccataatttcttgctaaacaatcattttcaacaatgaaatttatagcggtatttcttttagttgctgtattggcccaaaattcattgcaagaagaagaagatgcacttattccattcccgaagtgccatggagagaatgagcaggcacaaccaggatgtgcaccatgttgtcctgagcaagaagtgagctgtcaaaacaaagtgcccagggcttgccccagcccaatatgtccatatagttgtgaactgaaatgttattgtactgaaggatatctccgggacaatgtgtctggaaaatgtgtcaaaaactgttaaaccctatttaaaaattacttacttgtaaatgaatattgcgttttatcttatgttaataatttagttattaaatttttttcatctgaagaaaaaaaaaaaaaaaaaaaaaaaaaaaaaaaaaaaaaaaaagaaaaaaacaaaaaaaaaaaaaaaaaaaaacaaataaaacaaacaaaaaaatacatctaaaaaaacaaaaatatgacaataaatatatatggggggggggccccaaaaagaaacaattttttaacccggggggtgggcgcaccaaatttcttttaaaggggcccacaaaaaaaaattcccgggcgccgctttttaaaaaagaggggagggggggaaaaaacgcggggggccccaaaaatatatccctttttgaacaaccccccctcctttcccccagggggggaaaaataagaaaaaaacccccccccaccgccccccccccccacacaacttccgcccccctgaatggagagagagggggacccccccccctgtagcggcgccatatataaaagcgggggggggggggggggggttaaacgcaagagggagaacctataataatttttgaaagcgccctaaaaaccccccccccttttttttttttttttctttttttttttttcccccataattggcggggttttccccccccgaaaaaatataaaaaagggggggccctccttttggtgtgttctctttatatttggtgtctctctgcccccctccccccccccccacaaaaaaattatatatgtggggggggtgctgctacgagggggggggccccccccccgcgccaaaaa

SEQ ID NO: 3755 - DNA, 1286 bp, Diabrotica virgifera
ctgatttgaaagggtaattttgatagagttaatcatgtgtttacaccttcataatttaggcttataattacacttaatagaattaaactatttcttttaatatcaaaaattaatatacatcttatattaaagtgtaaaaaaggtaagctaattaagctattgggttcataccccactcataaaggttttaatccttttctttttaatttataaattatataaaattttttttattaattttttaattagtggtactttaattacagtttccgcttattcctgattaagaatgtgaatcggtttagaaattaatttattgagatttatccccctaatgaaatctcataataatatttttcccgctgaagccactcttaaatattttattactcaagctttagcttctgctattgtattgttttcaattcttttaactttaaattcttcagattttattttaagaaattgaaatttaacatataatttaatcctaaattcagctttaataacaaaaattggagcagccccctttcatgcttgatttccagaagttgtagaaggattaaattgaataaataatttaatattaataacatgacaaaaaattgctcctataattataatcatatataattataattctttattttttagaattattattgtaatttgctcattaattagaggaattctaggattaaaccaaattaggcttcgaaaattaatagcctattcttctattaatcatattgcctgaatattggctagtatattaacttataaaataatttgatttatttattttataatctattctattattctaatttctattatcttattatttaattatttaaaaattttttatataaaacaattatttataaatttaaattctaataaaatattaaaattattttttatttttaattttttatccttaggtggattacccccgttcttaggatttcttcctaaatgattagtaattaataatttagttgaaaataatttttatgctgtaagattaattttaattattttaactttaattacattatttttttatttacgaattactttttctactataactattataataaatgaaatttatagaaaatctattaaaattaataataattgactaattttttttaatgcatttactttaataagattaattttatgtacagaaattttcagaatactttaaatatttaaaaaaaaaaaaaaaaaaaaattttaaaaaaaaaaaaaaaaaaaaaaggggggtgtcgcccttt

SEQ ID NO: 3756 - DNA, 933 bp, Diabrotica virgifera
aaaacaactcagtgcagtgggtagagcaatgtaccaactgctggttatccaagccttcagacctgatagagtaatagctgccgctcataacttcgtatcagtcgttctgggagcagacttcatgtacttggcagaaaaagaacttgaatttgccgcatgcgtcgaaaaagagattagatctaacgttccagcacttttatgctcggttcccggtttcgacgcttctggtcgtgtcgatgatcttgcagccgaacttaacaagcaaatatccagcattgctatcggatcagccgaaggattcaaccaggctgatagagctataaatatggcctgcaagactggaagatgggtcatgctgaagaacgtacacttggctcctcaatggttagtccagctggagaagaagcttcattcacttcaacctcacgccaactttagactattcctcaccatggaaattaatccgaaactaccagttaatcttcttagagcaggaagaatatttgtattcgaacctccaccgggtattagagctaacctcttgagaacattcagcacagttccagccagtaggatgatgaaagcaccaaacgaaagagcaagactttacttcttattggcgtggttccacgcgattgtccaggagaggttgagatattgccctctaggttgggcaaaacattatgaatttagtgaatcagatttaagagttgcctgtgatactttggatacttggattgatacaacggctatgggaaggacgaacttgccgccagagaaagtcccatgggacaccctagtcactctgctctcgcaatccatctatggtggtaaaatcgataacgatttcgatcaacgactgttacattccttcctgaatctgctttttactcccataagctttgaaagcgactttcgcttcaagtccaacat

SEQ ID NO: 3757 - DNA, 990 bp, Diabrotica virgifera
ccacgcgtccggaaaataagtataatcttataagcgcaaaaataccgcggcagtcgagacttgccggctcaagaaaaggtgtttcgcgaatttacagtttttacatttgaacagtaccggctatagccttctgtcaacattatggccactccacagtctgatatcgagagaaggaaacaaatcagtgttaggggcatagccgagttagacgacgtaaacgaaatcaaaaaaacattcaacagacacctgcattatacccttgtaaaggacagaaatgttgccactacccgggactactactttgccttggcccatacagtcaagtcccaccttgtctctagatggattaggacccagcaatattattatgagaaggatcctaagagggtgtattacctttcacttgagttctacatgggccgttccctacaaaacacaatgatcaatttgggaatccagacccccgtagacgaggctctctatcaactagggttagatattgaagaactggaagatgttgaagaagacgctggtctaggaaatggcggtcttgggaggttggctgcttgctttttggactccatggccactttgggtatggctgcttatggttacggtatcagatacgaatacggtatttttgcacaaaaaatcgtcaacggcgaacaacaagaagaacctgacgattggttgagatacggtaacccatgggaaaaggccaggcccgaatacatgcttccagtaaacttctacggcaatgtcatcgacacacccgagggtaaaaaatgggtgaacactcaagtagttttcgctcttccctacgacaatcccatccctggataccaaaacaacgtggttaacactttaaggctgtggtctgctaagtcacctgttgattttaacttgaaattctttaacgatggtgactatatttcagctgtgctcgatagaaatctcgctgaaacatatcaagagtattgtaccctaatg

SEQ ID NO: 3758 - DNA, 994 bp, Diabrotica virgifera
  misc_feature (928)..(928): n is a, c, g, or t
aacaggacgaagttagtgctgtatatcaaaatcaagctaaatggttggaaatggcaatcaacaacatcgctagctccggaaagttctcgagcgatcgcgcaatcatcgaatacggtaaagacatctggggagtaacacccaactacgagaaactgcctgacccctccgttcctagggaattagctttaaaagataattaaatttgatttttttattgttgtactcatgcaacttttgtaaagttgtacgcttagtatgaatattagggagaaagtattctttaaaacgtgtatttagcaacaaaagtttatttgggtgtccgtttttgtttttatcttaaaaaagagactactagcattgactgtagttttagatacaattacagtattatgaataaacttatttcaaaaccatacaaatttaaaatgagaggttttcctttatattgtcacatttgttatttcagaaagcgagaaaatcaaggaataaaattggacgatgaagtggagataaactacatattatgtttttatattttaataataaaacagatctgcaggatatattgtaatgcaaatattctagctcaagaatctctaattactgtacttcctaatttttttgagagtgactgtatcaaaaaatttaaaactgtggtcttgttcttcgtattccaccgtattagacgtagaatagtatcgtaacagtatttttgacattttacaatatatgttgaataatatcttctaaaaagtttctgtcttagcacgaaatgagcacacaaatactctacgcaatatataggatagattgtaaaatctatagatatttgcgaaacattatttgaggaatactttggataattgcagaaatgaaacccaaatagacattttttttatatttcagattctgaaattctatttactanattaagagtgccattttatcgtatattttaagcaatatagtcaagtgatatttcagaatgttaaat

SEQ ID NO: 3759 - DNA, 2274 bp, Diabrotica virgifera
cccacgcgtccggtcgatgacattgccgtagaagtttactggaagcatgtattcggcacacccgagggtaaaaaatgggtgaacactcaagtagttttcgctcttccctacgacaatcccatccctggataccaaaacaacgtggttaacactttaaggctgtggtctgctaagtcacctgttgattttaacttgaaattctttaacgatggtgactatattcaagctgtgctcgatagaaatctcgctgaaaacatatcaagagtattgtaccctaatgataacttcttcgaaggcaaagaactcagattgaagcaagagtactttatgtgtgctgcaacactacaagacatcatccgaagattcaaatcggccaagttcggtacacgggaagctaccagaaccaacttcgatttgttacctagcaaagttgctatccagttgaacgatactcatccttcattggccattccggagttgatgagaattttgattgacattgagggtcttccatgggagaaagcctgggacataactgtcaagacttgcgcttacaccaaccacactgttcttcctgaagctctcgagaggtggccagtatccatgttagaaagtatccttccaagacacttgcagatcatctaccatattaacttcctccatatgcaagcagtcgaaaaacgttggccaaaagatatggacaggatgaggcgtatgtcgctgatcgaagaagacggagagaagagagtaaacatggcccatctctccattgttggttcacatgccgtcaacggtgttgccagaatccattctgatattattaaggccgatttattcaaagatttctacgaattatcaccagaaaaattccaaaacaaaacaaacggaattaccccaaggagatggttgcttctgtgcaacccaggactgagcgacttgatttcagacaaaattggggaagactggactgtacatctcgaccagctacaaaaactcaagaaatgggccaaagaccccaacttccagagagcagtgatgaaagtcaaacaagaaaacaagctgagactcgcacaacttttggaaaaagattacggtgttaaaattaacccatcatcaatgtttgacatccaagtcaagagaatccacgaatataagagacagcttctcaactgcctccatataataactctatacaatagaataaagaagaatccttcagccaagttcaccccaagaactatcatgatcggaggaaaggcagcccctggttactatactgctaaaaagataatcaaacttatcaatatggtcggaaatgtcgtcaataacgatccaattgttggtgataaacttaaagttatctacttagagaattacagagtcacgttggccgagaaaatcatgccagctgccgatttaagtgaacaaatttccactgccggtactgaagcttctggaacaggtaacatgaaattccaattgaacggtgctctcactatcggcactctagatggagctaacgttgaaatggcagaagaaatgggaaatgaaaacattttcatcttcggtatgacagtagacgaagtggaagcacttcacaagaaaggctacaacgcaatggactactacaacgccattcctgagcttaagcaagtcgtcgatcaaatccaaaacggcttcttcagtcccggtaaccccgatgagttcaaagacattgcagatatattacttaaatatgataggttcttgttacttgccgattacgaggcttacattaagaaacaggacgaagttagtgctgtatatcaaaatcaagctaaatggttggaaatggccatcaacaacatcgctagctccggaaagttctcgagcgatcgcacaatcatcgaatacggtaaagacatctggggagtaacacccaactacgagaaactgcctgacccctccgttcctagggaattagctttaaaagataattaaatttgattttttttattgttgtactcatgcaacttttgtaaagttgtacgcttagtatgaatataaaggaaaaagtattctttaaaacgtgtatttagaaacaaaggttaattggggggttcgttttttggttttattttaaaaaaaaaacaaaaacaatggattgggtttttaaaaaaaatataaggaataatgaataaacttattctccaaaaccctcacaaatttaaaatgaagaggtttttccctttaattttgcccccactttggttattttccaaaagaggggaaaaa

SEQ ID NO: 3760 - DNA, 931 bp, Diabrotica virgifera
  misc_feature (829)..(829): n is a, c, g, or t
  misc_feature (900)..(900): n is a, c, g, or t
tttttctcatcggcatgaacatttttgtgataaattaattcaatatgtggtcatttttttctcgtgatccttctaaagacttcaattttgaaattggagagttagtgccaagtttagaagacaaaagtgtatggaacctgcataaaggaaaaaagaagggttccagtgaagaagtatcagtatttgtttttgatttgaaaagcaatccagagtcacagttagaagtagtaaaagctgctgttaaaagattaaaaacattaaggcatcctagtgtactcacttatttagatagcttggaatcagaaaaagttttatatttagcaacagaacatgtagaccccttaaaagagcatcttgaaaaactaccgcttgaagcaccacaaagagatttatatatcgcttggggtatttttcaaataactagagctttatcttttttaaacaatgatggtaacttaaggcataacaatgtcaacatttggtcagtttttgttaattcttctggagaatggaaattaggaggttttgagtatgtgtcgagtacacaagaaacgaatttaccatctaaagtaatttctactctagatatctatagtcctccagaaaaaaatgatccaaccaaacaaagggccatgacaaaatgttcaagtgatatgtggggattgggctgtcttatatgggaagtattcaatggaccattgtaccaacattcgtcccttagaaaccctgacaaaattcccaaacaactaggacctttatattttgaacttttaaacacgaacccatcatcaaggcctaatcctgcagatgtaataacacggtgtagaanattaggaggttatttaaaaacgatcttgtcgacacgctgctcttcctagagaaatccaaaataaagacaanaatgaaaaaaatagattttttttcaaattta

SEQ ID NO: 3761 - DNA, 1124 bp, Diabrotica virgifera
  misc_feature (917)..(917): n is a, c, g, or t
  misc_feature (928)..(928): n is a, c, g, or t
gtaatgttcatgttttgtgtgtagaaaaacgctaaaactgtgtgcaggcacatcctttcgcgatgagtagacccaacacaaactgttttcaagtcttaccgaacaatagcagatggctatcgacacaagattctggaatttttcccaaacgtcacactgactactatgtatttaatatgggaagacaggaagtgttagtggaaggatggtggggaacaaaactgggatggactggggttttggatggagtgaacctggcgcctggcaatggttacagaattgtagtcagtgataaaccatattttgtaacagctgtgaaaataacaaataaaacaaatgtaagggctctcatgcattgttctaagataaacggttatcctctgcggagtcaaggaactgacagtatcagaccagatataagttcgattgcaaaatactttatcccttttggggtaggaaaaatttccgaaatcaatatgggctttaaatcgctggaaaatttcttttggcccaaaggaggtgaaagtgtttgggacaaaatcgctaagcagatagttttttttactaaatgaagcgacgcaaaaaagaatcaaacaaattctaagagaagatattttgcttgtacaagaaaatttgagtctactccaatcgcaaataaactccttccaaccttccgttgtaaaagctgagtttttcattaaaatggcagaacaactcgtattcttggaaaagaagttctctgattgcggagattcagatattgaccttaacttccacttgttacctttatactcggcaacagttaactttaaggttcttttatataccattgcttgtgaaagacatagagaggttggactaaatgacgaacagatcggaaaaattatccagttctccgaaaaactgatcaatgatcnctatcctttgnttcagtggctcatataacgaaaacctttgaaagacaatttcatcttgaatatagaacttgcgaccaggaacttatttataacatcttggcaactgttcgcacttggtgtggcattaacggagaagaatatgtgcaatttctggaggagcctacttgaataagaaaaaaattttctataatggcgtcattacctatt

SEQ ID NO: 3762 - DNA, 1381 bp, Diabrotica virgifera
gtgacattgaaccaaagttttatttgtaaaataggtcattacgttttctaatattttatatttaaatcaaaatacaatttgttagtacatacaacataattgtgtcatcctgagaaagaaagactgtccagacacgtagccgctcatttattatgaattttttgtgcgttttgtcaccaactttattcttagttttctttgacggaagattaacgtccgcttataatgtatctaatccgcaagttggaaaactgattgctgttgcagcggtctataggcatggagacagagcacctgtaatttcgtttccacatgataaatactatgatccatcatactggccgatgggtatgggtcaactaactcaggatggtattaaaaaactctacaacctcggtcaatctttccgacaacgttatcaaaattttcttagtgacatctactccccaaatgaaatatacgttcattcgtcccaagttgatcgatgcctaatgtcagctgcggcaaatctggcaggtctttatccaccgaagagctttcagttgtggaatcaaaacattctttggcaacccattcctattcatacaactaatataaaagacgatcatatcattactgaaaaaagacactgcagaaaatcgagaattattatggaacatcttaaaaatcaaacatatcctccattgtatcgaaaatactccaaagtgattgaatacctttccctcaaaacaggatggaatcctatatctctgtcaaatataaaaacgcttaacagtgtcatcaatacctacaaatcgtataacaaatcttttgtgcccgaatggttgtccaaattagagacgggcgttttggaatatttttcagacatcgtttatggtatacaaagttccactccagagatagcaagattacgcattggtcccttcttcaattatattattcaaaatttcgatagctttctagactcgcaagccgcacccacacctaagtttctagccatttctgctcatggtacgatgatttcttcaactcttggagcaatgcagcgcaatagaacgaaaataataaaatttggagatagcgtactttgggaactaagacaaagaaataatggaagttattatggtaatgttgtatataaaaatgaaacctgattttgtggtattaagttgctaagatgtgattatgatttgtattaatataattttaagaaatatgggcaaatattgtcgtaaatatttactcagtgggagtacgaatgtacaattgaaaaaaaaataaaatatttgtcttttgtcaaaaagcttggggtctcttggggttttaataaatttttagaaccttttaatagaaggccctataaaaaaaagactaaaaccct

SEQ ID NO: 3763 - DNA, 538 bp, Diabrotica virgifera
ccgggccggcccacgcgtccactcaatttgttttcagataatcatggaggtgctgtcgtcgtccaaaattgccttaacaattctttcagtattatttttatgtcaacatactcttagtaaaataactgtatcaacccatgatgcaaggataaaactacatgatacatttttaattgagattacattgccaggtgctgatattaataaagatgacacgatatcattagtatcacaacacgcggatattatcagtcctaatgtctcggaaattattttaaaggacgtaacggacggcgaaaagtttccagttagtataaatacatcacgtgctggacattcggatctatatgctaatgcttcatctaaccagaccgatgtaagcgacgtatacgttcgctttactgtatacaaaaacgatggattagatacattctcagctattataggttggatatacttcgttgcttgggctgtttcgttttatccgcaaatatatatcaactggaaaaggaaaagtgttgttggcttgaacttcgaa

SEQ ID NO: 3764 - DNA, 1362 bp, Diabrotica virgifera
cccacgcgtccgactagttctagatcgcgagcgagattgtaccgaccgaaagagctactaacaaacatttttactaattttcgtacgtggagtgatatcaacaattttgaatatgaggggaacattggctgttattgcccttttggggtatttgtgctgcacaactgctttaccagcaacttcaaaacaaatagatgacgatattgaacttttttcacctaaagaaacccacgtggaacaacctgttattgacacagatgcaggatttggctttgatggcttctccaaccattttagtggattgtttgacaactttgaatctatattgacaaagataaagcaacaaatggaccagttgatgaacagctttccagtatttagaactggaaattctaccggcgactttcccgattttcctaactttggaggggaccttccacaaatcccccaattcggtgacattgacttaagcaaaggaaacaccacatcagaaactaagatcatcgatggccacaaagttgttatcaataacacacaataccacaaagacggtgaaaacggcagtgccttcttccaagtccgtgtcatagatgtacaacctactgaagctgaagacgctacagcatcagctaacgcaatgcctaaagacagagaggatgtagaaaatagtatagataacgaaattattaaaaacaaagaggttggtacccaaagtgctcccgaaaaactgagagccatctaaaagcatgcgaaaagcctatccttcttccgcaattacaatatttaatactaatacatctgtaatatatcatatgatccgttttaaatgcagatatcactcatctagaagaaaagcgtcacaactcaaaaaaccgcttttttcaggaaagacaaaaatggattttttagatcttaaaaattctgtaggttaagcactagatgaaaagagtttaaaaaagtaaactaatataaaaatgaatgaatctaatgaataattggaacaaaataaaaacaaaaaatatctgatttaacaaaaaaaaaaaaaaaaacattacaattttgaggtatgtgactttttttttaaaacaaatgggggacctttttttaacaattaaaaaaaaaaaaaacaaaaggaaggtttttcttaaaaaaaaaacgggtttttccctgaaaaaaaaaaccaaattccctttctcctctccaatgggttttaaaaacacggcaaaagggttttttagaaaagttggggaagggaaaaaaaaatttaatgggggaaaccttttttccctcggggtaaaaaagaaaataaaaattttttttggggggcccacatttataaaaaaaaaaaaaaaaggacaaaaa

SEQ ID NO: 3765 - DNA, 1201 bp, Diabrotica virgifera
catcgagcgagattgtaccgaccgaaagagctaacaaacatttttactaattttcgtacgtggagtgatatcaacaattttgaatatgaggggaacattggctgttattgcccttttggggtatttgtgctgcacaactgctttaccagcaacttcaaaacaaatagatgacgatattgaacttttttcacctaaagaaacccacgtggaacaacctgttattgacacagatgcaggatttggctttgatggcttctccaaccattttagtggattgtttgacaactttgaatctatattgacaaagataaagcaacaaatggaccagttgatgaacagctttccagtatttagaactggaaattctaccggcgactttcccgattttcctaactttggaggggaccttccacaaatcccccaattcggtgacattgacttaagcaaaggaaacaccacatcagaaactaagattatcgatggccacaaagttgttatcaataacacacaataccacaaagacggtgaaaacggcagtgccttcttccaagtccgtgtcatagatgtacaacctactgaagctgaagacgctacagcatcagctaacgcaatgcctaaagacagagaggatgtagaaaatagtatagataacgaaattattaaaaacaaagaggccgtctactatcaacccctagacttagacgaactggattcaggaagcaaattccgacctactggtttatcctacctagtagataactctgaatgggatgacctaaacaagatcgagtccattgacgacaacgctttaaacttcaacggaaatcaacccgagtttgacttaagcagggacacttacgttaacgaattattggcaaaatcgggagctccagtgaatccagacgcagaaatctccaaaccaattcgggtatctactcagagagttcagcctgacgcagaaatcatcaagccaatttcgagtatcctactcagggagttccacctctgatatcatctagtgaaaaccttactccttgagcagggaacttatgttaacgagatactaccaaaacctggacctacaataaatctgatgcagaaggtctccaaacttcaccaaaagttccactggaaccccaatggtgatcaaatttcaactaaaaaaaaactggtcctttaattgttttttatttattttatt

SEQ ID NO: 3766 - DNA, 831 bp, Diabrotica virgifera
gagctcatttttttttttttttaattgtaataatttatttacccttatattattttatattactgtatttaattttcttttactgataccatggcttagggaaggttggcattgtaaaattagggaaaataggccaaatacttcgcgtgggataagtgacaggtgttggtttagtccagggtacccagcttgttggtggcacagtagcagtggttgccggataactgtctgttgtacctatgctaattaccggtatacccaagtttggaaacaatttagatgttatagacgagatcagtttaccgatatcgtttgataaatagaaagcatctccacccaaaagacctggcagtgcatctaaaatgctgtttttaatattcaaaaatccctcaaaagaaaattcagctaggaactggaatgaagcgtgtacattcccaataaattctatgcatttggtagcaattttcaaaaatatatcaggaatgggcaacgaccagaagtttttttcagcaagttcaacaagttcaataatccagttaaatacatcatctaaactataatagggcaaaaacggcagctttggtattggaagatttttcgggaatcctgcaatctggcttataaatcttgatactaaatatctaccatcgtctacgcttgtaagaaagtttataactattttcagagatgtcttattgaaaattgcgaatatgctctggtagtagttaataaatatttctataatcttcggtgctgttggaaatgactcccaaaactctacacttatattagtaagggcagcgcttatcctgataaatgtttgtacaattc

SEQ ID NO: 3767 - DNA, 1187 bp, Diabrotica virgifera
ggaatcttggctttttaagtgttgtgtgtgtgttagagtttattgccatctggacaaatggaattattgccgaaccaaataatttcctccgaaatacccttttggatcaattagatgaaattgaagaatatggaagacatgtcatgtttaaacgaaacgcaattgaattggctagttttacaccgtatttcaattgtaacgaagtctgcacaacattagtgggattaagtaaacgaccttactgtcccattttaaaacaaactgaaacaatgcggaccaaatttcttccaaaaagctgtaaagaaatttttaataaaggaattaccatgactggtatttacgaaattcgtcctaaaggtaaaacgattcaagtgctttgtgacatggaaacagagggtggcggatggacagttctgcaaaagagatttgacggttcagaagaattctatagagactggcgagactataaatttggatttggtacattacaaggagaattttggttaggtcttgaaaacttttacatgattacaggttctcaatcgactgaactattaatcgagttgacagacaaagatttggtaaaacatgttgttcgctatcgacaatttgaaattggacctgagatagatggatatcctctaaaaacggcatctggttttagtggtgctgcaggggatggtttgaactggattttaggacagaaatttagcacgaaagacttggatcaagatgcgtggaaagagggagactgttcagatttttcacttggtgcatggtggtacaataattgctatacttcaaatctcaatggaaaatatcgacatatggcacatgccgaaggaatcgacagaaaagggatgaactgggatccacttactaaatcagaaaacagttttttcctttctggatcacgaatgttagttaggccaaataactagaacaatatagaaacaaatttatcattcaatttttgtaatgaatgtactgttcctgtttggacaccaagactgatcttgaggacgaaaatagtaccaagaatactcttccatatagctgtttggtctacacatccaaatgaaaaacggtcctcgatatactcattttcgataaatattatataagcgttttaaatttataagtaacgtgtctccaaatttcgtaaaataaattattagttttcatta

SEQ ID NO: 3768 - DNA, 1138 bp, Diabrotica virgifera
caggagcatccctaaaatgtccgcaaacaggatacaaaggtgggctttatttttgtcatcgtttgactacagtattgaacatatcaagggaataaacaatcctgtagctgattatttatcaaggtcaccagtgcaggttacgggaacagtagaggaaccagcggaaggaatgacatatattcatttcacggagtctatagaatactggccaattaacaacaaagtacttagagaagaaacagacaaagatggcattttaagggcaataaagatgtatattaaaacggaaagatggcccaaacatttaagtgatgaaataatgccattttaccataaacgacaagagttgtatttagatgagcacataataatgtggggacatcgtattgtggtaccatcaagtctaagaccacaaatcctcgatgagctccatgcaggacattttggaatagtcaggtgcaagtcattagcgagatcatatgtttactggcctaaaatagattccgacatagagcatagggtaaaaagttgtggtccatgtttaaagaatagagacaaccctccatcagagttttcaccgtggcctgaagtggacaaagtatttgacagagtgcatatagattttttgcaattaaaaagcaagttgtgcttaatattggtggatgcttacagcaaatgggtagaggtatttcctatgagtagggcgacagcagcagaaacgcaagaaaaactaagggaagtttttgccagaatgggactaccaaggttatgtgtgagtgacaatggacctcaactagttgacaaaaccatggaaatattctttaagaaaaatgggattaagcatttaacaggggcaccttaccatccatccagcaacggagctgcagaacggtatgtcaggacatttaaaatgaagctgaaaacagccctagatgatccaagaaactctggtattccactgtctacattaatatcaagatatttactaacatatcgcaacacaaaacacccagtaacagaaaagtcaccagctgaacttgtatataatagatcattgcgaacaagaaatatcatgatggccgaaaagcccagtaaagaacagcaaaatatttctataaaggaggaaaagatgttttga

SEQ ID NO: 3769 - DNA, 1076 bp, Diabrotica virgifera
  misc_feature (1048)..(1048): n is a, c, g, or t
aataaatacagtaaactattgaacattgaacaatcggcagttaagtgaattgtggtgatcacgtaaacactattaacaatactattaactaataattgggactagaaataaattttttggctttgataacaatgggtcctatttggagtgcctttggagctactaacacaggaaggacagatgatgctgactcaacgacgggtttaacctccagagatagatatttactaaaatcatcatgggctggtgtaatgaaaaacccgacagacaatggagtagctttacttcttttaatgttcaaaaaattccctgagacgaaaaccgtctttccttttaaagacataccaaacgaagaactagcaaacaatgttaggtttagggctcactgtaacagcgttgtttacgccattacttccatggtagatgctatagatgacccatccttacttgtaggcatactcgaaaaagttggccgggaccataagaggcgaagtattccccaaaaatattttgaaggacttcaagagacaattatcgaattgttttccacgttcatgaaacccaatgaaattaactcatggaacaaagctttgggtgttatttttaaagtagttgctgataatgttaaataattttagatgtgtcattggtgtatcattatcagacgttttacaattaaaaaatcgcaattattgcttatctatatgttcacaaaaatatagaatcgctatatttagattgttattttttatgcatctttagaaataaggttttatttttctatctttttattataaagggtcttatctatttaaacttatttctaacattatttccaaattttttttgctctcttttgatttctgtaaacgccatttcaaaaatacttttttatatagcgttttcacgtattatctttaaaagaaaaaattgaaacgaaaaatcatatacaatttttttgcaattattcttagagaaaaacacaactgtcattaaaaatatatttaaaaaatcattgatcacatttcgcgaaatataaactgatttnaatataagtacatggtttatattttact

SEQ ID NO: 3770 - DNA, 776 bp, Diabrotica virgifera
aaataagttggtcgttatgcagagattccttcttttaaccttttacggtattgttcactactattttttaagctatgaagcttggagtgacaactgcattaagagaaaatttccgaatcacactaacgaggtttatgaaggatgcctaaaaaataaatcaatagatgcctatcacttcaaccaaattttaattttcccattgatgccgccagcagagctattaaggctacgttgctcagctaaaccttattttgaagagtgcgtcgatgtgggcaataacgatattagagaatgtttaaattccaccgtattggaaggattgaaggtgtggaagcaaattgacaaagaaatttctgaacaagtgtgccaacctgctgttattgaatttttagccaaccaaaccaatggattatctgaatgtgacaaaaaattaaaagaggtattcaacgtatgcagtagaaaaattggcaatcccgatgcaaattctattgaaatcttcaatattccacagactaggggttactgcaaaaaaattgcagcatatgaatcttgtgtaactgattctcttccatcaatgtgcgaagctgttgttaaaaataccctttccaaagtaatttcatcaattaggagaaacatatgtgatgtgccattataatggaaaaatattaaatttttttacatagttgggagatatatgaatatacataatgtactaataaattaaatttttaaactttgcacttttagaataaaattttcgcatatttctccctatt

SEQ ID NO: 3771 - DNA, 1205 bp, Diabrotica virgifera
  misc_feature (959)..(959): n is a, c, g, or t
ctcgccaagtgtgtagccgtcatcacagttactcgccattcacaggctcacccaatagtaccacaatttatcaatgagattcaaaccgcagcaacagactctcaacaaatattcgctttatcggtcgtaggggaaatcggtagaaaaatcgatttaacgtcaatttcaaatttgaagctagttatatttcagtcattttccgctatatcagaagaagtcaaatcagccgccagttatcgctcttggtagcatatgtattggtaacttaccgcaatatttacccttcattttaaaagaaagtcaggaacaaccaaggaggcagtacttgcttttgcattcgttaaaagaggtaatcacctgtttgtcacaaacaccagatggaatacagcagttgcttccattcgtcaccccaatttggcagcagttatacaaacactgtgagtgtgctgaagaaggaacaagaaatgtagtggcagaatgtctaggaaaattaacattaatagatccgacaaatgtcttaccaaaattgaaacgttcactaaattcaccatcacctctaactaggactacagtagtgacagctgttaaatttaccatttctgatcagcctgcatcaattgatccattactgagacaatgcattggcgagttcttaaacactttacaagatccagacttaaacgtaagaagagttgctttggtagcattcaatacagcagcacataataaaccgtcgcttattagagatttgctggacaccacattaccacaactatatggagaaactataataaagagagacttgattagagaagtggaaatgggacctttcaaacacacagtagacgatggtctggacattagaaaagcagcatacgaatgcatgtacacattgctagactcctgcctcgacaaagttgatatatttgaattcatcaatcacgtagaaaccggattanaagatcattatgatattaaaatgttaacataccttatggtagctagactgtcacagatctgtccaggagcagtatttcagatgttggataaattagttgaaccacttagagctacactaaccatgaaagtaaaagctaattcagtcaaacaagaatatgagaaaacagacgaactgaaaaaatccgctatgcgggctgtagcagctcttttgagcataccagatgcagataaaaatccacatctga

SEQ ID NO: 3772 - DNA, 1358 bp, Diabrotica virgifera
  misc_feature (1303)..(1304): n is a, c, g, or t
caaaaaatataggtctaagcatttaaattctttttgtacattttgtttttgtaattgtaatgtgtgattgataattttgatggtcttcttttatacaatatgtcgtgttcagaggaagttattttagaaattgaaggcactcctgtcaaatgtaaaaaagatgtacttatttccaatagtgattactttaaggcaatgctggaaggaaactttatagaaaaggatcaagagactatttgcattaaggacgtagatctaaaagccattaacattattctcacgcttttatgggatcctacgatttatatcgaagatgaagatgtactcatggtactacatgcagcttgtatgctgcaattttgtgagattagaaacatgtgtttagataagcttatccaaattctatgtgtacaaaattgtttgaaaatatggataataacagaacagttagacattaagccgttatttttaaaagctaaacgtctagcattagctgaatttatgatgattaaagagactgatagtattaatgatttaaatttagaacaacttattagatatattggtagtttacacctagtgactgatagtgaattaacagtgtttcaaacactaatgaaatggtggtatgatcacagcaaagaccatacttcagatgacttcatcaagctacttagttgcatcaactacaaacaactcttacctgatcattttagagaaatactaacttatccagaccttgctaatactgaagttgaagatattttaaagtgtttgtacaatattttaaacaacatttcaaacgggtcatgctcggagaaatatgtagaggtagcaactaagctaagtcaatcaaatgaccgaaaaattgatagtgtaccttgtcttttagtcctaaattcatatgatgatgttcctaataagaaacgccttgtggagaacaatcaaacagttgtggataagagcaaccttcacctggtttactatgatcggaaacttgatatatttcgaggattcataaatatttttaaaagattagaaggttttagactgagaggatataaagagtatatatttttgtttggtggagaatatgtgcttggtaaaggggaatggaattatactttctgggtatacgattcgatcaaagacatgtggagaacgaaatcgaggatgccttttcctagaagacattttgaaacgtgtatagtaggatctaaggtgtttatttcaggaggtattggtcaatttcgaataatccaatcaaacgttttttggtacgactacaaaacagacgaatggnnagcaacataccagttccccccaaacgtattgggagatcgtataaatgctgtaat

SEQ ID NO: 3773 - DNA, 1605 bp, Diabrotica virgifera
  misc_feature (1400)..(1400): n is a, c, g, or t
  misc_feature (1449)..(1449): n is a, c, g, or t
  misc_feature (1469)..(1469): n is a, c, g, or t
ctcgtgagaaacattggaagaggctagaagattggctgctcttcagaaacgcagagaactgagagctgccggaatagaagttacatctcgtagaaagaaaaaacgaggagtagactacaatgctgaagtaccgttcgaaaagaggccagcgattggattttatgacacgtctaatgaagtattagatcctatggctcccgatttttcaaaaatgaggcagcaacacttggatggggagctgagaagtgaacaagaggagagagaacgtaagaaagataaacagaaactaaagcagcgcaaggaaaacgacattcctcaagctatgttacaaaaccaggaaccagctaagaaacgatccaagttagtgcttccggaaccacaaatttcagaccaggaaatgcaccaagtggtgaagttgggcaaagcgagtgaagcagctagggaaatagttacagaaagcggtgttgaaaccactgacactttgttgaatgattatactttcaatcctcaagcggctgctacaccaaggactccggcgccccagactgataggattttgcaagaagctcagaacatgatggcgctcacacacgtagatacgcccctcaaaggcggcattaacactccgttacacaattcagatttcagcggggtcctgccccaagctcagaccgtcagcaccccgaataccgtgcttgctacgcccttcagatccagtaggagtgacggagctggcactcctggcagtagcgttggatttatgacgcctagaagtggcgctttggtgcctgtggggaagacgccggtaggaatgacgccttcggttagggataagcttagtattaatccagaggaagcaatggacgtaggaagcacaccagctgagcacagaatgtaccagatgtcgatgaaagatcaattaaaaatggggttgagcagtctaccacaaccgaaaaacgactatgaaatcgtggtgcccgaaaatgaagaccaggaagaacccgagcaagctcagtcacaaatgatcgaagatcaagctgatgtagatgcacggaaacaagaagagctcaaggcgaaagccgccagggagctggcgctacgttctcaagtcatccaacgtgatttaccgagacctcaagaagtgaacatgaccgtccttcgaccgtcccacgagagctattccttatccgatctgcagcgagccgaagaactcatcaaacgcgagatggtgactatgttacatttcgataaccttaaaaatccggttccgacgcagagtaagagatccaacatgtcgcaggcccatcaattggcgtttttggagcagcatccatatgagtcgttcaggaaagaagatttaggggtggccaaggggatattgaagaggaaatggaggtggntaggaatggtatgaatcacggggagttgcctatcgaagtctacactcangtgtggggaagaatgcttangcacagttctggtcctcccgaacaaacgagatacactcgagccaacttagcgagtaaaaaagacagactggaatcggcgggaaaaagactcgaacagaacagatctcacatggcgaaagaagctaaacgagctgcc

SEQ ID NO: 3774 - DNA, 1785 bp, Diabrotica virgifera
cgggccccaccctttcgtccgaagtccagatgtcacattttgacaatggtgaatgggaatgatgggattataaatatattaaatgtaattaaataaaactcaacttaactcgaacccatgagtgtctgtgtgtgtttcttgtgttagtaatatagtttctacgaaacatatcatgtggaaatgccacaagtgtcacaaaccagtatattttgctgaaagaaaacagtctctggggtataactggcacccggaatgtctgcggtgcgaagaatgtggcaaaaggctcaatcctggacaacatgcagaacataagggagttccctactgtcatgtgccctgttatggggctctatttgggcctcagttgttcggtcacggaactagagtggaatctcataagagttttggtgcccagaataactcgccaaagttcaataatggtcctgttcttcctaggtctcatttggagtcaaaaatcaaggtctataatcagttttatgaaggtaagagcggggaaattaggtctagagaagtaaatggtagatttattctggagggttcgttaagaatccattggggcatccagggagtgattcatctcaaagaaaatgatgaccagaggacagtagtcactgttagaaagagaaattcctacagatcacccagtccggagtatgacactgatgatgacatccaaaacatatcacgggatagcagttacaatgaaatctcaagttgttctgacgatcttacaaggtctgatacaggtattgagagtggatctgaatctttagacataagcgtgactgatagtgcttcttcctctccccaaaatgttataaaaagtgtgacattgccttccaaattagatgttaagaacatggaatgggacgaacttgatgaactgctttgtgtagagagaaaagtggatgtttctgaacacatttatcagactatgcctgttaccctaccctcacaagttagtactgagagtgcaagtggttctagcaatagtactaagactgagagtgtatcacagactataaggaacgacagcacagatgtgaccatcagaaatgacactacatacacagatagcaccttgaaagccccacttaccaacggtactaatagtcaagaaaaagttcctcttttatctccatctttaagcaaggaggatgcttggatgatgcagagcaatcatttgaacgggtctatgtctggacctgactgtgtaggacgagttagggatgcccaatcaccagaatttgataagagtatcatggcaagtatggagtctaccgtgacggagcaggcagaagaagtcgcgctaagaataccttataaaggatcaactgcaataaaacgaagacctggaaaacgattgtcaagaaataaagtaaaacgtagatgctccatcaatgggcatttttatgatagagaaactagctttttcactccgccccacggtagatcagatgagcgtgtgagtcacatcactagtcaataccaatgaagttatcaattagttgttagagatatataaggtggaaagcgatgcacataattttgcattgtttgttggaatacatgatgaagaactacggagactgaaagaggacgaataccctctcctagcaagagtcctattgcagcctcacgaagatgtcatcaaactgtatttgatggacagacatagcacttctgaggtctgatgtgaagcagcgcaatttttgtatctcactctaacagagtgccgtgccattttgtgtctatactactctc

SEQ ID NO: 3775 - DNA, 904 bp, Diabrotica virgifera
cccacgcgtccgggtcatgaacatcgcttgggttctgttttttgctatttaccactgcataaatgggggcattttgtatccaaggctttcgaaaaccagagatttgttgtctctggacggtatttggaggttttctcttgtgataaatggaagtgtagatccttctggtggactatcgaacctgcctggagacaaagatctgcatttaatgccagttccatcaagcttcaatgatatccctaccacgaaaacatcacgagatcattacggacctgtctactatgagaggaattttgaggttcctagcagctggaagggaaagagaatttggctgagatttggatctgtttgttattcagctcaagtttatttaaacgatgaagaaatcctttcccacgaaatcggacatcttccatttcaggcagaagtgactcaatatatagaggacgaccaagaaaataatatccgtgttatcgtggatacgactcttactaattccaccataccacaaggatctgccaccgttttaccaggcactggaagagtaatccagtctgttccctttgatttcttcaattacggtggaattgatagaccagttattctgtatacaacacctttaacttatatagatgacgtaactattactactcacgttaaaggtacaaccggtgttgttcagtacacagtggatttaggaggaacaaacgataaagtagtgacaaaagttacagttttagataaacacaaaaaagctcttatttccactgattctctcagtggacaaatagaaataactgatgcgaagttatggtggccttttcttatgaacagtgatcccggctatttgtataatttaaaggtcgatctctacgatggaaaacaactactagatacttacact

SEQ ID NO: 3776 - DNA, 941 bp, Diabrotica virgifera
gtaaaatgtaaaaattattatagagaaaaagacattacaattatgacatgcactccacattaccaccagagtaatggacttgcagaaaaagcagtcaatataagcaaacaaattttaagaaagagtaatgaggaaaatgttgattttagagatttggtgatggaatataataatacctgcataataaatcttgatgcatctccagctcaaattttacagagcaggatcctgagaggacaattaccaactacagctaataaattagaacctacaatccagaaacaagtatataagaatttatgcaaagaaaaagagaaattacaagtacgttatgataagacagcacgaagaaaaccagtagagtttagaaagggagatagggtagtaataagaagttcaaaagataattattggcgtaaagcaattgtgttagaaaaggccaatgaacctagatcatattgggtgaaaaaagaagataacaataaaattattagacggaattcacaccaaatgaaacattcatacaccacaacacttgaaaaagaactcattttagaacccgagttgtaccctgatattcagtcacaaagtgttcataaagataccactcacattaacgtaaatgatagtgttaataaaaccattagttgcccaagcccaaatgtaaaatcagtacctacattgagtcataaagtcaacccaaatattgagacttctaacagttataagacgagagttggtcgtaatataaagaccccttatagatatcgatcttagggggaaggtgtttaatatatatagctgtgtaacagcgtagcaaggggctgcgtgctagacatgacatggctaacttcaagccagtcaacatggttgtcacttgtatgatttattgtatgtaagatgtttagtaagttttataaaaatatataagtttactcaat

SEQ ID NO: 3777 - DNA, 2161 bp, Diabrotica virgifera
tgagccagtaagttacccacctgtaaatgtacctgtcgcaattagagataatttaaaaaatgaattagataggttgacaaaaagaggggcaattgtcaaagttaacgaaattgaccccagggcaagcataaaccgcattgttattgtggaaaagcaaaatggtaagttacgtttatgcttagacccattagatctaaacaaacaaatagtccgcaaaccaagagtagtacataaattggaagatgtttgtgcacaaatgataggtaaaaagatattttctgtatttgatctctctgaagggtatcatcatttagaacttgacgagacatcatcatggaaatgctgttttgcaacttcttatggaattttcagatataaagtattgccatatggattatcaaattcccaagatctgtttcaagaagtagtagaagataaatttaaaggtatagagaatttattgatttgtcatgatgatatgattgttatgggaacaacaaaagaagaacatgatacaactgttaaaaaagtgttagaaagggctaaagaagtaggagcaaagtttaatggggacaaatttcaatattgtcaagaagaggtcagatttatgggtcaagttttttcacataaagggatgcaaatagatcctgacagagtggaatcactttgtaaacttgaaaaaccaaatagtaaagtagaattacaaagaattttgggcgcatttaattacgttagacggtacattccgaacatggctgaacatattcaacctctttgtcaattacttaaaaataatgtagaatgggtgtggctcccgtcacatcaaaaatgttttgataatttaaagaacataatttgtaaatcaccagcgttagtcccttatgatcctaatcaaaaaattattttacaatgtgatgcatctaaaaatggtttaggtgtttgtatgttccagaaatatgattctattttaaaattagtagcttgtgcatcacgaaatatgaatgatagtgaaataaattatagtcagactgagaaggaactattggcaatttattatgctactcaaaaatttcacaattttatttataattttgatgttgacgttcaatcagatcacaaacctataatctccattatgaagaagccaatttccaaaattggatcagttagactccaacgtttaaggcttaaacttctcaagtacagattaaatgtatattttgttcctgggaaagacatacattttgctgatatgctatctaggtccagtttaaatatagagacacatgacccagaaatgtttgaaatggtccactcagtgagtaaacatttacctatgagccaggaaaagcaatctgagttaagactagctactagccaggatgaggcattagcagtaatttttgatttttattataatgggtggccaaaagaaaaaaatgttcctcaagtgtgtaaaaagtactatggtataagagattcactgtattttgaagctggcatcgcatttattgatgacaaaataattattccgaaaaaacttaggcttgacatgataaaattgcttcacaaaggccatataggagtcagtaaaactataaacaaagccaggagtatatattattggccaggacttaatgatgaagtgacaaactatataaaaaaatgcaggatatgtgagaaatacagaccaaataattttaaagaaccaatgatgcctcatgacattcccagactaagattcaataaagttggtacagacattttagagtatggttcaaaagcatatttagtaattgtagactatttttcgcattggttggacatttcaatattaaaagataaaacctccagttcagtaatcaactcatttcaagatacttttagtagatttggatatccagaaattttaattgcagataatctaccatttacttcggtaaaatgtaaaaattattatagagaaaaagacattacaattatgacatgcactccacattaccaccagagtaagggacttgcagaaaaagcagtcaatataagcaaacaaattttaaaaaaagagtaatgaggaaaatgttgattttaaaaaatttgggggtgggggaaaaaatataaaaataacccgcgtaaaaaaaaaacccttggtgtgtcccccccc

SEQ ID NO: 3778 - DNA, 885 bp, Diabrotica virgifera
caccaacgaaaagggtatcactaatccgtccaaataagtgtacgctacgttgtcacttttaattgtgcttaaaaccgttggattgttaagtattttatttttaagttcgatttctaacacatttaggtttacataatggcctgtagaattattttatccagtccacctatttgtgctccaggtgatgcaataaaaggaacaataatatgcatattcgaaaaggaagaaaaaataagaggtataaagtgtaggtttcgtggacaggaacatgttgaatggacggtgggcagtggaagacataaacaatatattaacaaaatcagaaattttataaaggctgacaccgaatttgttgataaaggtactatgatgcctggaagatacgaatataacttcgagtatatactacctccatcagatatcccatcttctttcgatcatgaatttggttctatcagatattttttatacgcttttgtggatagaccgtgggcattcgactacgaacatgaagttgaagtacaggttatagcacctatattacatccccctaaccaaacgagaccaataccagttgaagttaacaacaaatcacggctatgttgctggcccagtaaaccttcaactatggagatacaattagaaaaaaaccactatgcattaggagaaccaataaactttagggtgctcattaataatatgtccagttcagcagttagcaacgtattggtgcaactatcaaggaaaatgaaattctcagatactagacgtaaccataaaaaagagaaagtcattttagctcaaacggggcgtacaggtgttgaagcaggatgcagtcaattgtatacatttagtttagcagtacctcaaactaccgtaattcca

SEQ ID NO: 3779 - DNA, 1052 bp, Diabrotica virgifera
ctcctcgcgtccggttatagatagataaaatggcgttgtgttgtgccatttcaaatgaagttccggaataccctgtggtatccccatcgtcgggtgcgatatttgaaaaaaggataattgaaaaatacatacaggaaaatggcgtggatcctattagtggcaaagaactgacaatagatgatttaattgaaataaaaactcctcctgttgttaaaccgaaaccacctagtgcaactagcattcccgcgaccttaaagcttttacaggatgaatgggatgctgttatgttatatagttttacacagagacaacagcttcaaacagctagacaagaattaagtcatgccctgtaccaacatgatgcagcttgcagagtaattgccaggcttaataaagaagtcacagctgcaagagaagcccttgctacacttaaaccccaagctggaattacaacagttccacagccggctgttgctgctgaagctgcaggtgtagcaaaccaaccaactgaacaagctggtatgagtgaagaaatcatagaaaaattacaagaaaaggctacagtgttgacattagaacgtaaacagaaggggaaaacggtacctgaagatttgacaacccctgagcagttacgaaacttcagaacattatcctcacttatcggattacattcagcaagtatccctggtatattagcattagatgttcatttatcagacacaagtaaagtgttgacaggtggtaatgataagaatgctactgtatttaataaagatactgaacaagtagttgccatattaaaaggacataccaaaaaagtcacaaaggttatttaccatccagatgaagatttagttttaactgcttctccagatgccaccattcgtgtctggaatgtaccaacatcacaaacaactttacttttgcgacctcatgaaggtcctattactggtttgtcattacatcctaccagagactatgtactgtcgacatcagaagatcaatattgggcgttttcagatataagaactggaactttgttagctaaactt

SEQ ID NO: 3780 - DNA, 1522 bp, Diabrotica virgifera
tgctatagaaaatagaagtttgaggctggcagtacgaagattaaatatggaaaaaaacaattgcgaaaaaaattgcaatagagaccaattggcaaagtacagattgccggacactgtcaagcctttgctatatgatctctatctttatccagatctaaagaccggactatttacaggaaaagtaaatatctctttggagattttaaaagaaacagagagcgtgagcttacactcaaaggggctcaatattgcaaatgtgaaggttgcctcccagccaggaacatttatcacagaaaagacctacgatttactcaacatcaaaagacaagataattctaaatttatacctggatttgataatattgagattgagtttaatggtgatatgaaaaacagaattgtggggttatataccagcagctatacaacatcatcaggggagaaaaggcaaattgcaaccagtaagtttgagccaacattcgccagacaagcctacccctgctttgacgagcccaatttaaaagccaaatacaaagtccatttattgaaaccaaaggatagctcctacatagctctatctaattatcctgtagagaatgtaacagattacgataacgaccaccaactagtcactttcgatgaaactgtatcaatgtcgacgtacctgtcatgttttatcgtttccgattttacacataccgaaacatccttcaacaacagcggaaaaattgtaccccttaaagtgttcgctagccctgaaaatttggataaaacaagatatgcaggagaagtaggaaaaaaagtcattgaatattatgtacagtattttcaaatgccttatcctctgccaaaattggatctggttgctattcctgattttgtgtcaggcgctatggaacactggggtcttgtcactttcagggaaacggcccttctgtatacaaatacaacgcattcaagtctcaataaacaaagagtggcaactgtagtggcccatgaattagctcatagttggtttggaaatctagtcacgatgaattggtggaatgatttgtggttaaatgaaggatttgcctcttacattgaatacaaaggagtattagcagcagaacctacttggggcatgcttgaacaatttattataaccgatttgcatcctgtattatcatttgatgccaaactaagttcacatcctattgttaaacatgttgtaacgccagatcaaattactgagatatttgatgttatctcttacaataagggagcatctatcttgcgaatgctggaagccacagtaggcgacgaagttttccaaaatggcgtcaaaaactacttaaataggtacgcatttggcaacgccgtcacgaaagacttattaagcgaattgcagcttctagtcggaataaattggatgtcacagagatgatggacacgtttacacttcagatggggttatcctatattacatggttggcatatcggggggatccttacgcttttgactcaggaagagggttttgga

SEQ ID NO: 3781 - DNA, 1547 bp, Diabrotica virgifera
  misc_feature (1442)..(1443): n is a, c, g, or t
actagttctagatcgcgagcggccgctcgcgatctagaactagtccaacttttcgatccgtcattatattttatacctcgatccaaaaatattttcgcaaaattgtagtacactgaattttaactatcatgattgttccagatatgttggctgctacaagtgtattgcagcaaagagctacagatataagaaatcaacatgtaaactggcaatcctatttccagtcacaaatgatttcgcaggaagactacaacttcatagtagcttttgatgtgactgatagtgcaaaaagagaagctctcctgaaaagcgacagaaaccaatgtgctcaaacattgttgaaccttttggggcatgtatccaaggaccaaactctgcagtacattttagttttggttgatgatatgttacaggagaacagaagtcgtgtagagatatttcacgaatatgccaaccaaaagaaagaatctgtttggggtccatttttgaaccttcttaaccgccaggatggatttattaccaacatgacttctaggatcatcgctaaaattgcttgttggtcgcagacacttatggatcgttctgaccttcatttttacttgacctggttaaaagaccaactaaaaactcagaacaacgaatacatccaatcggttgcaagatgccttcaaatgatgctccgaattgacgactaccgttttgccttcgtgtccgtcgatggaatatccactctgttgtcggtactctctggaagagtaaatttccaagttcagtatcagctgatattctgcttgtgggtactcactttcaacccgttgttagccgaaaagatgaacaaattcaacgttattcctatattggcagatattttgagcgattcggtaaaggagaaagtaaccagaattattttagctgttttcaggaatttgatcgaaaaacccgaagatcaacaagtttcaaaagaacattgtatagctatggtgcaatgcaaagtattgaaacaattggccattttagaacagcgcaagttcgatgatgaagatgtgacagctgatgtcgaatttctaactgaaaaactacagagttctgttcaggatctgagttccttcgatgaatattcaactgaagtcaaatctggacgtttggaatggtctccagtacacaagagcaagttctggcgggaaaatgcgcagcgcctcaacgagaaaaactacgaattactccgtattctcattcatttgttagaaaccagcaaggaccccttggtattgagcgtagctagtttcgatattggagagtatgttcgccattatcctcgcggcaaacacataatcgagcagttgggaggaaagcaattagttatgcaactcttagcccacgaagatcccaatgtacgatatgaagctctgttggcagtccaaaaattgatggtccacaattgnngaaataccttggtcgtcaacttgaaaaaaagagcaagtacagataaaaacgcgccaaagggtggagctcctgtcgcaaggcaaggcgtaatactaccatgaaaa

SEQ ID NO: 3782 - DNA, 1742 bp, Diabrotica virgifera
  misc_feature (1640)..(1640): n is a, c, g, or t
  misc_feature (1687)..(1687): n is a, c, g, or t
ccttccagttgggagttgggtcagagttaattttttaggtcttctattaaaagggttgtaattttaatttaaaaaaatggcatccaatttagttgcgggagcaaatcctaaaatacaggatataatgtcgtctttggacgatgacaaaacagatatgttggctgctacaagtgtattgcagcaaagagctacagatataagaaatcaacatgtaaactggcaatcctatttccagtcacaaatgatttcgcaggaagactacaacttcatagtagcttttgatgtgactgatagtgcaaaaagagaagctctcctgaaaagcgacagaaaccaatgtgctcaaacattgttgaaccttttggggcatgtatccaaggaccaaactctgcagtacattttagttttggttgatgatatgttacaggagaacagaagtcgtgtagagatatttcacgaatatgccaaccaaaagaaagaatctgtttggggtccatttttgaaccttcttaaccgccaggatggatttattaccaacatgacttctaggatcatcgctaaaattgcttgttggtcgcagacacttatggatcgttctgaccttcatttttacttgacctggttaaaagaccaactaaaaactcagtacgaagcactggctgcatcgcaagcagtttcagatactctaaagggagcggctacggaacattacacggaatcaggattcgatcagcaatcctcctctcaagagatatcgaacaacgaatacatccaatcggttgcaagatgccttcaaatgatgctccgaattgacgactaccgttttgccttcgtgtccgtcgatggaatatccactctgttgtcggtactctctggaagagtaaatttccaagttcagtaccagctgatattctgcttgtgggtactcactttccacccgttgttagccgaaaagatgaacaaattcaacgttattcctatattggcagatattttgagcgattcggtaaaggagaaagtaaccagaattattttagctgttttcaggaatttgatcgaaaaacccgaagatcaacaagtttcaaaagaacattgtatagctatggtgcaatgcaaagtattgaaacaattggccattttagaacagcgcaagttcgatgatgaagatgtgacagctgatgtcgaatttctaactgaaaaactacagagttctgttcaggatctgagttccttcgatgaatattcaactgaagtcaaatctggacgtttggaatggtctccagtacacaagagcaagttctggcgggaaaatgcgcagcgcctcaacgagaaaaactacgaattactccgtattctcattcatttgttagaaaccagcaaggaccccttggtattgagcgtagctagtttcgatattggagagtatgttcgccattatcctcgcggcaaacacataatcgagcagttgggaggaaagcaattagttatgcaactcttagcccacgaagatcccaatgtacgatatgaagctctgttggcagtccaaaaattgatggtccacaattgggaataccttggtcgtcaacttgaaaaagagcaaagtacagataaaaacgcgccaaagggtggagctcctgtcgcangcaaggcgtaaatactaccatgaaaagtatttaaagatatttactgncataattgtagaaactttaaaaataattgtaaaaattatatcgatttctgtacat

SEQ ID NO: 3783 - DNA, 1530 bp, Diabrotica virgifera
aatttatatcacaagacttccagttgggagttgggtcagagttaattttttaggtcttctattaaaagggttgtaattttaatttaaaaaaatggcatccaatttagttgcgggagcaaatcctaaaatacaggatataatgtcgtctttggacgatgacaaaacagatatgttggctgctacaagtgtattgcagcaaagagctacagatataagaaatcaacatgtaaactggcaatcctatttccagtcacaaatgatttcgcaggaagactacaacttcatagtagcttttgatgtgactgatagtgcaaaaagagaagctctcctgaaaagcgacagaaaccaatgtgctcaaacattgttgaaccttttggggcatgtatccaaggaccaaactctgcagtacattttagttttggttgatgatatgttacaggagaacagaagtcgtgtagagatatttcacgaatatgccaaccaaaagaaagaatctgtttggggtccatttttgaaccttcttaaccgccaggatggatttattaccaacatgacttctaggatcatcgctaaaattgcttgttggtcgcagacacttatggatcgttctgaccttcatttttacttgacctggttaaaagaccaactaaaaactcagaacaacgaatacatccaatcggttgcaagatgccttcaaatgatgctccgaattgacgactaccgttttgccttcgtgtccgtcgatggaatatccactctgttgtcggtactctctggaagagtaaatttccaagttcagtaccagctgatattctgcttgtgggtactcactttcaacccgttgttagccgaaaagatgaacaaattcaacgttattcctatattggcagatattttgagcgattcggtaaaggagaaagtaaccagaattattttagctgttttcaggaatttgatcgaaaaacccgaagatcaacaagtttcaaaagaacattgtatagctatggtgcaatgcaaagtattgaaacaattggccattttagaacagcgcaagttcgatgatgaagatgtgacagctgatgtcgaatttctaactgaaaaactacagagttctgttcaggatctgagttccttcgatgaatattcaactgaaagtcaaatctggacgtttggaatggtctccagtacacaagagcaaaagttctggcgggaaaatgcgcacccctcaacgaaaaaaactacaaattactccgtattctcattcatttggttaaaacccacaagggacccccttgggaattggacgtaactaattttccaatttggaaagaattgtttccccatttacccccccgggaaacccattaatgaaaaagtggggaggaaaaaaaaattatatttttgcaacttcttatccccccaaaaaacccccaagggatcaaaatataaacattttcttgttggcgaggccccaaaaaatatatgggggcccccccaaatgagggaaaaaaaaatctggggacccgcaac

SEQ ID NO: 3784 - DNA, 1511 bp, Diabrotica virgifera
gaaaagcgtggtacgctctgcgaggtaccggccgcggaacccgcggggccaccagtggaccagtgtcgttctgtctctcgaaaaatatacatttccactcgcaaaaattcggacaatgaagggcacactgcttttcttggtcctgttaatatcatcaactattgcccaacatcgaatagttagagctaagttaggtaatctgggagcacctcaaaccatagatttaccagacttaggcttcgcacaaggttttttaccctcatctttggcaaatgctaaacatgtgaatattaaaataagtaaagcaaaatcttcaggatttggcgcaggtagtggaaacgctgaacatggagaaaatattggatttactgcaagaggtgcattctccgataattctggtgccaatattaatggaattagaggagggtttggtttttcctctaatggaggtagtacagcaagtgcaggcaatacaggatttggagtcaaagcacagttatccgctaacaatgcaggtgttagaggaggatttgatttttcctccaatagaggtaatgccgtaaatgcaggaaatacagcatttggagcaacaggactggacaactccgcaaaggattcagctaacttccatcaaaataccggaaaaattaataatgaaattagaggaggttttggtttctcatcacaaggcagcttatctggaaatactggattcggttttacttccaacgaaggtaacactggcacaacaagtaatggaaatcttgataccggcgttactcttgactccttcgaattctttgacaaacatttacatgaagccggtccacacttatcaccttttccaattattccatcaaatatttctcatgaagatagaggatcccaacatcaaagtgggttctctggcggtttcacaaaactacctggaacatcaattcctcaaccatttaatcataatcagggagcttttaatgacttccctggtacacgtccacctacaaaaacaacaacaaaacccacgacaacaacgactacaactacgccacgtccattcgaattttctggtcatatcccaaccttaccagtgcacgattttactgctagtgctcctcgacctgtccaagattttgaaaacaatcttccacaacctgtccaagattttagaaataatcctcacccacctgtacaagattttagaaacaatattccgccacctgtgcaagattttggaaacaatcctcctcaacatacacaaaacgttaatcaactatctgcggatttccctcaggtaccagctctgtctggacaaagtttcgaagaggttatagaacaggaatggagttcttttacaacgagatttaataaagtgtatgccagccaagatgaagcaagatttaggcgagaagtttttatcgaaaacagagcaaaaattatgcggttcaatatggattacgccgaaggaagaagaaactttgtcttcaaaattacgagtttgccgatatgttgct

SEQ ID NO: 3785 - DNA, 1202 bp, Diabrotica virgifera
ttcatcattacaaaattgtagttttttctcatcaaaaacacttcatcttcatcatatatgtaaaaaaataatgttttcactacaaaatcctaatcaggcatttgctacattatcacagttctcctctaaaataaacaccaggcactctgttcacctaaagaagacttctgccaagaaatctaaacatgctcaaagttttatatgtttggatagttttctagaagctgttaaaaattgtgacttttcatttgcaaagcatttgaatacaaaagatttatttggaaagcaatttattaataattttaaagtttcctacacttcaagtaacactttctttgagaataaacatggtttttcggaaagcgatttaaacaaaactgttcccacaataatatttaagaaagattgtatatatgttccgaccacactttatcagaagttggttgatggtttgttatttcaacatcagagtttatttaaaacccaattaagaacttttaagactgacagaagcataaaagctgaacttaacagaaatcctcctttaacagatagagtcaaacaagccttaggcattacagggtcagatgcaactagtactatttcttcaaaattaccaaattctccagagaaattaaaacacatgttaacttctgaagatggtgtaaatgaaacagagaagcagaggttgaaagttgctttcgctgaaggatatttgatgggaaacaatgctactcctaaagctggaaaatctacaagatacttaaaagtaactacacaaattttaactgtttttatatttttggccatcatatttagccttatagctagtgccagtggatctgtattcagaattcaattagggaatcaagtagaggtggatcctgaagaaatccatgtaacttttgaagatgtaaaaggagtagatgaggctaaacaagatttaaaagatgtagtcgaatttttgagaagcccagaaaagttttcacctttgggaggcaaattaccaaaagggagtttacttgttggtcctccagggactggtaaaacattacttgctaaagccgggggaggaaaagctgggggaccattttttcctggcagctggaccctaaatttgatgaaaaattaactgggaaaagggggccaaaagggtaaaaaaattatttaagggaagcgaaaaaaacgtgcccccatggggg

SEQ ID NO: 3786 - DNA, 1777 bp, Diabrotica virgifera
  misc_feature (1673)..(1673): n is a, c, g, or t
  misc_feature (1707)..(1708): n is a, c, g, or t
  misc_feature (1762)..(1762): n is a, c, g, or t
cggacgcgtgggtttagatctccgtaatcatctagaaccgattatttggtaaaaatacgtagtgtaaataatgggatacgtaaaagtgccttgaaaatattcgttatcgaaaattaataaattattatgcgatatgaacgatggtctatttgttctgtttttagtatcaataaaccataacaatcgaaaactagacactaaatattggatatttactaaatattggtgaacatgagttgatggaatcaatttgatggaaatagaaaatccagtaataagatctgatgaatatttgaaaaatcgtaatcgacttacaaaattatctaagtattataaaaacatcaatttagaaatacaatatatcccgatgataagatataagacacttagagctaaaatcaatcatttaattttaaacctcacttatgtgtaatttaattttaaacctcacatcaattgtgtaaagatgagtgtgaaaaatatagaaacacttctagaactacacattggtgagggtaaaaaaataaaagaaactcaaacaaccaacttagtcaatcctggagaaaactatggaggagaattatttaaaatagatgttacgttagaagattccgatacccagaaagaagaagttttacatattgtaggcaaaatcattccagcagatgataattcacaagaaatatttaacgttcaaaatacctttaaatcagaaataggattctatgaaaaaattgtaccggcacttcaaaacttccaaagaaagcataaaatcgaagaaatacttgatatttttcccaaattttatggaagccgaattaacttagatggaagtgacaaagttgatagagacggtgtgttattgctagagaatttaaaaatagaaggatatgacaatttagatcggtatattggatataacttggaagatgccaaaatccttcttcgagatcttgctgtattccaatcaacagtcgttgcattaaaaattaagcagcccgatgtattcaacaaagaaattaaacctttttgtaacaataatttggcaactcctgaggatgatccatttagaaatatgatattagttatcgatgaaattcttgaagactccgaagaatttagacagttcattccaaaggtgaatgtagcatgggaaaaacaggaaatgaaaactgaagtaagagaaccatttgcaacgatcgtccatcgtgacctatgggtcaacaacgtaatgataaaatacgaaaaaggtaaaccagcaaagaacaagtttattgacttccaactctacgactacggttccccagcttctgacgttcttaactttatattcaccagtgtcaagacggaggtttctagactacattttgatgatttgatagagcactaccatacagaatttgtgaacaatctaaagcggtttaaatgtgatactgaaccgttcaattatccaaattttctgagagagttaaaaatggaatcagaaatcattttgggatggactattggttttgttacaatagtggtatttggtaaaaagaatgaaagtttcatggacgatcccaatccagattttcatgatcctaagtataggcaaaaagtgagggatggattaatgccagaagccttagagagactctttttcattttacgtcagtgccataaatgtaatntggatttaaatggcaagaccaatggatgaaattnntggttgatctttagtacagtatttatttgtagaattggcgatattccacagaantattatgtttaatat

SEQ ID NO: 3787 - DNA, 947 bp, Diabrotica virgifera
tcgcttcctggtctgactctgtctccaaaaactgctctccctgacgttgaattagctttgcgactattacaagaaaatgccaatcacatgaatcccctggaagctctcttcatacttccagataatattcctgtctctagacttcataagtttttgctagtcgctatgcagaaggtcacccaagaaagaaggaatatgcagttgatgaaaggattgctgtacgctgaacatttacaatgccaggagatgaaattaaaactgcagagtcagcatgtgttagttactgagtttaatgtttgtccagtttgtaggaaacgatttggaaatcaaagtgctttggtacggtatcccaatggagatgtagttcactactcgtgtcaagacaaaaaatgattaataataatggcatcatatgtaacagacagttgaaaaatgtttattataaaacgtatattattgtatttgcgccacatctgatctaatgtaaaatatgattcgtgatcatacacacagcaaaatttacggaacattttaaagatgggatatgttggatgtctcgaatttcctaaaccttttgtccgatttgagtgattttttagtatgttgtagcctcgttatttaggataatcgatgtaatgatattgttgctggacaggtgggtgtcattttgtaccggttgtaactatcatactgtgtcttttctttaaagttcggaacgctctgtggagtattctagcacatatgaaatattggaattaaaaattccattgtagccctaggatttattatcatttttcctttttgattcttttgctttatgtggaataataaaaaagataacgacgtctaaccacctagccatggttttgaaaaataaatccccattttcggcttaattaataagcaagtttaaaaaaggtaagaaaaaaataaccaattaataaaaa

SEQ ID NO: 3788 - DNA, 1974 bp, Diabrotica virgifera
ccctggccgcccttttttcttttttttgtagtcatacgttttattggaacaaaatttccaattgatgtcaactgcattgtgtaattgtatgaacagaaaacaaaaaagtcttaaatctataatgaaatatttaaatatctaataattactgaatatctggtatagcgtgagtgtgaaacttctagttcaggaaacaaacactgcgattataaaatatacctgatgtaatgttctttaaaatattcttaaggtctaagaaatgttttctctggaagttcttagtagacaattgcggccatactctaaaattttcttgattaatcctgagattgtggcggtgcttgctgttggcctccgtaaccgtaagatgggaaaccatagccaccttggggtactcctccagggactggagctgattggggttgaccgccataatagccaccagctgcagcttgcggttggtaacctccataaggtgcttgggcttgggagtatccaccaggttgagttcctggtgcagctggcgtctgtccagtcgctgctccacccgccgctcctggcattggccctttagttttcatctgtgtttcaatagcttcagcttccttatgtttacccatactcctgtaatattcggcccactgggcactataatcagcctgagacgagggattagcactttgggtggacgcagccggctgggctggagtaggagccgtttgcatagatcctcctgcagttttcgccttcgcctgttgttcaatcatttcggcttctctgtgcatacctaaagatctataatactctgcccactgcatggaataatctggttggcctgtcgatgggtttacttgtactttgttgggttgacctggttgtgaatcagcaccttgtggttgacctccccactgttgctgttgttgataaccaccagcccctgcaactccaccaccaccaccacctccttgcattccccaattattctgaggattgtaattctgtggagtcatgcctgggtatgctgttggcatggtgctgttcatcggaggtccgccaccacctccgccgctttgtgatacgaaggttaaaggcatttgtactttttcttggatgattcgttttgcagtttcaatcgaatcgggatcgcctttgatattaaatactttgtcgttcgcggtaggattctgattttgagctcgcctatctaactcgcaatatgcaccagattgttgattgatttgttttattgtttcaccgcctctaccaataataactccacatttattagccggcaccgtaaacgaaacaacgtcctgttgaccgttaccttgtccacctggtccgccgccaccgcctcgtctatcttcccactgattaccgccaccaccgaagtccccaccaccgccgtttcgatcgcccctatcgaaaccgccttggccgccaccaccacgtccaccgtgatggccgcctcgtccaccgcgaccgccgccacggcctccgcgcataccgcctcccataggagcacccataccaccaccgtcaccgtcacgctgtagcacactgtctatgagttcgtctatcctctgacgggcctgttcaacttgtttgggatttcccgacaagtaacaccttctgtcaccggggccttcatcgcgagcctgttggaactgtactttcgcacctgtttcggcttggattttcttaatcatgtctccaccttttcctattacaacaccaacggccggtcgtggtactaagacttccatctgttcgccaccaccgcctccaccgccataatcattattgccataaccacctccatcgttttgtccctggttctgacgtcctcttgggccgcctctgttgaaactcttcatctccttttcagccatcaggtcatatactagctgtttggcatgctctaccttttgaggttcaccgctgattaccaggggcttctcgcccacgcgtccg

SEQ ID NO: 3789 - DNA, 952 bp, Diabrotica virgifera
ttatgaccgcaattagcttatgtctcataattttagtttagttccaaaattcagtgttttttgtataaatccgtttcctacacgccatcccatttaactaaggcctctgggatacatactagggcggtctaataagtacttctaccttcaaaagaaaaacgaaaattttggaaaagtggtgatttatttctgaacgtagtcttcttttagctcaatacacttgacccagtgatgttccaccttctttatctcatctgaaaaatacgttttctcgaggtctgcaacggaggcttccgtggcgatgatgaactcgttattcgatttaaatgtctgcccgggcgagccactttcaagtttagaaacaaacagaagtcacacagtgtcaaatctggagaaaacagtggatagaacagcagttcgtagcctaattcgatcaatcgaggctgtttttctacaattcggcgccgaatcggcccaataatacggcatagtaaagccctttgaccgttttgcccttttccaggaagttaacatataacacaccttgtgaatcttagaaaatggtggcctttttcaccattcacttttccggtccattggacagttttctccctcttcgaagaacattcgcggggtgacgtccactggtatcgactggtttcttggtctctggtgtataccagtggaacatgtttcgtgggcggttatgaaacaacgtagaaactcatttgtattacactgaaacagcctcatacactactcttaagtggtctcagggttgcgcttactgtccggagtgagcaaacgaggcacccatcacaccgacaagcgttcttatgcccaaaatttcatgcaggatatgactcacgcgatattttgagatgcctactgtctcgtgcactttcggtcggcgtttctgccatatgatatcacggatttctttgacgtcatc

SEQ ID NO: 3790 - DNA, 973 bp, Diabrotica virgifera
agtcgcccctccgcgtccggagccacagaaggtagtacatgtgttttcactcgagcagtagaaagccggtcaattgaattaatttgataattttatagtttagtgtgtttttggacatttctttttaaattaaaatggaagttttacccttcgttgacatcaagcagcacagcggtcttgaaggctgtgaaccagaatataatgaatttttccggttagaagagacgtccctgatagaagcattatctaagcgtctcgaaggagagcttaggactgcgaagagaacccatctttcggtaggagaagttcttcttcccaatggactgacgcattcgatagccaaagatcttttttacttggccgattctgaaccttgtggacttcgtgggtgcactttgtatatagactttgagaacaatgatctcaagacgaatttgagccaggtcaagtgcgatgcttcgactccttctaccttcgaagtgtacttgacgcttaagcaggcgaccactggatggaattcgtttctgccacagtttcttaaaaaaatcacaagttctggagcgcttatgataagtgcagaatatggacttaccaagaagcaactgtatcgctcgagttactaactcgactgatttttgataataatatgtgatcattcacacacatatacgtacacatttacatttacaagtatctcgaaattttttttatttcattcacgtttttgtattcataactatatcattagttgtaatcgttcgtttctttatcaagttagttaacattgagttgtatgtgtaagatataaaagagtttttaaggtttttggtaattttaaaaattctaaaattgtgatataggtgtgcagattataaaagtgttatattcatattttttgtgatattagtcgatacgaattttatttttatagaaataggtgcgttcagctgaatatttgggttgaaaactgaaa

SEQ ID NO: 3791 - DNA, 794 bp, Diabrotica virgifera
gtggcttctttcttcttctttagaatagtcgattacaaaaacgccacacggaaatagcttcgaacaatcatttaacgtgttacagattataagaatgctcaaaaaaaacttttcttttcaataacacacaaatcatgtaggtcatccagaaagaattcattttatacccacaatagagctaaagtgaaagtttttccaggattctcgatttcagtcgacaccagctcttcatatcgtctcaaagattctttagcggttttctcctgtttttttttttatttttaaagaggaatttacttgaaggtgcagtgggtactatttgtccaaaggagaatcatagatacgaccacaccagacgccctccgtcaaattcccttagtcgtgaacagcttggcttttcaacattcaagttaacgttggcctgaccagtttctcattagtttttgagacggtcgtagtagcaagtacttccatggcatccggttacaccgggtctagccacgaacttaaggatagtgccgacaggtatgggaaagcagtattactaattacatttccaaaagcaactagcactcagtattaccacaaaatcttctggtctgcgagaagacctgctgcatggttcccgtattgacagaaaacctttgcacagcaggcaggattcaaagctcagtggaacccaagatcccacctagctccacgcttgctcaaggaaccgtgtcaagataaaatgggattgttcatgggatcttcacatggtaagaagaatgctgatgctgagcacctagcaaccc

SEQ ID NO: 3792 - DNA, 923 bp, Diabrotica virgifera
cccatcgcgtccgattagagtagaatgcacagttttttaaatttttgtagatttaaatattcggaaaacaacttaaggaatgcttgttcaattttatgtctaaagaagacaagcaaatataagactgttagacatttttctgttgaaaataagatagtaaaagatgagaaacctgaaaaatttatacccttcctgcagaggattaacctgaggcggtcagaagcgagaagaagtatggttgttcaagtacaatctacacaatcgtttaaagaattatattcctattgcaatgctataggaaaaataaaatatatgttccattattctgtagggattgagccattgcacttcataatcgtagaatttgaaactgatacagatatcacgaatattaagaagtcaagcatatttgttgaaggaagcttaggactacctacacagtcacattttgtgtggtttagggccgcacataaaaaattaccaaaattaaaacaaataaaatctgcctgtctgacagtagaacatggtactgcgattaaagaggaagaaacaatcaaggaaatgttaagcaaatcagaaaatatttcagatcagataaaaactctccatgaaattactaaattaaatgatgttggtacccgtttaaggtttttaactgctctccaaattgaagatgcagtcaatggaatgtttcctcatgcagttgcttatccttttggatccagtgtgaatggatatggcaaaatgggatgtgatctggatctatttttaaaagtagcagctgacaagcataataatgaaaatgggaggctagcatttcctttgtaacacttaatggtcccgaaaaaaacatgaaccaaaggtccatggagacattgggggatttaatctattttttttttccccgggaaggggcaaaatat

SEQ ID NO: 3793 - DNA, 1439 bp, Diabrotica virgifera
tggggaaaaaaggccggcaatttccccgaaaccaaaaccaattgggaattggggttgttttttcccaagggggaaaaatttttggcccctttttttttttaaaaaaaaacaaacactttccaaaaaccccccttttttagggggaacccgaggattggagaaacccggttggaaaattcccttaaaggttgggccgggggttccaaacccaatttttccaaaatttgggccctttaaaaatttttttaaaagggggggcctttcccccttgccctttttttttttttgggtaaaaaaccctccctttagccccttttttttaaagccccccccgggcttttcaaatttttccaggggaattttttttttttccccccggccaaaaccccccccaaaaccaaattttaccaatttggaaacccttttgggccccccctttttttttttttttttttttttttttttttttttttttttttttttttttttttttttttttttttttttttttttttttttttttttttctgaaattaatttttatttaatacagatgttatgatcatatttcttaactagttaaagctattggctaaacaacgcttaactattcaactttgttatagtaaaagtgaatgattagataaacaaagaaacctagcaccaacgtatttatattgattagagcatgtgttcctgcactgctttcatccaattttactttttctgctttcaaccgatcactttggactcctctctcggacgcctttgctctatttactctatccatacatactgatttcatctcccagttgatggtagttatagcaacatttttctcctcaggttttaaatttgatttaagatcaattttgtccaaagtctcatctccaaacgtattatttggctttttgaaatgtaattcagtaccaggattccaacacaaagttgggttaaagaaaaaggatagatcagaaagatcgcaaaactcttctttagaagcaataggctgtttttcgaatcgcttttttaattctctcagaatgcaaatcatatctttaaagcaccactcattaactccggttgggataggtgtgaaatatttatcggagtagtcaatttgtccagagcactgtctatcccgcgggcccaaacaaccatgcttgtaaggctgaccctttgaatcgaaagataataattgtaaattgacataattggatagatttccctctaggatgggatttaattgttgttcaataaaacttttgtcataagggcagcctgtttcatagtaaacagtggcgtttatacctgccggccatggagactcacatttatttaaactgacaaaaaacatcaggcttattagcaaatatgatacaagatattccatttttattctagtttcattcattcaatctaattcagttaactttaga

SEQ ID NO: 3794 - DNA, 409 bp, Diabrotica virgifera
tcgaacaaacaaacaaaaacgaattgtccaaaatgctgcttaaaattgtcgtcgtttgctgctgcatttcaattgcactcagtcaagctgttggaaaatgtcccagtgtagatggtagatatccagtataccttcctgatgcaacatcctgctcaacattttatgaatgttctaatggaacaccataccaattcaaatgtgcgtatggaacatatttcgacagccagagcagaatatgcagacataaacgagacgtcaattgtggcagtagaaggagagattagtactctagttaaaaaaatgtaaatttgttttaattctcgtagtacctgtgatacacatattttttatattgtgttaaaaattaaaaaataataaaaaagtgattacatctaaaaaaaaaaaaaaa

SEQ ID NO: 3795 - DNA, 1489 bp, Diabrotica virgifera
gcagtcccttcaccacatttcccgctggtaatggtagaagagaaattgtatttgagggggccgataaagttgatgggccctggaaagaatataactttttatacaaaccaggaaacccgaatgcttcattaccgtttgttgctccccattcgccacagctggattggcacttagcgaccgcagcttatgtgagttacgatcaacagccatggttggtgtcattcgcccataggatcctggctcacaaacctgccgttcttgccctcatagattttagagattcgccatatcgtaacgtaccacccaaatatcttagagctcttgtatataaatatcaatatacaggttggaatcaaaggagtcagagagcttggtggacaagagaaaaaatttcagaatacttgccagtcgtttccttggactctcccttcctaactgactacctgaaagcaagaagtctattacctttaacttcaaaaggtaacgtgaatcctctatggacacaagccttagattttatcagatatatcgttaaccatttggaagcaacattattgttctggtcagtagtttctgctggctttgccgtcatttgtacgacttcatcagtttctcacggcaagaaataaagcaatgtttggttatgagtgtacatgtgtggtctggatgtacagaactgaaatactattttacatcagatttttctttcagtcacaaaatacatggattacatacaaatttgcagaaatgatgatcagttatgttatatcattgtttcttgtattaaatctgcgaatttaaacatgtgttttgttactgaaaaactactcgtatcttatctatatttttaattatgtgtttttttcttttgaaatattgcttcctaataaaaatgttttagatgatgagttttcttgtggactcattatacttcaatgttcacataattataacgtcaccgaagtttgtgaaatagcatgctaacatgaacagtaattactaattctgtcgttagtaaactaatttttgagttttctttgagatacattattaatgtttcatgaatccgttgcacgtcagtagatttcaagttgtcattatcgtacagcattgtcatattgtcggaatggtagagaatgtaaagaattaggaaatactaagaatgtgaggttattctttttaattcatttattcagagaaccagaagttgcatcgataaaaactaaccaagaatttatattattatagataatataataatataaatataccagcataccactatagatacgtcaaatattacgtcggttaataagttccggacctaattattaaaacaacatttttccaaaaaatattttctattcatgtggcaatagaatcattccaatgcttttttaattttccgatggcgcccttggaaaacgggttatctttgccttcaaataggctttagtttcagtgattacttcctcatcagagcgatatt

SEQ ID NO: 3796 - DNA, 1085 bp, Diabrotica virgifera
acggacgcgtgggcacaaacataaattaaattcctctgaagtggttagtgtacgataaaagttcacgataatttaattatgtttatatttgtaatcagtatcgatgtaacatatccgtgtcagctggataaatagcagatagcaccatataatctcgcagtcaacattatgagaaaagtagcagcggaataatggctttagcagcgaatagtttgccaactttgtacgaatattacactggaaatggaattacgcagggtttatcggataaccagccctattttaccctcaacgagaaaaatattaccctgtacagtggggctttccactatttccgagtgccgaggaagtactggcgggacaggctgaggaaaatgagggcagcaggcttgaataccgtggaaacttacgttccctggaatctacacgagccccaaccaggtgtgtacgattttggtcaaggaggaactgatatggaagactttttacacattgacgaatttttgagaaccgccaaagaagaggatattttagtgttggttagacctggtccgtacatttgcgcagaatgggaatttggaggttttcccagctggcttttaagaaatgttactacagttaggagttcaaaggacaaaaattatatgacttacatacaaaggtggtttaacgtgttactaccaatattggcgctgtttcagttccaaagaggaggatcgatagtcggtttccaagtcgaaaacgagttcgccagtctctccatagacgatccagtatacctcaatacactcaaaaagttatttattgacaacggtataaccgaactgctatacacagctgatgctccagattatacccacggaattataccgggagtgttgcagactgctaacgtgggaagtatgtcacaaattataaatgggattaaaactatgcacaagcgacagcccaacaaaccaaatatggttatggagacatatacagggtggttcgaccattggggtgaaactcatcatactacatcagcggagggttatttaccttatctaaaagcaattttagatttcccgtcatcaaataatatg

SEQ ID NO: 3797 - DNA, 1105 bp, Diabrotica virgifera
tcgcgggctgacacacgcctcaaaaatgtgtcagcatactattgggttgacacaactgctcgcggtggagtaccatcttcagctctccgtggaggcactgacgtcgacggctacgaaatctatgttggcagagctcactatgaaggagactggcttccagcaaaagtaattccaggcaaagatatcgcctacgtatcttacaatggatccgagattggagttcaccgcttccaggttctgtgcgaacaacaattcgactgggtaccatgtcacggcggtaacattccaccagacgcagtggaaggaggtagaacgtccgatggagaacctttatacattggcagagcttaccacgaaggttcccaaacagtaggaaaggttcacccaagtcacggttgttgctacgtaccattcaacggaggcgaacacagccattccaactatgaaatcttggttctcaggcattaaatatttattttttaagttatttatttttaaataaaacatttacacacaaaaatcaaaaaaaaagtccaagtggaatttttgtgaaagttccaaatatttttatgtgtcaatgagaatttttgagtttttattaaactctagaaaccagggaataagtttggatagaaatttaggcacaaaaaaagacagcaagagaggtaactccggaaactacaaggaacaacaaatccttaccagaatacatcacgtaccgtagatttttgttccgccgttctaaccttaagcgtattcaagatggtagtaaccatttactcagcccctaaaaaagcctctgacagttggtgtgtcaccccaaacaacttcgacgacaagaaggaaaaatcaaactctttccaatccaagaaagatatcaaaccacaaccgaaggcaaactcctacggagcttggggaccaacttttaaaaataaagatcactttgctagccttcattattgttagtctataagattttgtacgaaatttaaatgtatgtggttggatatgtaacttagaggcttagtaataaatatatttttctaaatttgtaaatttcattgatttcaattggaatgtaaagttaattaaagtatttggggac

SEQ ID NO: 3798 - DNA, 1042 bp, Diabrotica virgifera
tactgataaaaattgtttgattatttgcttcatccggtaaagaagctataaaatttttgtcctttataacgagcaactaatttgatcagtattttgaaaaagtaaaatgagaaatacaattaattttattttagtactggcttgtgtattaggtgttattccatacacgactgctagacatgcaaaatctaaattcgattactctgctattaatttaataagagatatagttgaagactgcaaaaatggtttagagacattcgaatactatccttatgactgtcaaaaatattactcttgtagtaagggagcacctcaggtaaatacttgtgacaatgggctatattggaacgataaagttaaagcatgcgacgtaaaagaagacgtagactgctccaacataataccattcccagctcacattatccctgaacctgactcaacttctgtcgccccccaaccttcaactgatgtcaccgaaccttcaactgctgtccccaatccttcaactgttaacccagatttacattgtgatatagaccttgaatatttcgccgatccttacaattgtcagggatactatcaatgccttaacggaattaagcagcacgaattttgtaacgaaggtcttctgtggaacgtacacattccaggatgcgatgaaaactctgattgttctcaactattagtttccactgaaaaaacagatgctccaactgcagcacccaccgaaagtacaactagtagcgtttgccaagaaggtgatcgaaatgagtatatacctgattgccacagattttttgaatgccaaaacaatagatgggtaggtcctttccaatgtccagctgatctttactggagccaagcaaataaacgatgtgtagtactagcgcagtcagattgcaataaacattaacgagagaagatattaacacataaaatgaatttgacattacaaccgaagactttacttgttatattgtaatataattttgtctgttgttataatgagcttaaaaaaataattactaatatttaacta

SEQ ID NO: 3799 - DNA, 1238 bp, Diabrotica virgifera
  misc_feature (1155)..(1155): n is a, c, g, or t
  misc_feature (1221)..(1221): n is a, c, g, or t
  misc_feature (1237)..(1237): n is a, c, g, or t
cttttcgcgtccgagaggctataagatttttgtcttttacaacgagcagctaatttgatcagtattttgaaaaagtaaaatgagaaatacaattaattttattttagtactggcttgtgtattaggtgttattccatacacgactgctagacatgcaaaatctaaattcgattactctgctattaatttaataagagatatagttgaagactgcaaaaatggtttagagacattcgaatactatccttatgactgtcaaaaatattactcttgtagtaagggagcacctcaggtaaatacttgtgacaatgggctatattggaacgataaagttaaagcatgcgacgtaaaagaagacgtagactgctccaacataataccattcccagatcctgattgtaaggatggtaaaaatacatattacccatatccatacgattgtaaaaaattctacgaatgtcttgattccatacgttacattctatcatgtccaggggatttcctgtggaacgaaaaacttaataaatgcgacgacaaagacacagttgattgttctcacattatccctgaacctgactcaacttctgtcgccccccaaccttcaactgatgtcaccgaaccttcaactgctgttcccaatccttcaactgttaacccagatttacattgtgacatagaccttgaatatttcgccgatccttacaattgtcagggatactatcaatgccttaacggaattaagcagcacgaattttgtaacgaaggtcttctgtggaacgtacacattccaggatgcgatgaaaactctgattgttctcaactattagtttccactgaaaaaacagatgctccaactgcagcacccaccgaaagtacaactagtagcgtttgccaagaaggtgatcgaaatgagtatatacctgattgccacagattttttgaatgccaaaacaatagatgggtaggtcctttccaatgtccagctgatctttactggagccaagcaaataaacgatgtgtaggactagcgcagtcagattgcaataaacattaaccagagaaaaaaaattccccccactttttatttaaaaaaaaaaaaaattttaaaaaaacaaaaatggaattttccctttattacacgtaattccttattancacataaaatactttacttgttatattgtaatataatttggtctgttgttataatgagcttaatanaataattactaatatnt

SEQ ID NO: 3800 - DNA, 1720 bp, Diabrotica virgifera
gattgggggcggtgtaatttttttctattattaaatcgttccaactgtttgtttacaatgcctaccaccccacctcaaatttcgcctgtagaagaacaggaaaagtatttacatgatgctttgggcattgttaaagcacaagcttttcaaatgaaaagatcattggacaaaaacaagctgatggatgcccttaagaatgcctcagccatgctagccgaactcagaacttctttattgtcaccgaagagttactatgaactgtatatggcgatctctgatgagctgaggcatttggaattgtttttagtagacgaatttcaaaaaggagtcaaggttcctgatttatacgaattagtgcaatatgcgggaaacatagttcctcggctctacttacttatcaccgttggtttagtttatattaaaactaatagttccttgagacgagatctgctcaaagacctggtagagatgtgtcgaggtgttcaacatccgttaagaggcctatttttgcgaaattatttattacaatgcactaggaatgttttacctgacactccagattgtgatggtgattgtccagaaggaaccgttaaggattctatagactttgtgcttatgaattttgcagagatgaataaattgtgggtgagaatgcaacatcagggacattctagagataggcaaaacagggaaagggaaagagaggaattacggattctagtagggaccaatttggtaagattgagtcaacttgagactgttacattagacaagtatcagaagtcagttctgcctcggacgcgtgggcaggttgtgagttgtagagatgcaattgctcaagaatatttgatggaatgcatcattcaggtatttccagatgaatttcatattcaaacattgaacccatttttgaagtcctgtgcggaattagaagcaggagtcaacgttaagaacattgtgatatgtttgatggaacgactggcttcttttagccaaagatcagatgctattggaggaaaagggggaaatatccttaaagaagtccaactttttgaagtattctcaaatcaggtgtcatcaattattgaaactcgtcagtacttacctcctgaagacatgattgcacttcaggtagctctgattaacttggcacttaagtgttacccagataaaattgaatatatagatcaagttatgctttcaagtgttgagatattgcagagattggccatcgaaaatatagaaccacactcttcggtagctaaggagcttcaaaaactcctgaaaattccattggatcactacaacaaccttcttttagtattaaaactcaaacattatgccggtttaatggagcatctggactattttggtcgcaaatctctcagtatctatattttgaataatgccctggaaaatgaaacgattgttccatcaccggaagaagcggaacaggctcttacgttgttcggaactttggtgactgataaaaacgatcatccaattggggagttggatatggatgagctaacagaagagcagtgccttctggctagatttatacaccagatgatgtccagttcacctgatgaccaatttcttattttaactggagctagaaagattcttagtaccggtggaccgctacgaataaaatacacacttcctcctctggtgtcccaagctatcagctcgcttacaatataaggacctaaacgac

SEQ ID NO: 3801 - DNA, 1846 bp, Diabrotica virgifera
  misc_feature (1019)..(1019): n is a, c, g, or t
agcgatcattcccttatctgtcatcagctgtgtggtgcgggataagagtcaaaaactaatcaaattaagtatttcccaaaaagatcaaatggttcggttgtctgttttctcttcggaatgattataacagaagaagctcctaaaatgttgttcattaagttacatagttatttagcatgattagaaccagtccttcaaaatgcaccaagaaataaatcgtcttcaaacgtttagtgaatggcccagtgacgcacaagtaagtccccaaagaatagcaaaggccggcttctttgccacaaaacaaggcttagaagtggagtgttttgcttgccatgcaaagatatcagaatggaattatggcgatcaagtcatgactagacacatagctttaaaccgagattgtccctttgtactgaatccctctacctcaggaaacgttcctataacatcctctcgtgtaccttccacttcgataaacatgtacagatcgtctgagactagactggcctcttttgaaaattggcctgctgctgatattgttacaccagatagtttggttcaagctggcttttactaccttaaagagggtgataatacacagtgtgccttctgtaaaggcgttgtgagagcttgggaggttggtgatgatccagatactgaacaccagagacattttcctaattgcccatttgttatggctgttattaatcctaggctccaagcaaggagaggtagtaatgatagaaataatccggaaaataatcaaatcgttaaggattcattcccaaacatcaatgtagtcggaaccgaacaaaacctaggagagttgggagttcaggctcacaggggcccaaagaaatcgaattttgctaccgtagaagcccgactacgttcctatgttggatggtcctcggatttgattcaaacacctgaagtcctcgctgaggcaggcttctactatgaaggaatgggcgaccaagttagatgtttccattggtgatggggggctaagaacgtgngatccacacgacgacccatggactgagcacgcgagatggtttccgaattgttccttcgtgaaattggtcaaggacaagattttgttacggcttgtaccattggacaaactacggatagtagtgtgagaccttccgctcaaagaatacagacgactcgaattcgaagagaagttaccgaacgagaaatccaaagttacttgactagtccacaggcgttggccgctctcagtataggcctcaatgtcgaaagggtaaaacgtgcaataagagaaaagttggagcagaccggaagggcctattcccaaccagacgctttagtggaggcagctcttaatctgcaacatgaggaagaggatcccaattcgcatgagcattacactccaatagatcgtagtcttaggaatgttgtgtgtgcagcaatggaagagtgtatcgatcgacaacctgagcaggtgcagcaacccgagcctgcacagcaaccagaaatggacgaggcgtttgaagtatcccccaccacagctccagatggcactccgcagttgcattaccaactggtaaaaacagtatcgctggaagaagaaaataggattctgaaagaagctaggctgtgcaagatttgtatggacagcgaggtgggaatagttttcctaccgtgcggtcacctagcgacctgcgtcaactgcgcccctaatttagaagattgtcctgtttgtagatctactattaaagccactgtacgaacgtttttctcataattattcgatggtattaaaataattgtttccaaaaaaaaaaaaaaaggcggccgctcgcgatctagaactagt

SEQ ID NO: 3802 - DNA, 1908 bp, Diabrotica virgifera
  misc_feature (1756)..(1756): n is a, c, g, or t
  misc_feature (1769)..(1769): n is a, c, g, or t
  misc_feature (1812)..(1812): n is a, c, g, or t
  misc_feature (1878)..(1878): n is a, c, g, or t
agttgtagttttgttttgacatttcccttctgacataacctatatgtgtatcataaaataatataatatattatatacaggcatattatgccttttttgcctttacacttacttgtgaattgattttttgttttatttatttactgaatatagagagacttttaaactgtccaaggttgttctagctttgttgttttaaaatttgtgatgtttgttataatgataataggagtcttatttaaattggtgcattaaaagggatttattatattattagcagtaattccaaatgcgaatattagagcagggcatttagcacaaaataaatcgatttttaaatgcagcacctagagatttgcaactttttgtattgtgtttaggatggtgtcagaaaaaaggtatactatagaaaaatgggtggaaatgacccccggtgctcaaaaatcctccacactccagaagacaacatgtcttagcagtgatcttgggcaccaggtagtgcatccagaaggtgacgtgaccatagacatgtttaagtctctagacacgaaaagtttaaagtctctgggtgctgtgtttaaaagtcgatttattcctatgtttttagtgctaatggtctatatgtttcaacactatatcatgcccaaaacacgccataataatgtgttttgaaatatgtcatagaaacctcatttgtgacattatttacttttaatattatatgactactgcatatgcatccaattttctgtaattcttgacgttttcgtaatcgaattttatctgcacattcttttggcaccatccctaattcctctaatttaatctaatagccttttaatagtctgtttaatggattgaaattatttgatatgtaatttagtatgtttacaaattgtaaaaaaaggggtgcctgatataattttgttttgactataattaatgaataattaaaaaattactttttttatatattaaatagttatttatgtatcaagggcattaaatcgatgtttataccctaagggcgacaagcttataaattacataattatgcacgtggtgaatataaaattttgtgtcatagcggttcattgcgtcagttaaagttttaattttataatataataaatttgaagaaatactgtatcgcagcaggtatttagtaccgttgctagaaaagtgatgttggttagcaatttggtattaacataaacaaagtttttctatgtgaaattgtcaaaaaagtcagaatgcaagagaaattcgatatttctgaaaaaagccaataaagcgactgagaatttattaccaaataaacgtatctatgacaaggaatacgctaaatttcaaccatggatgacagaaaataatactgaatgcgtaaatgagactgtactactggcatacactgtacaggacgaccaagaaaaacatggaacaatagcataagcaagattctcaaagaaagaggaaagacatagagtgagccgaaggaaccagctagagacagaaaagagtggtgtacatttgtacaaaaaaatttaagagagcttgtacacctcgacaccttcgggtataagaggttttcgattatgtatgtatgtatgcatgttaattatagtcggaacaaaattatatcgggcaccccttgttttttataattgttaccatactggattacatgtccaatgattttaatccattattaaacagatcggtgcagatcgacattatattggatcctctactatanataaaagatccanagtaccaacaatactgtcagtagtcttaaaatatatttattanaacataccaactgtagaaaaataatataacttatcaaatctggttatttaaaaaatacagctactnattataattattatcaatatgatttataca

SEQ ID NO: 3803 - DNA, 849 bp, Diabrotica virgifera
ctagttctagatcgcgggcggccgcccacgcgtccgcgttaaggaggaaagagtcgaaagaggagagaagatactggtccggccggaaaagtttttataaaatgaatgtcacggtgaatgtattaaaaagattgccagttgggtctgccggaataaaatcacagtttttccaaaggttgttacatatttcttctgctaaaatggttaaagtaggtgacagtattcccagcgtagatctctttgaagattcacctaccaacaaagtaaatttggctcaactttcttctggaaagaaggtgatactatttgctgttcccggagcatttacaccaggatgttctaagactcatttacccggatatgtaaacaaggctgatgacttaaagagtcaaggagtaagcgagatagtctgtgtatcagtaaacgatcctttcgtaatggctgcatggggcaaagaacacaaaacttcaggaaaagtacgaatgcttgctgatccttctgctgccctagccaaagctttggatctttctgttgatattgcccctctaggcggaaccagaagtaagagatactctatggttgtcgaaaatggtaaaattacttctttacaagtagaacccgatggtactggattgtcttgctctctcgcagaagctattaagttgtaagctattatgttaggtagagttttaagtaatattggttcttcccggagattattatttaataaagaaattccatttttaagtatagaataaaacagattgaaaactaaaaaaaaaaaaaaaaaaaaaaaaaaaaaaaaaaaaaaaaaaaaaaaagaaaaaaaaaaaaaaagggcggccgctc

SEQ ID NO: 3804 - DNA, 883 bp, Diabrotica virgifera
ctatattttgatatttgaaagaaattagttgttttcaaaactaagtcctcataaattagttgtttagtgtagaaaataaaaagtcttaatgtaattaattaaattacattaatttacttacatttaaatgtacttgtttatagctgctgactggatttctaatatggacgcaagtgaaacatatgatgaaacaagtgatgtaatatccactccagatacatccacccaaatagagacttctccagaaactatcactgccgactggaattctagtatggacgaaagtgaaacatatgatgaaacaagtgatgtaatattcactccagatatatccacccaaatagtgacttctccagaaactatcattatcaacggaaattctgtagaagacacaagagatgtaatatcctgtccgaaaatattctatcgaatactgtataatattaaagtttcttatgatgacgctgttaaaaagtgcaagaaacgtggaatgtcgttagttagtatccagtcaaaagaaaaaagcaacagtcttaatactgtacttcaagccagtagttatggaagaaatactttctggacatccggtaacaaagaggataacaaatggacctggctgaaaggagaaccactcgaatttactaactggaacgcaggagaaccaaacaatggaaggggaaatgaagattgtcttacagtcacagtctttaaatctgacaaccactctttatggaacgatgaaccatgtggatggggatacactcccgcgggagaaaaagtcgttgaatgctcagaatgatcacactctgattatgcatatcaggtatgatactgtttccggttttaaatttattttgaactgaacgctgcattttctttcttt

SEQ ID NO: 3805 - DNA, 994 bp, Diabrotica virgifera
  misc_feature (914)..(914): n is a, c, g, or t
  misc_feature (965)..(965): n is a, c, g, or t
ctacaaaacaacttgttcaatgttcaatctgttctgtttaggaatactttctaattatgtttgataatcttttgcgcggtattggcggtatcgacagtatgtgattcataagtcataataattatgtttatatcctaaaaataacattactattataaacaaaggttcattgtttagttttatttgtttgttgtacgtaacggtgacgcataaaacaagcgagatttgaagttttgggtgtgcaacaaaatttcgaagcaacagtaatcaggaaatcgcatatatcgaagaagttacgaaatttggcaactattacaacagacaatttgttattttcgactataatgcaacatcgaaatcattaatttgttgctgttcgtttagtacctagttgtttataaaaatgggtttgggaagaagaaatggtagtagctgttgtagaaaatggcttataggaacttgtttgtatatatttattttattactattaatatttttaatagtatttgtagtagtcccagtcgtttttaaatatagtgttggaatccaaagaagtataatatttccgtcatgggtaatcgacccgaaaaactattcaaacatcgaccaatttgggatcaaaggggtgaaaaacttctacgtgaacttgcaagaagatgacaactcgacgctgaataacgctgaaaacattaccttgggcgtgtggcaaattttacctcatgaaatgctaagtgaactcatagacaacaacgactacaattatgatggtgttttaagtaatggaaactacagtgttctgttgtacatgcacggaaatggacaagacagaactgattcagtcggaacgtatgaggtgttgaggaaatttttccatattttttcagtggattacagaaagtatggagattcaacanaaggtgagctaaccgaagctaacgtagtcgacgatatggtaaaattctacnaatgagtgcagctgcgcaccaactcaaaa

SEQ ID NO: 3806 - DNA, 959 bp, Diabrotica virgifera
gtcagtgtgaaggaaaattcctgctgtggcaaagattaactttttagttaagatatcaattgcagctggactttagttatatttttcggcaaataatttataacatcatcgttatagattaatttttcttttttattcgtactattttggtttttgttcacctaattagatacgatactgttgctggatgcagatgaaacgtggttgaagctggacccagtagagatttttagatattcgtaagctcatttagaatatcatatttaacagaaagattttaaatctctaaaagtcatcgtccataagggcgctaaaattttatatgactttggtaaaccatcaaaagacattattagcaagaagcatagttggggatttagggcccgagcaagcgaggtgtatgacttcgcagcgacgtgagcctacttattataggactataaaattttcatcgaataggcatcgaaaacttcaaccatttagagaaacgtgactggctattataatttcacgaaaaacaccaaagatcattaaaaccaatatcctttctcctacgatcttacaacatagctaacgcactacatccacaatgagtgtcaacgttaacagaggcgtcagcgatgtgttctatcgctacaaaatgccccggcttatggccaaagttgaaggtaaaggtaacggtataaaaacggtaattgtcaacatggccgaggtcgccaaagctctaggccgacctcccacttaccctactaaatacttcggctgtgagttgggtgctcaaactcaattcgactttaaaaatgaacgtttcattgtgaacggttcccatgacgcttctaaactgcaagatcttctagatgggttcatacgcaagtttgttttgtgtcccgaatgcgacaatccagaaaaccgatcttctagtttctgtgaagaaaaaacacatatcccaaggatgtaaa

SEQ ID NO: 3807 - DNA, 2541 bp, Diabrotica virgifera
  misc_feature (2528)..(2528): n is a, c, g, or t
cccaacataaccaaagtgctagagttcgaggattcgaaggggcaccaagcctacacagtgctcatggtgtccactttatacgggaatgttcgctacaagacattattagcaagaagcatagttggggatttagggcccgagcaagcgaggtgtatgacttcgcagcgacgtgagcctacttattataggactataaaattttcatcgaataggcatcgaaaacttcaaccatttagagaaacgtgactggctattataatttcacgaaaaacaccaaagatcattaaaaccaatatcctttctcctacgatcttacaacatagctaacgcactacatccacaatgagtgtcaacgttaacagaggcgtcagcgatgtgttctatcgctacaaaatgccccggcttatggccaaagttgaaggtaaaggtaacggtataaaaacggtaattgtcaacatggccgaggtcgccaaagctctaggccgacctcccacttaccctactaaatacttcggctgtgagttgggtgctcaaactcaattcgactttaaaaatgaacgtttcattgtgaacggttcccatgacgcttctaaactgcaagatcttctagatgggttcatacgcaagtttgttttgtgtcccgaatgcgacaatccagaaaccgatcttctagtttctgtgaagaaaaacacaatatcccagggatgtaaagcgtgcggctaccacggtttgttggaatccaaccataagttgatgaccttcatcttgaagaatccacccaactcgaatccagccagtcaaggatcgtcgctgactgaaggaaaacgatccaagcgcagcaaacgtaatggcgaagcgaatggcgaccaagaaaatgattcgacgctcgattcttctgctatggaaaattcaacagacaataacggtggcagcgatgatgaccaaactgaatgggccgtagatgtatccgaggaagctgtaaggcaaaggatgcaagatctcagtgatggtgccaaaaacatgaccatcagtgacgatcttgaaaaatccgagaaagaacgtatggacatcttgtacaacatggtaaaagtcaaacgcgataccggacttttgggaaacgtgcagactcaaaaagaagtcttgagcgaagctgaacgtttggagattaaaaccaaagctcctctcgttttggccgagttgctttttgatcagaacatcctcgcacaggctaagaaatatcgtatgctcttccttcgtttcactctgaacgagaaaaaagcacagaaatatctaattggtgggctagaacaggtcatcgccttacacaaagacaaacttatgagcaaagttcccggtttgctgaaaatcttttacgatatggacattcttggagaggagtgcatcatagaatggtcagaaaaagtgtccaaaaaatacgtagctaaggaagtaagccaagagattcacgacaaagcagaaccgttcataaaatggttgaaggaagccgaatcggaagattccgacaacgatgatgatgaagaagacgatgacgtggagattgaatacaatgacagggcacaaatccagctgaagattactccccaaagcaaacccaaaccggtggctagtaacgatgatgatgggcaagatgatgtggatatcgatgctatctaaacacttctcttattattagttaggccctttgttacgaacttttttattataattatcattatagtagtgtaccattaaacgtaatattccgtatgaaaaagaccatcactttttataatcttcatttttggacgactgaaattcctacgggacagaaaccgatttgttctttttttaataatcatcacacaggtcacaattttgtaacaatatatttatttggggcagcaatggctcaaacttacataaaatagagggtgtttcaattttacaatttcaagaatcaagaaagaaggtcaaaacatcgtggatttgctaaattccacctgtacctcgcatttccagcaacacgagacaccaaaaacatgacaggtgtcatctgtcatgttcttggcgctggattgcgagttttatctaacacacatacacacacacacacacaagaatcgataagtgttagaaaatattggaacaattaaatacttgcgaaatgacataaagcagggactttatttattaaaatcgatataactgtccaagtagagtaaatatttaacaaaacatttgaaaattccgccatgaagacgttttggaacaccccctataagtaaaagctgtacacggtaaagtttagtaaagacactccatcacataacctacattctaagaatgacagcgcgatgttgccattactcttagcttgtgtctaaactacacatttatcggtacttgtttatattttgtttaatccgatggtcctaactattataaagggctttagtataattttatatctatctatctatccattatgatttttataaatatgttaatgttggtgatcaggattgcanggtgagtgttgca

SEQ ID NO: 3808 - DNA, 900 bp, Diabrotica virgifera
  misc_feature (847)..(847): n is a, c, g, or t
ggggctgggggtgtgctgtgtttgtgtatgtctgtctctctgtgttaaaaaaagccatattcaaataccaaaccaatccagtaattttaattttatggaagcaaagcgaccaatgtttactgaacttattacgtacttaattaattattgataaagtataataacgtaattaattgttgataaagttcaaattagagataggtattaacctaaaacaagagatatgaataatgatgatttaccagatgatagcgattctagcgatgaagactatgtacccaatgaaaaggtagaggacttaccatcagaaattgacgaggatgattcgatatccgaatcagaagaaactagcggaaaatcttctagaaagaaaaagaaaagccgcaagaaaattgtaaaggataaagtcgataataaaaatgaagctatcgaggaaaccaaatctgaagaaacaaaagcgaatgttgatgatctatgggcagattttgttaaagatacaggttttaaaacaaaaggcagtattaaatcaactcaacctacatccttaaaaccgaaggaaaatattatcaaatcaagtagttcttcccaatcatctagtacagaatcaaagccagctaataaagttaaagtcacacaaatttttgaatttgctggagaagaagttaaggtggagaaagaagttagtgcagattcagccgaagctcgtttattaggaacaaatacagaacaaaatgtttctggtggtaaaagtaagagatctgctggactgggtggcataggtaatgttctgaatcagctcactaaaaagcctaaaattagtacattagaaaaaaccaaattagattgngatagctataaaagggaacacgatatcgaagaagaaatacagacttttaataa

SEQ ID NO: 3809 - DNA, 1411 bp, Diabrotica virgifera
aaacgtatcattgtagtgttgaaagtgctaagtgaacaacaaaatggccttaggtgggtgtcagttactaaggtttctaaataaagttaagcatattcattcaagatcggtgtcccaacattatccaattgatgaacacatttttggattatctgatgaccaaatacagctacgtgaaacaatttttaactttgcacaaaaagagttagctcctatagccaacgaaattgacaagaaaaataaatttgaaaacttaagaagtttttttaagaaactaggcaacttaggagctctaggtatcactgtaaatcctgaatatggaggtaccggtggaagttacactgatcacgtcattatcatggaagaactgagtagagcttctggagctataggtctttcttatggagctcattcgaatttgtgtgtaaatcaaatccatcgaaatggtagtgattatctaaaaaagaaatatctgccaaaattgtgttcgggtgaacatataggagctttagcgatgtcagaagctggttccggttccgatgtagtgtctatgaggttgaaagcagaaaagaaaggagaccattatatgttaaatggaaataagttttggataactaacggaccagacgcagatgtcttagtggtttatgcaaaaacagatgctaaatgtaagaaatcacaacatggaatatcagccttcgtaattgaaaaacattttaaaggttttaaagctggtccaaagttagataaattaggtatgcggggttcaaatacttctgagttaatatttgaagattgtgtagttcccaaagaaaacttgttaggttcggaaaataaaggagtgtatgtgcttatgagcggattagatttggaaagactggtcttagcaggtgggcctttaggtataatgcaagcttgttgtgatgttgctttttcttatgcacacgttaggaaacaattcaatcaacgtataggtgagtttcagttgttacaaggtaagctggctgatatgtacacaacattaagtgcttgcagaagctatttgtacaatgtagcgaaatcttgtgataaaaaaaaggtaaacagtaaagactgcgcaggtgttattttatactgcggtgaaaaagctactcaaatggccctagattcaatacaaattttaggtggcaatggattcattaatgattatccaactggaagatttctcagagatgccaaactttacgagattggagctggaacctcagaagttagaagactggttataggcagggtgattaattcagagtattcataaagaaatatctatttttcttgtaatatcctacatatttcagcatagaaaaaatttaataactctctatacattccttttttgttttgtttttaatttttgttttgtcagcagtct

SEQ ID NO: 3810 - DNA, 1311 bp, Diabrotica virgifera
cccacgcgtccgatcaacaacatggtccttatttttttgaaataaatgaataatatccattaacagaataaaaaaatggcaaaattaggatccttttatagtttatgtcctttaattgataacaaaggtattttagatgtatcaaatgatcgtgaagaaggcgttgtaattgtaacattaggaaaaaatattgctagcagatacaaagtatcaaaccaaaaacaaatcacatgttggcgtacgaaagaaaagtttagttctccagttttgtatgacaaacaaaaaaaccaatatgttgcagtttttaatcaaacccatatcaaattttggaatttagatgatagtttggataagttaaagaagtataagttcacgaagccaattcacactatattaaatgtaggaaaaaattatttgatattgtttcaaaatggttaccttcacgacctggatgatgcaatagaaaaccgaaaatctttaataccacccagtactgatgtgacacaaattgatcatgtcttatgtgaatcaatgaacgaacacatttatattggtttaataactggaaacaatttttattggacaatttacacgggagggtctccaaaatactccaaaatagagttaagcagagatggtttagatgtgaggggacgtatgttccatgcaatgggaaatgttctctacttgtttaccttgtggtcggacggcagtattttcgcaaaatcactagaaaacgagaactcttctgaaaacgacttgggcgagctatatacaatagtggattctgtatcttccaaacattttgtggcaatgatatctctagatgaaaattatataggcttatatggtgcaaatacaaacgaagaaggagctatgctagctatatataatctacagtttaaaagttacccaatctaaacaacctttttaattgtttactacaaatacttaaaattatggaaaggcaaggaaaaacaggtatatttggcttgcccggtggggggcaaaaatttggggcgcttggtacctttttccccctttggaaaaagaaacaattttggcaagtctttagggggaaaattataaaaaaaatttttttaaataatcttttctttgtaaatatttaaaaatattaaatcgaaaatgggtttataacccttctttgggaatggaaaaaaaaactataaaaaaattaatttttttctttttcataaatttaaaagaaaacaaaattttttgtacataaattgttttgtttatttcagaggttttttaattctgggaaaaaaaattatttattttcttttt

SEQ ID NO: 3811 - DNA, 1627 bp, Diabrotica virgifera
  misc_feature (1416)..(1416): n is a, c, g, or t
  misc_feature (1483)..(1483): n is a, c, g, or t
  misc_feature (1603)..(1603): n is a, c, g, or t
cttacagacacgccaacgctactgaagatgaaaagaaggaacaagaaaagaaattcaaggaagttggtgaggcgtacggtatactttcagatcccaaaaagaaagcaagatatgatagcggtcaagatatggatgatttcgacggaggtatgtcagatatagatcctactcaagtattccaaaccttcttcggaggaggtggaggaggccatcaccatggcggagctcaggagttctccttcggcaatttccctggctcgttcaccttccagttcggttaaaccatctgcaactcggacgtacctcgtacattccagtggttgtagagattttaattctctttttgtgttattgaattttcttttctctgattcgtgttagtatttattttaattttaaagttttttatggaaattttaagattttcaacagtaagggtgcaaagagttaagccagttaacccatcgaaggaagcgtgcgaaaaagtatacaacgttttaccatttaaagtgtggtactttatccgataaaaagtgtcccagttaatacgagtatatcctaacaaaagatgcgaaatagtgaagaggcaagttatcaaactcgtaaaacatagaatgtataaattggaaaggacaatttggaaaaataagtctgcattaaaacgatcattttttattgaaaacattttttttgtaaactttgtagttttttttgtcttctatgaattagaacttttgttgtaatattatatttttatcttatttttttcttatcttatttttatcttatttttatattatgtatttctttattttggaaatttttataattaaatgagagtataagcttccacgacaagagcctagtttcaataagtcgtctttcgataaatatatttatttgtattgtaaaatgtattgcctgttaatatttaataaatcgttacatatgcattcaatgtcctttgacattgtcccaacacgttgaacgtcgcgcgaatcatatatgattcacgcttattttacttacaaggctgcgcgaatcacaattgcttcgcagtgactgttataccgtcaggaccacgtctcagtcggcccagaaaatctttaatattatatacatttcggcgtttaacgtatcaaaatatattacggtatatggtattctttacttgagcgccttttctggttgatgcagtttttagcaaaaatgctacctttgaggactttgagggctagtttactttttgctattcgtatggatagaaatttgagaaaagggggaaggcgatttattgaatatctatcattcgtttgttttttggaatgtacttgaacttatattttcatgtattgaattttgtggtatagttttacttcaaacaacttttagtaatttagatcagaaaaagaatanaagtagagacaaatactgatgtcatattatcttttaaatgatcacaactgttctttatttaattacncatattggtacatggctttttagactgatttttttatctttcatatttcgtcactattataaattataaaaagttccgcaattgctatcttattacacagtaagaacccgaagtgatttngagcaagtatgctacttccacaca

SEQ ID NO: 3812 - DNA, 1161 bp, Diabrotica virgifera
aattctcatgttgatgctcagagaggtgcctgtgtgccacttctgaaaaatttaagctgtgatttggatagtgattctgaatttctagatttacatgaacgttgtctaacacccaagccatcgcaagtgcctgaggtccaagaaacaccagtaaaatcttcattgaaattggatgccgcctttctgggagacattccaggacagtacactatctgtgccgtcgaaccccatcaactgcccgttgttggggtttacatcgacccaagagtggtccctggttttaaataccgaatcagacctctcccagaagtcggccgtccttctaccactaataaatgcctgtttgataacaaggctttgactttgcagtcaattggtagaggatatgctagacgttttactttcgaagctgatgagaatcaattgaacaacaacgagaactatttctggagcgacaacaggcctgaaggttacgcttttgagctggagttgctgtctgaaggggacaagttcacgttcttcaatcccaatggtgaagctgaaggaacagtagaagtactttctatcgaggcccctcaaattgaaatttttagctctttagcaaaaggtgtcattgacaagaaagccacagtcgcatttacaggtaaagttgagtattatgagactggtgtggctaaacctgtgaatcttactggtactgtgttgtcacgtaaagtgaaaggcagatcttcagctgagatcgttaagatcaccaaagttagtatcaataagcacaggtgttatctgttacctggcatacaaaagaattcacagaagaatttactgttagaggaaaagatattaacgatggttccgacgaaatatactaaggactgggattgggaatcctttgaaattcccgttggtaggtacttacgttgattcaagaaatcattccctggtttctggctacaaagtcagaaccaaacgacaggaaagatcattctctttggaggaagagccttaaaactggcttagtattggtaggggtatggcaagagaattactttccaaccagattctctagtggaaccagataacaatctaagggtccgacaaccatcccgacggtctaggtttggaaccaagagcagtacacaagggtatgggaattcatcgtca

SEQ ID NO: 3813 - DNA, 3461 bp, Diabrotica virgifera
tgaacgttgtctaacacccaagccatcgcaagtgcctgaagtcgaagaaacaccagtaaaaccttcattgaaattggatgccgcctttctgggagacattccaggacagtacactatctgtgccgacgaaccccatgcgtccggcaacttcaagtggtgttcttgaaggagcgaaagaatgaagcaactactgtttgtcttagtttccgtagccatttacggcaccctagaagccgcaaactgtgcaagacccaacctcaaccgtgccaatgtctatatctacagttcaataggaaaagtcccagtcagagtcagcagatgcctcttcaacgacaccaaggacgcctactccgacatctcagacaactgtgtaaaagctttccaatccggaaccttcatcgacaaatggcaggataagaacatacttgctgagaaaggttctccaatcgtattggaagagtacgtttccaaggctgatttggtgaaaaacgaaatttctctgagaacaggcaagatttgcaggtacgatagaggtttctgttatgatccaactgaaaccaacacttatgctgtcgtttgggaaatcctcgacaagtccaaagttcaatgtcctaatcaactctttaaggtattccaaggagatgttgatttctgggaattcaagcaacaaggtctcaactatttgttccattacgatgcgcttgaggacaaagctttttacttgagcttagagaacagagcccaatgtcaagatacagatgtttggtacaccgaagaaggttacattgtgtccactaagccacttaaatctaaagatatggaatccaaaggattggctctgagaaccaaaggaggagttaaaggaggtgttaagggaggagccataaaagcaggagctagcgtaagtcatgattacttcactgtcagaaccaaaaaaattgtaagtgaaaacattttaaaacattgtgacatcaaatctctatcatttgaagaattgattgaagccgtcgattcagactacctacaaaacccccacaacttgcatcttattttggaacggtactacaaccttattatggacacaaaacaggaagttatcgaacttatctataaagaaagtacagtaaacattacaaaagaattaaaacaacaacttattattctgcaagagcttttagaaaaaactcgcgtggaggttactcaaatccaagaaactcttcttgctgctggcgatctcaaaggaataagaattgatgtagatactttggctaaacaaattgccttattattgaagacaaacgaacactacgatgaaatcattaaagaaatttatgaatctattaaaaagaacactgttttgatcaacgatcaaagtaaagaaattacaactctctatgagaaagtggaaaaaatccaacaaattataaacacacaactccctgaatttatcacaaaacaagaggtgtacgaaaagatcacacaaatagaacaagattttcatggaaagctcagagatttagccatgaatgtaaccatgcttattatggaaggtggtggcggcggctctggtggtgtgagaggagggccaaaagcaaaagaagaacttgaaggacttgttcttgagaaactaaaaactttcaaacttgatgaacttgaatcaaaaattgacaggctttcagaaaagattcaattagaattaaaccaatacagacatgaatcgtatagtaactcaactctcttagaggaaagaattttgaagaagcttgccgacttggaagctaaaaacaaaccaattttagacagattgaacaagtacgaagaacaaatcaacaatttgtttagcgaagtcagtgttattaaagaaactgctgaacactttaaagaatctgtagaaaaagtttttaaagaatttgactccaaacatgaaagtattttgaaaacttttgaagactatgacaaacttattaatcaagtaagaagtgacttaaaagtattgagtgagaaggaaattgactttactccagctattgaaaaagccaaacaattgctacaagaagcacttaggtcaagagacattcgtctagaaaccttagagactcttgctgttaagttgggagacagtgttgaaaagagcgaacacgagtttgataacgtagaaaatcaaattaagggcctccaggaatctttaagtcgtatcgacagagttaaagaagaaatttcagaagttattgatagaaaatcagctcaatgcgaaaagaatctttctgagttgaaggaaattgtagaacaaatatctgcaaaacgcgatcaaacagacaaagatcttcaagccagtaaagaagcttcaaaaacaaggatagacgaagtttacgaagaatgtaggtcttcaattgagcatattaatgccactttaggagaagacagacaattaattgaccaaatacaaagtgaagataccaggatcaacggtgttattgataatttaaggaaagaaatcggaggccacaaggattcgatttcaaaacttgaaagcctcataacagaaaagagttttgcgtgtgaagctaaaggcaagcaaaaccgtgagcttattgatgaattgaagaaaaaggtaactgaattgtacgagatcgttaaaaaacaagaggatctgattctcgaattaaagaaatcaactgaaaaagcttcctttactaaaggaggtactaagggtggtactaaaggtggtactaaagtaaaggaggatacggtcaacaatctcaaactagccaagacttcgattacgagagtgaatggaacaatggtcaaaagattgtctcacaacaaacatctgatgattgggaacaacaaaaccaacaattcggtggaagtgacagctacgttaaaactacaaagactgttgttcattcttcgatacctgaccacagccacattcacaaacaaaccacacataactcccattcccactcctcgatagaagagactgacgtcaacttgattatcgaaagacaagaaggtgaaatcactcacttaagaacagtccttgccaacgctcatgtcgctctggatgctcatgagcatagaattgatgacttagaacttaggattgatcaattattgcacaaacttgctcatgtacaaaaagatctagaaggtgatatccataccatggatatcagagttgatgaagtacacgaagaacttgtgcatttggagagtgacttaagaggttcaattgcaggatgctgccatcagaatcacggacagcttgttagtcatgccaacgtcaagacaacaaatagtagctactccggtaggaaacattaaaacctctaaactgaattcattgaaatatttttaatattttcactttaaaaaattattatttatttgttaaggttccgttctagtgatatttttatataaatgtataataaatcttgacgaaaaaaaaaaaagaa

SEQ ID NO: 3814 - DNA, 1118 bp, Diabrotica virgifera
cccacgcgtcccgcaagccgtaaaccgcaagttgagtttatttctgtaaagcgcttcgagctgaacagacgtgattattttagtgctaaaaattaactgtgattattttcgaatattttccaaagaatctttgaagcaactactctctaataactaaccgaaaatgctttcccaaaacatgcaagaagaagcaaaacttgacgctatgcaacgccactggcaaatactccgccgtggaccttcttcttcaacagccttttttgaagaagctaatgagactgaagatttattaactttaccattgcaaaattctcatgttgatgctcagagaggtgcctgtgtgccacttctgaaaaatttaagctgtgatttggatagtgattctgaatttctagatttacatgaacgttgtctaacacccaagccatcgcaagtgcctgaggtccaagaaacaccagtaaaaccttcattgaaattggatgccgcctttctgggagacattccaggacagtacactatctgtgccgtcgaaccccatcaactgcccgttgttggggtttacatcgacccaagagtggtccctggttttaaataccgaatcagacctctcccagaagtcggccgtccttctaccactaataaatgcctgtttgataacaaggctttgactttgcagtcaattggtagaggatatgctagacgttttactttcgaagctgatgagaatcaattgaacaacaacgagaactatttctggagcgacaacaggcctgaaggttacgcttttgagctggagttgctgtctgaaggggacaagttcacgttcttcaatcccaatggtgaagctgaaggaacagtagaagtactttctatcgaggtgagcctcttctttttataatacttattacatttattttttcgatcacctgttatgcataaatccggaaagatttttatcagaaccatggactaaaaaaacaagaaaagaggttcagcgaaaaacgacctccctaaaaacgccaaaaaacggggccccccaccctctaccacaaaaaattttttttaagccagcagtaccttttctccccatactcccctttcatggccccctcaaattg

SEQ ID NO: 3815 - DNA, 1678 bp, Diabrotica virgifera
aaagtgttttcatttacaagattatctcaatataaacgcattaactttttgataacttaaaatgacgtgctgccagcatttgaaaatgaatatgattccatcgtataggaaaatggaacgttgtctaacacccaagccatcgcaagtgcctgaggtccaagaaacaccagtaaaatcttcattgaaattggatgccgcctttctgggagacattccaggacagtacactatctgtgccgtcgaaccccatcaactaccagttgttggggtttacgtcgacccaagagtggtccctggttttaaataccgcatcagacctctcccagaagtcggccgtccttctaccactaataaatgcctgtttgataacaaggctttgactttgcagtcaattggtagaggatatgctagacgttttactttcgaagctgatgagaatcaattgaacaacaacgagaactatttctggagcgacaacaggcctgaaggttacgcttttgagctggagttgctgtctgaaggggacaagttcacgttcttcaatcccaatggtgaagctgaaggaacagtagaagtactttctatcgaggtgagcctcttctttttataatacttattacatttattttttcgatcacctgttatgcataaatctggaaagatttttatcagaaccatggactagaagaaaaagaagagcggttcagtgataaacgacctcccaaaacacgccaaaaacggtgcttcgtaagtctttataacgaaaaatttttttatagtcagtgttacctttacttattatactcactctttcaggcccctcaaattgaaatttttagctctttagcaaaaggtgtcattgacaagaaagccacagtcacatttacaggtaaagttgagtattatgagactggtgtggctaaacctgtgaatcttactggtactgtgttgtcacgtaaagtgaaaggcagatcttcagctgagatcgttaagatcaccaaagttagtatcaataagcacaggtgttatctgttacctggcatacaaaagattcacagaagatttactgttagaggaaaagatattaacgatgttccgacgaaatatactatgactggattggaatcctttgaaattcccgttgtaggtacttacgttgattcaagaatcatccctggtttctgctacaaagtcagaccaaacgacaggaaagatcatctctttggaggaagagccttaaaactgcttagtattggtatgggttatgccaagagacttactttccaaccagattctctagtggaaccagataactatctatggtccgacaaccatcccgaccgtctaggtttggaccaagagcagtacacaagggtatggaattcatcgtcaaagctggcgaaattgtcctaagcgaagctccagcttttaaagatgatcttcctcaatttgagcaacatatggaaaagaaaccgacctcctctgggggtagaaatccaaaaaaacttccacgttgacgttttctgccccatccgaactttgaagaaaaagtgggggctttcaataaaaaaccaacctccttcctctggaaatctcccggattaggggaagtttctaaaaaaaccccgggcctttcgaaccccccctttcccggggaaaaacaggggcgttttacacc

SEQ ID NO: 3816 - DNA, 2075 bp, Diabrotica virgifera
cccacgcgtccggtgattattttagtgctaaaaattaactgtgattattttcgaatattttccaaagaatctttgaagcaactactctctaataactaaccgaaaatgctttcccaaaacatgcaagaagaagcaaaacttgacgctatgcaacgccactggcaaatactccgccgtggaccttcttcttcaacagccttttttgaagaagctaatgagactgaagatttattaactttaccattgcaaaattctcatgttgatgctcagagaggtgcctgtgtgccacttctgaaaaatttaagctgtgatttggatagtgattctgaatttctagatttacatgaacgttgtctaacacccaagccatcgcaagtgcctgaggtccaagaaacaccagtacaaccttcattgaaattggatgccgcctttctgttatgcataaatccggaaagatttttatcagaaccatggactagaagatcaagaagagcggttcagtgataaacgacctcccaaaacacgccaaaaacggtgcttcgcccctcaaattgaaatttttagctctttagcaaaaggtgtcattgacaagaaagccacagtcgcatttacaggtaaagttgagtattatgagactggtgtggctaaacctgtgaatcttactggtactgtgttgtcacgtaaagtgaaaggcagatcttcagctgagatcgttaagatcaccaaagttagtatcaataagcacaggtgttatctgttacctggcatacaaaagattcacagaagatttactgttagaggaaaagatattaacgatgttccgacgaaatatactatgactggattggaatcctttgaaattcccgttgtaggtacttacgttgattcaagaatcatccctggtttctgctacaaagtcagaccaaacgacaggaaagatcatctctttggaggaagagccttaaaactgcttagtattggtatgggttatgccaagagacttactttccaaccagattctctagtggaaccagataactatctatggtccgacaaccatcccgacggtctaggtttggaaccaagagcagtacacaagggtatggaattcatcgtcaaagctggcgatattgtcctaggcgaagctcaagtctttagagatgatcttcctcaatttgagcaacatatggaaaagatacagactccatctggtgtagcaatccaaaaatacatccacgttgacgttttctgccacatccgacttgaagcaacagttggagcttcaatagaaaacgacctacatctcatgagaatctcaggattagcggtagttcgaaaagaaccgagggcatctgaagcccacgttatcagggtagaaaatgttggttttgactctcaattagcccttcttttcacgcagacctacatggaactgacattcgttcctaaacattattaaatgatcagtctatagagaaagcaataagaggtatatgctctaccacctaccttctaattgacacgactcttcctgtttatttcaaactggaagtagatgaatttctaattttacttaaaaatgatttgtcaatgatagtgatgtaagatagttatcgatctcagaatggagatatttaatttaacaatcaaagaaatagtcaccacaatctacttacatcactttttgaattcaatagtcaaatacatagcttttattactttacaagatttatacaatttgtcaccgcaaaaatgtagaggtaatatctcttatgcaatacttctctatatttgatgatctgtggtgttctagcgcaccatttgcttacagaagtctgcttgagctgatgtagcttgattttatgagtattgatttttttaggctattagtttaggttgtacttattttatttaatattaacttatgtaagctacttgattgttatacaattctttacacaaactatatgacatgtttacatattgtttttattgaatttgtttatatttttgttatattttaataataaaactttctgatataaaaaaaaaaaaaaaaaataaattttttaaaa

SEQ ID NO: 3817 - DNA, 1411 bp, Diabrotica virgifera
  misc_feature (1293)..(1293): n is a, c, g, or t
caatattaatagaggtcttctgtcgataggtcaagtaatgacagcattgtcaaacaattcaacatttattccttacagacagtctgtcataacgtcaatattgaaggactccttgaacaaaaacaacttcgtctcattaatcgcttgtgttagccccattgcagaagacactactgaaacagtacagaccttagaatttgcacaaagagtaaagaggattaagagtaaaccagaagttaatgaagtcatatcccaattcagaaaggaaaatcctcttctgttccaattgaaaatgaacaccccgtttaagagaccattatttatgaatactcctaaaccacctaaacaacaaaaattgtcaataataagtgaaccttcgtactcctcaattataacagaccagagtcacagtcctaaatcgttatcatcaagtgtggcatcttcaataacaaacactctaagatcatccctggactcagtttctgctccacaggctctaagtcctattattaggaaatatatgactgcaatggaatcttccttgatggataaaataggaagtgttattcaaagtactttaaagactgagtctagagaacaggttatggaaaaagagaatcctagaacaccaggactcacgtgggcattaatcaaaaatgaggtttcgaagattgttaagtcagaggtagctcagttaactggtaatgaagtaagagctacgagtagtcctcttggtgagcatctggatgatgtcagaaaaattttgaattacgacatcagtccactagctgaaccaggaactagtaccacagaatatgaatttaaagtacctgaattaccggcagaacagaagagtacctctttcgctttatccccaattgaaaacatcatgccgagacgaagtatgcgtctatccatgagaagaagatctagatgcagtataagtaataataataaaagtagtgtagttgatttagaagtgtcaattgagtcgtcactttcattcagagaggatataaagcttcttgaacaaactctaatagataacattgaaaattctgtagaatgcagcacatggaaaccaccagttgctcctaggagaagtatgaggatacgaaaagctgtcaatccgttacaaaataaactacagggaaagacgaaaatgcagttaaatgtcttgaatacccctgcaggaaaaagacttttgaagaccacacagaaggatagtcctcacacgtcacacaccaaaggcgttttacatactataaattatggaagtagtagagaaattgnaaaagtaccatctgtaggaacaaaaacagcacaacatatttccccttttcagggatatcaaaggtaaattaagcacgctttcccgatctaagcaaattcctggatggggaccgaaaaa

SEQ ID NO: 3818 - DNA, 1833 bp, Diabrotica virgifera
agtcactctaaataaaatcctataaccttttttgggatttcaattcgaattaaataaatttcttcagaaacatacaagaaacaaatacagacaatggctttacacgtccctaaagcaccgggctttgcccagatgttaaaagaaggagccaggcactattctggtttggaagaagctgttataagaaacataatagcatgcaaggaatttgcacaatccgtaaaaactgcctatggtccaaatggtatgaataaaatggtcattaatcacattgagaaacaatttgtcacaagtgatgcagctacaattatgcgagaactagatatagaacacccagcagccaaactcatgatactaggaagtcaaatgcaagattctgaggtgggtgatggaactaactttgtgattatacttgctggagcacttttggagcatgctgaagaactaattcgtcttggagtaactcccacagaaatagcagaaggttatgagaaagcactagacaaatgtctagaaatccttcctaatcttatttgctacacaatcaaggatttcagaaacatcgaagaagtcaaaaagggcatacaaacctcaattcaatctaagcagtatggcaatgaagagtttctatcaaaacttattgcagaagcttgtgtgtcaattttgccagaagaaacaacatttaatgttgataatgttagaatatgtaaagttttggggtctggtttacataactctcaggttgtacaaggtatggttttcaaaagacaagttgaaggggaaataactaaagcagaaaaagctaaaattgctgtattcagctgtgctgttgatattatgcaaacagaaactaaaggaactgtacttatcaaaactgcagatgaacttatgaactttagtaggggagaagaaaatcttcttgaattacaaatcaaatgtatagcagatgctggagctaaagttgtagttgcaggagccaaatttggagatatggctctacattacttacataaatatggcatgatggttgtcaggttgaactccaaatttgatttgagaagattatgcaaaactgttggtgctacttgtcttccacgcctaacagctcccacatctcaagaacttggttacgcagatattgtatgtgtagaagaattgggtgatacccctatagtttctttcagattggagggcaaagaatcaagaatttccacaattgtcatcagaggtgctactgacaattacatggatgacattgaaagagcaattgatgatggagttaatacatttaagggaatctctcgagatggcagatttgttcctggtgccggcgccgttgaagcagagttagctgttcagctgactaaatatgcagacactcttccaggcttagaaaagtatgctgtcagaaaattcgcatctgcccttgaaagttttcccaaaacgttggcagataatagtggacacaaatccacagcagtattagaaaaaatattggaagctcaccagaatggtcagaaaaatgttggagttgacatagaagctgaaagtgcagtatgtgacgctttggaaaagaacatcttggacctttatcaatgtaaatattggggactgaagtatgctgtaggagcagcagcaaccattttaagagtcgaccaaattattatggcgaaaagggcaggtgggccaaaagttaggcaaccaaagggaagtgatgacgaatcttgaaatcgttaattttgcgcttggtttctcgtatacacttaaattcaccttacaactcacttgtattaatctgttaatttaattttttaattaatatttcttaactaa

SEQ ID NO: 3819 - DNA, 955 bp, Diabrotica virgifera
aggaactaaaacacgtatgggtagaatggagaaaggcccttagcaagtgcaaagcagattatattccccacgcgtccctatctaaccaggcagctaaattaaacaactttactgataatgcagaactgtggctcttaaactacgaagacgatactttcaaagaccaagtacaagctttatgggagcaagtgaagcctttatacctagaacttcacgcctatgtgaggttcaagctaagacaaaaatacggagatgttgtcccggagaaaggacctattcctgctcatttgttaggaaatatgtgggcacaaacatggaacaatattgcaagcttcacattaccatatccagatgttgttgattatgatataactgcagaaatgttgaaacagaacttcacagcgaagaagatatttgaaacggccgaaagttttttcaagtccatcaatttaacagctatgcccgatctgttctggcagagatcaatcatagagaagccgaaggatagggaaatcgtttgtcatgcctcagcctgggacttctacgatggaaaggacttcaggatcaaaatgtgtactgacgttaattatgaggatatgaacacagctcaccacgaaatgggacacatagagtactttttacagtaccgcaatcagcctactccataccggactggagctaatgatggattccccgaagctgttggagacctgatttctttatcattcagttccaccaaacatttgcggaaaattggactaataacatttcaaaagctgataacaatgaacagcttctccaaaaacttatacaaaattggttttgaaaaaatcccattcttgccatttggatacttgatcgacttgtggggatggggattatatctttgcaggaaaaactactcctgaaaactaccaccttgaaaagggggggggcaactaggaaaaaaacaccc

SEQ ID NO: 3820 - DNA, 772 bp, Diabrotica virgifera
cggacgcgtgggttttcgtataagtactacaatagcagtgctataatgaaattttgtattatttcaatcctattatgtgttgctctctcaaatgctgaatatgcattagagaagagaagtgctcattacagacttataagagatatatctagttcaaaccgaaatcgatttcttgtaaattcccgctcggatataatagaaaattgcaagcgaaatggaataacagcagaagccagaactaaacttgaggaagcgtttgatgaggtcgaatcgtgtgcaggtaaaaaaaatatatatgctgtaccagaagctgaatttacacaaaacattaatgactgcagcaaagaagtggttagacttagtaaagcctgcttaaaggagagccagagctattttccagatttgcttatatcaatgagaaattcagtgacacattttttgtatgccaacaaagatgttttaagatctgacgaggtacaacaatgttacaaaaaagtggagtcaagtagagctgttagtaaatataggcaatgtgttgaagcagctgcagtaggtgtagacaaagtcgagctgcctcatagtaaagctgaagcatgtcgggttctcgtcggggtttctaaatgttttccaaagctgtttactgaccaatgtgacgcgtctgccaacttagataaattcttgaaaatttacgatgaatcaatttctggtccatgcgcggcttaaaatctaaattgtttattattatactaactaaataaaggaattactgagc

SEQ ID NO: 3821 - DNA, 892 bp, Diabrotica virgifera
cacacgcgtccgattttttgaaaggaggtatcagcatctgtttcgtccagatcctcattaaaatacatataaaaatggcttttggagatttaaaaacagaaaagggagttaaggagctcaactccttcctagaagacaaaagctatgttggaggctatatcttaagccaagccgatgtaaacgctttcaatcagcttccaaaagctccagctgccaatttaccccatgctttacgttggtacaatcacatcaaatctttctcagctgatgagcttaaacaggccggagtctcaggtaaccccttgaaatctgctcctaccaccacagcacctgccaaggatgatgacgatgatgatgttgatctatttgcctccgacgaagaagaagatgctgaagcagctaaagtacgtgaagaaagacttaaagcctatgcagaaaagaaatccaagaaacctgaattaattgccaaatctagcattgtacttgacgtaaaaccatgggatgatgagactgacatgaaagaattagaaaaagtaaccagaacaattgaaatggatggtctcatctggggagcatcaaaactcatgccagtaggatatggtatcaacaaactgcaaattatgtgtgttgttgaagatgccaaagtatctattgatgaattagtggagaagattcaagaattcgaagactacgttcaatctgtagatattgctgcgttcaacaaaatttaaacaactggtactatatttcttatgtatttttatgaattaaagcaatcattttaaatttaaaaaaaaaacaaaggcgggcgcgcacgcgtccgctagatctagatcgcgattaccccgggaatgggaaagggaaaagctttttctaaaagaggggcacccgt

SEQ ID NO: 3822 - DNA, 971 bp, Diabrotica virgifera
gatagagcaaagagcaaagatggtattcgacgttcaaggaagaagtgccgttatcactggaggagctcaaggtatcggtcttagtatagcagtggagttacttaaaagtggattaaagggagttgttttagcagacatagaaagccagcttggaaatgaagcaatcactaaattgtcgaatcaatttggaagtaacaaagcagtattcctaaaaacagatgtaacaaaagccgatcaactagaagctgcctttaaactagcagtatcgacatttggagcagttgatatagtagtcaacaatgccggtatgctcaaagattctcaatgggagctagaaattgcagttaattgtaacgccgttgtccaaggatcattactgggaatcaaatatatgggaaaaaataatggacacaaaggaggagtcatagtaaatgttgcatcgatttatggttttcaagaagtggaagctgctccggtatacggtgccaccaaacactttgttgttggtttgaacaaatgctttggtgcaaaatactattacgatctgacaggtattaaatttctaactatgtgtcctggaataactgatacaacactagtgaacgaatcagcaggatttactttccaaggatttcccaatttgggaaaaatgttaagcgaaggtttagcatcaatgccccaacaaacgccagaatatgttggacaggggacggtgactgccattaccaaaggagagcatggtagcatttgggtctcagaaggaaaggaacctgcctacgaactcgacgttcctgatcggaggacaatgagaaagcattaattgatatttaggacatacatatactaccaaaaacgtgattctacatttattctattgttgtaaatagttaataaacaatatagttctttaccacaacgcgcgggggctccccacattgactacacccccccccccccatgtatcccccctt

SEQ ID NO: 3823 - DNA, 992 bp, Diabrotica virgifera
cttagtcagcaataagatgggagtctctattctcctttttttagtaactgtaacatttatctgcgtaaattcacaactgcaacagtaccaatacgcattgccagattattcccttcaaaatgtggaacctaattacaatcagcttttacaacaacaagttccttactaccttcaggcacctcaggaacagacttattatccggtgagccaacaacagccagtttatccaactaatggcttatccaatgtttatccaactaatggccaaggagtatattatccatatccttatcaatatgcagttcctgatcaaccacaatttacttcagaacaattacaacaaattgcattacaacagttaccacaatctctggttttacctcagcaaatagggaatgcaaaaaataacactgaaccacagcctgtggccgtaaagacagaacaacctaattcatttgccaatgttaaaacggaaatcattgatcttaatcctcaagattttagaagagtgatgcaacgactaaatgctagacccataattgtatcgtatgaaagacgtgtggtaggaagtggatcaggacgtcctcattataccgtgacgacaaattctaagcagaccaatgaaactgacgtcccaaagtcgatcgaaacttacaaaacgacatccaaggtatactcatttaataaaacttttgttttacatcctaccgatggtcaaaaggttgtcaacttacattttgtaaacggggagcaagtttctgatagtcccgaatcagatgaatctgagactactactatagggaccacagaagccccaactactactacagaaagtgaaaatccggatctattaataagtggttttagatactctcttttaaccagtataaaacagtcttgataacaaatgtactaaataaatacttcttatatttatgatcgaaactattgtacacaatttaaaaatataataaatgaaatgtttttggttt

SEQ ID NO: 3824 - DNA, 994 bp, Diabrotica virgifera
  misc_feature (829)..(829): n is a, c, g, or t
  misc_feature (963)..(964): n is a, c, g, or t
attccttagtcagcaacaagatgggagtctctattctcctttttttagtaactataacatttatctgcgtaaattcacaactgcaacagtaccaatacgcattgccagattattcccttcaaaatgtagaacctaattacaatcagcttttacaacaacaagttccttactaccttcaagcaccccaggaacagacttattatccggtgagccaacaacagccagtttatccaactaatggcttatccaatgtttatccaactaatggccaaggagtatattatccatatccttatcaatatgcagttcctgatcaaccacaatttactccagaacaattacaacaaattgcattacaacagttaccacaatctctggttttacctcagcaaatagggaatgcaaaaaataacactgaaccacagcctgtggccgtaaagacagaacaacctaattcatttgccaatgttaaaacggaaatcattgatcttaatcctcaagattttagaagagtgatgcaacgactaaatgctagacccataattgtatcgtatgaaagacgtgtggtaggaagtggatcaggacgtcctcattataccgtgacgacaaattctaagcagaccaatgaaactgacgtcccaaagtcgatcgaaacttacaaaacgacatccaagattaacaatacaacaccagctccacaacaaaaatttggaaaaacgatttatggacgtacctggaggatgtcaagaggggatgcaattttctgctacaggaggatgttttgagtccttcaaactggctgtgaccgaaccgaactataatatttctnaatctacaaaagttcctagccacaccactcgttcctccgggagaaatttaacaagagtttccctaaggcaccactaggattcgagtatggatctaccgtagtcagtctttttgaacgccagaattcattatttnnatatctcactaactttttttcaaactgaac

SEQ ID NO: 3825 - DNA, 989 bp, Diabrotica virgifera
ctttccagttccacattagactagttctagatcgcttgcaactcaaactaaaaaactttattctcaacttatttattagatgtcaaaaaaaataaaacaaggtaagatattaatttatatgatgccaatcttgttggcaacatctagagcatcataatctctagctaaccttacatatgccttctttttgccatcgggcctaattaaggtgttgaccttggctacattgatatcatacaatttcttaactgcagctttaatgtggtgcttgtttgccctagtgtgtactaaaaataccaacgtgttgttatcttcaatcttcttcatggctgcttcggtggtcaatgggaatttgatgatattgtaagcatccatgcgggatctgtggggaacactcctcttggggtatttgggactcctgggtggtctgagggtcttaggacgacggaagtggactgagttacggattttccttgagtgtgttccattggggcctttaattactttcttttggattttaagtgctctcgctacttgcactgcactggcagctggctttttgccaacacctttctgttgttgtttaacaggaacattcttcttgggcttagcaataagagttgcgggagccttggcctttccagcagcagctggtttctttcctgcagccttggctgcgggtttggcagcacctttgcctgcagcctttccagctttagcagcagcggcttttggtttgggggcagcagcttgcgctttcgcggagcttttggctgaggcagctttaggtgcgggtgcaggggtttttgaggaagatgctttcttgtcagctggtttgcttgcagctttggctgctgcttttggagctggggcgggtgtttttgaacttgaggaagaagctccagcggctccggctgctggtattaagatctagctttttattaggagtttggaaaacactttttcgatttttcatgcttgctatatat

SEQ ID NO: 3826 - DNA, 1016 bp, Diabrotica virgifera
catgatataacataagtatgtagaaattttttgtaatttgtggtttagtatttgttatttattttttattaaattcaattattttattaaagaatactgaaacatgaaattataatagagttatgttttttaaggataagaacttcaaatagacaaacaattataggtatttaaaaattcaaattgtagtgttttacatgatatagcatttttttctgtcttaaaattcaaattatagacaacatgagtggagaccataaagttattcgtgttggttcacgaaaaagtgagctagctcttatccaaaccagacatgttatttccttacttaaagactgttttcctgacaaagaatttgaaatagttactatgagcacactaggtgacaaagtactagatattgcattaccaaaaataggcgagaagtctctctttacaaaagaactggaaacagcattagcgacagactgtgtagattttgttgtacattccttaaaggatcttccaacttgtttgccattaggtatggctattggtgctgtattaacaagagaagatcccagagatgctttagttcttcgtaaaggtttaactggtctttctctagaaacattaccagaaaatagtattataggcacatctagcttaagaagaactgctcaattagcaaaaaagtatccccatctgatagtagaaaacataagagggaatcttaatactagactaaaaaagttagatgacttggagcattatcaagctataatattagctgctgctggactcaaacggataggttgggaagagagaatatcaaaaattttaatagaagatgacttactgtatgcagttggccaaggagcactagctgtagagtgtagagctgataatgaagaaatcattaacctacttcaaccactgtatgacttagaaacagcattacaagttgcagcagaaagggagtttttaaaaaccctaggtggcggatgtagtgctcctgtagctgtgggctcaaacct

SEQ ID NO: 3827 - DNA, 1544 bp, Diabrotica virgifera
  misc_feature (1453)..(1453): n is a, c, g, or t
  misc_feature (1497)..(1497): n is a, c, g, or t
aaaaataattccttaactagtatttatcaagaattattgataaattactttaaatttgaatattacctaattgatacacgtgataataattattattcatgaagtatttgtcattgtcatttgtcaatgtcactggtcatttgtcattgtcacttgtcatttgtcttgtaatttgtcattgtctttgtcattgtcatgagtgtcatctgtcagatgattaatacatcgcggtagacataaattcgccggactctaatgtgcgttacatgattgtaaaatagccgttcttgtaaaattgagggttggcatggggtaatggtatagttattgttaaatattaatggataaaaaatgtttctttattacaaaataaatactgtacatttttatttattagattctcactactggtgaaaagtttaattagtttctaacacattttttgtttacatattttatttctgttggttataatcctaaaaatttaattgttagtttcagagctatctcacgatacataggaccttaagtatggtaatattcaccaacaaaacattattttatttagtaataatcacagtatctattaattctattcacgtatataaaatcagctccatgctcagttaaaatgagcattttgaatatgcatagaccgatatcaaaaatattttttttaatttgtcagtaaatgtctcaaattttagaaactcttcagctaaaatctaatttttgttataatgtaaagtcgaagaagaaaaaagaaaacaaaaaattgtctatttgatgcaacgtactttttttttaattttgttggtatatttaaaatctatatctaatcaaactagcactgccttttatcttattgtgaatatatcgatatacatagaatataaggagtattcttaaagtacctacatatattttaaactaagattttaaattataatcaacttctaaatgatacttaaaccatactttatttacagcatgacaaggaaaaacgtgcttaaacaattacatttgaatacattatgatcctcgctttcatagccagtagtttactcaattttatcctgcatttcactaaatcatcatcatcatctcccgtagataattccattgcatcccatattgagcaccctcaatcaagttgtcctggatgtctgatgtcgtccgactactttgttggagtggaggacgtcctcgattacggtaagcatcgtgtctaggtctcctttctaaaatgttctttgtccatcttccatttttgaatctagcaacatgtttcactaaatatgtgacatcaaatacactcattatatcgatatatttaaaaattttaaacaactggttcgtacaatccaaattctggggattgtgtactcaagtgactgaaagaatagtacaaagtacacccaagtcgtgagttagcttttagactatttaattntgtaatatttttgttggcactgctcgcaaagtaagtatttatangtatagaatcctaactgtatattttgtattttactctaggttttttt

SEQ ID NO: 3828 - DNA, 1430 bp, Diabrotica virgifera
cgcttgtgcatatgcaggcggtttgccaacgtcgacgccgcgatttacccaaaaaactcaaccgccgcgattcaagttagcatagaatagaaacaaatgcaaccgttcatcatcgtaatatgatgatacacgacacgcaaccgcgagtttaccaactagcgcagcgtttaaactggtaaattgcggcgtttacgttggcaaactgctctatctgaacaagcccttagtataagagtagcataatgaacctggttcacatagtgagtgtatagattactgtatagatagtgtgatgtgatttagttttagggttttagcgtctaatagcaatcggaagaagtggtagtagtaacgaattagtaggtttcactcagtaataattttaactctagtgaattagactatataaaattatgaagattcttggaaaaattctcgtaattttatttataggatacagtaacacgcagaataatgattttaacagatttgacacgcagggtatagattttgcgaatttggataggagaatcaatggtatagaggagaacccaccaaacacacagggattaaattttaagccctatgaatcatttgatattaagcaatttgataattcagtaacgtttgatggtcgccgtttttgggaggacgtaccaacagatcccgatgcatatttggcatatcttcaccgtgaatgtgacaagtctgggcatcctgagatattaaatatggataacgaagtatatcgtcaagctaaagtttgcctcggcagcagagcggattacataaaaacgaccgtgagacaattttttaatgagtctggactcagtgctattcgccaaattgattataaagaagcctgtaaagtttggcccgaagttcataactgcattaaccctcttgtgagttccattaaacaatgtttgaaaagcgatgtacaaaaaatttttgatacattccttgaattcatcgacgtgtcccaaagtttcttctgcgacaacaatgcggaccgtatatcgagtttagtcagcgatggctctgtacaatgtttcagcttagtagataaagatcttaaagaatgtcaaactaactttaagaagaaactaggagactcaataaacgctattaatatatggggggacgtcgattcgtataaggttatgactgggaagaacttagcggacgagacttgtagcacattcaagtcttaccgtaactgcatcacctcaaaactagctaaatgcaaatctaaatatacttccaaaaattgcagatgactatttagcactggttcaagacgagctcaaattctgcgggtcgccacgatggtttccaagtactaatgctatgatatttctaggacttggtgaagtactattaattggatccatttttagggttttagggaattaggggctagaattggt

SEQ ID NO: 3829 - DNA, 858 bp, Diabrotica virgifera
  misc_feature (774)..(774): n is a, c, g, or t
  misc_feature (779)..(781): n is a, c, g, or t
  misc_feature (829)..(829): n is a, c, g, or t
gaaaaattttgatttttttgaattttttagcaggtggccagtgattgatgattttgaaatatttattgaacaatagccgaaatgaagcaaacaataaaaatatcccaaactattatagatagattaggacgtacccctaacagctgtgatggtaatttgtatggaatttcccatcaaaatgatttgtttatcctggttttacaggcagattcagaaaacgaaattgatttctctagtttccttcccacaggaattgaattgtgcggccgttttcaaaaagccgagattaccgacttaaatatacaaattccagctcaatcagtattagttacaagtagtattggcaaagaaaataacgtgaatctttaccaagaacaaaatggaaagctcaataaatctgaatatcaaatcatcactgaacaggagattaatagcacatttttatttattagactgaaaggtgaggttgtcctaaaatctgaatttaccgtgcaagcattgaaggatgccttccaaataattaagaaatcactaccgttggatagtgtttttggtcttttaaaaagcaatttatttctccaagaacatggcacaataaatgctgagtctaatagtgctattaatgaattttacgaggatgtaaacggtgcaaatgatgaaggcagtagaaaaaagaataaagttgttagtataaagccaagagttttagattttaattatcttcaacagttaacaagagataaatcaattgatagtataaaagaacatgctccnattgnnngatctaacaaaaatcccttgaccattattgatacactgttaccactanattgtatttctatggttcatgaacaaact

SEQ ID NO: 3830 - DNA, 1648 bp, Diabrotica virgifera
  misc_feature (1552)..(1552): n is a, c, g, or t
  misc_feature (1587)..(1587): n is a, c, g, or t
  misc_feature (1629)..(1629): n is a, c, g, or t
  misc_feature (1646)..(1646): n is a, c, g, or t
aaccaaatcttatacgcaccttttatccgccgacatcaatttggttaatcatcgctaaaactacaccactgcttgactcattcatagtccaaggttgccgtgttctactcgataaaaattaaattttgattatctgagtgttcaattgtgatgatttttaattgaactttcgtagttattactgttttgtaagatgtcaggaccaatagtgaccgtaaaagaaggtaaactgttgggaattcaagaaaaggatgatgacggaaaccagtattacagttttcttggaataccatatgccaaaccgccaataggagagctgagattcaaagctccacaaccccctgaaaaatgggaaggaattcgagacgccacccaagaaggagacgagtgcttttccaaacaatttcaagcgtatacgggatcagaagattgtcttatcctgaatgtttttactaaagagatttcaagttccaaattgaggcctgtaatgttttggatacatgggggtggcttcacgaaaggctcaaatacactgaaattatatggtcctgactatctattaagagaagacatagtattagttacaattaactatcgtttaggtcctttaggattcatggcattcaaagatccagatgtaggtgtaccaggtaacgcaggtttcaaagacgctgtaatggctttacgatgggtccaaaataatattaaacaattctctggagatccaaataatgtgacaatatttggtgagagtgctggagcagttgctgttcatctgttggtactttcgccaatggccaaaggtttatttcacaaagccatactccaaagtggatgcgccacgagctgttggggaacaatgaaccggatagaacccaatttatttgctgaaagagctggaattcactctaatgacgacaatgtaatactcaaacacctccaaaatatgacactggaagagctggaggcaacaatggaaaagacaccggagttatatcccgttggaacattattccctaatggtccagtagttgaaaccaactccaaagaaccagctttcttacccagtgatccacgtgatattgtaaaatccggaaattataacaaagtacctatgatgatgggatgtgtgtccagagaaggaatgttcatttacagcatcgttgctcaggaaaatctagtgttagtacacgaaacgttgttacccaggacgttgaatttgaggataggaagtaatttgcatactcaggcagctaacaaagttaagaagttttattttggtgacaatgatcctcttgaagatagagataaaatatataaggagtttcgcatgcagacgattgtggttatctcttcaaaactcatttcgtaacagagatagaaaaagacagtcctgaagacaaagcgattcgaagaactgtaagactgtggacgaattttgctaaatttggaaaaccgactgttaataaagacgatcaaattcttcctgtggattggcttcctatttctaaagacaaatttcgagtatatgatatagggagaaagaaagtanattacacgatagtcatcccgagactagagctatgncaattttgggatgaaatgcatacaataaatcccttttagttncaaattgtaacgataanat

SEQ ID NO: 3831 - DNA, 819 bp, Diabrotica virgifera
acgacaaaatccactaaacatgttgcggctttctttcttgtttgtagctctcttgatcctttcagctgagcttgattcagctgttctgaaagatgattttgactacatcccagataggccgcaagatcccaaagaggtcacatctagctcttcggtggatccccttagtcctgaaaatggtgaaattgacattctcgaaggaaatttgacggattttaacggcactggaaaggatttgtttgtgataaaaacggttgtttatgaaattggaattttgacggatgttggaaatgatactaacttcgacaatgaaacccatgaacaaatcgacgtgtcatttttcgacccaacccacaacggctccatcatagacctatcccaaatcccaataccgattcaaaccaacgtcagtggagtctctatcactggattactaccagccaacttcggcgacttgaatttacttaaaaatggtactcccacagtgcagggatcccactttcctttgttcccgaacaaacaagtcagagtaactcataatgtgagcacatctgacagggatagaaccaacgacgtcttgtctggcttaccggaattgttgggcttgaaagacttcataaaatacgattcttcgtctgaagaatcgaaggaccaaagtagcggagaaagtaaagatagtggcgaatctaaagaaaagaaacataagaaatacaaggaatcaagtgattcaagtgagtcaaatgaatcaaaggaagatgacaaagagaaaaaacattaattctttaatttattttaatttgtataaataatatattacac

SEQ ID NO: 3832 - DNA, 872 bp, Diabrotica virgifera
aacaaaatccaccaaacatgttgcggctttctttcttgtttgtagctctcttgatcttttcaacagtgcttgatgcagctgttctgaaagacgattttgactacatcccggataggccgcaagatccaaaagggccgcaagatccaaaagaggtcacatctagctcttcggtggatcccctaagtcctgaaaatggtgaaattgacattctcgaaggaaatttgacggattttaacggcaccggaaaggatttgtttgtgataaaaacggttgtttatgaaattggaattttgacggatattggaaatgatactaacttcgacaatgaaacccatgaacaaatcgatgtttcatttttcgacccagcccacaacggctccatcatagacctatcccaaatcccaataccgattcaaaccaacgtcagtggagtctctatcaccggattactcccagccaacttcggcgacttgaatttacttaaaaatggcactcctacagtgcaaggatcacactttcctctgttcccgaacaaacaagtaagagttacccataatgtgagcacatctgacagagatagaacgaacgatgtcttgtctggtttgccggaattgttgggcttgaaagacttcataaaatacgattcttcctctgaagaatcgaaggaccaaagtagcggagaaagtaaagatagtggcgaatctaaagaaaagagacataagaaacacaaggaatcaaatgattcaagtgagtcaaaagaatcaaaggaagatgacaaagagaaaaaacattgattctttaatttattttaatttgtataaataatatattaaacaaaaaaaaaaaaaagggggggcggtttaaaagattcc

SEQ ID NO: 3833 - DNA, 467 bp, Diabrotica virgifera
agatattcttcggctgtaattccagtgtacttggctaaacgattctaaaaggaacagacctacgacttaaatattttgtgttggtgtcgtgtgacgttacctactatgacgcgcaacggtatttatactgtacgaaccataagatgccacaaggaaatagcttgagaacagtatacttacatgcaatagaaaattaagataatttagttatcataagaaaatgcaagacacttgaaaaagacgaaaatcataatttgtcataattcttgaatccgtattagacagacagtttatttttatgtagctcctactaaccaggttaagctactcaaaagctctcagttccaagttcctttctcttttttcttttgctttagtatctatacggtgtattccacgaatataggactgttttgggttgtcgcgacagcgaatattttagtgtgcaacataagaagtacgaaagt

SEQ ID NO: 3834 - DNA, 886 bp, Diabrotica virgifera
attatatgattgtatcaccttgactccttagtctcttttcctaaggagtatttagacgacttacgacgtttaaagtggatcagttgttgtggaaacaagaagccgaactgtagcaaaatgttcaaaatcgctctatgtgccgccatcttggcgatagcctatgccgaggatggtatcgtctatctaatggatcctactggaaagagcggagtcactggcaccgttagattcttaaaactaccaagtggcattaatgtcataggtgacatccgcggcctgacaccaggaaaacacggattccacattcaccaagaaggcaatatccaacctagttgtttagctgctggtggccatttcaacccattcaacaaacaacacggtggtccagatgatgctgaccgccacgttggagatcttggaaatattgaagctgaccaaaatggtgttgcagtattcgatttcctcgataataagatttcctttgacggaccaaccaatatgattggtagatccgttgtcgtccacgaaaaagtagatgatttaggaaaaggaggacatccagattcgctcaaaactggaaatgcaggaggaagactggcatgcggtgtagttggagttgtaaccgttaaatagattcgttttttgtttttccatattttttttttcgttttgtttagtttagtttatatgtgtattaaaatattgtgttaggtacatgtctttattttttaaatatattgtctaaatttactatattcgcttaatcaaccagtgatggatgaagctttagacgtctcgaagagtacactattgggaaataagaatgaaataaatatcattatgatcatataaaaaaacttgatacggtagtgatttcagtcaaaat

SEQ ID NO: 3835 - DNA, 1024 bp, Diabrotica virgifera
cgcgagcggccgctcgcgatctagaactagtctttttcattcaattctttattatgtagatatttttacagatataaaccttcgattacaaacaggtgctctgttgataagtacagtttggtattgaaattgacacagaaggccatcagctttaaccagatctccatccaaatcctgcttcatatcatatcaacatttcaacagaaataatcagctaaaaagtctatctaacatcgattaaatcttaggactagtttataaatctaaagacttaaaacctgcccacgaagaaagtcaccggtacaaaataaatacagtacattcagtaaatttgcgccctgaacaaaacgtatacaaacgtacagataagggtacatcattggtaggtaatctatgaaaagtaccgagttgtttacagatacacttggtgatagaacgacatgctctttttccatatggcgatataggccttttcatcagacatttttttcgtactctttactataaacaagcatgttaggttaggttgctgacaagtaatgaatgatacctaacctctcaattcttgattaaaacagtacgacaaacatagcagatgcgcactcgctcctcacatgatgaaaaggcctattgtctactgctgtcagtactatctgtcatctgtactatcctacttgacacgtatacgcacagaataagcctaaaagcagataggagtagcttttaaacaggcaattaacggttgtgattagatgtgatctttttcaatatattttcaacgcttctcatttgtttatctactgtcagtaccgtctatcacaagtcatacgtcacttaactttaaccacgaagaataatcttaaacgtagcgtttaaataagcaacttagtatacatgttcattttaaattgaaagtaaatgttttcaaattaaaaatacgctaataatatcgagatagcaatctctgcattctctgaagaaccactaaaaagtggtgaagtcgtcgataagagtgctggttgcg

SEQ ID NO: 3836 - DNA, 1286 bp, Diabrotica virgifera
agttaatagtaagtttagctcataatggaagatccactctcttttggttttaagcagttaaaagtatcagttttaaataaattagatcatattaattcctctacaaatggatatgttccaactgaaaagccttctagaaaaaatcaagtggggattcctgtcccaaaggataatttaaaaaagagtagtcctcaatcaaatcagtcagaaattcagtttcaaagtttaatggatgtttttgaacacaacagaaggcaagaagtaataaacaaggtacaagcccgtttaaagaaatttgaggactttacagtacaacaagagttaaataaaaaagaacagtggtttaaaaaacaacaagaattcattgaagatttacaacaacaagaaaataatataaatcaagctcttcaagaatatgataagaactcttcccattcgcaagcacaattggctttatactacaaagatttagaattaaaaaggcaggtacaagaaaatgaaattaagagacgagaatatgaaaaacaactcctctataagtgcatagataaaattaagaaattacaaccagaattttcgagtctttacgagaagatcttaaaaacgataaaacgatgtcagaaaatagaagatctgaaggctcagcacgcagaagattttcagttactaaactccttgccatctagcttcgatgtaataattaaaagttgtaaaaatgcaaaagtaacagatgatgatgtcaaaaatgctcaagatatgtttatacaattacaaaatatagaaagaaaaataaatgaaacagtggatagtatcaacaaaactcatgaacatgaaagtattccaaaaccaactccttttgccagttgaatctaaagcacttgttacaaacccctaaacctgttgccaaaaatcagtctgccccaagtatagaaaaatatataaccttggacaattttaaaatatattcccaatggtgggatttttttgacaaaaatacgaaaaagattagaaatttaaaaaaaggatagtcttcaaaaaaagttttggagggttggcaaaaacttttcaattttcccgaaatttcttggttggggggaaacgctggaaatggggtaaaaaaaatttaaaaaattttttaggggtggtaaaggggggggaaaaaaattttttctattaaaaaaaaaataaagggtttccttttccccctggggggggctctcgtttttttatataattttattttagaaaaaaaaaatattgttcctttttaaatgggatatctaaaa

SEQ ID NO: 3837 - DNA, 2413 bp, Diabrotica virgifera
gcgagcggtcgccctttttttttttttttcatttctaattttttatttaaatttattatgtagaaaatatatttatattattaataaatattaaggttgtcctttctcgtatgtacagtcaatagtcaacattatttacaattggaatgccaaggagacaacaaaataaaaaaaatattattatattccccaatatttacgtacggtaaatactcccaattgatctttttaacaagaagagtttacttcactttttctgcgtaaattgttcataaaaaatatttactgtttattgcaaatattgcacatattctcagaaaataattacaactatatctacataaaaaaatatttacaatctgtgagtcttattctactatcacccgcactttggtcaacaaaactaactttagtctaggcaggctctgttgatattttctatggaaaatagtcctatcgggctctatttttgcaggaatcacttcaggatgtagtgaatccatggaatcactgggatcctgaagtgagtccagcaaaaaatagactcctatggaaattgtccacatcaaaacatatcctgcctggactacttgcacaaaatttagtgacacttgcgtgaaatttacgttcaatctcacctatacacctgtacaatttgaggtgtcttttcaacgtaaatttaacgtaaaaatatcacgttaaagaccactggttcacaaagataatctctcttcgaataaaatcaggtgaagttcacgtaatacttttcgttctctgatagaacatctaccaaattgttccttttttactcatttgaaaatttattgatgatttcgttcaaactcgtggaggtgccgacgataagtccaaagaatcccaacaagatgataaggcagttcttgatcatggtaaatattctcgtcttgccggtacgttggtgccagtaggtgcccatgtccaccatagcagggatgaagagtcctagtccggagagagtcaatgctccgaacagggagatgaagagatcgatgtagggaactgctaccgcaagaacaaaacaaaaggtaaccaagaagactctcgtgacgtattccaaaagtaccaaatggtttgatccagtgagtaatggcaataaatatatgtcccatacggttttaatggcaggatataattgaagaccatgagtgacatagatggacatagacaatagaattctgcatatttggccgggtatatcgtccccaatcgacagagagatagaaccttgcactgagctgccataggcgatatatccgaagaatcccatggacgtgtacagtatagtgatcactaccatacctttgtttaaaactccaaaagggcttccaaagttctgcggcgttttcatttcattttccaacggcataatcacaccgattgcttctaacgcaaaaagaacagttccgaagaacaagggataattcttcacctccccgaacggctctttaccgtcaaaggtaaagtctctactgaacatatagtaagcaatgattccaaaactgaccatggtgatgatattggcgaacgtggatagcggtgctagatatttcaagtttttcacgcagttgatcagtatcagaggtagcagggcggccaacatgactagttttacgtttacggtgataccgtgtgcggcgaatacgcctgagatgttgtctccgatgaagattgtgtagacagcaccagagcccagttgataaattaggaggaatatgtttaccatatgcggtgctataaaggcaatccgtcgttgaaagggaggtccttcttgaaagccagctaaagcggtctccgggtaagacatcacagccactttccgtctcttgcacagctcatattcagctcttattagaagatgaatacagtgagtacataagaatcctataatagctgttcctactgctcccaagaggtatcctgagtggtagaaggccatgggcatcgccaggattcctgttccgagactccctttgagaagatgcaaaaaagtttctgtatcagtggtagggtgttccacatctcgccatctatacggatcatattcgcctgcttctagtgactttttgcgatcatttaattcgactgtaaagaagccgttgtctttgctatgtctggcaagctgatttttattggtttcggttcctggatattcattatgatttccatatgtaccatctccagcaaatccttgattgtcatacccggacatctttcgtcacttacagatgcaccacttatcctgtcaaaacaaattcaccactaattaataattcgaatttcttgaacccgaatatcattcaccaatcgcaccggcttttagtatagaacaaattaaacgcaaccaaaaattcgaatagttttagtcctggcctgg

SEQ ID NO: 3838 - DNA, 961 bp, Diabrotica virgifera
gaccggttgcttgtttgcgtcttagggttatcgcatggtcttttatagacgtctttttacaattgattaatacaatcaaaagttagtgagatataaaacgaattttagtagtaaataatttataatcggtgttataaagcaagctaaacgtttgtagatatttatttgaggtccaaaaagtgttattcacccagttagttccaagaagttttagtacagctactaacagaatggctaatgctgatatctccaagacgttgaatgccaacctttgggattcagatcctgagttgtgggatatcatcaagaaagagaagaggaggcaaattacaggaatagagctgatcgcatcagaaaattttaccaccttatcagtattacaatgcctaagtacttgtctacataataagtattcagagggattgcctggagagagatattatggtggaaatgaatatattgatgagattgaaagattggcccaaaagagatctttagaagccttcaacttagatcctgaacagtggggagtaaatgtccaaccttattctgggtcacctaccaattttgcagtctacacagctgttgctgaaccacacggcagaataatgggtttggatttaccagatggtggtcacttaacacatggtttctacaccccatctaagaaagtttcagctacttccttgttctttgaatcactgccatataaggtgaacccagaaacaggtcttatagactacgataaactccaagaatccgcaagactgttcaaaccaaagatcatagtagctggtacaagttgctattcgagaccattagactacaaacgattcaaagaaatatgtgatgaagttggcgcatatctaatgtcagatatggcgcatattttctggtttagttggcagccaggtgtaactccaagtccttttggatacagtgatatagtcacgacgacgac

SEQ ID NO: 3839 - DNA, 2037 bp, Diabrotica virgifera
gtataccataagtaccataaccttagctgttaccaatgtacacataatgtaatgtacattactgttggtttttaatttgctactttctcgtattttattttaattcatcgagtttatgaataataattagaattagtttatattgttgacaatgaaaagtgttaaaatattttttcaaccacaggtccaaaaagtgttattcacccagttagttccaagaagttttagtacagctactaacagaatggctaatgctgatatctccaagacgttgaatgccaacctttgggattcagatcctgagttgtgggatatcatcaagaaagagaagaggaggcaaattacaggaatagagctgatcgcatcagaaaattttaccaccttatcagtattacaatgcctaagtacttgtctacataataagtattcagagggattgcctggagagagatattatggtggaaatgaatatattgatgagattgaaagattggcccaaaagagatctttagaagccttcaacttagatcctgaacagtggggagtaaatgtccaaccttattctgggtcacctaccaattttgcagtctacacagctgttgctgaaccacacggcagaataatgggtttggatttaccagatggtggtcacttaacacatggtttctacaccccatctaagaaagtttcagctacttccttgttctttgaatcactgccatataaggtgaacccagaaacaggtcttatagactacgataaactccaagaatccgcaagactgttcaaaccaaagatcatagtagctggtacaagttgctattcgagaccattagactacaaacgattcaaagaaatatgtgatgaagttggcgcatatctaatgtcagatatggcgcatatttctggtttagttgcagcaggtgtaactccaagtccttttgaatacagtgatatagtcacgacgacgacacacaagagtcttcgaggacctagggctggtgttatatttttccgtaaaggagtacggaaagtcactcccaaaggagagaagatcatgtacgacttggaaaacaaaattaatcaagcagtatttccaggattacaaggtggtccacacaacaatagtattgcaggcatcgcaacatctatgaaagcgtccaaaactccagaattcgttgcgtacgcgaaacaaatcgtagccaatgccaaaagactaagcgacggtcttcaatccaaaggctacaaggtggtcaccggtggcactgaccttcacgtattgttagtcgatctgagatccgcaggcttgacaggatccaaaggagagtacgtgctggaagaggtcaatattgcttgcaacaaaaataccgtgcctggagataagagtgcatttaatccctctggaattagattaggaactcctgccatgacaactcgcaacatgaaagaaaaggatatcgatcaggttgtagacttcattgatagagctttgaaaatagccaaagaagcaacagccctttccggacccaagcttgccgattttaagaaagtgattcatgaaaatgctgacatcagcaagaaagtagcaactttaaaggatgaaataaacagatacagcgaaaagttccctcttccggggtatcctgaatattgagaatctccgttcaacatttatttattgtgtcatattctaatttttaaatttttaagatttatcaataaaatattttaataatattgtaggttatcaaaataatttcaacctgtacaatcaaggttatggcaccaatgctataatagagaaagcgccaatagactaacaaaaagtaacgtccagtaaagaaacacttctacgtgacccatgcttctgtgagaagacgtactccctttgtagatgaactcataaaagaatgaaaaaaaattacagtcgaacagcaatgatctaaccccattcataaattctacgaattcaatttccctgattacatcttgaccaaagctttcaataaatcttatgcatctccgacaccaatttac

SEQ ID NO: 3840 - DNA, 978 bp, Diabrotica virgifera
gtttagtggaagccggttaagttcacgcttatacaatagtattaccttgaaaagtgttcaaaataatggctccaacagtggttccttatccagatttcaatgccgaagaagatgcaaaggctctaaaacaagcattcaagggtttcggaacggacgaagaagctgtaatagaaattatcacaaaaaggagtaatgaacaaagacgtgaaatagcgattacattcaaaacaatgtatggcaaggatctcatcaaagaactgaaaagtgaacttagaggaaatttcgaagatgccatcgtagctctgatgacagagcccatcgagtttcaagccaaacagttgcataaagctatcagcggattgggaactgatgaaagtacaatagtagaaattttaagtgtccacaacaacgatgagattataagaatttcccaggcctatgaaggattgtaccaacgctcattggaatctgatatcaaaggagatacctcaggaacattaaaaagattattagtcggattatccacgggttgcagagacgaatccggcgtcctagacgaagaaagtgcctttaaagatgctcaatcattgttacaagctggagaacttctctttgctggaaccgaagagtcagtatttaatgctgtattctgtcaaagaaataaaccacaattgaatttgatattcgacaaatatgaagaaattgttgggcatcccattgaaaaagccattgaaaacgagttttcaggaaatgctaaacaagccatgttacaccttatccagagcgtaagagatcaagttgcatatttggtaaccaggctgcatgattcaatggcaggcgtcggtactgacgatagaactttgatcagaattgttgtttcgagatctgaaatcgatctagaggaaatcaaacaatgctatgaagaaatctacagtaaaaccttggctgataggatagcggatgacacatctggcgact

SEQ ID NO: 3841 - DNA, 954 bp, Diabrotica virgifera
  misc_feature (897)..(897): n is a, c, g, or t
  misc_feature (922)..(922): n is a, c, g, or t
gaaaacaatggagtccccagtgataacggtaacagaaggtcagttaagaggttatcgcaggaagaatttagacgggaaagagttctatgcatttttgggagttccttatgcaaaaccacctgttggggagctgcgatatcaggcaccggaacctgcagaaaaatggaatggggttagagatgccacggaagatggtcagccaagctaccaatgggatggtcaaaataataaactcatcggttctgaagactgtctacacctaggtattcatacaaaaacacttccatctgaagactcttgccttaaaccagtaatggtatggatacatggtggtggattcgcctttggttcaaacagttctaccgaatatggacccgaatacctgatgcttgaagacatagtcttggtatctgtcaattatcgtctaggattcctaggttgtctgcattttgaagatacgtccttgaatgtgcccggcaatgcattacttaaagaccaacaactagctttgaaatggattcaaaagaatatccataattttaacggtgatcccaacaatgtaacaatctttggagaaagcgcaggaggtgctagcgttcattatcatgttttgagtccgtcgtccaaaggactcttccataaagccgttctacaaagcggagtcacctgttgcccttgggcaagagtcacggaactaaacgttggtcttcaatttgcgcaaattgttgatcaacacattcaaactgaaagagaagcactaaagatgttacgcagcttgacagccgaagaactatttgaggcacaacgaaagtttatcgcaaaatatggaagacaacttaaaatagctcctaaaattgaaaagccaaacgattcagccattataacatccttatcccnagacataatagttaaaggtcagtancacaagttccattaatgatcggctttatacta

SEQ ID NO: 3842 - DNA, 1405 bp, Diabrotica virgifera
gtgaaaaggttgtgacgagggtgtgtagagcgcggtataaaatagttaaaatagagataaaatttgtagttttttcccgcaagtgtgtgcaaatcattttctagataggaggaacactttaaaacagaaccgaccatgtcgtcggaacaattttccctatgttgggacaacttccacaagaatatgagttctggcatgaactcattgttggagaatgaagacttggtggacgtgacgcttgccgtgcagggaaaatgtctgaaagcccacaaaatggttctttctgtgtgtagtccctatttcaaagaactttttaaatcaaatccttgtaaacaccccatagtatttatgaaagacgttagttacgaagctttaagtgatctattgcaatttatgtatcaaggggaggttcaagtgagccaagaaaatttaaccacgttcattaagactgccgaggccttacaaattaaggggctcactggagacggaaatggctcaactgacagtgacgttgtggaagtacctgcagaaaaacgtactccacacgtggaggattacaagccagtttctgtacctagaccaaagaaacaacaacctcctcccgccccaatgtcatccccttctgtgaagagacaaagactgagtgcttcaactagtgatacccaacccttaccccctcctgttacaaaagtggaacccattgcccctcctcaacctgttcctatttcaacacccgaatcttcacctctacattttaagacagaaccctatgaacagtcagtcagccttctagatgagacaggtgatgacacttttaacgaagatacactggatgagactgtaggcgatgacaatgaagattactctatgatggaaagtggtagtggagaagaaccacaggcaggaactagtactgatggagcaggcgaaggacaaggatttgaaaaaaaatgaacacaatgtccgtgatatagatgagtgtaaaaccaacaacggaggctgcgaaagagagtgcgtgaatcaaataggatcatattcttgtaaatgtccgactggattaaccattgctgaggatagaaaatcctgtcaggatatcaacgaatgcttactaagaaatggtcacggaccatgtcaagatacttgccgcaatacttttggatcatacaattgtagctgtgtaggtcttaaaggaaccaaattaggtattgatggccactcttgcgaagatatagacgagtgcaaaaataataatggtggttgttcccataactgcattaatgcccttggacgctcattttgtagttgtcccgatggtatggagttatcctcagattggaaaacatgccaagatataaaatgaatgtgaaaacagatgaaatactacaaacctgtaaaacctgtatca

SEQ ID NO: 3843 - DNA, 849 bp, Diabrotica virgifera
acgaagtttattttaagggaagaatgagtaattttaagaaagttgtaaagagagcagaaagttcaagagtgcagaaagggaattccagagcagccagacctaacagcttgataagtgaaaatagaaatgcagggataaaggacggctctttggcagtactagaagaattggtacaatgtggaatttgcttggagaaaatgaaggagcctcgcatgcttacatgccaacatacattttgcaaatcgtgtctaaaaaatctggtcacagcaaaaaatcttgttttaaaaagtggtccaagttcaaaagtaactctttccagcgaattaaaaaatgcaaaatgcccagtttgccaaactgaaatagtattgcgtaatggtttggaatctctagaggagttaccaaaaaattttcacatagaaacgttgttgaagttattggaaggtgacccaactgttcctactcccgtcgtaaaagctcccgctgattacagatgtgttaagtgtcaaactatatgtgaagagcaggcgcatgtctgtcaacactgcatgcaggtatattgttctatatgttggatagatcacatggcagaattagactcaaacttatctttgttaatcaaacaagtagaggaatccagagatagattaaatcacaaagcacaaaatttttctggccgatgtgatcaacttgaaagaaacaattaaaaagagtatcgagaaaaaaattcaaaaaattaagaaaatggaacatgatgtcttacttgatgtaacttctatcaaagaacaaaattcagttgtaaaaagatatgataaaccacagaaatccacctaatttaagaaaaaattgaag

SEQ ID NO: 3844 - DNA, 1586 bp, Diabrotica virgifera
  misc_feature (1447)..(1447): n is a, c, g, or t
  misc_feature (1497)..(1497): n is a, c, g, or t
  misc_feature (1519)..(1519): n is a, c, g, or t
  misc_feature (1523)..(1523): n is a, c, g, or t
  misc_feature (1553)..(1554): n is a, c, g, or t
cggacgcgtgggctgcagcgccgaacaaaactggggtattatccgtctaagtgcaagtgggtttttgaagagttttgagttgattttgtgaatttttttgtggactttttcaaagagaaaatatgaaaagcatactggtattttcgatcctgtgtctcgtcggccaaaaagtcaatgcatggggaggactgttcaacagattttctccagaaatgttggctaacatgggatacggaggacatggaggaggtgggggattaatgagaaacgacggggatgaaaatgccctggaggaacccctaggcgaaggcggcgacgatgatccgtgttatatgaaagcctgttcagccaacgaatattgttgccctaatcaaatttgtgtcgacgttgatggaattcacggcacttgtctgtactttttcggtcgtcgagtgggagaactatgcagacgggataatgactgcgaatcaggcctggtatgcgcggaggctcaagctggtgtatccacgagagtgtgcaggccaccacttcgacaggacaagcaatattcagaaccatgcaacatgtcgagcgaatgtgatatttccagaggactgtgttgccagttgcaaagacgtcatcggcaagcaccgagaagggtttgctcctatttcaaggatccacttgtctgcgtcggtccagtagctgcggatcaagtgaaaaacaccatcgaacacacagctggagagaagaggttaacatctctgggtagctttaaaagacccatgcactaaactaatttcaaattgttgtaaaacaaacacactcagtaacgtactgttccaattgagaaacgtagattttcttcctaactggaaacatgcgttttgtgtttctaggttggattgagttggattctttctgagacatacatatcctgctcattggttacatctttacgatatataactctcttaaaacgtaacatgaatgctaaacgtaggtataataaaaaaaatagactctgtcaatgacagactaaaatttgtcattgacaggacttcgtagataaaaaatctattgcggcagatcagtcattagttcaggtcatcgcctacttattgcaattcttaaccaaatgcattcgtgatgcaatgtttgcatttaacaatagaatcttaacacctataagtaagatttggctagatatgtatgtccctctctttctcaataaatgtgtacgtgtctaatatataacaagttacttggtacgaattactgatatcattacatcttttctcaatttccttggttgagtttgagccctccgaagtaattcgtatcacgtccactaattgtaagagagttggcacaacacgagtgcttggaaaaagcttattaattgcaaaagttaaacttttgaactattttgatctatcgtcaatgtttgcagaaaatatttgattanatacaattgaaaaaacaatggaacatcatagaaacttgatggagacttancagaaaacacagtactggtcanatanacattttggaaagtttacctttttaaatanngtggctttttttctgaactccctgccagctct

SEQ ID NO: 3845 - DNA, 1005 bp, Diabrotica virgifera
  misc_feature (880)..(881): n is a, c, g, or t
  misc_feature (896)..(896): n is a, c, g, or t
  misc_feature (900)..(900): n is a, c, g, or t
  misc_feature (919)..(919): n is a, c, g, or t
attatttacacgacatagcaaaagccgttgtcgaaggagctgcagaagctggttttccaatttccaaagatttaaatggtaaagactataccggatttgctaatccgcagtcttatgttaaagatggttccagagttagtatggctaaagccttccttagacctcaaagaaataatccaaacttgcacgtgatgttgaactctactgcgacccgcatcctattcgacggcaataaaacagcttacgcagtcgaatttgtttacaacaaccaaaccttcacagttaaagctaacaaagaaatcattttatctgcaggaacaatgaactcacctaaaattttattacaatctggagtcggaccaaaagacgctttggacgctgttggaattgaacagattcataacttacctggtgtaggacaaaatttaagtaaccatgtagctttcagtatgaattactgggttaacagtacagttgatactagaattattacatggcaaactttacaggattacattctaagaagaactggacctctggctagctcaggacttgctgttaccagtcgactgccatctaaatatgcaactgctgatgatccagatattcaaatgttcttcaccgtgagtcaaactacttgctcaccagatggcgaagttgatgaaccaattgatccaactgatcctcaaaaaccacaacatgtttctatcagtgctgttaatttacacaccaagagtcgtggtagaattacgttaaagtctaacgatccacttgcacctccacatatggtaggaaattacttaacagtaaaagaagatcaagatagacttattgatgccataagactggttcaaaagctttacagcagcccaactttaannagacaatggcaattngttnatgaaaatgtcactcacgncacctgtgctgaccaatacacctttgactctgatgattactggcgctgtgctatccctctacacactggtccggaaaatcatcaag

SEQ ID NO: 3846 - DNA, 1930 bp, Diabrotica virgifera
cggacgcgtgggcgcaacttaacagttgagctacaatggcggattgtggttgcattaatcccggatactacggaccctatttgggtaacaattgtggagcaggcagcttcattgtttttatgagtttagttgatgctataataagaaatacgtgtgatatatcagatgtctgtggaagagttcaacccatagaagagccagattcatcttacgactttattgtaataggtggtggaagcggtggatcggctgtgactggacgtctggcagaacataaaaagtctagagttttacttatagaagctggagttgacgagcctgaaacctaccaagtacctggactgattttgaagtattacaataacccaatcgtggactggagctatcgtacctccgacgaacctgtggcatgtcgagcaacaaatggtagctgcaattgtttaagagcaaaaatgctaggaggatgctcttcaattaatggaatgatgttcacaagaggaactccaccagattttgataagaggtggagtggcgaaggcattaaaggttggacctggaacgacgtcctaccattctttaggaaatttgaacataatttacagccttcagaatatgattctcactaccatggttacagtggaccagtggctgtgtctgaccaatattatgtacacgacatatcaaaatccatccttaaaggagctgcagaagctggttttccaatttctaaagatataaacggtaaagactacactggattcgctaattcgcagtcctatattaaagacggtgtcagagtcagtatggctaaagcctaccttagacctcaaagaaataatccacacttacacgtgatgttgaactccactgtgacccgcatcctattcgacggccacaaaaaagcttacgcagttgaatttctttacaacaatcaaaccttcacagttaaagctaaaaaagaaatcattttagctgccggaacaataaactctccaaaactattactacaatctggagtcggaccaaaagatgctttggacgctgttggaattaaacagattcataacttaccaggtgtaggacaaaatttaactaaccatgtatctttcaaagtgaattactggattaacagtaccgttgatactagaatcatcacatggaaatctttagaggattatcttaacgatcggactgggcctctctctaccataggaattacggttacatgtcgacttccatctaaatatacaacagcagatgatccagatattcaaatgttcttctctttgagtcaaaatacttgctcaccagatggcgcagttgatgaaccagttgatccaaccaatccccaaaaaccacaacatgttgcaatcagtgttgttaatttacacaccaagagtcgtggtagaattacgctgaagtctaaagatccacttgcacctccacatctggtaggaaactatttaacggtaaaagaagatgaagatagaataattgatggtataagacttgctcaaaggcttgtaaacagtacaacattaaaagacacagtgcaatttgtttttgacaatgtcactcaaggcacctgcgctgaccaatacacctgggattctgatgattactggcgctgtgcaatccgttacaacacttttgcggaaaatcaccaatccagtacacttcgtatgggctccactgacgacgaatggtctgttgtagatgaagaacttcgggttattggtctccacaatttgagagtagcagacgcttcggctatgcctgtggttacaagctctaatactaatgctccaattgtcatgcttgctgagagatgcgctgactttattcatcatagatggggacattatggcaaaaactaactgtatacattaaattaattatatataggtaataataataataaatatagttg

SEQ ID NO: 3847 - DNA, 795 bp, Diabrotica virgifera
caccatagttttaattttagttatttgaaactatcagtagttatcaaaaaataaatggcgataaaaactaacttgttcaatacgttcctcgttccgttaatttttttcggagcagctgttattattattaccgatgcagtggatacaactttattaaagcatatttctccaactatgtacactctatggctgaatatacctagtgcatacgatgaaaactattcaggaactgtaaatatagtttttacagcaacagaaacttctgaatacattctgttacattcatccgaagaacatattgctataagcaaaatctatttaaacggcgatacaaaaagaccgtgtcgttggaagtacgttcaaaactcactggatttactaaacattacttgcaattcccatgtagaaataaaagaagcaaactcattgagtattgattacaaagcaaaactctctgcaagatatgatggaggactttacaacattacttacgacgataataatctcaaacaaatcgccatatttagtcaattatatccaacttttgctagacgagtatttccatgttttgacgagccgaattttaaatcagtatttcatatttttattagttatcctgggacgttcgaaattattggaaatactcctattgtcggaaaggttcatacttcagatgggataactactcaatttgacgaaacaccgataatgtcaacacaatcattaggattcttcatttccaactttgcacaaataacaacaacagatcaagagtacacatatagcatctttact

SEQ ID NO: 3848 - DNA, 886 bp, Diabrotica virgifera
  misc_feature (825)..(825): n is a, c, g, or t
  misc_feature (846)..(846): n is a, c, g, or t
  misc_feature (867)..(868): n is a, c, g, or t
cccacgcgtccggatgatataaaagaagaattttacgcaagctttagggttatgtaatgttataaaatgtcagttgattagtaaatagtaaataatagcaaataaaagttttgcttgtattttgattctacaacaagagacaaaaatggaacaaaatgctagattacctatgtatacacttgataaggaacttgcttcagcatttcaaattgattgtgaagatttgttaaatgagtttgaatcatatcagtctttcagaattcaagattttcagaaagtatggcacaatcaaaaattttcatatgtctttgcgggtcaaacatatgctttactattaaaggacttctgtgaaaactgcttttatattgttaaaaagttcatttattttcccaggactttgtacacacaagtaggagcattttatttgctagctatcttatattacaagcaaccagtaagaacatgggtaaagatcagattaacttcggaagaatatgaaaaaatacacggactaatattagaaatggtaaataaaaaagtttatgaaccagtatacatgttttccaagttgaaagctgacgaagcctttacatatgtctgccaacgtaaaccactaggacctgaagatagattcgttaaggattttcatttgtacatcaatgatactttcgtagcttccaaaactagcagcgccttaactaaatttaaaaattcgtttgggtctacagatatgctattcaataaactaaaagagacttctacagaatattcccagcttatgcacaaatttgcagaaaaatgtccagatattactcctttttcatncaatcttgtcagggatatagnaactgctaatttattattacnntcgtcagataaaaaacca

SEQ ID NO: 3849 - DNA, 945 bp, Diabrotica virgifera
ttttctttgtatactgtagtacagctcttcagtttagaaaaatgttaacatacgtctttggcattgctatcgtacttttatcaagtactgattgtgaagcttctgatgatcacactgtcaatgtaagccttccaagatacgtggaagtaggaaaaaatgtaacacttcattgtgattacagtccagataacaacatttattccgtgaagtggtatatgggacaatatgaaattttccgatggataccaaatgacgttccgcacaaacaagtttttccactaaatggagtatcagttgatataaacaacagctcaggcaacatcttagtcttaaacaatttacaaaccatagctacaggaagatatatttgcgaggtaacttgggaggcaccattatttcaatctattaatagaggaaaactgatgtttgtaattgagaaaccaaagggggaaccagttctaacagtcgacaatgacaaagtgtcttgtactagtccaccggtacatccacgtccaagcattatatggtttttaaatggagtccagactatgggtactcctccaaggactaaacaaaatgaccgtcaattaaaaaacttcttctctttgtttaccgttggtaatgaaacgtctacgcacgaccatgcaaacttgacatgtgtagttcaaattggagatatctacagagcacaaaagtctataatattgtaaaatagtaataactccatgaaggaatcttaagatgcagcaagcagtatgttattggaattccaagaatcatagctagcgtgaatatatttgcagcagtttttaattaaaaattattggtggatgtattgtaccaatctatcatacccctttataaaatttaaaggcaaacctatttttaataaaaaaaaaaaaaaaaaaaaaaaaaaaaaaaaaaaaaagggcggccgcctcaaaa

SEQ ID NO: 3850 - DNA, 1568 bp, Diabrotica virgifera
gtggggagagttcatcggttaaacttgatatcaacagacaattgacattgaaattcatccacatttctttttcatcagcgcacaacgaagggaacgcgtaaagtgcgtacctacttcaaaagtattatcaagaaagttgtttctccaagttgaatcagtgcattgaatagtcgtctaaaatggatataaaaactgttttagtagcagatgcagtagatgctgcttgcgttgaacttttaaaaaaatactcaatacaagttgtttgtaaatataagttgcccaaagaacaattgatagccgaaatcgcaacgtatgatgctcttattgtccgatcagatactaaagtaactgcagaagttatacaagcaggtaaaaacttaaaggtgattggacgtgcaggagccggcgtagacaatattgatattcccgctgctacagctaaaaatattattgttcttaacacacctggtggcaatgccattagtgcttgcgagctcacgtgttccttaattacaacactggcaagaaatgtagttcctgcagctgcatctctaaaagctggtagatgggacagaaaactatattcgggacatgaactctatggtaaaactttgggaattttgggactgggaagaattggaaaagaagtcgccattagaatgcaagcttggggaatgacgacaatagggtacgatcccattgtaccagcatcagaagccaagaaatttaatgtggaggctttggaactggagcaaatttggcctcgagtagattatattacagttcacactcctcttataccagaaactagaaatttaatttgtgaagcagtactcaacaaatgtaagaaaggagtaaagatcgttaacgtagcaagaggaggtatcattaatgaatcagatcttctaaaggccctaaaatcaggacagtgtggaggagcggctttagatgtatttgaacaagaacctcctaaagatccagtcactttagacttgatccaacacgaaaaagttgtagctactcctcacttgggtgctagcactgatgaagctcaagttagagtagccgtagaaatttcagaacaaataattgcattaaccggaagaagtaaagaatatacatctacaccaggagtggtaaatagaagcgttctggtaaatttgtcaaagtgattttgaatatcatatgtacagtacgtaaaccatccactctgtatgcatatttttttctttactttgttaacatttaaaataaacatacgtttttttttggaaaattaaaaaaaaaaaaaaaaaaaaagcagtttagaacaagttccgaaagcaggtgcaaaatttattaaaaaattatgatcaaatgaataaacacgcaagttatatatccgagctttggactgatagtgatttaagagatccaaaacgctatacgcataaactactattccgatgttgtctgtaccccaaagatcaccagaccccccttataagctacaagtggatcctcaaccgcaaagtttgctcttatgactaccttgaaattctaaaaaacaactatgtggcactttattt

SEQ ID NO: 3851 - DNA, 1228 bp, Diabrotica virgifera
  misc_feature (669)..(669): n is a, c, g, or t
atggtgagttaacaacagtggggcgcagcgtagaaaccaaagtagatgatgtttatgtttcaaaagaacaaattgaatgtatagcggatacagattcatgtacagtaaaagtaaagccagtcggaaagtctatttgtggtgtggatggatatgctgtagtcaaagataagacatacaccttgggacctggtcatgttatagaattccgtttggggtttcatccattcgaagttgtttttgagtatctagaagaaaaactggaacaaaccgctaagagaccaaagttagaagttatgtacgctgagccaaacaatagtgccttttttaatggagcaggtaaatgggaagatattgaccaaagagaattactgatttataccccagacaacattcagagtcaaaacaaaatagcagcatttgatatagatggcacaattattaaaacacaatcaggtgcaagatttcctaaagacttcgatgattgggccatgctttttagtgatattccttcaaaattacagaaattgtacaatgacaattttaaaattgtgtttttcaccaatcagtcaggtattgggaaagatccatctaaagtaaagggattcaaaagaaaaattgaaaatattttaaagaaaatcgccttacccatccaagtctacattgctctgnggagatccaaatatagaaaacctataacaggaatgtgggaccttttaaaaacccaaaagaacgataacgttaaaattaatatgaaatcatctttttatgttggggatgctgcaggaagaaaaaaaaattgggccccaaaaaaaccaaaaatcattcttctgctgatcgtctattcccattaaatattgaaaaaaagttttatactccctgaaaaaaatttcttgaaaaagaaaagctttttgccttttcaaaggccgaaattggtactcaaaaaaaaaaagtacccaaaacttttttcctaccccccacaatcccaaaaccccccaattttaattgtttttgggaggggggcgccccgggtcacgggaaaaaaaacatttttttttaaattccccctttaaaccccccaaaaaatttttctcctcctcttaataaaaaaaatttttttgtgtttttggtgaaaaagggggggggtaaaattttcgcggagggaatctttttctctaaaaaaaaaaaaaaaaagttgggtgtttttttaaaaaaaaaaaattgttttaat

SEQ ID NO: 3852 - DNA, 1068 bp, Diabrotica virgifera
gggccgaccaagccgtcgaccaaggcttcggccacaatacaccaagcttgtgtacgtatagtcgagtcgttgcgtttgcgttgcgaatcagttctctcaaactgtaaattattattttgcacgattgaaagacatttactattagcaaaaatgtctaaagaccgggaattgcagatggggatgcgatgtgtgaagtacatgatttttgtggcgaattttatgttcatgttagttggattgttgctgatatcaattggatataccattaaggctatctacaccgatttcgacgctttccttagcagccatagctacaaagcatccgacttagctatagctgttgggttcatcattctagtggttgctttgtttggttgtgcaggagcaattaaagaaagtgttctactggttaatctatacgctttactacttcttgtaatagttatcctggaattgaccgtaagtatcattgcttacaaatccaggagtcacttggaagaaacactttctcaggatatgtggattagtatggagtattacatagccgatactggatatatttgggatgcaacacaatactcgttgcactgctgtggagtacatggtccaaacgactgggacagatttaacagttcagactacaatctcacagtcatttatagtttacaagacgactcaacaagttcagactcgcaacaaataaattacccaggagtttaccaagtaccagagagctgctgcagaaataccaaatgccaaagtatcgcttctctttacacgagaggttgcttaccgaagatccactatataatctcgcaaagtgctcttctgcttggagttggggctatgtgcataacattcattcagcttctcggtgctacatttgcccatcttctggccagatctattagaaaacttaaaacacagattgaagtggaaagaacaataagaagacaacaactgtacgagtcgcttgcaaaatctaacacacaagagaaagttagtccagtcctatacgtggcagagtcgtctgaagcttaagaattcgtcgtgtattaaatataaaaa

SEQ ID NO: 3853 - DNA, 1478 bp, Diabrotica virgifera
  misc_feature (1296)..(1296): n is a, c, g, or t
atcagttagcaactgcttggtagctgttaagtagccaaaaatgtgtgacatcgacacaggttgtgctgccttggaccaaaaggtagctgaatggttggccctggacaaaaatgaaacaacttctaacgctatgcgaactctgctacatgaaaagaaattccaggaaataaataaaattctcaccaaaagacttggttttggtaccgctggtttaagaggaaaaatgggtgtaggatacgcttgcatgaacgatctagtcatcatccaaactgcgcagggattttttaattatttagtgaagcttgatgagaagttattaaagtcaaatgggattgttattggttatgacggaagacataatagcagaagatgggcggagctaacagcctcagtatttcttcacgctggatatccagtgaaattgttcagcacgatatgtcctactccattcattccatatgctattagacaatttggttgcgctagcggcgtgatggtgacagcatctcacaatccaaaggaagataacggttacaaagtgtatggttcaaacggcgcgcaaatagtctcccccgtggacgaacacatccaaaattcaattttacagaatctacaacccttggaaagctcttgggacacctcgataataagcagcagtcctctaatatcggaccccagaagcgacgtattttgccgttacatgaacgtaatcgacagggacaattcggaagaatgtaaggagttgaatagaaaaatgaatttgacgtttacgtacacaccgatgcatggggtggcgtacgagtatattaaaaaagtgtttgaaattgtaaatgccaagtttgtggtggttcccgaacagagagatcctcatccggattttcctaccgttaagtttccaaatcctgaggaagggaaaagtagtttggatttatcgttcaaatgtgctgatgaaaacaatagttcaataattctagcaaatgatccagatgctgatagactagctatggcagaaaaaagtcccaaaacaggcgaatggagaatatttaacggcaacgagacgggagccctcattggctggtggatgttaactacgtttaaaaaaagaaacccttcatttcccctcagtaaggtgtacatgctttcaagcaccgtcagttcgatgattctcaacacaatgagcaaaaaagaaggctttaaatttgtagacactctcactggatttaagtggttaggaaataaagctctagaattagaaaaagaaggtaataaggtaattttcgctttcgaagaagccanttggttttatgtgtagcaccgaagtactcgacaaagatggagtatctgcagctgcccactttgcttcgatggtttcgtatgtatatagtcaaaaagaaaacagtagctgatcaactaaatgaagatttatgacacttatggactgcatatttcttttgattcatattatatttgcactgaac

SEQ ID NO: 3854 - DNA, 1095 bp, Diabrotica virgifera
  misc_feature (1054)..(1054): n is a, c, g, or t
ggacacgtaaatttgtgcctatttccaatcaattattttcacatcgcatcaatagtttcatagaagattctaaaatggctgggtgcttgccttgtttcatcattccactacttctatttatttttcaccgattcatccaaccaatactactaaaattctggaacccatgggagaaatcttccatcaaaaaggacggagaaaaagaaaattgtacctttagctgcgagtgtgcttggatgaagaaaaagccagttgaagataaagacaaagaggcagtgactacacctgaagataaaattaaagcatcataaactgtgaatttgagtttctagtgctcatcctaaccattgactatacttgcaatttcattgtttgttttaatgtatttatgataagtaagtaattctatgatgtgagtatatcaacaatatttgtattcgtatctggtacaatttataaatgatatgacaatgtatcagttttggattaattcattcatatttagctatatacttgcagatgtatcagttatggtacaaatgatatgtatcagtcttggattaattctttcatatttagctattaacttgcagtattttaaaacggaaaacacatcgtcgacctaatctgtaaactgcgtaactctatttatccaaattaggaggcacaaaaaagtatctctctaaatatgactaatgcgaaaactacgtatctcccaattcaaaagatttgatggtaaaacggaatattttatagatacacacattgctaaaatttgtatattgtttaataagtatttaatatttcttaccaccaactttttcttgaaaatatcactttctgaacagtgatatgtcagtcatgtggaatgacaaactagggagttatatatttttcgtaataaatttggcggcaagggagatacaatgtacacaaagaggtcgctatttactcatctggtaaaatatgcacctgcatccttttttaatgataagtagtgagtcaaacagatgtcagtaataactcattttcaggaaattatggagtacgcagnttacagattaggatttacatgtcaaaaatcattagtctact

SEQ ID NO: 3855 - DNA, 1263 bp, Diabrotica virgifera
gcgtctatttctatagtggcttcggaactggatgacaaagtacgctcttttcgagggtatcgacttctataccaaaattagcagagcaaggtttgaagaattgtgttcagatctattcaggggtacactacaacctgttgagaaagccctgaatgatgccaaattagacaagggacaaatccacgacattgttctggttggtggttctacacgtattcccaaaatccaacaacttctgcaaaattactttagtggtaaagcactaaatctttccatcaacccagacgaagccgtagcatatggagcagctgtccaagccgcagtattaagtggagaaactgattcgaagatccaagatgttctactggttgatgtagctccattatcattgggtatagaaactgcaggaggagttatgaccaacataattacaagaaattcaagaattccatgcaaacagagtcagatgtttacaacatacgctgacaaccaaccagctgttactattcaagtttttgaaggcgagagagccatgacaaaagataacaatcgtctgggaacatttgatctaactggcattcctcctgcacctcgtggagttccaaagattgaagttactttcgacctggatgccaatggtatactcaacgtttcagccaaagatacaagttcaggtaatacccgtaacatcaccataaagaatgacaaagggcggttgtcacaacaagaaattgacagaatgttatcagaagccgaaaaatataaggaagaagacgaacgacagaaagagaaaatagcagcaagaaaccaatttgaagggtacgtcttccaactgaaacaagctgtacaggactgcggagacaaattatcatgtgaagacaagtcaacaatcgagagagaatgcgaaagctgtctgaaatggttagatagcaacactttagcagacaaagaagaatatgaagagaaacggaaagattgacaaaagtatgcagtcctatcatgaccaattataccaaggaagtcaaaacaatatccaacaaagtgtgaaatgccacggggttgggacaaaaaatggtggggtttggggggggaagaaaagggcccccacaaaaaaaaggggtaaatttttttataaccacttttttttcttatattggggggataaaatttatttttgggcgcgcgggttattattttttttttttttttttttttttgttttgtgggagaaaaaaaaaaaaaaaaatttttattttttttttg

SEQ ID NO: 3856 - DNA, 1551 bp, Diabrotica virgifera
gtcactttatagtcaaagttggcctaagatggttgattgaggttttggtagggtttcaccatgttcccataggcaatatcctgtaacatcggcgtttagcctgtttaatattatttttaaataatgtaaattgaattttaaattcaaccattgtttggttctggggctatttagcaagtatgcacgtaagtaatctaaccacatttttagcttttaaaaatttcaaccatctttcaattctaatagtgggattacttattttattgtagattcactgatgatggaccgataggtctgaaaacgttctgaattggacatttttattcaatccattgggatttttaagttttaataaatataccaatttacatagaagtggttttacttcttgttagagttttttaactatatggtatacagccaacctagggaacctcccttttagtttatatatgacagtatggtcaacttggcgctacaatacttgcgattagccacacaacggagcaacataaagctggacatatggttcatttcaagatgtttacatcataaagtcttcccaacattttgtagagttagaacatccaataatgtacatcctaacatcaggacctccatgcagattaaactcatgaagaaagagatttgtaaacattacagtaaactcaactacatagaatgtaagctaaaggtaacatatgattctctacttgaaactttacaatttattaatcttaattcttttatgtcagacgttcaggataaggtagatcattcacattcagttaaatttaatagagtcaataataaattaaaacacttaatcaacaataagattagacttgatcaacaaaaagcttctcgtaataaaaattattccaattttcgattccacccaagaatcaaaaatctctcaaatgtccaattttctgatgacgaattaaaactcttaaacctcggcctcaaacactccattcctagcaatttatctatcaaagatcttgagagtctttccatagagaccgacatggttattcagaatctttccatttcactcacacaaaaaacttcaatcagaaactcttgcatccaaactatcaacaaattcaaaactaaacttctttccaacaataactcctctcttaccaacatcagttccccttctacttctacacaaacttcttcatctctctcttttcccaatttctcatataataagtctaaatcccttctctccacactcaaatctatcaaaaataagatccaaaaccaccacctcatcttcagcaaagcagataagggtaactgccttgttattttagaccaacaattatacattgacaaagtcacctctttcctagacaacaataactttactttgcttcctgttgatccctctaaatcttttgtttcgaagatgaaaaccaacttaaagcaatttactgaattcttttctgaatttgaagcaccatatactaaaattccatcaaatccactcacccccaggttatacggtttaccaaagatacacaaaggtgacattcctat

SEQ ID NO: 3857 - DNA, 887 bp, Diabrotica virgifera
cacaatttcttttcaataaccaatagatttaaaatgttagacatttttcagatattaaaatctttatcatttgttgtgggtcatgaccttttggttaattaacattgaaaatcgactacctttttctctactgtcaatgtcacttcaaacagttccttagtcattagtgtcactttatagtcaaagttggcctaagatggttgattgaggttttggtagggtttcaccatgttcccataggcaatatcctgtaacatcggcgtttagcctgtttaatattatttttaaataatgtaagtcgaattttaaattcaaccattgtttggttctggggctatttagcaagtatgcacgtaagtaatctaaccacacttttctagctttcaaaaatttcaaccatctttcaattctaatagtgggattactcattttattgtagattcactgatgatggaccgataggtctgaaaacgttctgaattggacatttttactcaatacattgggattttttaaatttcaataaatataccaatttatatagaagtgttttacttcatgttacagttttttaactatatggtatacagccaacctagggaacttcccttttagtaaataaaataaaagtttaactttgacatcctgtatttcggctattataaaccctcgcactaaggcaaatcagcttaaatcgacctattttaagctcagaaatctaaggatctatggcacgttcaataccaaataccctatatgtaaatggtttcagatatatttatgtcaatattgcagtatgtagtaatatgttacgtagattactggtataactattattcttgaactgttataagttcacaaagaaacaggtcgattattattacttt

SEQ ID NO: 3858 - DNA, 1428 bp, Diabrotica virgifera
  misc_feature (1305)..(1305): n is a, c, g, or t
  misc_feature (1347)..(1347): n is a, c, g, or t
caagaataatatattataaaacaaatagcatttcattattagtagtgtaggaaccgagaaggttgagtatgcgcttttatgtccttttggtaccatgatgtttttaagttttttggtgcgtggattcgatatttctagggtaccaggctgaaaactttaattatgtaaatgattctatctcctaaactatgtattagagatatttaattctaaatgaaaataggtatgtagttcctttttaaaaattaacaaaatggtgtttgacagatttgatccggttgttagagctggaattataacaaattaagtaaaaaaaattgtaaaatagtcatttgatgtggccttttaatttgagggtaattgttttagctttaaacctagcaagtactgtaaaatggggtgaataggaacaaaacttcactaaacaattacttatcttcctaaacatatatattactttcgttgggctattttatttttttcaagttggctaacgtaatatggctttagaaaatttaggtttgtgttgttggcgtcacacaatagattttaatacaggtgatcccattcaccccacttggtggggtgaataggaacaccaggttttgatttttttatgattaaagtattaactttttaatttattaacatctaaatatcaaaagagaaaattaagacccaaataacgatgcataagttttatggttgcaatatgtgttagtgacattttttcagttgaaagttgaaaaccgttcctatttaccccattttacggtaaatcaaatttcaatatctcgccacaaaaattaacatagaaatgtatacccaaacttgaaatgatcgttttgagttgatctatatgtttcattagttagattttattagcttaattttgtgtaaacctcttattgacaaattaattcccaactttttagtggaatttttaattgttaagtttctaattaatatatatatctaggtaatcaaaaatagtactttttcaaaaaatttttttaagatgaaataattacctttaaaattaggggcgttaatcgcacgtaggaatgctgagttatacgtggaaaagtccattcgaatgcctattttgaaatagtttttcacgaaatttgctaatgtagatataaaaatatcggaaaagaaatgaaagtcataatttacacaacagtcatcagagtaataattacataagcggcagaaacaagacgtgccacagagaggacaaaaattctgctagaaacagcatagatgaaaaccattcgaaaaatcaatggtaagataatatgngatatacgagtatattctgtgctagaagcacatatatacgancgatatgcaaggtagtgaacattaaaaactgtgtaagaaacaaaagagtagaatggtacgaccacatcccgattacaaaaa

SEQ ID NO: 3859 - DNA, 877 bp, Diabrotica virgifera
  misc_feature (747)..(747): n is a, c, g, or t
  misc_feature (857)..(857): n is a, c, g, or t
  misc_feature (861)..(861): n is a, c, g, or t
gggagcagaaatagttggcctcaattgtgccgaaattgccattataatgaaaaatcttatggaccgactaggtttcaaacagtactatcttcaaggaggtgattggggagctgcaatagccgcagatctcgctatattatttccagagaaagtaattggtatacattcgaatctatgttttgtcaacactccaatgtccaattttaaatactttcttagcggttttataccatatttattcgttgatgaaggtaaggagcacttggtctctccagtttgggacaaaatagagttcttgatgttggaatttggttacactcatatccaatctacaaaacctgatacaattggtgttgctcttcgtgatagcccagtgggtctagctgcatacctgttagaaaaattcaccacatggacaaatgctgcctataaagatttagacagtggtggtctgactaaaaaattcaccatggaacaactaatagataatgtgatgatatactggattactcgatcatcaaccaccgctatgagactgtacgcagaaagtgtaaataggaaacatttaactacaaatatggaaggaattcctgtacaacctccaagtggctgttcgagatttgaaaaggaaatcttgtggtttccagaatctgttctcactgaaagattcgtaaatatggtccacataagcacccaccgtgatggcggccatttcgctgcgtttgaagttcctgacgttttagccanagatattttacagtttacagaaattgttgaacgtattattaaagaaaaatcttagtagaatatgtgtatggataataataattaataattgttataagatgttttattanaggntgtataaattgttttt

SEQ ID NO: 3860 - DNA, 993 bp, Diabrotica virgifera
gcaaagttatttttgattgattttgaaatcctacactgtcatatcctaaggtagaaaaggcacaactgagaagctgatatactaaatctaaaacttcaacatgtctaaatcacaagtagctattcccgaaaacaagactgtagctcttggagcaggaaacagggaggaagagatagaagaaacggaagaaaccacactatcagagactcacaaggatcttggccacacacaagtggcagagaagaaagccacttttgacagcaccatcgacaaatcgatagtggaagaccatcgacagcagcaaatccactcaaccaaaaacgtacaacaatcagaaagtgtagaagtatcagcaaacaaaaagccagaaactactgaatcaaatttagaagcctcttcagttcccctttctaatttaggatacgatcgtgtaggacccattaaaacatttgaacctctccaaccattcgctcctttacagtttgagttaccccaatcctttgagctagtaaaacaagcaaattcgagtttacagaagtcagaatattctcacaaccaagacgaacaagctaacatagcaccacaaagtgagagaaagttggtaatacctgaattaaagatagattccccaacagttattgaaaaacaaactaaagtgtatgacataccaatacaacaagaattatataccgaaccagagttgcccaaaccatacgaagctcctagattgccacaagttccaaaaatctcggaggttccaaaggtaacagaaataccactttttccagaactgaggttgtcgtctgaagtatcttcgtcgacgcagtcaaatatttttgagactttgggttacacaaccagttcagccgttagctccattagatatcaactcgctattttcacctgtacaaagccagcagaatggaataaatctgaaaataaagaccggaacatcagaaactctctaaaggaaaaatttatctgatttggaac

SEQ ID NO: 3861 - DNA, 922 bp, Diabrotica virgifera
ttttgattgattttgaaaccctttagtcgatatcctaaaatagaaaaggcacaactgagaagctgatatactaaatctaaaacttcaacatgtctaaatcacaagtagctattcccgaaaacaagactgtagctcttggagcaggaaacagggaggaagagatagaagaaacggaagaaaccacactatcagagactcacaaggatcttggccacacacaagtggcagagaagaaagccacttttgacagcaccatcgacaaatcgatagtggaagaccatcgacagcagcaaatccactcaaccaaaaacgtacaacaatcagaaagtgtagaagtatcagcaaacaaaaaggtattcagttctcattttgaatcttctcaaagcttcgagtccgaagagtttgaggagtatgaaattcagggatgaataagaattgtattaggatatattttttaaatatatattgggatctatccacttccatgttgtcactttaacctaaagtgtacgaaatacttacccagaagaaacatatcactaattttttatatagttgggtaattctttctatatttttcgtttcatttttgttttatagttcttaatttactccttaacatgtttatttatatatgttggatgattttcaatttagacattttagtgttattaattaagaaaattcactgccccgtttatgtttagagaatgtaggggaagtttttgctttatgattggaacataataatttaaaaatccagttagtaaaactctccttaccagttgatctaaaggcacgtatccactaggttcgcgaccctcttgcgctccgcgctccctgtaactgctccaatgggatacggcatgcgctcctctacatataaaccgtcaccgattgggtgcgcaccggttcacggtcc

SEQ ID NO: 3862 - DNA, 790 bp, Diabrotica virgifera
  misc_feature (782)..(787): n is a, c, g, or t
  misc_feature (789)..(789): n is a, c, g, or t
gtcgttaaatttatttttggaaatatataaaagcacaagaagatctggttcaggcagtaggcgtatactcccccaacactagctttgtcatttttttgtttcgattctgcaatacctagtccgccaaaatgtctgctgatgaactcccaccagaacaaatcgccgtactccgcaaagcttttgaagctttcgacagccaaaaatcaggaagcattccatgtgatatggtagccgacatccttcgtcttatgggtcaacccttcgacaagaaaatcttagaagaactcattgaagaagtagatgctgataaatccggtcgtctcgaattcgaagaattcgttacattggctgccaaattcatcgttgaagaagatgatgaagctatgcaaaaagaacttaaagaagccttcaggttatatgataaagacggaaatggctacatcccaaccacctgcctcaaagaaatcttaagagaattagatgaccagctcacagacaaagaattagatatgatgatcgaagaaatcgacacagacggttccggaaccgtagatttcgatgaattcatggagatgatgactggagaataaacataattacttgtttatacctttataaatgtctaataaataagaacacattttttgttaccgatctttttatttatataactgtaatcataactctagttcgagttacatgaaaaatatttattttagttacatgctatttacataatatttaataaatataatgtaaaattttaaaaaaaaacggaccgnnnnnnana

SEQ ID NO: 3863 - DNA, 810 bp, Diabrotica virgifera
gcggagggggcgggggtaatggggggccgcgcgattcttgtactatcagcattttttgacccacaaaaaaacacaaaatggatgaactcccaccagaacaaatcgccgtactccgcaaagcttttgaagctttcgacagccaaaaatcaggaagcattccatgtgatatggtagccgacatccttcgtcttatgggtcaacccttcgacaagaaaatcttagaagaactcattgaagaagtagatgctgataaatccggtcgtctcgaattcgaagaattcgttacattggctgccaaattcatcgttgaagaagatgatgaagctatgcaaaaagaacttaaagaagccttcaggttatatgataaagacggaaatggctacatcccaaccacctgcctcaaagaaatcttaagagaattagatgaccagctcacagacaaagaattagatatgatgatcgaagaaatcgacacagacggttccggaaccgtagatttcgatgaattcatggagatgatgactggagaataaacataattacttgtttatacctttataaatgtctaataaataagaacacattttttgttaccgatctttttatttatataactgtaatcataactctagttcgagttacatgaaaaatatttattttagttacatgctatttacataatatttaataaatataatgtaaaattttaaaaaaaaaaaaaaaaaaaaaaaaaaaaaaaaaaaaaaaaaaaaaaaaaaaaaaaaaaaaaaaaaaaaaaaaaaaaagggaaaaaaaaaaaagggggggggc

SEQ ID NO: 3864 - DNA, 1475 bp, Diabrotica virgifera
  misc_feature (1333)..(1333): n is a, c, g, or t
  misc_feature (1394)..(1394): n is a, c, g, or t
  misc_feature (1414)..(1414): n is a, c, g, or t
caacttacaccaggatgacgataccggcagaccaccagaattcatcacatctccttcagattaatatgaacgaaaatggactcgctcacttcgaatgcagattaatacctgttaatgaccaaagtatgagggttgaatggttccacaatggtaaaccattatgggctggttcaagaattaagacaattaacgactttggtttcgtcatattagaagtatcgggagtttaccaaagagactccggtttatacacttgcaaagcaacaaacagacatggagaagctactgtatcttgtcaattacaggttaaaggcagacaaggaattataatggaaccacaattgccttctaacttccgcactggtacccaaagcattcaaaaacttgaagaaatgctacacaagaaagaagagttactcactgaagaagaacaacctaatccacccagatttacagtggaagtcaaggataacattgatgtaccagaaggtggaccaattcattttgattgtagagttgaacccgtaaatgatccaacgatgagaattgactggttccataatggcagaccattcgctactggttccagagtccatcaaatcaacgattttggctttatttccttggatattgactattcgtattccagagatgctggtgaatacatatgtagagcttctaacaaatggggaacagctaccactaaagctactgttacgtcaaagaccaagaagagtattgatactgaaagtcaacttccttctggaatgagcgccgagaaacttaaggaactcgaaaaaggtccagtttctcaagcacccgaaaaagaaaagacttactctcctcccagatttgtcacacaaattgaatcttcaactgttgaagaatctgaatcggttcacttcgaatgcaccgttgaaccaaaagatgatcctaagcttagggtcgagtggtatagaaatggtaaattgttaccttcaggacaccgttacagaaccgtttttgatcttggatttgtttctcttgatatcttgtacgtttacgctgaagattcgggagaatatgtatgtagagcagtcaatgattatggagaggactttaccaaggccagtgtgtcttgtaaaaaacttcctaacattatcctacagaaccaagtaccaaaaggaatgaagaagtctgaaactctcatgcaaatggaagctgctattaagaagtacacttccgaaatccatcttacagaagacgacttgtatgacgtggaaaagagacagcctccacggtttgtaacccaaattaaagatcaaactgatttggttgagatgcagaccactanatttgaatgtcagttggctcctgttggtgatccaaacatgaaagttgaatggttccttaancggaaaacctctaccacatnaaaatagatttacacccatctatgacttttgttacgtggctatgaactttggatggtatat

SEQ ID NO: 3865 - DNA, 1651 bp, Diabrotica virgifera
tagcgagcgagatctcaaacacagtttttacttaactttgacgttagtgagccggtaaacattgctttaaaatcatgtcggaagaattagtggtaacaacggaaattggcaagcttcggggcaaagcccagaaggattaccatggtgataaattttatagttttagtggagtaccctacgccaagccacccataggggaacttagatttaaggctcctgaaccaattgaatcatgggaaggagtaaaggattgtaccaaagaaggatgggaatgtccctcgttagatatatacttcaaacaccacattggcaacgaagacaactgccttaatatgaatatatacaccaaagagcttccaagtcataacccgaacatgaaaaagagacctgttatggttttcatccatggtggcggcttcatatatggctccaacaaaagcatgcacgtgggtcctaattatttaatgactggtgatattgtattagtgtgtatcaactatagattgggagtatttggtttcttaagtctagaagaccaatctttgggtgtacccggaaatgcaggcttgaaagatcagacaatggcactaaaatggatacaaaaacacattgctaattttggtggtgatcctaacaacgtaacaatatttggggaaagcgctggtagcgcctcagttcatttcttgcttgtttctccacttacgaaaggcctcttccataaagcgattatgcagagcggatgtgctttcaatccctgggctaagggaagaagaaactttgctgtaatttctaaagctatgggttataaagatgtagacgaaaaaactttgttccagaaactttgtagagccagcacaaggagcttagtaacagcttcgtttaaaatagaagattcattcttcgccagcatcgtccgacctttcatcccagttgtagaatacccccacgaaggagccttcttaacagaagacccagaagaaataatgaaagctggccgacatcatcatgtccctgtaataatcggttacaattccatggaaggtttgatgtacgaattaattagaaaaactagaacagatgcagatcttcccgagactcttgaaagggacattccttttgaccttaacattccagaaaaaacggaaagggcgaaagaagttgcggaaaaaatgcaaaaattttactaccaagataaagacctttctgaaaagaacataaacaatagatacaggatggtaagcgatgtacatttcctctacggtatccagaaaaccattaccttacttcagcgccacagcaaagctccagtatacgtttacagaatgagcatcatcagcaacttaaatttcttcaaaaaattctgtgaagttaaatatttgaaaacaatgcttgctctttcgttgcttacaaaactatccggcggatccagtatgaagaacgtcttccaatccctaagagaaaaacttcctgttaggcaaatagagggcgtctcccacgctgacgacatcttctacctattcagcactttcctagctcctaccattgctaaggggagcgtggaagacagaaacatacaaaaattcgtgaagccttggaccactttcgccgaatgcggtaaccctacaccagaacctacagaactcctcgatca

SEQ ID NO: 3866 - DNA, 2179 bp, Diabrotica virgifera
ccccttccggaatttgtttgtgtcctttcaccaggcaattagagctgagtttgatttaaagttttcagttcaacatgtctggcaagacaaactacttccttcactgggcagcttttacagtgaacattttgacgttagccacaggaatagccatggcatgggcttctccatctttaataaaactagaaagcttggatccagatgtcaatcctcttggacggcccataacaacagctgaaaagtcactgatagcttctttaccaacttttaccagcgtcccaggaacaattatagctggttatgtgtctcagaaactcggtcgaaagaaaacactaatactatttagcttaccgttcctattctgttatataggtatagcactagctaaatcagttactgttttctacataactagattttttctcggtctaagttgtggctgtaccttagctgtattaccaagttacgttgcagaaatttctgaagattcgaatagaggatttctaggttgcattatgggtattatgggagcaataggatattttatcgtttatgctattggacctgtagtttctattcaaatgtttgcctatcttcaattatttccaataatactgttctatgtaatgtttgtaccttttatacctgagagtccttattacttcttggccaaaaagttagataaagaagctgaagcgtgcttgaaaaaaataagaactaccagtaaggtgcatgaagaattagcatatctcgaagaagttataaatgaaaataaggaaaagaaatcagattggagagagatatattccactaaagcagctagaaaaggtttgactattacctgtgggcttctgatgtttcaacaattattaggatttatggcagtgctgaactatatgcaatctattttcgaagctgccaagactagcattaattccaatacagcctcgttaatattaggaggtgttcagattatttccaacatattttccactcttttagtagatagattaggaagaaaagtacttttactagcttccaatgttggttgtactatatcactagcagctttaggagcatttttcttttgtctagagaacaattataatacagactccatattctggctacctattcttagtcttattgtatttttcgtatcattcaactttggatttggtacattacctttgacagtgtgtggaagaactgttttccagtaacatcaaaagcaatggctgccagtttgccaacatgtgtttgcctgttactgggccttttctagttactttaaggtttttccatatttattcttgaatgaagtttgttatgcccgaacacctttttcggggatatcttcagttcatcttattttgtttgtagtatttatagtgcctgaaacaaaaggcaaaagttttaaagaaatacagcatgtactagaaggaaggcgttgaaggtgatgtgaaatgacataagactagagatatgatcttattatttatttatttctatttaaaaccattttcgaaaacattgtgtgggttttctactcttatctgcaatattttatcgccattatttgaatggaaaatttagctaagattgtagataatacgtttttgacagtattgtattaatgtaatcatttggaattcttctacaaagtggctaaatcagatcatagcattttataaacattataataatcgaaattcccagtattatttagtaatttaacaactatttatacatttcagcaaaaacttgatacattattgtagacaacagtgatccgcgtttacttaagaccaaaaatgttttttttgcccataatacaatcaaatttttttcgagaaccacttaataaaatgaaatttatttttggaactcttagaccactcatgatcttcagagatgtattcgaaacaccgcagttagtaatccatatgtttttttatttaaatttaaccgagttattaaacgagaatattatggcgaaaatgtttttatctgtcaaacttatcctttcgttatcaatgactgccaaaaatttttctttattaaatgattgttgaaaaaataaattacatgtgtagtatgtttttttaacctatgtagcaatgtgttactgctattattttatttttaaattttattataaaatatacactgaaataat

SEQ ID NO: 3867 - DNA, 1362 bp, Diabrotica virgifera
agttaatatttttcgagttatttgctagtgaatatatttatttttcaacaaaaaacttaagcactttatggggaaaactgattacatctttttgaaagcgtttggaaaggctttatttttgtttttttaaagaagcttatagcttcaaaaataggcaagtttcgcccaaaataaagttggttcctttttttggtaaacaaatcatgaaaatcgccccctggttagcatcccaaaggaaattgtttgttaccgctttactggtgaatatattgtttatatgatctgtaagtttcttcggttcaaagtccttatttctgaaaaggctgtagttgaaagggcttgaaggagtcactaatcatgagtgtatgcacattttgaacagccatatcttaaccaatttttgtcttacaggaaaacaaaaaaaatccaaaatattcagaaaagcaaaatttgtttttttttactgtttgagatttttggtatcactaaaattttttaagtgatttcaaagttgtaaaaaagcattttttcaaaattaaaaattttttattttagaacccaattttttcaaaaataagcagtttgaaccagacacttacatatcatataaataaagaacttgtgaagcggtaacgattaattttatttgagatgctaattaggggttgattttcctgattttttttttacgagagagtaactaacattatttaaccgtaagttgcttacttttgatgctagaaactctttttaaaaaacaaaaataaagctttttttgaacactttaaaaaagttggaatgagttttcatgagcatattcacttgcaaatgactcgaaaagtattaacttagtgaagaaacgctatggaatggaggttgcttagaattagtcagtttgtccatttcgggacttattttgaacgtatattttttcaccccgagaaggggtgaaagtcacccctagggcaaaagtacccatcggcacaatatctcttttttctttgacatgttagctatgctccaactgggttcgttaaaatttggagcaaaaaccgttagtaaatggactaaagttattgaccgccgatattgattcgaatatttttgtgtcatctaataagttttttctttctctctattttccatgtttcttaacttttctcatactactgaaagttctaattttgataaataattaattatatactgaatgattgagtgaatttatttaattattttcttggagcacaaaattgaataatcggaattaataatctatttttaattattgtgataaacatttgtaatttgattacccttttactggtatctcctaaaaaacaaaaaataaatatatggaat

SEQ ID NO: 3868 - DNA, 1006 bp, Diabrotica virgifera
acgagaatggtgttgtgcgggaggtattgacaattattcaaactcgtttacatatctcagtggtctatagaattccaaatgggaacatattctatatgtaaacattgttgttaacttgtgagttctactttatttaaaggcaaaatgagtgttcaaagaaggtacgaaaactttctggagtacagacggaaagaaaaactaaacttcttatggatttcgaaacggtgggatccggtcattgcctttaaacaaggtggtagcaggagacctacccctcattctcataaggtggctgttttgcgtagtcctaagattcaagagttattagatcagataagtaggatcgataatatcccaaaagctacgttagaaacacaagttcgtgacattttagatgaaataggctacgatagaaacttaaaaattgtcagatggctgggtttagtattaacaaagatatgtttaaaggtcctctcaggaatatatgtaaatattgatcaagttgagaagataaaaagtcggatgggaaattgcccagttatttttgtacctactcatcgaagttatggcgattttatgatgttgtcatacgccaatttcaactatgacattgaaatacctgcaattacagctggaatggattttcacggcatgtggggcgtaggcaaggtacttagagataccggagcattttttatgagaagaacctatactaatgataatttatattggaccacttttagggaatacgtttaccagttagttaccaaaggtgatctgccaatggaatttttcatagagggaaaccagaagtagaagcaataagtccttacccccaaaatatggagtattgtccatggactcttaaagccttttttttctcccacgtacctgatatactttttgggcccaatgggaattagttaatgaaaaaaattataaaaaaaaagtcttgtttggattttgaatttgttgggaaggggccaaagcccaaaaaaaaaaagaa

SEQ ID NO: 3869 - DNA, 725 bp, Diabrotica virgifera
taacccccccacccccccccccttaatgggcccttcaaggggggttcccctttccccttaaggttggccaatttttgggaagggggatgggggggggcctttttcttttttccccaacggggaaaagggggaatttttccaaggggattaaattgggtaacccccgggttttcccccccccgcctttttaaaacgccgccccggaaatttaattttggggcccctttaaaaaaatttttgcttcccaacccccctttgtaaaatttggttcttttaaaggggccccccctttttttttttttaatttttttttttttttttttttttttttttttttttttttttttttttttttttttttttttttttttttttttttttttttttttttttttttttttttagttatttaaagaatgtacttatattacatgaaaataaaaaaaaaacaatgtcaagactctcgttcacaccttttgaagattatcttaaccttctggcttcacgttcagattctaggagggtgaggatgtctccttctcttacgggtcccttaacgttcctgatgatttgacggttttgttccccaagaaattcaacttttacttgggtacattgtccctgggatccagttcttcccaaaactttgattacacgggcgagaactacgggtttatccatgttttttagttaatttgtggaaattacttgtaacaaacacgtgc

SEQ ID NO: 3870 - DNA, 608 bp, Diabrotica virgifera
cgggcctacacatcgtcttttttatttctttaaatcataaaaacatgaaggtagtatatttgatactagttttggctgttgttacacaagcctttagtgatgtcactagaaacgaaactggaagacattggtttacgttgcgaggaaaagaatatttcattgaagaaaatgttaaggccaatttctggactgctgttcaatactgttaccatcataatatgcagttggtaagtttaggaacgcaagaagagaatgatgctctttataatgaagtcgatcaatttcttgccggtcaagcagagttctggtcttcaggaagtagaatagcaaacgatgatgactggatttggcttacaacaggaaggccaattaaagttttcaactggggcgatggagaaccaaacaacaaggacaaaaaggaaagatgcatttcgctatattatagacattatcaaaatgggtggtggaacgacgagaattgcgacaatgaacttggggttatatgcgaaacgaagtgtcaagattaaatgaaacatatttttatcttattttaagttgagaggagttaagtaaatatatgcaaataaatgaagcagagattatgtgat

SEQ ID NO: 3871 - DNA, 909 bp, Diabrotica virgifera
aattaggttaggtttaagtttaagatccaagtccaatgccaaatttgctaaagataaaattggaatacttttattatatgtgaagatttgaaatttacagaaatttaattgcattatataaccaatttttgaaaaggagaatagcagtattatatggttcccaaactggaaacgctcaggatttagccgaaaggatatggagagagtccaagagattttattttaaaggctccgtgaaggctttagatgactatgatgtacttcatcttatccaggagacttgtgttatctttgtatgtgcaactactggtcaaggtgaagaaccagataatatgaagtcattttggagatttttattaagaaaaaacctacctccagacattctatgtagactcaagtttggtgtatttggtttaggagattcaagttatgcaaaatacaatttcacagcaaagagactttataagaggttactacaattgggagccaatcctctcgtacctttaggactaggagatgaccagcatgatttaggatatgatgctgcagctgatccttggatagaaaatctctggagtagcattttaaggtttcatccgctacctgtgggcatagaacctttatcaaaacagtataagattgaacctagatggaatgttgttagtcattttagtacaattaaagaagaatcacgtaggccacactctatttattcctacataagaaaaccatcagattttgttgctacagtgatagaaaattcgagattaacatcatctgaccatttccaggatgttagattaatttaactgaaatgtccaaaccagaagtacaatcctggagatgtagtttccttaaggcctagaaatctagactggaaaatagaagagttcaggcaagtactatcgt

SEQ ID NO: 3872 - DNA, 3195 bp, Diabrotica virgifera
  misc_feature (2967)..(2967): n is a, c, g, or t
cgtgtttattgtttgaattaaaagtggccaattcaacaaatatttaaataatttattacttgttcaacgtgatagcggtattagtttaaccatctggtacgctttcgtgcaattttaacgaaaactatgtcaagtccaaagcaagattctgccctaaaagcaggtcaccctcctgcagtgaaagcaggcggtatgaggataactcaacacaaaacaagaaaagattccggaggcataactgaagatgtcaccggtatcacagtctccggcagtccaccgaagacgactaccgtttctggcgcggtcgtcaagggacacgccgattttcctgcggaagcagtgcaaagttttcacaaagaaaagcccccagcaatccatcctaacaagccagtggctcacatccaacaacccaggaaatagattagatagttgccaaattattcctaaaagaacttatgtaagatccaagatttccataacgacatagtctattaatatttgtttaaatgaaagtacttagtaatagtttgttaaaaatgttacacgtacttcaatattttataattattatttttatgtacatatagtcagtcataatgagtttaattgacgaagaagaagtagatacataatattactttgtttttttgatataatacttcgttgttgatgttttctttgtctttattactatcagaacgtctttttgacaaataatatagactaactcacaaactatgtctattattgttaatttagtatgtaaatttgataaaatctattacacttgttaaatgtctatattatcaaattaacaaaaatgaattattaaattattttttgtaatgaaatgtcgttatggaattcagtacatactttaaaatgcattttttattcttaatattcttatgattgagtctttcaacattcagcacatttgacactccaaattatgccttagatattaatcaaaattgagattttcgacctcgagtttaaatattggcgaaacatagtgtctgcttcaaagaagtaattgaccattgatttaaaaatgtgtgatattttataccattgctgactccgagcgaaatttttgtttttttacttataagtcactcagattttttactaaacagatacattttttaatgtaacttcatttttttctaagatattttcgttcttgagtgagcagtaatatacaattaatgttgtaacaacttacttgctgtaactagaggaaaatgtttgtataagttttggtaaattttaaaacttgaggtacttaaacgattataataagttttcattagacacaccgacaaaaagcggacaactttgataaaataaaaaattttaaaatgctgcccttataattattcttccgttgaatttttcgtcttcagtaagtgaccacggagtttgattttatcatagaaaaatattcagtgggacttagatctgtaattaaggcgggccagtctggtagtgtcgattatattcaggtatttagttattgaatacacaaagttcaacgcatttaacaccgtgtgcatgagggtggtccgataaaacttttgcaaacgtgcgacagtttggaaacaaaactaaaccgcacggggccaattctggagaataaggtggaagagcactttttcttctacaaatcgagtcgttttttccgcaaatcgttgtcaaatcggtccaataatttgtcatagcagaactctatgaccattttgtccttctccgggtagcacaccttgcaagtcccagaaaacaatagcatcgaaaagcgctgaagtggtctcacaattgggcttgcccggtatgagcaagcaaaggctttctcatgcccaaaatgtcatgcaggatatgacgtacgcgatcttaagagactactgactcatttatctcacgcacctttaatcggcggtctgccaatacgtgatcggatatcgtggatttgacacgttatccacgttattggtctgccaatacgtggattttgacacgttatcctccgtgataaccattttcggggcacctgggcgtggttcatcaaaaacagacgtgtaacctcgttgaaactcattaaaccaataatttttgacggtcgccatcgaaggaaagaaatcactatatataccatccagtcgctttttggttccacttcgcgatttcctgcatttataaattatgtaaggttgcgtgacaaacttgaaagtagaatgaaataatctaaattatagatccatatttattcaatgatttgtttaatggtagccagtatttgtcaatgtgtgttccgtatatatttttaaatatatttttgatttcattaaacgtttcccaaagataattgattttataaaatgtgtactcgaaggcagaaaaagttttttaaatttttataaaatgtgcaattgaatttattatgtaataattagatgtggaattttgcatgagttattatagatttacctcttaaggaaaggaaaataattcgggattcaagaatgttctaaataaaagcaaattgaaagaaaatttcatttctgatttcaaaatttgtcttttattaactaaaattcagatcaattacgacaaaaaagttccgttggatttataattattataaaatgaaaatactctgatcatttatatcgaatattttaccatgtgttaaatatgtatatcgatcaacgaaatgtcaatactaatggaatgggcatgaagcgaatttaatgcggccaggatgagatagcgtagtcaggaagataatcgccatctttcgtaaacaaaaaaattgatagtggtagtcagggttgccagattggtgtattttcccacaattttggagtaatttgaaagtgtctaggtgaatttttctaagcaaaaatggttgggagatttttttggggggacaattatggacgattttaagaagtcatggtaaattanatttgcgaatatacataggactgtatattatactctcatataaccgaagacgataggacctatgaattatttccagggccctctgttgataagtacatagtataatttttgtttactgttctctacatttgactactaatttattaaaatgcggcacaaattttaaatttggggggattttgagttttaattttgagggaaatttcagttttctaaggggggggattt

SEQ ID NO: 3873 - DNA, 1048 bp, Diabrotica virgifera
gcgattgttacttcaaggggagaagacgttaattttttagaaacatcttcaacaatataatttatattcaaaattgtaattcataatataatttttgaaaggaagtagcttccaaaatgtaccatttacagaaattttctcgtgagccaaatgaggttatgaaaacacatgcgggaggtaacagaagaactagctgcccgcacgaaaatcgaaaggaccaagcaggatgaagtacgaactggtagtagtaagagaaaatctgctgcaacagccaccactgctgccattacaccacctcaaccaaagacttccacctcttcttcctcttcgaggcacaagaaaacatcaaaacatggaacaccggtgaaacaaggaccttcaccaccaactgcaaccactccagccaaaggacacaacaaacgagagaaggtttattgcatttgtcgaacaccttatgatgaaactaaattttatgtgggttgtgatctatgtaataactggttccatggtgattgtgttggcataacggaagaaagtagcaagacactaacagagtttatatgcaatgaatgtaaacaggccagagattcgcaaaagttgtactgtctatgtcagcaaccctatgatgattcacaattttatatttgctgtgatcgttgtcaagactggttccacggaaggtgtgttggcattctgcagtcagaagccgataatatcgatgaatatgtatgtccaaggtgtcagcgaaacaattccgtcaactttgcaaatatgaaagatttgcaacctaaggaccatgaaggattgaggaagcttatcaagcaattgcaggttcacaagagtgcctggccatttatggaacctgtggatccaaatgaggctccagattactataaagtgataaaagaacctatggacttgcaaatgatcgaaacaaaaataaacgatcaggtctacacgaaactgagtgagttcattggggacatgacgaaaatttttgataactgtagatattacaaccccaaagaatcgccgttctacaagtgtg

SEQ ID NO: 3874 - DNA, 1495 bp, Diabrotica virgifera
  misc_feature (1446)..(1446): n is a, c, g, or t
  misc_feature (1478)..(1478): n is a, c, g, or t
gaagagcaaatggaattcagtttgtcataaaagcgttgacaggcaacgcaaacttgaagaagctctcttatattcaggacagttcaaagacgccatagcagctttagtccaatggctacaaaaagctgaaaaagatctttcaaaggacagtcctgttcatggtgatttggataccgttaatcatttagtcgaggcgcacaaagtgtttgaaaaagaactagaaaaacgtaacgaccaaatggaatcagttattaaaaatggtcaagagttagaaagaactgcatccaaaactgacgctatccagattagagctcaattaaatgaactaaccgaactttgggaaacggtgacagacttaacaagaatcagagcagataagttaagagatgcactgaaagaagccgaaaaacttcatagatccgtgaacatgatcctcgactggttgtccgaagctgaaatgaaactgagatttgttggtaaccaacccgaagacgaagcaactgcttacgaacaagttaaagctttggatcaattcagagctcaactaaatgaaaaagaaatcgagaaagatcatactcttgaattagcccacagcattcttgcaaaggcccatccagattccatcaacgttatcaaaaattggattaaagttattcaaagcagatgggacgaagtgtcacaatgggctcttcaacgtcaccagaaactgtcacagcacttacagtcgctcagagatatggacgatactttggaagaacttatccaatggctcatgggtcttgagaacactcttattgctctgaagcgcgaagaattgcctatggacattccagccaccgaacagcttattgcggaccacaaagagtttatggagaatacgcagaagaggcaagcagaggtcgatagggtttgtaaagccaagcaggttaagcctgcagctggcgttaaagatcctaagaagttcgtcaaaggcaaaggacaaattcgtggttctcagcttgacattcatgattccacgcaagacatctacggcgcacttggtcgcaagcaaagcttcaaaggctcgaggaatgacctacaaagaggaagcgaaccagaattccggtcaccaagagtcaaattcttatacgacaaatggcgtcacgtatggatgctatcatgggaaagacaaagagaattgtacgatcatctggcttatctgaaggaaaaggaaaaggccgacaacttctcttgggacgattggagaaaacgcttcttgaaattcatgaattacaagaagtccaggttgacagatctctttaggaagatggataaggataacaacgaactgattcccagagatgacttcattgaaggaatcatcaagaccaaattcgacacctcccgccttgagatgaaacacgtagcagacatgttcgacgagaacaccgaggactgatcgactgnaaagaagtcatagcagctctcagacccgatgnggaggaaaagggcgctg

SEQ ID NO: 3875 - DNA, 913 bp, Diabrotica virgifera
aataaattaagaatttatttctttattgattcagcactcaagatgtctggactaaaatatttcgttctcttcgcccttgtgacagtcacttgcgctcgccacgtgagccgcaaaagtactggtttgaaaatcaatggtggtagccaagccaaaagtggacaatttcccttcgtagcatctctagagttgggaatcttcggtatctacgaaaacgaatgtgaaggtgttatccttaatgaaaattgggttctaacatcaggtgaatgcgccaaagaagtatccagggttgtagctggtgttacagacttgcatggcaatgaaacaagcagacaggtggctgaagtcgaacatgcttatgtacatcccgaatacgacagtaatgggcctagtccaaacgacatcgctcttgtcaaactgaagacacctttggtatttaaccagttcgtcggtaatgtcagcttgcctgaacaagacgctgtatttaatggcactgctaaccttactggctggggatggagcttcttaccagacttcaataaactaagcttcgtagctgacttacccctaattgatattgaagaatgtaaccgagtggttgattcgatcttagaagagaataccttggacaaaaagagcaatatctgcgccggagatctcgacaaaggagcaaataactgtgacggtgatgttggaggttctctcacccaaaacggtgttcttattggtatcgttacctggtacatcgaaccttgtgatattgaaggaactccagatattttcaccaacgttgctaacttcgttgactggatcaatcagactattgacaaacatcaataaactgtaatttttgatatttttaatatatttggtatttttttatatcacaaaacggtgtacttttacgttatttatc

SEQ ID NO: 3876 - DNA, 959 bp, Diabrotica virgifera
  misc_feature (903)..(903): n is a, c, g, or t
ttcgcgtccgtgcgttttgcgttatgcaggtttgaaatatttgttgtcagggagattacatactcttaaaaatagttgtatttatctctagtacgtttaaacatacttactagtataataatgtcgtcgtttgtacattatacgtaggtgtattaaaacagcttaaatgtataaaaaccggacttaatatttcatcagttgtatttgatgtgatggttatatttacttttatttagtaattagaaaagttagcccttcatcgacagccaggagatatcttttcatgatggcaggaggttttacagaggcggcctttattaataaattatccgatttaaacaactcttcgggaagtatacaaacactcagtttgtggttaattcatcataggaaacatcacggcaaagtggtacaaatctggtttcgagaattgattaaagccaaagattccaaaaaacttacgttcatgtatcttgcaaatgatgttattcaaaacagcaggaaaaagggaccagaatatggacaagaatttagtttaatcctcgacaaagcatttgagcacatgtctaaaagtgatacaaaaactaaaaatagtctgaataggttgataaaaatatggaatgagaggggaatatatgacaataagctgatactagaatttcaaagaataatggcttcatcacctgaggaaaatgaaccacctattaaaaaagtaaaagttactgtgactaaagaacgaagaaaatttgatagtgaaaagattgtagagcattctgatggctccatcgaaacacacatacagttaagtcctcacacacctgcgggagatcctccagaaccagaagaactaataaaggccattcaagattttagaagtaaatattgcttcatctgatgagtggntagagagagaatttgctaaattaccgagagaagtgtctgaggtatccctgatatct

SEQ ID NO: 3877 - DNA, 742 bp, Diabrotica virgifera
aaatagtattcaggaaaattttgcgtttctctattgaagacaatcatttgttgttaaattacattaatccttaaatactacagtttaatttataataatttacccagtgcaaaaaagataatacagatacctataagaaaataacttggaagaataaggttacatttcacaaaactactttttacgcacattatattgcttcttttttatgatgaattatccaaaaaaaaagttacaactaagaaagtattcttctatcagaacatactgttcacttttagtgttacaactttcaaaaaaatggttatatctttacttataacaaacaaatgaaatagagaatgcggaaaaatccccttacgaacaattcacacatccactacttcgggctgggaaaaattttttgaatagaatcgaagatccaaacaccagctcttagaaatgtgtttcgccctcttcaacctctatgggctcatcggtgaagatgagaggttgaatatcttcagacacattccaatcaaaaaacaacattcgagacctagacatagcaggaacgtaaatttacgcccaacctgacaatgccattctcaagttttaattccctaattactttagagtaagtaacttataacttcatatcaaaaaaaactagttttagatcgcgagcggccgcccttttttttttttttttttttttttttttttttttttttttttttttttttttttttttttttttttt

SEQ ID NO: 3878 - DNA, 851 bp, Diabrotica virgifera
taaataaagaggttaatttcagattttacaataaacaatttttcaaaattttataaacaatcaaatcgacgtatcttattcacgtatttggggggtttcagtacttatttttataattttaaataaactcctctctatctctacaaatacttatttatgagaaaaaactgttatggaatcatttttaaaaagaaaaatagaccagccagatactaatggcaaaaaaaatcaaaagagaaaactgtcctcactcacttaagtgtttcagaaaaaatccacatcatttcaaggaatttgaccatcctcatttattgaagctaatagatatgggtagccctgttgaaataccaagtgattttccacaaccacaacaagtttatttggaacaaatcgagatgcttcagtcacttttaaagacttctcatttaaaagacatacaaaacctaccaggcagctcaactagtgcagaaaaaaagcctgagaagcaagaaaaaagtaactctagtacaaaaaccagtccagcaaagactcagaaaggaaaaaatattgctccaaagtcaagtacagttctagaggaggatcctgtggaagttgtgcatattttagatagtcctatattgaaaaaatcttgccacgaaacaatgatggagaaaatagaaaggatggcaccttacagtgtattttttaccacaatcattaaagctcccgagactaaaagacaagaaaacgccataacatttacagaatttactgtggccaagtttaggaaatcttaaaaaatttctcccaacaattaacttcatgattgatattaaaattgggtggttaaaggcaattataaaagaaagagg

SEQ ID NO: 3879 - DNA, 1476 bp, Diabrotica virgifera
attggtaactgtctaattcagtaatttaagcaaaggaagtttttcgacttctatagagtgatcactactgaaactattaagatgtcagtattaaatcagagtggcgaggagcaggtggagtgtccgctgtgcatggaaccacttgaggttgatgatcttacattcttcccttgtacctgtggttatcagatctgtcgtttttgctggcatcgtattagaactgatgaaaatggattgtgtccagcttgccgtaaggcttattcggaagatcctgccgacttcattcctttatctcaagagcagattgctaagttgaaagcggagaagcgtcagcgcgaccagcagcgcaaggccaagttgaccgaaagccgaaagcacttggccagcgtgagggtagtgcagcgcaacctggtgttcgttgtgggactaccgatgaggttggcggatcccgaggtgcttaaaaagcacgagtacttcggcaagttcggcaaaatacataaggtggtgatcaatcaatcgacttcgtacgctggctcgcaagggcccagtgcaagtgcctatgtaacctatatgaaaagtgatgatgctttaagggccatacaaagtgtcaataatattacgatagacagtagagtgataaaatcaagtttaggaactacgaaatattgttcgcattttatgaaaaaccaaacctgtcccaagccagactgtatgtatctgcatgattttggtgatccagaggctagttttaccaaggaacagatgcacgccggaaaacatcaggaatacgaaaagaaactccacgaaaacctactcctccgcaccgccaacaacaacaaccaatccaacacttgtgacaattctaaaccttctatccctatacccacaacaaattcaacatataaatcgtcttctaaagataatatgacagcggcgctgtcgagtagtgtgagcagtagtagcagcacaacatctaacagtagtggtacaaataaggagaactggccgcatttaaatacggagaaagaaaagaaagacaaggagaaaggaaagaagagtaaaggtaagggggagagcgggagtaggaagggcgagaggaaggaatcttacagtagcggaaagagcgaggttaagttcgatagtggttttaggactgacagtaaagataaaaacacatctccgcctctcagtgaaccggcagaaactccatctcctcctatgttactagagtcacagctgtctgttccgaaattaactacgcccatgatggacgataatactagtttcttttcgctgaattcgtttcaaaaattaccttccaatagttcggcgcaggaacacgcgacagaaacagatggcgaggcgcatccttctagtatattgacagatactctaccaaatatcaacacatcagaagactggggggcggtgtttggatttttctagacattcggaggttaatttagggaaaaggga

SEQ ID NO: 3880 - DNA, 863 bp, Diabrotica virgifera
cctttttttttttttttccgattttaagaattttcgtctataagttacaacattttaccaaaatactgaaaaagaactgattagtctattgaaataactttaaaatgagttgaagtaaaatagaattggagctttgtttatcaataaacatcaatgaaaggtatacatttgcgatatgccccgtgttggcttaatccgttactgtttaaatttatttcttacgttttaacctaactacctgaggtattagatttaatccatggtttcgaattcacctgtagaaggtttcgagttggcagattcaggtagtagaaaagttacgaattggccggtgttctttgtataccgtagtccctagagataacggactaccctgctttaatcccaaagccgcgatagcgctataaaagggagactattattattatcattttctatgttgcgtttcctttccgaaccataaataccaaaaaaatttgctactttttgttcaatcgtaaatcaatcaatcagtcgtaaatcagaaaattaattaatgccggtacatggacttcaaggattaaagacaatcacaggtaagatatcagtcattgaaagatagtataggagtatagcattgcattctgtggatgaggcaacatatttggggaaatataagtttctttttattcaattgcgaacaatttaagcaacattttagtacaaacttttttcttgaagaaaattagaatacttctccaaattccttgatttcgcactctctttttttagttttgaaattgagcgacaggtatatgtcgcatgtagctagaatagacaaatttggaagacttatattaacaattttacgaactcttttttac

SEQ ID NO: 3881 - DNA, 1378 bp, Diabrotica virgifera
actcgcgggccacgcgacgcctcacgcgtccgttccttgttcccattttgatattttgtcggtatacacgtttcgtgtctcaagacttaaaaatgcgttacgtggctgcttacttattggccgttttgggcggcaaagcctctcccaatgctgcagatcttgaaaaaatcttgggatctgtaggtgttgaagctgaaggagaaagagtaaagaaagtcatcagcgagctcagtggcaagtctgttgaagaactcattgctcaaggtcgtgaaaagttgagctccatgccagttggtggtggtgccccagctgctgccggaggtgccgctgctgctgctccagctgctgaagaaaagaaagaggccaagaaggaagaaaagaaggttgaatctgaatcagaagacgacgacatgggctttgctctattcgactagactcattagttgtaagatcaaccttgttttgtaccttaatatattttttttaagttcaagaaaaaaaaaaaagaaaaaaaaaaaaaaaaaaaatcacaaaaaaaaacaaaaaacagacagatgaaaaaaaaaaaaaaaataaaaaaaaaaaaataacaaaagcaaaaaaaaaaaagggggggggcatagaacaagacaccaacttcgtaacctggggtaactgaagataaactctttttaaaggggccccaaaatccaattccgggcccgggttttttaaaagccgggaaggggaaaaaccccgggggggtcccccaattttaatccccttggaacccttccccccttttcccccttggggggaaaaaaaaaaaaagccccccccccccaccccccttccccaaaattcccccccctaaaggggaaagggacccccccccgaacggggcttttaagcggggggggggggggggttaaccgcaggggggccccaaaattttggcggggccccaaggcccccctctttttttttttttttcttttttttttttccccccgttttcgcgggttttccccccaaaagttttaaaataggggggcctccctttttatgggttctttattttatgggttttccgccccccccccccccccccaaaaaaatttatttataggggggggggggtccccggtaggggggcgccccccccccctcaaaaaaagggttttttctccccccttttgtacgtgtggggctcccccccctttttttaaaaaggggggacctcttggtttctccaaaacgtggaaaacaacaaccccccaccaccccttctctccgcccctctttttttttttttttttttttaaaagggggttttttttcgccgctcttcctccccccccttgttggggtaaaaaaaaagaagggagcgtggatttat

SEQ ID NO: 3882 - DNA, 1557 bp, Diabrotica virgifera
cagtaagacgatgcttttaaatgctttttgtgtgactggtacatatattataaattaagcttagcgagtaattaagaatcttatctttaaatatccagttgtacatcttacatagtgtacctcttagaataggaaaatgtatttttcaactgtacctaaccaaacgcgtatagcaaaaggtgtagaacgtgacaaagaatagcataaagaaggacctgagcttgttttagttattcttccttcaaaattagataatccttaaattaaactagatatgtgtgctaaaaaatcatctctggcggtacagccaatagaaaagaagctgaggaaggtctcagatcaccgtgatcaattatttaagcagaataatggaaaactggtcgtgagccatctaaatcttctctatgctatagtttaaacgtactacacctattttcaaatcacagctttgtattcatgctagctaactttgtatcatatcctcagtagtttatcgtgacctattttttatatatctactaaaagacaccgatagtttttccaaaaaaaaaaacttctatttgatagaaaaataaaaatttatcgtttacaaattatggtaaaattatttagttgttattattcagcatttacaacggtacaacgctttctttcagtgcagaacgagtatcaaaatcataatacgagcaaaacttaacggagccccaacatataccaaccttgaataacacaaaatacaacaatttcttagatctggggaaaatcgtcgaagatttgacaatttcggccaatcagagcgccatattgtagtcacgtgacctaaaattttcctagattccagtaaactggactattacaggagcgataaagcattaatagcgttatttgtgttggctatcccgaagtttgattttttatagtagtcacgatgtttttggtcgatgaaagactttgatcaatgattttatattccctactactcgttttgccactgaatgaagcattttcctcattccttataatgttctatatatataagtgtaaaattgaatgtcgaataacatgttttcgttactttatgtgtgtcctcattttgttttatcggtgagtatattgaggtgattaaactctaagttggtgtacgtttcttttcctcaccccagacaataaaggccctatttttgtggtagtggttctattattgtttggtttacagcggggggggacatggaaaagggggatttaaacgggatttgcgggggaaataaccctaaaaaatatttttctataaaaaccacgcctatggaataattgcccccccactggctcccgggggggggaaaccccacaaataaaagaacaggggggggctaaaattttattttttttttgttgtgggggggggggtggggggggggttttccccacaaaagggggggagggagaaggggaacaaaaacccaaaaacaaaaaggggagggggcccccccctattttttttaaaaaaaaaaaaaaaaaaaaaacccccccgggaggaaaaagaaaaaaaaaaaaata

SEQ ID NO: 3883 - DNA, 1146 bp, Diabrotica virgifera
taaaatatgtttctaaacaaactgataagactgtatgatagcctataattttttctagtaaaaatttataaaaacagtgatttaatttcaattgcttcactttccacccacgcctccagtgttttagatataataaatatcaaaatggtccaagtgcccactgttaaatttaacaatggaaatgaaattcctatttttggtctaggaacatggaagtcaaaacctggtgaggtagctcaagcagtaaaagatgccatcgacatcggctacagacacatcgactgtgcttttgtctacggcaacgagaaagaagtaggtgaagctttggccgccaaattcgccgatggtaccgtgaaaagagaagatattttcatcaccagcaaactgtggaacacttaccacagacccgacttggttgaaaagtgcttgcaacagactttgagcaatttaggtatacaatacttggatctgtatttgatccactggcctatggcatacaaggaagacctcgatatttttccaagaagagaagatggttcaatcatctttagcgatgtagattatgtagacacgtggaaggaaatggaaaaagtacagcagaaaggtctcgttaagtccattggtgtctccaacttcaacgaaaaacagatcgaaagagttctaaagattgcaaagatcaagccagtcaacaatcaggtagaatgtcacccctacctcaaccaaaagaaactcatcgacttttgtagatccaaagacatcaccgtcacggcatatagtcctctgggatctcccgaccgcccgtttgccaaacccggcgatgttgagctcttacacgatcctaaactgaaagatctagctgccaaacacaacaagagtccagctcagattttactgaggtttcaagtcgaaaggggtgtcatagtcattcctaaatcagttaacaagggtagattggaacagaatatcgacattttcgatttttctttgagtaaagaagacttagcaacgttggagagctttgattgtgacggaaaattgatccgtcttgatgcggttcttgaacttcctcccccccatttcttccaatccataatttattaaattggtttttgttaaattaaaattttgaaccaaaaatcatttttt

SEQ ID NO: 3884 - DNA, 1228 bp, Diabrotica virgifera
agggggaaaattttccccccgcggtccgacccctcttcgtccgactagttctagatcgcgagcggccgcccttttttttttttttaatagtaatattataatataagtaatacaaactcgtaaaaaagtaaacatttacaatggtttaacagtatattgaatatattgcagagttctcagattaattgaaaacaggagccttctgtgaataatcacaaagctcttccagacactccgtgatatccctcttctggacaacagaatttgtcaacgccctccttacagtatcgctgtcgattgtcttcaaatttgaggcgcattctaatacttggaatatcctgatggtcttggagatagtatcgttagcatattgaccgtattcgctaacctgatagtcccaaggagcgatgtaatgataagccagccagttgcttttgttaagaataaagactagattcgtgtcgcatgggaatttttctcctttttttaatccccaaattgttatggcactgttgattaaccaggctaaattcaggttaataaaacctcttaaaaatcctagaataaatacagaactgtaaagtccttcattccaatattctacaggagcgttgattggcagtagaagagtgacaatcaggtagagggctatgtaatacttcttttgccacattactagtttatccttttcgagatcactcatatcaatttttttcagttctgcctcttgagcttcacttaagtgaagagttgtgctctgaatttgtgcgaagaaccaccctcttgagggattgtatgggtccaaatcagtttgaaaatatttgtgatgaagcctgtgccattgaacccattcatatacggaaccagttccagagagggtttgacaaaagatgaggaaagctctgagaataccatcagcggtgtaagtattatgtgcccatagcctatgtgccccagctgtaactcccagttgtcccagtaatactaaagctagcgtgaagagaagcgtcttccattgtgaatcatataaaaggaaatgaatcgtaaataaggacataagagtgatctgcaactggaataacaccttcatccagttcacatccctggttttcgacagcttagtttcctcatcctgcactacggtttggactacggtagtcgacatggtcttattctcaacggcgctttttaggaactaaacagcttgcatcacgcgcctgtatcgagc

SEQ ID NO: 3885 - DNA, 881 bp, Diabrotica virgifera
  misc_feature (827)..(827): n is a, c, g, or t
tttttgataatttttcactatttgtttatttctgtatagaaaattatctttaaggattattaaaatgactggaagtaaagtgtttttacctagtcgaggtttaggatatgtcagtaatcacatacctttacaagtgaggtatattaaaagtagacaagaaaacttaataataacctgtgttggaaagtcattccacacttatggaatatcccattttggcctactgagtgtaagtggtttgcatcacgatgatataaactgtatgactgcagacgcctatcatgtatacacagctgtagacaatgttatatatgcatggagaagaggtacagaactaaaacacacatataaaggccacaagaagaaagtgcgtctaatgatacctttcggtgctcatttgatatctgtggatgagtctaacaatgtcaaaatatgggatattaaagctgaaactgtatatttagaacttttgtttagcttagaaacttttaatatcagtgcgattcttcatcccagtacgtatatcaacaaaatattgctagctagtgatacaggcggtatgcagttatggaatatcaataatgcaaaaataatacatacatttagtagctggaaagctggtgtgagttgccttgcccaagcacctgcaattgatgtcgtagcagtgggtttagtaactggtagaataattcttcataatttaaaatatgatgaaaatgtcatggagttcacccaagactggggcatagttacttcaatatcattcaggacagatggcaaccccatcatggccactgggaaagtcatgtggacatattgtgttttgngatttagaagaaagaaaagtgtctactcagctattagctgctcatgatggatct

SEQ ID NO: 3886 - DNA, 778 bp, Diabrotica virgifera
aaaaaacccaacgagaacaatgactgaattaacatacatgagcggcttcggctcagaattacaatccgaagatccaagatgcccgggctccttgccaccagaccaaaacagtccacaaaaatgcccctatggtctgtacgccgagcagttatcgggatcagcctttactgctcctagatcagaaaataagagaacttggttctatagaattagaccgtctgtgttacataaaccatttgaatccatcaagagtagcgacgtgagtcataactgggatgaagaggaaccgaatccaaatcagttactatgggatccttttgaaatgccgccaaactccaaaaaagtagacttcgtagagggattacacactgtagcaggagctggtgattccaaatgcaaaactggccttgctattcatgtattttcctgcaacacatcaatgaagaacaaagctttctataatagtgatggtgattttctcatagtgccccaaactggaaatttacacataaaaacagaattcggtaaaataaaagccatccctaacgaaatagttgtcattcaacaaggaattcggtttcaaatagaagtagaaacagcttcccgaggttacatcctggaggttttcggtcgtcactttcgaattaccggatttgggtccaattggagccaacggattgggcaatcctagagactttttacatccgacagcttggtacgaagacgtagaggaaaatttcgaaagttgtttctaaatacaaaggaaaattgtttgtat

SEQ ID NO: 3887 - DNA, 904 bp, Diabrotica virgifera
  misc_feature (871)..(871): n is a, c, g, or t
  misc_feature (896)..(896): n is a, c, g, or t
gaaagaacaagttgtcccagatgttatagatcaagtgcctgagcatgtagttgaggtgcaatatcctggaggcgaaaaagtagattttggaaatgaattgacaccaacacaagtaaagcctcaacccactataacatggccagccgattcagattcctattacacagttctgatggttgacccagatgcaccaagtagaaaagaaccaaagtatagagaaatactccactggtccgtaggcaatgtactgggaaatgatgtagccaaaggtgaaacctttactgattatgtaggctctggagctccaaaaggatctggattacacagatatatctttttaatttataaacaaaatggaaaaattgagttcaatgaaccaaggatagacaatcggaccaaaaccggcagacttaatttttcgacaaggaaatatgcagagaagtacaaccttggtcaaccaatcgctggaaacttcttccaggcccagtttgacgaatgggtacttgaaatggaaagaacaattaagggttaaaaattgtatgccgttataaaattataaaaaatataaaaaacaaaaaaaaaaaaatagggctgaggtcattagaaggtttttaatattttgcgtataaaatattaaatattaaaatccgcaaaaatgcagggtatgtcattgaaatctcttgcaaaacataaagctttaattcctctatatttctgtgtcgctttgggatgtgctggtgcagctttctacaccactagattggctttaagaaatcccgatgtccaatgggagtagatcaggggacatttctaatgaagaatttaggcagaagcaatataaagtctatttcaccaatgttgattatctaanatggaaagtcagctccaagtattangatgactg

SEQ ID NO: 3888 - DNA, 1073 bp, Diabrotica virgifera
  misc_feature (65)..(65): n is a, c, g, or t
ctcaacagacactcgtattacggtatattatgtcgctagattcataacaggcataagcttatgangtggatacgttatacaaataacctttataagtgaaatagcgagtaaaaataccagaggttttgtttctacaattgcagctatgatgctcggggtaggagctttggccagttattgcattggaccatatgttccagtaacaactttaaatataattttagctgtcaatccattactagttattttggtagcgatcttgttttgcgaagaatctccctactactaccttatgaagaatcaaaccgaaaaagcgaaaaatgctttaaaagtatacagaaatccaggtgtaaacgttgacgaagaaattaaagaaataaaggagaacattgaagagcaaaactctggaaaattaatagaagtacttaaaactaaagcatttataaaaagttttattatagcaaatatgttgctcatttttcaacaatttactggtattaatggcataactatgtacagccaaacgatatttaataaaacaggctcaaatttatcccccgaaatttgctcaattattctcggagccctcaatctggctagtggttccatagctccgtttgtggctgaaagatttactagaagatttcttttgaatctctcagctgcaggaatgattatttgtgagtccgttttgggaatatattgtgttctagatgatgcaggaaaagtgtcgtcttcattaaaatttttacccatcgtttcattagccggtttcatgtttacatataactttggagtcggacccctttgctgggttgttatcagcgagatatttgttaccagggtaaaaacattcgctatgtccttctcagtatttatttactacattataggattctttattgctcaatattttaatcccgtatctgaagcaattggaataggagctgtgttccttatctttgctgggttgtggaatgcatttatattatttgtgggcttcaatgttatccaaactaatgcccaaaccgttgaaggaaattcaagaacaatttaggtagggaataaaaggt

SEQ ID NO: 3889 - DNA, 896 bp, Diabrotica virgifera
attacaaaaaaaaattcattttataaacatcattgttgtaggtgtaagttgtatgatcgttgttaagaagaccaaacgaggagggtgattgttaattattaagaataacaaatttaggaacagatccagttcaagtcagtagtcagtgtataaacaaaacaaatcagaaggaatactgaaggttgttgaggtcaattgtaataattacttattactttctcagaggagagaaacaacatgaacaaactttgccgccaagtttctatcgagtcacccgggccagtaatcaaagattgtgtcttcaattttgaaattccggttcccaatgttcctccaaatggagctaggattcgtgtagtatgcgctggtgcgtgctacagaatgagaaacagatcttcatctacatccagcgtatcttctattagcagtgtacaatctacagaagatacaggttatggtccagcacatcatggtgtaagagatggcgccttatttcctggatatgaagtagctggagttatcgatgagttggattctgccgtctcttcaaatgacttcaaagtgggaacgcgtgtgatactatatccgtatgaaggaattccacatggatatgcagagtacattgttgtccctgatctggaatatctagtaaaagtgccagattccttgccaatgagtgttgctgcaatgttgcccacaggtgctcttttggctaaaaacgcagtcgtcacagcccatcagcatgtcactgacttattaaaagatagggccgctgatcatatcgtaagaatccttattgttggtactggaggattagctttgtgggctcttaagatagctgaatatcactttaagaccccagaatacaaggacagagtaaaaattactgttgctac

SEQ ID NO: 3890 - DNA, 1343 bp, Diabrotica virgifera
  misc_feature (815)..(815): n is a, c, g, or t
cccatgcactgacacacttcaagacaaaaatactacgatggtgcagtacatttttttacttttattcctggttccaaatggagttttctgtgagaagggttttaattttgacatcccaccagattttcaccagaagttgatgcattttaaagaacaagctatccaagttcttgataccgctgggggaggaactcaatgtgccaaggacttaaaggaagtaatcaatgatacgtatgcaatgaaaaaatgggcgatagaaatgttagacgccatggcaaaatttcctagtggtatattatctggtaacatctttgtgatgggagcttacgatcaatgtgtaaatataaatatttttaatgacactgcgatacatggcgaatactgccccgtcttgttacaacctaaaactaaagaaggaaagataacaatagctaatgttcttgacttcttcaatttgaaaacgaattttcagaaaaatgttctcgaccaagcgatgagactaccttacggaatatgcgttccatcgagttgcagggaagagacacttcaagttatatgggatcacgcagaaacagtatttaaaccaccagtcagtctagaacttctggatgggctctgtactagtttagacagaagtccttctccgtttcctgttgacacctacattcaggcttttttcatattctacattgctcttcttgtattctgtacctggtatgatgtatgcattgacagatttaagcaagaacatgaatctaacagttttctggtatcattttcattcttctctaatgccaagaaactgataaaattanaggattcggaccaagatgatattcaggtggattgtatgtgtggaatcaaagtattttgtatgttatcagttatccatgggcaccgagtagcaactaatactctaactggcacacattatgctatccgtatagaatctgtcattctagttagagtattaggtgctactcggtgatcatggataactagagtaagatgcagatgctcatcgctatgaatataggggaggagacgatagatagaccaaaacaattatatgaatggcacatatggtgagcgaatggagtttgcgagcgaagagagcaatgctggtgtgatctgggtatactctactggtgtgagttgagcatcgcccagtgcgttggctgatgctatttctggatttatacgatgctgtgttaaggaatgtcaactctttgttgtgatatctttgaataatatgataaatgcctcatagtcccactgccctgctgagagctctacgtgaatagaagagtccagatacttccaactaggaaatttgggttacg

SEQ ID NO: 3891 - DNA, 529 bp, Diabrotica virgifera
accacgcgtccgcccacgcgtccgagtaaatcggtacttcagacgattacaacaaatttccataatgaaatccaccagtttttgtgtttctttgtcgatttttgttttgtttgttgttgctcaaaatttacccgtaggttacgctcttgaatgctaccaatgtgaagctaatgctgggataggttgtgaaaaaaactttacatcagttcttcatgaaaactgcacaactggtttttcctgcggtaaaactgtctggaaagttaacgatgtaacaagatatgaaagacgatgcgctgcttcaacatattgcgaggaccaaaaagcaatagcaacaagggaaaacagaacactcgttagttgcagtttgtgtaacgcgacattgtgcaactctggaaatcatgttaacattcctattttcaccttgataatatcattcttggtttcactcaaagtagtctgtaatttttaaataatattatttatataagcaaatattgtcatctttaattctaataaaaatggaatattt

SEQ ID NO: 3892 - DNA, 1480 bp, Diabrotica virgifera
attcggacgcgtgtatctttaagcagtgacatcgagtgttaggcttcaaagatgaaggtttttctaagtattagtattggactttttgtactttgttcaatagaatcaaggtctctaaatagcaagctttctaaaaagccaatatttaaagacttttacggaaagctaaacatagaagtaagaggaaaccctggagagccactgatattaactgacttgattaaagcagggaagctagatgaagctcagaaccaatcactcgtgcaaggattggacacagaggttaaaagttattccggctatttcactgttgataaaaatcatgattctaatatcttcttctggtttttcccttcacaaagtgatcccagttcggatccggttgttctatggctccaaggaggaccaggatctacatccatgtttggactttttcaagaaaatggacctcttacattaaaagatggtgagctgggtattagaccaacgtcttggaataggaatcactcagttatctacatcgatcagccagctggaactggatggagttatactaacggaggatacgccaaggatcaacataaagtagccactgatttgtacgaagccttgcagcaatttttcaccctcttctatcaataccaggagagagaattcttcgttacaggcgagtcttatgggggaaagtatgttcccgctataagctataaaattcaccaagaaaacgaggatgcaaagttgaagatcaatcttaaaggtttagctataggtaatggttttactgatcctaaagtacaagtgagatattcagactacgtctatcaacatggactcattgatttgaaaacgaaaaatgcgctccacaaaaaagaaaataaagctgtacaggatataacatcaggggagtactataatgcatttgagttatggaatgaaatcgtaggaactatacaagaatatacggaattagatatatacaactatctgtcacttaaaggaagcgctgctgatgaagaagagttaaacgagtttttcagtaaagaacaggtaagaaaagcaattcacgttggcagcactgaattcggcgatggtgaggtttatacaaatcttgaagaagatattcccaaatcggaggcacataaagtcgctgaactcttaaagcactatcgagttttaatctacaatgggcaaacagatcttatagttccttatgctttaacagtaaactatttgcagcaattacacttccctgggtctgaagaatacgcagaagcagacaggactgtatggcatgatgataacgattccgatgtggttgctgggtacgtgaaaacagctggaaagttaacagaaattatggttaggaattctggccatatggtaccgacagatcaaccagaatgggctttgcagctcattaataaatttacaagaaatataccttttaattaaatttaattaaaattatatagtatttaat

SEQ ID NO: 3893 - DNA, 1025 bp, Diabrotica virgifera
  misc_feature (960)..(960): n is a, c, g, or t
  misc_feature (963)..(964): n is a, c, g, or t
  misc_feature (976)..(976): n is a, c, g, or t
  misc_feature (986)..(988): n is a, c, g, or t
  misc_feature (998)..(999): n is a, c, g, or t
gtactgaaaacagaaatagtgtcgcatccgatatctgtgatactgattacaatgcttccgcagaaagtagtgatagcagtaggagaagttctatcgacatgccccaatatcagttaaatctacaagacgctaatggaaatggtgctgacgatgatgagagtgatgatcaacctgacagtttatcaaataattcgtccagaagagactcaactgtttcaacgtcaactagcaactctcaaaataatcttgatggtttgtcagaaggtttgcccgcaggttggagtattcaacgggctccaaatggccgtcttttctttattgatcataatgaacggacaacgtcttgggtagatcccagaactggacgagctagtccgatgcctaatcaaccggcagctccagtcatcactaagcggccagatgatgatttagggccgttgcctgaaggatgggaggaaagagtacattccgatggaagaatattcttcattgatcataatacaaggaccacacaatgggaagaccctaggttgtctaatcctcaaatagcaggacctgctataccttattccagagattataagagaaaatatgaatatatgaaaactcaacttaaaaaaccaaacaacgttccaaataaatttgagattaaaataagaaggaggagtatattagaagattcttaccgagtaataacatcagtatctagaatagagttactgaaaacaaaattatgggtggaattcgagggagaagtaggattagattatggcggcttagctagagaatggttctacctattatcaaaagaaatgtttaatccgtattatggtctctttgaatattctgcaatggacaattacactttacaaataaatccgttctcaggactttgcaacgaagatcatctcagctattttaaatttataggacgagtagcaggcatggccgtttacatgnaannatattagatgcngtctttatannngacttttatnnaaatgatgtaacgaaaagtattgatc

SEQ ID NO: 3894 - DNA, 1524 bp, Diabrotica virgifera
ttaaaatttcgtttcgtggctcgtgatttttttcacatttaacggtgaccgaagtgctcatttttcgtcatcagacggcttcagaaagtatttttcggctcacgttccacaaatcggaaacgatcggatatagtgaagaacctacaagcaagttgcgccttagagtcatttcgtgctaaaaatcttatcgaaaaaggacatttttcggagcaagtgatccatatcgtaagaattgatttaaatagcgttaatggtgatgagacaatcgattctgtccttacaaaaacaaagaaaaggactcttagtcctgagtggaatgaggaatttatatttagggttaaaccaggagaacacaagttggtgttacaagtttttgatgaaaatcggttaactagagatgattttttgggtatggttgaacttcccctgctaaatttaccaaaagaacaaccagaaagaaatataccacctgtcaagtatttgctgcaaccgaggagtgatttcagtgcccgttcaagggtgagaggtcatctggaactataccacgcgtttttgtttgattcaaatctacctccaatagctgctccggaagaacccagcgatgaacgagattgggagatcgtccacgaaggaagagaggaagaagcagcgcagcccttatacatcactccaacgacagactcgcagccaagtccgttgccatctggttgggaagaaagacaagatgccaatggacgaacgtattatgtcaatcatatagcaagaactactcagtgggagagaccaacattgagcaatcaggatattcacagtggagaaaccgaagaacaaagagaagtatttgaacgtcgttttcacataagtgccgatgaagaatcaaacgatcgtggtgatgtaaatcagagtgatgatcaacctgatagtttatcaaataattcgtccagaagagactcaactgtttcaacgtcaactagcaactctcaaaataatcttgatggtttgtcagaaggtttgcccgcaggttggagtattcaacgggctccaaatggccgtcttttctttattgatcataatgaacggacaacgtcttgggtagatcccagaactggacgagctagtccgatgcctaatcaaccggcagctccagtcatcactaagcggccagatgatgatttagggccggtgcctgaaggatgggaggaaagagtactttccgatggaagaatattcttcattgattattatacaaggaccacacaatgggaaaaaccctaagtttcttataccctccaaaataggacctgacccccctttttccaatttttccaaaaaaaaaattaaaaaaaaaaaaaaaatacaaaataaaaacccaaactctgtaccattaaaaatttgaggataaaaaaaaaaaggggggggttaattaaaaaattttttcccgagaaataaactctttatcctaaaaataaagtatcggaaaaaaaaaatttaggggggggaaattcgaagggaaaaaaaaagaat

SEQ ID NO: 3895 - DNA, 892 bp, Diabrotica virgifera
  misc_feature (665)..(665): n is a, c, g, or t
  misc_feature (737)..(737): n is a, c, g, or t
  misc_feature (793)..(793): n is a, c, g, or t
  misc_feature (810)..(810): n is a, c, g, or t
  misc_feature (820)..(822): n is a, c, g, or t
  misc_feature (844)..(844): n is a, c, g, or t
  misc_feature (869)..(869): n is a, c, g, or t
agattagaaataagtcgtagataaagtaaagtaaacacgtaattaaaaacatagatgagtatcaaatttagctgcgagtatcgaaaataattatgaccatagtttgaggtggtgttagtaagctcaagaatgattgcagaaattttgttaggtacagcattaacagcttccatagccgccctttcattggttagcttcaaattgtacataaaattaaccactggaatttgtcaaagtcaagtgtgccttgctggaaaaactgcaattgtgacaggagctaacacaggaattggttatgaaacagctttagacttcgcaaaaagaggtgccaaggtaattttggcctgtagagatgaagtcaaagcaaaagaagctgttgatacgattatcactgagacccacaataagaatgtcgtttatagactagttgatttaacaagttttaattcagtccgaaggtttgccaatgatataaatagtaatgaagacaggctggacatcttagtaaacaatgcaggagctggaaggttgggaaataaagagactgaagatggcatctcgattgttatgcagaccaactatttttcacactttttactcacttatttgttaatagatctaatgaagaaacacccaagcagaattgttaacgtatctgccattgnggccaaagtagggcacatatattttcgtaaactgacatcttttacaacagaagctaaccagtacattacgtncaaactgtgccaagtattgtttaccatggagctggcttctaggctttcaggaaccnacatacagcttattcgntacaccctgnnnggtataagacagagatttttangaatatttacacctttgataggtgntttatcctgtttttcattgatac

SEQ ID NO: 3896 - DNA, 628 bp, Diabrotica virgifera
cccctccccttttgcccgtccccgcgggttggcggtggttgttgcgcattttttggcaggcaagtgacaattttgtattcatcattggcgcgcctacgggtggtggtctgaatttttttggagagaaaatggtacgcgactgagatatttcaaattaagaattgtttttgtattcaacgtttaatttgtgaaaaagaacctttcttgtatttttttcgtatggtgcaccgtttttatgcgaaaaaataaagcatcttcgagcgtatttttcatttcttaatacatcatcaagagctctccaatataatagtgccagggtagaacaatgacggaaaagattactaaaaattttaactaggtgcagagctacaacaaatgttcaaggttgcctcctttgaaggtgacagaatgattttatattcaccgttggcgtactattttttctttaaaaaattcgggccattaccggtacgcgcgccagtggtgagtatgaaattgctctgtcacctttgaaggaggtaaatttgaacatttgttgtagccttgcacatagttaaaatctttttagagatattttctgttattgttctagtttggcgttgttatgttggagagttcttgatgatgt

SEQ ID NO: 3897 - DNA, 1565 bp, Diabrotica virgifera
ttttgggacacaaccataatatgcgttggtttattaaaaataataattctcctattaaagacttacattctcttattaaacacgaaaaatttacttgtatttgaattatttctattttactcattttcgcttttatggatcttattttgtgcgtggtcctagcgcactgtcataggctagtttacaaagagattaattttatccaatattaacatgaagatctggtctattgaagacatattcgacttaaaaccatcggcccattcaccaaggaaatcgtccacgtgggcatttagtacgcactgcgcgctattagcctaatttatattagggcggggacaaaagcattggctagtttattgtacaatctaacgggcctacaccggggacgtgcgccgtctattgttctacggcacgtgcctttcacgtctcgtcgtagaatgaattgggattgacacctactcctagtttataatgtgcgttctttgttaaaaaactacgctttcatattattaaatttaaaaacatttggagaccatattctcatccatagtaaactacacatataccgtgaaatattctcgtccagtattcctacaaatcttagtagtaacgtagagttgtatgagagtttaagacaatctatttacatggtggaatcattgcatgttttgtatacatttattattatacaattgcagcgttattttggatgaagtgaaaatcaatcctatattttgttatttcgcaaagttattttgatatagattttaagagatatttggaccatctgctatgagttatataatcaatagacattttacaatacatactcggcttgctcaattgaaacgtatcgttgatccagaaaaaatttataggtaaacataactacaaataactactatatttaaggcacatagtccattgtttccccaacccattatttaacctttgtaaagaattcttgtggctctagattgaagaattattttacgacattttgtatttcttcgtccatctgaaaacgattactttttaacgtcatttttagtggcccaaagacgtgaaaatcgtaaagcgataaatcggaactatagtgaggattctctaatattctctatttctattgttgtagattttttcacttcttcggcaacataaggcccagcattttcgtgcagaagaattacaagcttttctggacgttttggtcatattgcttgattaaccttgtttaaagtttcattatacaggttttcgttaatatgcactctaagtttcgtaaactcatggttcgtaaacgcaagggttcttcatgattgaaaaaacatgttaacatgaccttgcccgcagaaagttgaaattggtatgagcgcacgctgattatatttatatggattcagtcagttgagagattactattgtttccaaggctaacctgacaaagatatgtttcaattgaacaagcttatagttaattttcattagtgctttctattttatcataatatgtttgaaattggtatcttagtttggatttcacttcttcaattgtaacttat

SEQ ID NO: 3898 - DNA, 1674 bp, Diabrotica virgifera
tctcaaacgaccgacctccacacccatcgtcgtctttgagattagcattgttttcaataatctacaaggcttctttcatcacacgctatatcgatcacaataattacactctgcagtatatagaatacacattcaaacaacgaaatagtgcaattaaaatcaaaatggcagacagtaccacagaaataaatcaagaaagagtttatggaggatgcgaagggcccgatgctatgtacgtaaaattaatttcatcagatggtcatgaatttatagttaaaagagaacacgctcttacatctggcactatcaaagccatgttaagtggccctgggcagtttgccgaaaatgaagcaaatgaagtgaactttagagaaatcccatcccatgtactacaaaaggtctgcatgtatttcacctacaaagttcgttacacaaacagctccacagagatacctgaatttcctattgctccagaaattgcactagaattattgatggctgctaatttcttagactgttaaattatttattctaaaaaaaatgtgggttgttcattacttagctgtaaaatgcagttgctttttttttatttttacttcataataataataattagacgacaattgaaatcctgcacggataccagaagaagaaacaattattttgtctgccgaagttgattttttcatatgtttaaatagtttctataaagtttaaacaattacttttattgtataaatagatgattttgtggcagtaactcatatcattttccaatgtctcctgaaaaaaaactgctgctcaactacatttaaccctgcgttagtgcgatgggtaaatattagacagttagagcggtggggtgtgtagaaccccaacaaaaagtacaaagaaaaatttgaaaaaatcaaaaaatttcagaaataagataactaatctttactaaatgcctttatggcttcgatctaaaaaataacagtaaattgaaaaaatacaaatagtattctgaatatgtcaacaaagaacaccaaaatatttctagctagggtgtaccacaccctgccgcactaacgcaggtttaaggaagtctattgcatttttgtagtagagtaataaaatctatttttattagtcaagcagcttacaattcacgcaacatttcagtgttgccaaccagtatggcgaaaaaattcagtacgatgcgtaaatatctatatttgataacacatgatattggcactaagcttttcatatattatgttagtgacagttaactcatcttagttctatacatctaaagttcacttggactttcttcaattttaaaacattgcttgatgataataaaataacattttgttttctctagctggatatctcattgtttcgctttaggacaatacttctatggtataataatgacaggcaacattgcaattttttgttttattacagtgaatttaattttctatacttttgataaaaagttataatcaacttgagtaatgtggatcttagttgagcattgattaaaatgattttatttcattttatcactgagtatttccaaagaattttaagtcttgctcatttagttgaaccatttattattttgttctattagaaattgagcaatttctttatgctatctgataattttatatctagcatatt

SEQ ID NO: 3899 - DNA, 781 bp, Diabrotica virgifera
cgctctaaaattgataagaaattccccgcatcatactacccggtgaccgccgcgccagtatcggttcaggaaaggaaactctgcggcagacgccataaacaggattaagagagagatatccatatgtaggaacaaatgggtggtaactttcttccttgatataaaaaatgcttttaatagtggtaggtggaaaattatcgtcagactactgggcaacttgtgaatatctccctatctgcagaacttggtctgggactagttcacagatagatacatcaatattacgaggggtgactctatgaggagcatggcagatgtgctgcagggctccgtcctggggccattgctttggaatgttctgttaacgagattttggagatcttaacctggtcttggttttggagtattggagggttaagcaacttagttttaatatcactcaatataatgcttacatacgtagtgtacttcaatatctaataactataaaatatgacaccaagtgagaacaagtggcatttgtttagtgtttaattataattattaacaattattattgtaaacattaataatctatataaaaacctaattcactacaagataaaccttccaatagacctaaattgtattattttttcaggaaataataatatactttatgtacttcatcaacacatcataaactgtaaactaaaaatgtaaaatttctacccaattttgtaagcaattctgcaaaaacaactaaatgtaaagcattaaaggaaaaaaaaaagggggatac

SEQ ID NO: 3900 - DNA, 953 bp, Diabrotica virgifera
  misc_feature (901)..(901): n is a, c, g, or t
tttgaaacgtatttgttgttgaaaatttggaccgcattaagaaaaataataataattatgtcgggggatactccaaggaaactaaaaagattctctgaatcagataggacgtccgaatttgatgcagctacccaaaaagctctggaggagattgatatctgtcagaacgaaatagatagcataaacgaaaaatctagtgaagaaatactgaaaattgaacagaagtataatcagttacgaaagccctttttcgagaagaggaataatttaattagtaacattcctaacttctggattactgctatacaaaatcaccctgatttaagtgagctactagataatgaagaagaagattgcctccattttttgataaagatagaagtccaggaattcgaagacattaagtctggttattgtatcaagttttattttgaggaaaacccttacattgacaacacagtcattaccaagacatatcacttagattgtgctactccaacttcccaaagtaccagaattatatggaaggaaggctgcaacattggacaaaatattgaaccaccgaaatcaggaagaaaacgccgtattgaaaggtccaaaactttctttgggtggtttgttgataatgttgacccttacactgatgatattgcagaagtcatcaaagatgatctttggttgaatccactgcagtactacctggtagctgatgtagagggggatgcacatgtaagtgaaatatcaagcagcaatgatgaagaggaggaggagggggaagaagagagaagccaaaataactaagtctatttttttaccatgaagtattattgtcatacttccattttgatcagttgctgttggtatataattcttatataaataaaattgtgaagactcatanaatatattgtgccgcaatcattttaattttataaattgtgtcatcaaatctc

SEQ ID NO: 3901 - DNA, 1022 bp, Diabrotica virgifera
aatatcaacacgtattggttatgtataatagtgtacttaattccattaggaaataaatataaatcagggtcatgctttgtctgataataaatacattctctaattccccaaattagaaatccaatattatacaggggacccttatcaaataaagtttcagtgatcattttcaaaatgattttattatagtgtagtctaggaaactaaaataatatggcttactcagtaaacacaacacctttattacaagaacagtatgattcagacggtgaagacgatggcaatgatattcttgtgccccaagacagacccttatttaaggcagaacccatagataaattctatgccacctatatcatattttacatactgggtataatcagtttgctgccttggaatttttttataacagctgatgattattggatgtacaaatttagaaatgtaaccaacattactaacataagagacgctcctcctaaaaggtcgcctcttcaagcagaattcacttcgtaccttacattaacatcatgttacccaaatttggtgtttcttatcctcaatacagctattagtcaaagagtatcactaaataaaagagtgttgggatccctttcttgtatgttggctttaatgttattaacgctggtattcgtgaacatcaatactgatagttggcaacaatggttttttgtaataacactgatgacaagttttttgctgaacgtcttcagtcctatcttttgtggaagtctaataggcgtagtcgggaaattctcgcctatatacataacagccgtggtcggaggacaagccttgggtggcgtcttcgcagccgtaactcaaatagcctcattggccatcggagcctcatcctcgcataccgccttagtttatttcgtcataggaaatatcaccatagctttaggtatagttctgtacatagttctatctagatctgtatttttacgtacacacatctgaccagcctgtgataattaacgagttccaaggggaatcga

SEQ ID NO: 3902 - DNA, 1373 bp, Diabrotica virgifera
cgaaaatatcgaaaacactttagtttggatattcgtcgagtatgttgcgttgtttcgcgctagttttagctctcctgtcagcacagagcttccagtttgagtttaaacatcacaacaacgatgatctggtcgctgttttgcaggatgtgaacgcgagatgtccgaatatcactaggatctacactttgagtgagaattcagtgttggggttgccgctttatttcatcgagttttccactaacccagggcgtcatgaaattcttaaaccggagttcaaatacatcgctaatatgcacggaaacgaggttttgggcagggaattgctgctcaagctggcagatttcctctgcgatgagtacacgaagggaaataaacagattaggtctctaatcaggacgacgaggatccatctaatgccgagcatgaatcctgatggatggcaactggcaacggatactggtggccaggattatttgactggaagaacaaacaacaactcagtggatttaaataggaactttcccaatttagataggatcattttcacgaacgaagagcagcaccttaaccataacaaccatttgctagaagatctcacacacctggatcaaccactccagccagaaacaaaagctgtgattcgtcttataatgcaagttcccttcgtactatctgctaatttacatggaggggatcttgtagctaattacccctatgatgatagcagatctggcagacaaaatggagaatatactgccacgcctgatgatgaaacctttagacacttagcattatcgtattcctcttaccatgccgatatggcaaacccaaaaagaaaaggctgcggtgactacgaaagccaagattttcctaaacaaggtggtataacaaacggtgccaaatggtacgcactacaaggaggtatgcaagattttaattatctttcaagtaatgatatggaaattactttggagttaggctgtgaaaaatatccaccagcatctgaattagaacctgaatgggagagaaataaagatgctctcattaacttcatatggcaggctcatattggtgtaaagggagtagtatacgacaaccaatcaaagcgtggcattcccggagcagtaatacatgttagaaacattacagatttagaaaaatcatatgatatagaacacgacgtaacttcagttcatgatggagattactacagactgctgacaccaggcaaatacaagctcacagcctaccgagacggattcttgccccgatcgaaaatagtgactggtctgaataaaccccttcgaggagcacccagggtggatttccctctgaaaccaatcacgaagatcgagaagccttttgcatgatga

SEQ ID NO: 3903 - DNA, 831 bp, Diabrotica virgifera
cccacgcgtccgatggcggaaatgaatagcacgcgataagtgacatctctaaaaaaaatgtcaacaaccagggcggcgggcagtgcgaaaaaaagggggcatcaacatcaccctagaaacgaaggtaccaggaaaaggttagccctagaattaacacctgacaaacccttaagcgaatacagcgtaaataatgtagtgacagcgcaaaagtcgacaataataaataaaaacactgtgataaaagatagtgccttccctgaaaatagttcgaaaaacgtaatagccagtcaatcacaaagtcccacagaaagtaccatcaacaaatgtgatatagaagtgatagatttaacaaattgtgatgatgatgatgttaaagttattagtataaaggaaccaagtcctaccaaaacagatagttacgaaagttgtagtaaaagtttgaaagatgatcgtaatagtaaaattcgaaagcttaaaaagtctaggtctagtaaaaatgaaacccaaagtgaaactaaagaaaaacaagatatgtctcttgttcaaagaccagaagcagaaggttccagtcagagtgacatagaaaacgaacaaggtcctgttgatccagaaatcgaagagttatccaagctccgctgtacgtcagaaatgactgaagtggtagctgaaagggaaaaacgcagaaggaggtgtgctgattatccaggtctagcatttgccagttccatatttagttcggataccttaatgaagttttccattatcaaaaatgagctgcataatattatgaatacacaattaaagaagggctgaatccgaagttgccgccct

SEQ ID NO: 3904 - DNA, 1182 bp, Diabrotica virgifera
aacgtcactgtttgtcactagcgctttcagaaaggtggtcttgttgcataataacgttaaatctttaagatcaaaatttcaagatgctgaagcctgctaacgtccctggctactttagagcagttagccaagtagtaagtaaccaactcaacactggtaaacaggttgcgatactcccacaaaagtcagtggttcacataccatggtcgagcagttcaccctctgcccttagcaaagccctaccaacaggaaacatcgcagtttcagtaggaccagcagttagcagccaagtgaggtgtgctcataccgacattactgtaccagactttagccattatcgcagagatggtactaaagaccccgcaaaatcatcccatgatagtgaagatgctagaaagaattttacctatttgatggctggaggacttggcgttggtgcagcctatggtgccaaatcagtggtctcacaatttattagttctatgagtgcatctgctgatgtattggctttagctaagattgaaattaagctttctgatatccctgaaggcaagtctgttacctttaaatggagaggtaaacccctattcatccgccacagatccgcatccgaaatccaagcagaacaatccgttgcagttagttcccttcgtgacccccaacacgataacgaccgtgtccaaaacccatcgttcttgattgtaattggtgtatgcacccacttaggttgtgtcccaattgccaatgcaggagactttggaggttattactgtccatgccacggatcccattacgacgcctctggtcgcatccgtaaaggacctgctcctttgaacttggaagtaccaccttacaacttccccagtgaagatctattagttgttggttaaacgattttttaattaatagttgaattttacttgagtgacgtattatgaaactggaagaaaaagaatttttggcaagtttttgttaatttctgtttaaaacatttgtcaaaattttgagtgatagcgcgaacagtttaacaggactcatgctgggccaacatcagctttcattaatttttttctttttatgtctgggggtattggcggtttggtaaactctttttattcacttttttttttttccctcgcgcaaaaaattttttgtgttaaagggttccctttttcagggggg

SEQ ID NO: 3905 - DNA, 869 bp, Diabrotica virgifera
agtttttattgtcggttcctccacaggtattgactaactcagatttttataacaatgctagcagtcttgatcttctgtatacctatcttaataaaacaatttatcaaggaaaatatttagatcaggacgtttcttatatagactacagtcatgagaatatccagaaatacatggaagtatttggtacatttttagaagatttcttcaatcacactatcgatggtttggttttaaccgataactggccagcgaatgaagaatttaaaatggataatgacagttttccgtactttactaaagcattacaagatgccatgtcgtacaccattcaatggaacacaactgccaatgatatacttcacattcaaaagcacaactcctatggaggataccaatataaatccttaaaagattatttcaaaagtaaagaaatattcatactatcagcaacgaaatcaatcagtcaagtcgaacctatgatcatagagaacgtagaaacttcttggaccaatctcagaaaatatctggacagcgtgttattcgatagtataatcggcaaccatttggttagtatacctgtttgtggggataccaacgttttcgatacttcaattcaaatgaaactttgtttgagatggtacttgattgctgctaccatgccaatgtttagaatatctgctcctaaaccttggagaaatccagatgatttgtccgcctcatatgatcagcaaacagctcaatctgcgttagatacaagaaatatgttactagcctactacaacggtctcataagcagtaacgaaccagtgattagacctatgttctacgacttctacgaaaacaccaccacttttttctctgtatgagca

SEQ ID NO: 3906 - DNA, 296 bp, Diabrotica virgifera
tttggcgaactcgcgaacgatctccagggtctcgctccagcgggcgccgaggccgccgtattgggtggggatgctaagggccagcaagccgctttggcgcagggcgtcacgttcggtcttgggtgtgccgccgcgctcgtcgcgttcgacggcggtgagggcgaattcggcggccagcactttggctgtctgcaacggtgagggcaggacgctgttgggtttggctgtcacgcgggattcctcatggtgtgccggggcgtaccccggcagacggcaagtcaggccttggcttttgc

SEQ ID NO: 3907 - DNA, 1149 bp, Diabrotica virgifera
atcctatgtttttatttttatttatggcaaattttgattgtgtcatatgttttccaattccaataataagactaattcaagtgtaaaactctattaaacataaggatagtataatggaagtgctgtattttaagtataacacacaggatgacattaagtttattgatgttacagacagtatgactacatctaaggaacattttgtagatcatattaaagaaacttttgtacctaggttaaatggatccttttataggatccaagctagcaatggtgccatacaattgttggaaaagcatttatacatgaattcagagcaaactgaagcagctcaaaatttggttatcgaactgtacaggtgtttaagaaattgtgtaacaaacaagtcaacgcaagattatgtagctgaacagaccaacattttagcatttacaaaaacttacattcaaaaattagatcaacacaatgtatgcctaaaaatcatattgcagtttttaacaaacttaatatcgtcaaatcccgaagtaactagaaaagtacatacaaatttttcagacgtatttagtaaaataatagaaaacaagctgtgtttgtatgaaagtgcagcacttatttattattcagcattagtagtaccaccagatttaaattcaatcaagtgtatgttccaattagatgaaaaggataatgaaatcgaatatgtcttattcttttttgacaaatgtattacttataatgtttggtgggaatttatacacagttttgaaatttagcataaaataattatattaaaaacattaaggttacccccccaaattaaaaaaaaacaacattccctaccggatttaggaattgataaaattctaagtgggttttttaaaaaaaccaaaaatatttttttttaaataaaccaaaaccttgcccccacggaaaaaaaaaaaaaaaaccctccctggggggccattattttccccttgggctccagataaaaagaaaattttttgggaaaattcacggggaaataaaaaattttttttgaacgcgggggccgctctttgggtgttactttttttcccccaattttggggagggaagggggggataaatttttttttaactccctaatacaaaaaaatttttttttttccc

SEQ ID NO: 3908 - DNA, 1249 bp, Diabrotica virgifera
tttgcgtccgatattttttctactattctttccctgaatagacctttcttctcatcttttagcatccaccacttaaattttttgtggtcctctccgatatttttgtttagttgcgctttttacttcgatgtccagaacaagcagcttatgttgttggcttactgtctcactaactattaccttgcagtccttgcattcacgtatgccttctttccttatcctgaagtagtctatttgggattgatgttgtccacttttgtaggtacataataagcaaacatccttaaccatcttaaggaattcaagatgtggtcacacagaaatatgatttgcatctgaggagtagaacatgtttataatacatatggtctacaaagggctaatactaagacaacattattgatcagaatacggtgcagtacccaggtcacgtactgagaggtgaaaaatgccgcttactacagctgatgcctacaaattttaaagaagtcaatgatacctacaaatttgaaaattaacagccataagaagtgctatagtgatcgtcaacatccgtgagaccgggcaaggcacttaaaagaagaagtacctctttctttatcagactcgataccaccaatttctttatgcccgagcagcgacgacaaagttctttgttgaggttagccagttgcttaagagactgctgttcgttgctatcaagttattagagattcaaaattgacagatttcaatagaattcagtcattttgaatttttgttcacaaaaaaaaataaacaattaaaacggtctcctgtagaacaagttcttcatctcctgattagtaaagtcattgtgtcctaggaatgccatccaaaagtttaaaaagaaacaagttgtaagaataatattattatctctgaactatttttataactacaaatacttctgattattctaatttcttaataaccaggtatattgtaaatggatcaaaaacctattttgaaaaaactagtacctttcccattgggaccaaacagtaagaaaaaatggtccccccggggtctgataaatgggccttcctcttttttttttaaaaattttcctataccttttggtaaaaaaaaaaaagggaaaaaaaaaaaaaagtttgaacgcgttaaagatatttgttaaataaaaatcttttttttttctaaatggcgaaagttgttgggtaaaattttaaaagggaaaaaaaaaaaaaattttcccaaaatctcgccg

SEQ ID NO: 3909 - DNA, 1598 bp, Diabrotica virgifera
gtgaatagaaaatttgtgaataaggagacagtgtacgcctttacggagatacgcacggtatccttaataccgtaaggaataaatttatattaaagtattgtttttcaatcggttccttcttcaatatctcttaatccgtttaattcaagaagtcatcggactcggactcattttaataattgttttggggtttttgatcaagtactaacatttaagaaatcagccgtatatacagtgtaaatcgttaaaaatgtagtttaatctcaacaaacttttatgtttaacgtttaggaaaatttcttgtcaaatgttttcggatttctaatatcgattttttatcattcaatttatttcagcaaaattttaactcgttttttctgtcgcattgcaaactctcaattattttttttagcataacataatatgtatgtatacaagtgaataattttcatttatatttataccctttgcaacttttttgtgaataattatcatagttattggatgttaatatggatagaaaataatcttctttatgatgtcaacttataatttaaaagtattattatcaacaataatttagacagtgaacaatcaacaaaaatagctgtagtccattattagcgcaagtacaggaattgtgtagctgcacatagaaccttggaaccataggcgtatataacctgcagagctttacagaccaataaaacaaaatatatcaatcaatcatcagtaaaacctgaaagaaagtaatcccactctaatataatgaacataagggttcacattttgactatcaatttaaaaaacatgtggtatgtttttcttagttgagtatttgcaaaaacgccatgtacaaaacggtatagaatcatttaaattacattttgaaagttgtaaaaattaaaattaaaacgacataatgtcgatgacttaagacttcgccgaaagggaacagggggtagctcaagataataataagaattgtattactttcactgggaaaataaatagatgcatgagtgcagtgacaaaaaataagagatattcatatttcagtaacattagacaattatttataatgatctaaatgttgatattttcaagattagaaacgttgttctaacatgtacagcccattagatgtataaatgactttaattatattttataaactccaaggaactataatgtcctacaaatatacacgtttcgaatcttgaaaacttaatttaaccgtataaataggtgttgatactcgtttctattgatgtcaatatacatcaatagatagtcttcgcacaatttgtcgatcagttacgatgcgtggggaatttgttttttttttaaaaaaaatgggaaaaaaggaactttttatccaccattttcccggaaagggaaaacctttctcaaatgggaccccggtttttttaaaaataaacccaataaaaaagggaatccccaagggggagtgttcccctctaaaaaaaaaaattttttatcccttaaccctccacattcttttttttcttacaacgggctccccccacctccccccccagagaataaaaataataacacagccccaacgggggcgg

SEQ ID NO: 3910 - DNA, 478 bp, Diabrotica virgifera
gtttaatacaaaatgttcaaatatttcttactttttgtgattgctgtggctttggctgccgacacatatttgtctgacgacgaagagtttgaaaaattcaagaaagacttcaaccgaaattatgctactcctaatgaagaacagcaccgtaaaggaattttcgttaatactttaaataaaatcaaagagcacaacgccaaattcgaaaaaggagaaatttcttattcattaggcataaatcagttcgctgatcttacccacgaggaatttcaaagcagatacacgatgaaaaactgggtagagcaacggggaaaacttgcccagaaaactgctacccacaattaatgtacacaatgatcaaaacaaaaagtacagtttataggtaaatagatggagtgatggatgtgatacaaataattaactattaattaatttagagttattataacggttgtttcaatcaataaatttttacacg

SEQ ID NO: 3911 - DNA, 913 bp, Diabrotica virgifera
gcgttattagtggggccaatagtagtcaatcattagaagttctagaaatacaaaaacagaaaaaacatcaatcaaatagaaaccagcagccgaaatctgctcctcagtatacagctgatcctggtcagtcttaccgaaatcatccccagacgtcaggaaatcaaaagataagtaacaattttataaaaaactgttataagtgtggttctaatcatagtttaaacaagtgtccggcttatggattacggtgtaaaatttgtaataagtttaaccattttgcaaaagtttgtaatgctaatagttatagaaacagagtccataatgtaaatgtccatcaaagtgataccgattcagattctgatttttcgccagatcagttttttctaaataatataaatgaaaagtcttcagaaaagtggtatgaagactgttttataaataataaaataattgtatctttcagattagactcaggagcagactgttgtgttttgccatacacttattttaaaaaattaaatattcaaacttctgaacttactagtagcaccaataaaattactgattataatggaaaaataataaatacagtaggaagtgtatatttaaaagtcaggcaatgcaaaaataaagaaaatatagctaaattgaaattttatattgttaaaacacataatgatgcaatacttggccttgatgcctgtataatgttaaatttaattcagaaaaataatattaatgtaataaatgataatttacacaatgatattgagagtattagtcaaataattcatgaatatgatgatgcttttaggggtgtaggatgtttgaaaggaaacatacccataaaattgatgagaaagtagcccccagagtccatccacctaagaagggtacattttgcatgcatgac

SEQ ID NO: 3912 - DNA, 481 bp, Diabrotica virgifera
aaagttcggttaggttgattacctaataataatctttctttcgtgaattttataaatttttagaacttattctagaaaaatggctgttagctttgcccagaaacgtttcatgtccagcggactacaaaaatgggcatacaacttggctggtttcaacaggtatggtctgtggagagacgatcttctctacgaagattctgatgttgcagaagccctaaaacgtgtaccccagaagacaattgatgaaagaaactaccgtatccttagagccacccaactgtccctttctcatagtattttacccaaagaacagtggacaaaactagaagatgataaactatacctgactccatttgtcaaccaagttattaaagaaaaaaaagaacaagaagaatggaataaagtttattaattatatagtgaattgtagcaatttgtacaatatttatgtaagttatgtgttaaataaaatttagtcccg

SEQ ID NO: 3913 - DNA, 965 bp, Diabrotica virgifera
  misc_feature (797)..(798): n is a, c, g, or t
  misc_feature (864)..(864): n is a, c, g, or t
gctaaatccggccaagaatattattgaagaaatagatgcttttgttatgaagctcgttacaggacaggaggtggagattcaaaacaaaagccactctgacattggcaaaagaattattgctatgttcggtgacgcccaaaagagtattttaggtgatcaaactggagacgatagaaatcgtgaaaatgcagcgtttcctacaccttcatctagggaatttgttatgcgagttaatgctgtcaaaccggccatttattcggccaaatgtccacagttgctacgagctgttttaagtaaagatgagtttagattagttggtgctttttcggaggatacagctttcttttaacttctgctactcatgtataatcatgtatgatatatttgtatttttccttattatggtaagctacttggttattctttaggagataatgtgataagattatataaaatataaatttttaatcttcgtcttatttcaaagtggcatagcgcatagcctctgcctggatcttttataataccagatttagtcatttcataaaccgtaccaaaaagttatatcgttgttcacacatgatttcgtaagttaactacttcatgttctacaatggttttgcaaaagaaaccagagccaaagaaggagtcgtcttattaatacaccaggaacttggaacttcttcttcttcaggtgccgtcctcgttccgaagtttggctatcatcaaggctatgcgtatttttgataccgtagatctaaataattggcagctgctgcacttgtaccaatctcttnnaatcttcaaccatgaatggtttcttctgccaatggatcttttacctattatttttcccctgataantaattgtagtagctggtacttttgtccccctcatatatgtcccaagtattgcagtttgcgctttttatagtaagcgcaagttctttttctttctgcatcct

SEQ ID NO: 3914 - DNA, 920 bp, Diabrotica virgifera
  misc_feature (849)..(849): n is a, c, g, or t
tccgccgtctcgaattgctacatacaatacctacagatcctacaatatcctacaatattgtaggtgttttcagagactcgattacttcttctaaaatctagttttgtatgtcataccaacagcattcgttaatggttctgctttcctatattcgttatttttctatttatctgatatgatgtttgtgttctaagggtatcgagataatattctactatgatttgagtttatatcagcgccggggcaagtttttacagaaatttctgccaggaatttcgtcaaatttgaaaaatcattcaaatgttctgcacttgcagttttagaatcatgtgtgtagtatttattgtgattaatggtgtatgtgccaaccatggacgtgtaaataaattttattaaatctttatttatacgtccatggtgccaactattacggacatggttattaaatttactatatagttgctatttcagtgtttattatcgtatttgttgatttcagagctactgtaaaggaattaatgtcggtttaaatgatgatacattaggtggtataataaaatgtagtattgctcaatatttagctttagaaataaccaaaggtaatggtagagacaacagagctgtcacgagatattttccttggttatgtagtacttcaataacgcaacagagtccaagagaattcattgagtgcataggccatatacgacttctttcatggcttttactgggatcgctaacacatacggcattacagggtaacaacaataataactgtcaaatattaagtcagccaattccccaagaagcttcttgtcaaatcgctgaccacattcaagtgataatggnctggttttgccgaacaaccaaaaggcatctataatacatatgtcgtcgctatttcatacattcattttatg

SEQ ID NO: 3915 - DNA, 894 bp, Diabrotica virgifera
acaactttaccagctttagtcggaatgttgtttacgggaatagcattgcagaatttaaatattgtcaacatagactcttctttttctcatctcaataaacatctaagtgctgttgctctagtaatcattttaactcgagcaggattggacctagatcccactgctgttaatagacttaaatttaccgtactaaaactatcagtaattccatggacagcagaagcttgtttaactgttattttagccaaattttggttaggtactagttggaaatattcaatattattaggtagcataatagcggctgtggctcctgccgttgtagtgccatgcctctttagactacgttccaaaggatatggagttgtgaaaggcattccaacgctaattatagcagtcgcaggtatcgacgatgcactctcggtagccatttttggagttgtgttgggtattatatttactggtgcgagtgtagccaaaggaataattttcggaagcctctcaatactagcaggtattggtataggtgtaatatggggaattatttgtaacatcacacctgaaagaaacgatccatttgcatcacctttgagaattctacttctcctttctggcggtctagctggagtctttggtagtgagctagtaggatatggtggcgcaggtcctttaatatgtgtcacagctgcatttgtggctctaaccaattggtccaaacaggggtggcatgtagaagaaaacccagcggctttggcatttgaaatattttggatgatttttcagcccattttgttcggaataaccggatccagaataaaaataaatgagatggatggtaacgtagtattagtctctttgggaatattggcgattgttgtcgtagtccgcatagca

SEQ ID NO: 3916 - DNA, 1614 bp, Diabrotica virgifera
ctagttctagatcgcgagcggccgcccttttttttttttaaaacacgttctagcctagaaggggttcatatcagtataaatatttataaaatacaatggctaagtttcacttaagaaaaaagtctaaacgacagccagcgcgtctcagatataagattgaaaagaaagtccgagagcacaacagaaaactcaagaaagaaaataagaacaaccctaaaaagaaaaaggaaataatgcaaatcccaaacatatgtccttttaaagaggacattcttaaagaagtagaagcactaaagaaacaaaaggaagaagaaaaacttaagctaagagaagctgcaaaattggaaaggcaaaaggagaaagaggaaagtaaaaaagagaaacttactgcaggacttcagggattagtgcaaaatgctgaactaaggagtaaacttcatgaacatttaacaccagataataatgtaaaacagcacgagacaaataatgagcagtccctgaaacaatattacaaagagtttaagaaggttatcgaagctgcagatgttattctagaagtagttgacgctagagatcctttagggactagatgtaagcaagtagagcaggctgtgttagatacaaaaggtaataaaagactagtcttagtattaaacaaggcagacttagttcctagagaaattttggatcaatggctaaagtacttgaagaaaaccactcccactatagcattcaaagcatcaactcaaaatcaaagtaaaaagttaggacagagaaagcttggaaagggaaataaggtattgcagagttcaaattctgtaggagcagaattgttaatgtctctgctagcaaactattgtaggaacaagggtatcaaaacttctataagagttggaattgtaggtttgcctaatgtaggaaaaagttcaattattaacagcttaaaaaggtctagagcttgtaatgttggtgctacacctggtgttactagggcaatgcaggaagtacaattagactcaaagataaaacttttggattctcctggtatagtttttgcatctggaaatgacagtagtgcttctttgagaaatgcagttcgaatttctgccttgagtgatcctgtaacacctgcaaatgcaattttacaaagagtaactaaacaacaaatgatggaaatgtatgatgttactgaatatagcacaccagagaattttatagtttaaaagctgcaaggactggaagatttaagaaaaggtgggggtcctgatgctattgctttgcccaagtttattaaaaaatggaaaaaatgaaaaatcaagacttatacagaccactgggggagctcaaaaaaaagggccctttagggatcaattggccctgaaaaaattaaaaaattcacttgggagagttccaggttttgggaaatgaacttttaaaaaaaaacaaaaaaaaaaaaaaaaaaaaaaaaaaaaaattttttttttgaaaaaatttgggggccccgtaatttttttttgtggggaatgggaaaaaaaaaaaaaagaaaaaaaagagaaaaaaaaaaatttaataaaatggaaaaaaaaaaaaaaaaaagaacgctttttctcctat

SEQ ID NO: 3917 - DNA, 843 bp, Diabrotica virgifera
ctcataatattatgccaaaaatttaaaatagtatttcgaggagaaattctttataaaaaaaattgtatctttctttatatttctggtgatatttatgaaaaacacaccagcaatatgtttgctatatcgaggagatcaatagctgctttaacacaaatcagatcaaagacagacaaggccgttttggacgaaattattcgagtagatcatgctggagaattgggagcagatcgtatttatgcaggccagatgttcattctaggcagcacttcaaaagcacctttgataagacatatgtgggaacaagaaaaacatcacaaagctacattcgaagatctaattagaaaaaaacgtgttagacctacagtaatgactcctatttggaatgttgcaggcttcgccttaggagcaggatcagcattgcttggagacaaagcagctatggcgtgtactgtggctgtcgaaacagtaattgtagatcattataatgaccaactgagaactctgttggaagatccagagtgtgataaagagcttgtagaaactattaagaagtttagagacgaggaacaagaacatcatgaccatggcattgatcagggagcaaagcagactcctttttatgaagcgtttactaatgtcattaaagctggatgcaaagcagctatagcaatatcgaaagtagtttaacttgtgtttatgtacatattatgtagttgattgtgaaatatatgttgttaaatttgtaaagtattgacagtattatatatttttggatataaagttagtcccactatgtgtacagaaaaatctaataaaataaaatcaatttaaatacagatt

SEQ ID NO: 3918 - DNA, 841 bp, Diabrotica virgifera
tttgtccgggaacctataactgccagtccggaaccatttgagtacccgccaataacaaaacggatgttaccttttcagtgaaccacgaacttggtacctacatagaagcatggctgctgtttaatttatggttaaaaaattattttgtgactgtgttagtttatatattgttgttgttatcgctggattaaaacttcaagatgagtgatagtgaacccgcaattgcttttaaggatcttcctctaacttttaaggtgaaatatttaggtcgacatccagccaaaggtctctggggaatgaagcacacgagaaaaccagtagactacttagtatctcaggcaaaaaatcttcctcccgatgtcattctccctataatcgatttcaaagtcacccaagacggcgtcagctatgttgagtccgcaaataaaaaagtagaatcagagccagtgaagtttgctgtggacaaaatatcgtacggtgtgcaggatttggtatatactagagtttttagtatgattgtagttacagatgacaccctcgacaacggtatcccttttgtttgtcatagtttcgtttgtgaatctagggaccaagctagaaggatcacctacgctttagcagcagcttttcaagattatggtaggaaggttaagtccgagaatggggaaaggactgttaaaaagtttgctatcgatttacgaacgccagaagagcaggctgctgcttcggatggagaaactgacgcttaaatatttcctaatttgttttatgacaaagctgtttttgatatttttagaacttaatgttttcccttatttccaaaattaaatattggtttagg

SEQ ID NO: 3919 - DNA, 1545 bp, Diabrotica virgifera
tcaaaatcctgaaaagatgactggttaattttgcaatttcagagagatatactttgtttttaataaataagtagaacaaaaagtgtacaatgggacaaaatcaatctggaccaggaggtggtgacaagaaggaagaaaaggacaaaaagaaaaagtatgagcccccaattcccactcgcgttggcaagaagaaaaggcgtactaagggacccgacacagctttaaaactaccagcggttactcctcatacaagatgccggttgaaactattaaagttggaaagaataaaggattatttgcttatggaagaagagttcatcagaaaccaagaaaggctgaaaccacaagaagaaaaaaatgaggaggagagatcgaaggttgatgatcttagaggaactcccatgtctgttggtacattggaagaaatcattgatgacaaccatgcaattgtttccacatcagtaggcagtgaacattacgtgagcattttatcctttgttgacaaggatcaacttgaaccaggatgttcagtacttttgaaccataaggtgcacgccgttgtaggtgttttaggtgatgatactgacccaatggtaacagtaatgaagcttgaaaaagctcctcaagaaacctatgccgatattggtggtctagatacacagattcaagaaattaaagaatctgttgaattacctcttacccatcctgagtattatgaagaaatgggtatcaaaccacctaaaggtgttatcctttatggccctccaggtactggaaaaactcttctggcaaaagctgttgctaaccagacttctgcaacatttttgagggttgttggttcagaacttatacaaaaatatttgggtgatggacctaaactagtccgagaattatttagggtagctgaagagcatgctccttccattgtatttatagatgaaatcgacgctgttggtacgaagaggtacgattccaattctggcggtgaaagagaaattcagagaactatgttagagttattgaatcagttggatggattcgattcaaggggcgacgtaaaggttatcatggcgacgaaccgtatagaaactctagatcctgcccttattagacctggtcgtatcgatagaaagatcgagttccctctccccgacgaaaagacaaagaaacgcattttcaacatcacacgtctcgtatgacccttggctgaagacgtcaacttacaagagctcataatggccaaggacgatcttttcgggagcagacattaaagcttatttgtactgaaagcgggtccaaatggcgttgccaagaaaaacaaaggaaaggggatgaatgaaaatttccaaaaaacccaaggaaagccgggctttttttcctaaaaaaggaaaggccccccccgaaaaggacccctatttttttaaaataccttaatgttttagggttgcgcaatttttaactttttttttttttattttttttgggaaataaaaaaattttttttataaaaattatttaaaaaaaaaaaaaaaaaaaagagggggg

SEQ ID NO: 3920 - DNA, 998 bp, Diabrotica virgifera
cttttaacgcggccgcgctcacagaagaagataaacatcaagtttgtcttaccttgcaaaaaataatcttgatttaatttgaactggataaacaataatgtaaacatttatttgattgggatctatttggtagaatattgttcccgttaaaatgtcttgtagctacgcagatggtttgtcccattatgaaaataaaggagttctaggtgttccagaacaatttgattcagaaaagaaggttgatgagaagtgtgaggttttggcccaatggatcaagaattctaaacatatagttctccacactggtgcagggataagtacatctgctggtataccagattttaggggccctaatggagtctggacgttagagaaggaaggaaagaaaccaaatattaatatttcatttaatgaagcaattcctaccaaaactcacatggccatcaagcatttgttggacaaaaatattattcactacgtaataagccaaaatatagatggacttcacttaaagagtggcgtttctagaacacatatggctgaattacatgggaacatgtttattggtcaatgtaacacttgtgaaagccaatttgttagaccagaagctacctcaactgttggcaagaaatgcctaaatgaagattgtaaaagatcctctatgctacgaggacgtacttgtagaggtaaactacacgatacaattctagattgggaggacagtttaccggaatatgacttggaaatgtccgattatcattccagtctagctgatttaaatatttgtttgggtaccacccttcagatagttcctagtggtaatctacctcttcgatgttaaaaatatggcggaaaagtagctatagtgaatctccaacctaccaaacatgataaaaaggtagatttaataatcaatagctatgtagatgacgtcatatcaagaataatgaaaaaactaggtctcgaaattccggatattctaccgaagtcgatccaac

SEQ ID NO: 3921 - DNA, 3198 bp, Diabrotica virgifera
gggaggcgccaacggctcatccccttctgctggtcgccgtcttcgtggtcatgtgtgctgccataccgcactctatcatggccatagatcttagccgtctctacggacatgtcagctcaaaaagaggtgacgcgtgccacccatacgaaccattcaaatgtccaggggacggcaactgtatctccatccagtatttgtgcgatggggcgccagactgccctgacgggtacgacgaagactcaaggctttgtacggctgccaaaagaccgcccgtggaagagacggaagttttcttaaatcgcttctccaaagccatggtccgaactatttggagaaattgttcggaagcaaagctcgagatgcactgaaaccactaggtggagtagacaaagttgcaatagcattatcagaatcacaaacaattgaagattttggagcagcgttacatctgatgcgatcagacttggaacatttacgttccgtgtttatagcagtagaaaacggagatctgggaatgttaaaatcattgggaataaaagattccgagttgggtgatgtgaaatttttcttggagaaactcgtgaataccggatttttagactgaaccatatttgaccctgctgctattttcttcgctcatccccaaccccatctacccttaagtaaaaacttttattcctatcttccatattaagtatctttctgtctgtctgtctacttcattgttcagcagcagagtccgttaaactccgtcccctgtctacaccatcccttaaccaacggctcgttttcccaaaccaaccactaataaaaatggtagaagagtaattttacgcatttgtttctttaaaaattatttacaaaacaaaaaatataaacgttggcctctcaataacaccaaactttacactaaaagggtggccttagacattttaaggtttttggggaagcgagcctggttatgttttttactctgctggacagccctttctgctgtctcaaaggctggctgcacataaccaaggccaacaacaattttgaacttatgacaaacatatcaaagcaccaaaaggtctttgtaaacggcacatatcataactaagtatattgttagtctataagacaattttaaaacacagatttatatatatatatatactagtacatatagtttttattaatgttttagacatctgaatgtttttcaaagaatgtatctctttttgtcaaacaccttatgaacttaagtgagataactagctacatgttggacttaccaaagactttcctttttacttaattcaacaacgatatcttaaagaaaatagatttaaatatataatatgccacgacctaaccacatcaataaaatagctaaatgtgtgatagtgcttcgtgtagttttaaaaaattgctaacaaaatgttcatcgacaatcagcgcatatattacaagtttacgctttcagccatagtatttatgaaagcaattaagttttaattaacgaatctgagctaaaacctgatccataatttcacaggtacagtgtcatattttgtaggtcaatcagaaacccttgtgggggaattgaggtgtgaactttgtagtaggtgaatagaattcaatgaatactgaattgtgaatgtcgcaatggatataaaaattgagctaaactgaacattgtaaatgattttttaaaagaccttcattggaactattatagcccgatttttcaattaaaaagcgtaatttaaaatatgcgtctatttatattattctttcactttatctctctcccacaattcaattttggctgcttttgcctgagatctataagttaactcttcgacatacatcgattagatatacatatatattgataagtttgaaagttttttattgcacacataattgcattctttctttaaaaacaaattctagacgtaattcttcagactaaaagcatagtcacgaaagaatttatgctaagaaaatctgttgtgcaatgccacttagatagtaagtattatacagatgtcctaccaatgtatcttactacagtctatttacagtcatttctacgcagaccatcactttcctgtcaatttatagaaatgaaatttcatgttgtgcataccttaaataaataaaatcataaccaaaactacctcatatatctcagttaaattgtgacaaaaatgtattacaacaatcaaaattggtacacaatgattgggtctttcacgatcctgttattgatttattattaccatctatatttgttggttcagtgtaattggttttttatcataaaaacccttttaattaatacgattcttcttaaaatttcaataaaacatttgtagcaaaggaacatactcttggaatgttgtcaattttatgataaagtatcaagttctccgaaattgaatttacctaattggtcagtggtgtacttactgtattttaatccagaatctataaacagtttttaaaaagttgtgatatataaatagaacgggatgtttttggtaggctctttacagcaattattgtggcactagtcatagattttaagagtgtattattaaacatatcaaataccggctggccggtttatgttgcccaagaactcctcacctgggtctaaaaaatttgagatcatgctaaaactttgttgcaataggtgcagggtaacaaagtgctggcctaccttaactttaccaacttaggggggaattcagggcatttattaagcaacgacactgcgggttaataggaagcgctttgaagggcctaatgcgcaaccccctggaaactcatagtgtccattttgtgatttttggatatataattaaaaattctgattgccacccactccaaaaaaaacaacctgacccttacccatcaaatatttttgggagtgtgaaacaccccatctataacaaaaaccaatcacattccgcaaaacggaaaaaatttaatccataattgttggtacagtgttccttcaaacccattacacccctaaactcaattcaaaaaaaaaaattaattgggctaacgggcaaatcgcaaaaaaatatccaaaaattttaagaaaatctaacatttcccccaatcatttaaaacatacttaaaaatttaaattttttttctcttataaaaaaaactaatattaaaacaacaaaacacaaa

SEQ ID NO: 3922 - DNA, 1133 bp, Diabrotica virgifera
acgcgtccaaggacacgtgggttagattctgcagtctgccttcttgtcgaagttggaccatgttgggtgctgtggcaagagcaacttccagccttttggctggaaaatccatcgaaaaagttggttccgaatcccttaaaattgtctcttcatacaatgttcaaaaaagagacttcgctgccaaggctgctgccggtaaggcacaaggaaaagttgtagcggtcattggtgccgtcgttgacgtacaattcgatgaagaactacccccaattctaaatgcattggaagtacaaaaccgacaacctaggctgttccttgaagctgatcttcatttgctagaaaattcagatttttatagtgctataaatattttagataatttttttgtaatgaaatgttattcgtttttaaatatatctaattttttaagaaataaattaaatttatttattaacaatatatttataattaaatatttttatattattaatattaaatatttttagggatgagcttaaaaataaaattttattaaaatttaatttttaaataaaaattaggaaaaaattttcatattttaaaatatgttattatttatttttatatattattatttttattttttataaattttttattaaaatataaatttaaattatttaaatttagtaatgatgataatattagtattaaaaaattgtatatttagtataaatatataggtttaataaaggaattcggcaacatttttttcacctgtttattaaaaacatgtctttttgtattaaatataaagtctcgcctgcccactgattaatttgaatggccgcggtattttgaccgtgctaaggtagcataatcattagtttttttattgaatgatgtaatgaaaggatgtatgaaaaaaataatgcctttatttaattttaaagaattttatttttaagtcaagatttttaattatattaaaagaagagaagacccaacaaagctttataccttaatgaaatccctttttactgggaaattacccataaaaaacttttttttattaagggctgatttaggatccaccaaacctctttttaggacaaccctttaatcaaaaaatttttataaacacttttttcccc

SEQ ID NO: 3923 - DNA, 1124 bp, Diabrotica virgifera
agtacttatatataattatttatataaatacaaataagggagcagtaactttaaatatattcacacattgtcttatgggggagcttttttttataaaataaaaataggggcttttaattatttattttcaatctttttttatacagcagaactaacagcagaactttgacttaaaaaatttctcctaacccccaatttgacccccaaaaaaattccttcccctggttaggattgtctcttgtggcaggtcgttctgggtgctactccaaatccatggacgcctcctatttgatctgggaaaagagattttaaaaatgaaggtgtttggataagtacaggaccacccatttcttgagggtatttgtacattaggaaatagtacaaatgtcctactaatataccaaagagttccataattcctcctccacttaggaccaagttgaatgctagcaatacccaaggaaggtagattgctttaaaacgggttccaaaccaaaatgacacaattgtttctttatttaactggcaccagatgtatagaacagaaagaatcatagggtccatcaggataggtaattcagctactaatccaagtacaacacaacatgtccagttgaaaatcaacaaaaagagatagtctgctggtttgcttgcatactgaccttcttccaaacgtctggaataattatacaaaaaatataaattgatgagatagtgaaaaccagcctgttgaattggataatataaaacgcttgtaacaagcctccataactgaaagctttttaaaggttcatataacagaattaaattgtatggatttatgaaaccgaatcgccctaaaagtgtgaataatattgaaccagcaaaccagtatcttgtaaaaatgggaacactcctaaaccattcacccaaatctgacattttttattttttgtcagtacacttgtaggaaatttaaaacataaataactttctagaactttagtattataattatgttgacatggttttaacaagttttaagtttaagaatgattttcacaaaatctaaaagtgtcgtggctctttatgcgtgggtaataaactgggcggacgcgttaacacgacgtctttgtagagtcttg

SEQ ID NO: 3924 - DNA, 2081 bp, Diabrotica virgifera
cccacgcgtccggtgcctactagcggagttgaatcgaattatttaaacttcattctgtagtctgcgttcttgtcgaagttggaccatgttgggtgctgtggcaagagcaacttccagccttttggctggaaaatccatcgaaaaagttggttccgaatcccttaaaattgtctcttcatacaatgttcaaaaaagagacttcgctgccaaggctgctgccggtaaggcacaaggaaaagttgtagcggtcattggtgccgtcgttgacgtacaattcgatgaagaactacccccaattctaaatgcattggaagtacaaaaccgtcaacctaggctggtccttgaagttgctcagcatttgggagagaacacagtccgtactattgctatggatggtactgaaggtattgtccgtggtcaacaggttaacgacacaggatacccaatccgtatccctgttggtgaagcaaccctgggccgtatcatgaatgtcattggtgaacctattgatgaaaggggtcctattgatacagacaagagagcttccatccacgctgaagcccctgaattcgttgacatgagtgtagagcaagaaatcttggtaactggtattaaggtagtagaccttttagccccttacgctaagggtggtaagattggtctctttggaggtgctggagtaggaaaaactgtactgattatggaacttattaacaacgtagctaaagcccatggtggttactcagtattcgctggagtaggagaacgtacccgtgaaggtaacgatttataccatgaaatgattgaatctggagtaatctccttaaaagataagacctccaaagtagccttggtctacggacaaatgaacgaacccccaggcgctcgtgctcgtgtagctttgactggattaactgttgctgaatatttccgtgatcaagaaggacaagatgtactgcttttcattgacaacattttcagatttactcaagctggttcagaggtatctgccttgttgggtcgtatcccctctgctgtaggttaccagcctactttggccactgacatgggtagcatgcaggaacgtattaccaccaccaagaagggttccattacatcagtacaggctatctatgtacctgctgatgacttgacagatcctgccccagccaccacattcgctcacttggacgccaccactgtattgtcccgtgccattgctgaattgggtatctacccagctgtagatcctttggattccacctcacgtatcatggaccccaacattattggagccgaacattacaaagttgctcgtgatgtacaaaagatcttgcaagattataaatcactacaggatattattgctatcttgggtatggatgaattgtctgaagatgacaaacttactgtatctcgtgctagaaagatccaacgtttcctttcacaacctttccaagttgctgaagtcttcactggtcatgctggaaaacttgttcctcttgaagaaaccattaagggattccaaaagattcttgctggtgaattagatcacttaccagaagtcgccttctacatggtaggacccattgaagaggttgtccaaaaggcagaaaaattagctgaatctacataaatgctaggataactttgtatatttatttgtatgtgattccatcaatctgcagagagaaagatgtttctttttattaagatcatgtaaagaacttttcattacactaccagattttttttatatcgaaaatttttgtttattagccctaatttcatctgtcatgggtattgttgtatttttaattaatccataaataaaatagatctaaaaaaaattttttccacaaacaaaaaaaaaaaaagggggggggcccgcttctaaaaagggaccaaaaggttttaccgtaacggcgggggagtgggcacacccccctatatcttccttctttataatggggtccccccatataatttctatattttcccccggggcccccggtgcctttttttaaaaaacgccctgggggcctggggggaaaaaaacccctcgggggggtgataccccc

SEQ ID NO: 3925 - DNA, 953 bp, Diabrotica virgifera
cggacgcgtgggctaattatgacaaacaaaaagttattattaacgtttttatttgcgctcatatgtgcttctcgggcacaatacaaagcagattgggatagtttggattcaagacctcttccatcttggtttgatgaagccaaaattggtatttttcttcactggggcgttttttcagtgccaagcttctcatctgaatggttttggtcttattggagctcgggagattcagaggttgtgaattacttaaaaaattattattctcccaactggaagtaccaaaactttgcaaaggactttacagctgaattttatgatcctaatgagtgggcagaaattttcgctaattctggagcaaaatacattgtcttaaccagtaaacatcatgaggggtactgtctatggccatcaaaatactcatatagttggaatgctcaagatgttggaccaggaagagatattcttggtgaacttgcaacagcagtaagggctaagaatctcaaattcggtttataccactcctattatgaatggttcaatcaactatatctagctgacaaagccaatggatataaaacacaagattttgtagaccgcaagacagatcccgaattaagggagcttgtaaacacctacaaaccttccgttatatgggctgacggtgactgggatgctccagacacttactggaaatctaaagaattcttggcatggctgtacaacgaaagcccagtcaaagatgaagtagtagtaaacgatagatggggatctggaattccctgtactcatggaggatttttctcatgtcaagatagatacaatccaggtactcttcaacaacacaagtgggaaaatgctatgacaattgatcacaaatcttgggggatttagaagaaacgctaactgtctgactacatgaccatagaaaactcttagcacttctggtcccgcgc

SEQ ID NO: 3926 - DNA, 1327 bp, Diabrotica virgifera
ccgctcgcgcccacgcgtccgcccaaaataaataaagtttttttctgataatatataatcaaaatgcccaaacataaaattgataaacaaaaagctgttactttccaactggtacacagaagtcagcaagatcctttgatagcagatgaggatgcaccccaaagggtacttttgccaattaaaggcaagcagagaaatactgaagatttgtttaaaaataaacaaaaagcagagtcaattatagatgaaggggatgatgatgaagactttagtgatgatatggaagagtcagaaggcgaagatcaagaaaaagtgaaggaattgaaggtaaagttcaaattaccaacaacagtgtttccatccgaggtcgaggaggaggttggaatgctaggaaaggcagctcctgtatcaggtccgcagctccacttggatccagatgtagtagctgctatggatgaggactttgattactcagatcctgaaaaccaacttgaagacaactttatagaattagctaatgctgttggttcaggccatatgaatgaagatgatgatgaatatgatgacaatatgtcgggttacaactctgaagatctagatgaagttaattcccttttagggtctgatgcgtcatttgaaaaagaagaaactaaatccagatttacaaattactcagttactagttctgttatgagaagaaacgaccaacttagtttgttagatgagcggtttgaaaagatgttcgttggctatgatgaaaatgaaatagggggctttagattgtgaaaaaaattgaaggtgacgtatcggcagatgatataattacaacgttgtgtaaaccaatttttcaaaagtccccaaactaaacgaaaaaaaaaaaaaaaggaaaagcgctctagcgaattaaaatttcaagaaaacaaccttggaaattacccccctggaggaaaaaagaaattgtgtagaaagttggttgaacaatcccaaagggaaaaatgggggactgttaaaagaaattctgaacactttttctcaaaaatttataaaatcttcccgaaagttgattcctcaaaacccaaaaaccgggaaaaattaaaaaataaaaaaaaaaaaccggggggcccccccaaacgttttccaaaaacaaaacctcccaaaccccccaaagggtttctaaaaaaacctttaaagaaaaaaaaaaaacacgcggtttgaaatcccataaaacccccattttgggtcctcacacccccccccctttttcccccacttctgtctcccccctccacttctcctccgtgtgggcctgctccccctccctcacaca

SEQ ID NO: 3927 - DNA, 1367 bp, Diabrotica virgifera
ataacacgggcgaagcaaggtacgattcaaatagaggacaaaatagttatgggtgtagaccaagagaaaattgtgaaagaccaacgcaagagtaccaataccaaaataattaccggtgttcgggccaaaactgtgtaagacaaacctcaagctacgggcaaaccaatgcaggacaatattcaaatcaacatcaaacctcaagctacggacaaaacaccgcaggacaatcttcaaatcagcaccaaacgtcaagctacggacaaaacactgcaggacaatattcaaatcaacaacaaacctcaagctacggacagaacaccgcaggacaatcttcaaatcagcaccaaacctcaagctacggacaaaacactgcaggacaatattcaaatcaaaacccagcttatactcactccacgacatatgggcaaactgataatcaagagcaaatcagtacttctactgagtacgtgggatgcgatctacaaactttaaagtgtttccttcctggtgaacatggtagtccaataaatggaaatactgaaggcttagttaaaaaaatttataaagttaaccaaaagtgtaatccagcagtccaaaattgtggtcagtacggagagacctattcgagcagttggcaaaacaacgaatacttaggaaacggtcatggagaactcaacaggcataactgtaatccagctacacacaactgtgaccaatactcaggacaaagtagtacagtcacccaatggtcaactgctccacaacaacaggctacgcaatggtcgagtgctcaacaacaacgtcccaattacaacaacatctgtaacgtaaacgatcccagctgtagacgaaaccaacctacaccccaacaaccagctagtcagaaaaaaacaacgaattctcgacctgtttgtcccagtggattcgtgggtctacacaagcaccctacagagtgcaagaaatatttgaactgtgctaatggtcagacgttcgtgatggattgcggtcctgggactgtgttcaatccgaagatttcggtatgcgactatccttccaatgttgactgtacagacggcgaatcttctcaagtgaatacgtatgtggattcaagtcacaatgcgggacgtgatacaactgagcggtacacggaaagctatactgagtggcacaatcaaaatggaggtgactggcaagaatcgagtcacaattcaggatgcgatagacctgaatacgtaattaaaccagtagataaatctcccgagtacgatgatgtctacaactacaaccactaccaacgaagacctcaagttagcaccccaagaagtgcttggattacaccatatcaaactgcggattccgacgatctt

SEQ ID NO: 3928 - DNA, 1497 bp, Diabrotica virgifera
ggttatgtttggtaatgttacatcttatttaattttaatttatttttatttaatttacttacatttcataaagtgatcagaatatagattgaatactataagagtaattattggtgaattatgtgaaaatcaaaataaaacacaaccttggtagacaaaatgcccgttactgatttcatctccactttgtcggataatccctattttggagctggatttggtctttttggtgttggtgctggtgcagccttattaagaaaagcattccagagctcactaattctttttagaagacattatatgataactttagaagttccttgccgagataaatcatatcagtggttattacaatggatgacatcaaaaggtgccagacagacacaacatttaagtgttgaaactagttttgaacagaaagatagtgggttaataaagaccaaatatgattttataccaagtataggaacacactttttccggtatggcagaacttggataagagtagaacgtacaagagagcagcatacactggacctacatatggggacaccatgggaaacagtacaattaactgcatttgggagaaataaaaatatgttttttcaaattctagaagaagctaggcatatggcattagaaaaacatgaaggaaaaacattaatgtacactgcaatgggaagtgaatggaggacattagggcatccaagaaggaagagaccaatttcttctgttattcttgacaaaggaataagtgacaaaattctcactgattgtcaggagtttattgcaaatccagggtggtatataaacagaggaattccatatcgaaggggttatcttctttatggacctccaggttgtggaaaatcatcctacataacagcgttagcaggtgaattaggattttctatctgcatactgaacttatcagaacgaagcctctcagatgacaggctcaaccatcttttgagtgttgctccacagcaaagtattatcctactagaagatatcgatgctgcatttgtatcaagagaagatactgccttacaaaaagcagcctatgagggtttaaatagaattacgtttagtgggttgttaaattgtttagacggggtggctagcactgaagctagaatcgtttttatgacgacgaattataaggaaagattggatcctgcattaattaggccaggtcgtgttgatatgcaggaatatatcggttggtgttcccaagaccaaatcgaaaggatgtaccttagattttatgacggcgaggaggctgcatctcaatctaaattatttgccgaaaaagttatgaagtttaatgctaaagtcagtcctgctcaagtgcaaggtttctttatgattcataaacattctaactttaaggatgtgataaatgattgcgagctgttggtcgaattgggaaaaaaataatagtttaaagtgaaagtggtccatacaataagaattacaaacaaatagaacttatag

SEQ ID NO: 3929 - DNA, 608 bp, Diabrotica virgifera
agaaaatactacagaacaatacaacaatgaattgcaaattgattttagttttcctggtggctctcatcgctacctcaaactgtttcttccttacagacataggaaaaggagttgtaggattggctggaaatgtggtggaaggagctggtaatgtggtataccagggtggcaaagcagtcgttaatggagctggacaaactgttggcgctgcaggaaacattgttggacaagcaggtactgcagtggttaagggaaccggtgcagtggtaaaagaaactggcaaagttgctgaaaaagtagttgacaaaactggaaaagttttgaccggacaagaagcgttggccaacctaaatgtagacaccaaagtgaagatcttgggtaatgaaatcggcattaaaggaggagtcaaacttggagttggaaagcaactaggagcacatgctggcgtggacgcgaatattttgggacaaaaagctaatgtcaatgctgctgtactcaatgctcattaaaatcatcgttagtattacttagttattagtgcataataagttcatgttttttgtattaaatttgttttttttacagaaatgttaatgttaatttttgtt

SEQ ID NO: 3930 - DNA, 1188 bp, Diabrotica virgifera
gaagcgttgtcgtggaaattaaaattagagcattagtagttgattgatttttaatagaaaatataatccttccctgtaatatcgaagtgaatatttgttccaaaatgtcgagtttgatggctacacaagctgagaaagttaccatcgaaattactttggataaagcaaatggggatactaaatgcaatggtgtacagtctaaagtatcagaacagaataaaaagcatgaagaatatcaatatttagaccatattcaccatataataacgaacggaaataaaagggtagatcgtactggtgtaggcacctattcaattttcggggctcagatgagatacaatctacgggattcgttccctcttttgaccacaaaaagagtattttggcggggagtcgttgaggagttactgtggtttataaaaggaagtacaaacgcctttgaattgagtgacaaaaatgtccatatttgggatgcaaatagcacaagagaatttttagatagtataggtcttaaagatagggaagctggtgatttcaggcccaatatatggattccagtggaggcacttttggagcagactataaaggaatgcatgaaagttataaaaatccaagggattgatccaattggcacatgtaattaaatacaatttaaagaaagacctaatgacagaagaattatcatgtgtgcttggaatccaattgatattccagaaatggcactaccgccatgtcattgtttggttcattcttttgtgctaatgatgaactgtcttgccagctatatcaaagatctgcagatatggggcttggagtgccattttatattgctagttacgcacttctaacatacatgattgcccatattactgaccttaaactgggggattttgtcacacattaagaaaataccctgaatacttaacccatggaaaggtccccaaaaaacagttcaaaagagaacccaaggccttttcctaaactggacaattaaagggaaaggggaaaacatttaaaaattttattgctgttggtttttgagaaaaaaggttttaaacccccccccccaaacctgaatatggcccattgggcggttaaaaaaaatttttgttggtatttttttttatttcttaaaaaaatgggataaatattattaattttttcaaaataaaaagagttttttttttt

SEQ ID NO: 3931 - DNA, 1103 bp, Diabrotica virgifera
  misc_feature (1083)..(1083): n is a, c, g, or t
caagtttgttttgttagccagtaaaataaaaaaataaaaacgtgtagaactattttcttaaaaagcattttgaggatttaacagaaacataagtgaataaatgcgcaggaatggcagacgttagagatatcatggagttggagagaccctccactccagaagtgacaagagaaacctttttggggaatgataaactgaagaaaagggcttctacgggccccaaggtgtcaaaacgaccagaaggaatgcacagggaagtgtttgcattattgtataatgataataaagatgcccctccgttatttccttctgatacaattggtaacaatggttataaacagacgaaaatcaaattgggaatgaggaagcccagaaagtggaaatggatgccttttactaatccaggtcgatcagataatgcaacgttttaccactggagaaggccatcggatgaaccaaaggaatatccatttgctaagtttaataaggtgatcgaggtagttaagtataccgaacaagaatacaacactcatttaaaatgtgataactggacaaaagaagaaactgatcacttaatagaccttgccaagagattcgatctaagatttattgtcatggctgacagatatgatactgaaaaatacccaaaaagatctgtagaagatttaaaacaaagatactacaaaatctgtggaattttatccaaactgaatggagaaaagaaaatttacacatacgatgcagaccacgaacgaagaagaaaggaacaattgaagaaattgtatgaaaggaaacccgagcagatagaagaagaacagtttctactgggagaactgaaaaagatagaagcgcgcaagaaggagagggaaaggaagactcaggacctacaaaaactcatcagccaggctgacagtcagaacgatactcccagaaggaatgacaagaaactgcccaagaagaaaattgccaatccggcgagaccttccagagtcgatacaaatcatattttgcaggctgtagaaagcgctggcatcaaattttccagattattagatcagcggcgtctcgttgagatctcagcgnatgaaattgcccgcgaacgt

SEQ ID NO: 3932 - DNA, 768 bp, Diabrotica virgifera
cgaaagttcctgaaaatgtagcgaagaaaactgctctaaaacgttgtgtagaaagttttcatacattttcagctgctctacactatgtggtgcttacgtaagataatctttattctgttatcagcgttatggactgttatcgttcgccataagttggaagtttcatattagacaacgacatattcgtattatttatcacacaccacattataagaaatcgtttaaataattttgaaatcgttaacattttataaatgtttttatattatcattccatactctataactggtagtgacttacgtttaatagaacaaaatacgtcaaattaaacaaatacgactgtcacatgtcatacgtcaattttttattaagttaggttagaataactcgctgaaaggtcgatttagttgagtaacaacaaaagaaattcgtagttgtgcaaaatattcaaaaatatttattatttattattaagacttaatagttgtttgacttcgtgttctttttttgtatttctaggaaggttcacccattttgtcattgttcttatccattatttgaaaaagaaagtgctgtatcatgtttactgcatttatcacatggatcggtcatcagtcagttggccggttgagttggtcgttagacgtttacaaatcaacttctttttgtttcattgttttcggaaatattctcatacgtttgttataatttgttgtatggtttatgtatgtaaatatcaaaatgattaattaaataaattatattgt

SEQ ID NO: 3933 - DNA, 1757 bp, Diabrotica virgifera
agggtctatgtcagtcccatggcaaagaggttggccgaacagaggaatatcagattgcaaggtaaaggtaccggactattcggctcaataactacttctgatctagcagccctagaagccgcctcagcagcacatcccatggcagcagccttgccttcggctggtgcttcggcatctcccttcgtagacatcccagtcacaggaatgagagccaccatcgccaagaggctgctccagtcgaaacagtccattccccactattatttgtcagttgatatcaacatcgataacttgatggccatcagagcgaaatataacaagaagttagagaagcagaacgtgaagttgagcgttaacgattttatcatcaaggctgttgcacaagctagtttaaaggttccagaggccaactcatcatggaacgaatccacaatcaggcagtacagaaacgtagacgtcagcgtagcagtatccaccgacaaaggcttgatcacgcccatcatcttcgaagcagaacgaaaaggcgttgtagagatcagcaaagctatgaaagctcttgcagccaaagcaagagaaggaaagcttcaaccacaagaattccaagggggcaccttcagcatatccaacttgggcatgatgggcgtcgaccaattctgtgctgtcatcaacccaccacagagctgtatcctggccatcggaactagctcgagtcggttgattgaggatcccttgtcagaaaaaggcttcaaatctgcacagtacatgtctgtgaccttgagttgtgaccaccgcacggtagatggcgctgtaggcgctagatggctgcaagccttcaaagaaaaccttgaagatccagtggcgatgatcatctaaggaggcgacaacccgttgaactaaacagttcctaaccagttcatctcatacagacgaaaagctgccaatggacagggtgaagaaacagtggattcgcacacccagaacacggagacaaaacaagagtttttcgcccagctgtaggggactttttggcgagatattttaaacttttaagttatgtatttgtaagagttgtaagttcaatattttgttgataggtgacgcttatgtattagcgtttaacgaaagttcctgaaaatgtagcgaagaaaactgctctaaaacgttgtgtagaaagttttcatacattttcagctgctctacactatgtggtgcttacgtaagataatctttattctgttatcagcgttatggactgttatcgttcgccataagttggaagtttcatattagacaacgacatattcgtattatttatcacacaccacattataagaaatcgtttaaataattttgaaatcgttaacattttataaatgtttttatattatcattccatactctataactggtagtgacttacgtttaatagaacaaaatacgtcaaattaaacaaatatgactgtcacatgtcatacgtcaattttttattaagttaggttagaataactcgctgaaaggtcgatttagttgagtaacaacaaaagaaattcgtagttgtggcaaatattccaaaatatttattatttattattaagacttaataattggttgacttcctggtccttttttggatttctagaaagggttaccccttttggctttgtcttatcccttatttgaaaaaaaaaggggtggattctgtttattggctttttttcctggatcgggccttaaccaagttgggcccggtggggtgg

SEQ ID NO: 3934 - DNA, 1382 bp, Diabrotica virgifera
atttcgtgaaagaccgtcttttaaatgacctagagaaggatatcggtgagtcgccctcgaattcacatcaaattcaccataagcttaagacataactgaagaacagtacaaaattaaacacgaaaattcaaaatgttccgaacgatcatattacgaaatgatgttgccaaagaaatttttagaaaatctctccgatccaagactttgagaaatgtttccatagagtgctgcaaacgaagacattatcacagagctttatttggcaatgaacattcacaagttttacaacgatgggtgaaagcagaacacaattttgtcagatattatgccgccgatcttccaagtcataccaaagttacactgccagccctttctccaacaatggaactgggtactattgtaagttgggaaaaaaaggagggcgacaaactgaatgagggcgatctactcgctgaaatcgagactgacaaggcgaccatgggcttcgagactcccgaagaaggttatctagccagaattatcataccagctgggaccaaggatgttcctataggtaaactggtgtgtatcatagtcgaaaacgaagcagatattgcagctttcaaagatttcaaagatgacggagctgcagctccagctccaccaaaggcagctgcacctagtgctcctgcaccatcgccagccgctccagtagctgcagcaccacctgctccagcaatggttgctgatgtatcttccacaggtagggtctatgtcagtcccatggcaaagaggttggccgaacagaggaatatcagattgcaaggtaaaggtaccggactattcggctcaataactacttctgatctagcagccctagaagccgcctcagcagcacatcccatggcagcagccttgccttcggctggtgcttcggcatctcccttcgtagacatcccagtcacaggaatgagagccaccatcgccaagaggctgctccagtcgaaacagtccattccccactattatttgtcagtgatatcaacatcgataacttgatggccatcagagcgaaatataacaagaaagttaaagaaagcagaacgtgaagttgaggggtaacgatttttatccattcaggctggtgcaccagctagtttaaagggttccagaggccactcatcatggaaagaatccacaatcagggcagaacacaaaccgaaaacgtccgcggaaaaatattccccccaccaagggcttgaaccacccccaaccatctttcaaacaaaaaaaaaaaaaggggttggaaaaaacccccaaaagcatttaaaaacttccttggcgggccaaaaaaaaaaaaaaggaaaaggttttaacccccaaaaaaatttccccaagggggg

SEQ ID NO: 3935 - DNA, 1031 bp, Diabrotica virgifera
cttttatcaaaatttatactgatggttggtaatagaggggaagtggaagatgaaactaacaatgaatacagctagatagataatagctgtaactgtagattgcaaatgattttgtcaggtgtcttaattttactagttactgaaattatgttaattttgctataaatgtttatcatacatttgaagacatctggtaaaatttattcaaggaaacatttgataaggtattgaaacctaaattgaagtttgacaaattcagtaatctgtattggtgacgataatggtgttcatagaaattatgttttatttatgtattaaacagcaaatttgcagtccgtatttttaggttatttggagctgatgagatcctctaaaggtaacaatttgatgcactgtttgatgtcttgtttaaccttcctagttccacttccaggattatcattgccagttgatattttaactgaaattctttaataagaacagcatatgatcattttactaaattgttttttttttcttttttggtgctcgcgcgaattatagtgcagcaatggtcacttaatgtgtgccggatgctttactcatgtcttggccgatgccaggctccgagacgaaacagctacttgtccaagctgtagagtcgaaataagtaaaactacagccactagaaatttggcagttgaaaatgccgtatcggagcttccggccgaatgccaattttgtaacaagcaatttccgagaaattctttggtcagacacgaggaatctgaatgcgaagaaagaatttctggttgtaaatacagtcgtataggttgtccatggagaggtccgttacatgaaagatctgaacacgagaaggaatgcgttcacccaaatcgctctggagcggatgtaatggaagcgttgaaagttttggatcaacagatgaacgaggaacgtgtactttacgatagcatatttgacttactgggatatgaaaaaatcacatttaacgatgtacagttgaaaccttatcgtacagatgagtttgt

SEQ ID NO: 3936 - DNA, 1496 bp, Diabrotica virgifera
  misc_feature (1320)..(1320): n is a, c, g, or t
  misc_feature (1392)..(1392): n is a, c, g, or t
  misc_feature (1408)..(1408): n is a, c, g, or t
  misc_feature (1416)..(1417): n is a, c, g, or t
  misc_feature (1425)..(1425): n is a, c, g, or t
  misc_feature (1435)..(1435): n is a, c, g, or t
ctcagccaacatcatcgagtagcgagactacttcgcaaattgttgaggatgtaaaacaggaagaattcctagaaccagacataaaaaaacgtaaaattagtagtaaactaccagatgacaaaaaatacaagttagaagaaaggctgggcggaattttatgctgcgcagtttgtttagatttgccaagagctgctgtttatcagtgcagcaatggtcacttaatgtgtgccggatgctttactcatgtcttggccgatgccaggctccgagacgaaacagctacttgtccaagctgtagagtcgaaataagtaaaactacagccactagaaatttggcagttgaaaatgccgtatcggagcttccggccgaatgccaattttgtaacaagcaatttccgagaaattctttggtcagacacgaggaatctgaatgcgaagaaagaatttctggttgtaaatacagtcgtataggttgtccatggagaggtccgttacatgaaagatctgaacacgagaaggaatgcgttcacccaaatcgctctggagcggatgtaatggaagcgttgaaagttttggatcaacagatgaacgaggaacgtgtactttacgatagcatatttgacttactgggatatgaaaaaatcacatttaacgatgtacagttgaaaccttatcgtacagatgagtttgtacacagattattttacgaatcatcaagattttcggctttcaattaccagtgggtagtcaaagcgaggataaataataaccaaaaggatccaactcagagttcagaacgggatatgtcataccagttgattttaaaatcgaaatcaagcaaaccaataagtttgagctacatagtactaaggggacctgtcggtgacataaatgtgaaagcaagaatacatgaatttgaattcacagaacagaataacgagaccccttttgtgaaactacccttgccagatacacctgaatgtaatcgattattggcagcgactaccataaattttaggttgataatgttttcaaagtaaacgtttacctgcaccaaaattgtgtaagatatttttacacgttgttttaaatattaataataaatttttgtgctatataaatcctagggatttttcagtaatttctattttgtgttatttgtggatctcttagttacattaagtgtagattatttttatatccatgacttatgatattttgtttctttgttcttgtagaagatggtaagattctatttatccagaatattaagatttatatgctatatatgtctaattgttaccttagaatttaatttanatgccattattaatatactataaactcatattattttattttttatacttagtgacatggtggcaatggttnatgtatttttgataanatataagnntaaatggntactcaaaangacatgattgatcattatataaatgagtatcgatatcgcaggaatcaacatcatactctgc

SEQ ID NO: 3937 - DNA, 3089 bp, Diabrotica virgifera
gagggaaacacgctagggttcgtgtcaaataagaaacgtcacgtcagctgttttctggttttgtgtggaagtagagagttcctctcagctgttttgtgtttgggtaatgattgaattagctatcaacgaggatattaatcctatcgacatgtctgaaactcagccaacatcatcgagtagcgagactacttcgcaaattgttgaggatgtaaaacaggaagaattcctagaaccagacataaaaaaacgtaaaattagtagtaaactaccagatgacaaaaaatacaagttagaagaaaggctgggcggaattttatgctgcgcagtttgtttagatttgccaagagctgctgtttatcagtgcagcaatggtcacttaatgtgtgccggatgctttactcatgtcttggccgatgccaggctccgagacgaaacagctacttgtccaagctgtagagtcgaaataagtaaaactacagccactagaaatttggcagttgaaaatgccgtatcggagcttccggccgaatgccaattttgtaacaagcaatttccgagaaattctttggtcagacacgaggaatctgaatgcgaagaaagaatttctggttgtaaatacagtcgtataggttgtccatggagaggtccgttacatgaaagatctaacacgagaaggaatgcgttcacccaaatcgctctggagcggatgtaatggaagcgttgaaagttttggatcaacagatgaacgaggaacgtgtactttacgatagtatatttgacttactgggatatgaaaaaatcacatttaacgatgtacagttgaaaccttatcgtacagatgagtttgtacacagattattttacgaatcatcaagattttccgctttcaattaccagtgggtagtgtttgagagttttatcgcataccatcgcaccttccggcaagattcagtttttcattgttcaaggtctcagatgtacagttgaaaccttatcgtacagatgagtttgtacacagattattttacgaatcatcaagattttcggcttttaattaccagtgggtagtcaaagcgaggataaataataaccaaaaggatccaactcagagttcagaacgggatatgtcataccagttgattttaaaatcgaaatcaagcaaaccaataagtttgagttacatagtactaaggggacctgtcggtgacataaatgtgaaagcaagaatacatgaatttgaattcacagaacagaataacgagaccccttttgtgaaactacccttgccagatacacctgaatgtaatcgattattggcagcgactaccataaattttaggttgataatgttttcaaagtaaacgtttacctgcaccaaaattgtgtaagatatttttacacgttgttttaaatattaataataaatttttgtgctatataaatcctagggatttttcagtaatttctattttgtgttatttgtggatctcttagttacattaagtgtagattatttttatatccatgacttatgatattttgtttctttgttcttgtagaagatggtaagattctatttatccagaatattaagatttatatgctatatatgtctaattgttaccttagaatttaattttggtgccattattaatatactataaactcatattattttatttttataacttagtgacatgttggcactgtttatgtatttttgataaaatataagttaaaatccatactcaaaaagacaatgattgattattataataatgagttatcgatatcgcaggaatcaacatcatactctgcctcaatcccaatgtttatgtaagtattattcattttaagtcaaaagcactatgattggtcgctacctaacacgtttaaggtatgataataatcatctttgactctattcctattcgagatcccacaaccctaattatatttgccatacgtgtctatcttgacatcccaatattaatgtgtcatcatgtattttttgccagcctctcccactgtttccaggaactcaatactccgtgattcttaccgttgtaaaattctcaagtttataataaatttaataataaatattcattaaaattatgggacaactagtttatcaatggaattattaaataaatgtcgatatatacaaagtacttcatagcgtacagctaaccatattggtccttcgagccggattgaaccggcgacctatggatcaatttagctgtacgctatgaagtagtttttatttactgcacaatgaaatggtgttgtcacaaagtgacaatgtgacttgtctgaattctggcagtgaactctcataaatttggtataagatacgtgcggatctatacgcactgaatttagggaagattggcacgttcttatatgaattctagtacgtgttcgtgtatattttggcatattagtttagttaggggaattttaagcatgtgattgcattttgatggcatagaaatttcatttaaaaccgcaacggagaaaaatgtaaattttggttgttgaatcgtagacctcgaccgatatattaattttcatgataagatcatttgtcttaactttaaaataaatttattgtgtgtactaatttaattcttatacgtatctgtggcatataaggtccatatactgaactttttttcataatttttatccaacaaaaaaatactacgtaattaattatggaaaaatatttataattttaataagactttaacaaaaaactaagtggttgtaagtttgcttagttttttcaacaacaccaatacaagtgctctagcaatagtccgtggaatcacaagcttaattcctgctgtgcaggtttgcaataaactaaagcattcgtaattcatttttaatcttataaaatgattaaaaaagtggaaatacgaggtggataaaaaacacagaacacctggtagacctatttccccccgagattttttaagttatatcaataaataaaccctttattatatctttgaaaaaatgaaaaaatggtaaaaaccgttatttgggaaaaaaacttgccctaaaaaaatggtttt

SEQ ID NO: 3938 - DNA, 1273 bp, Diabrotica virgifera
aaaatctaaaagatctacagtagatacagtgtttcgtactacaatgataaaaacaatctttcaaagagatgttacaagaagtgctcttaaaattatgggaaggtctaatcaaaaacgaaggctcgcaacccacacaaaaaggcacccagtattcgtaagacctacgatagacttcactcaagaagaaacgattctaaagaacctcattccacaaattcgagaagacattctgaatgaatctttagtttaccagaagaacatgccaacagttagaaaacaattcgaaaaccttattaatgatacagtcggagatcttaagccaaaatttctcaactgtgctttaatagcgatatatgcctacaagtatttcaaacaggatcacaccgaagaagagttggtcaaggctggtattttgggatggtgctacaaattgcaagacctcgccatgattatcgttgatgacatactggatgaatcaaaaattcgttacaataaacctcccttgtatagggtagtgggaataaaacaagctatcttagactctataattttagaatcaggcgctaacttcctagttttaaaatatttttctgatcacaagcatttagttaaaatccaaaaggatctcatcctaaacatagcgacaaccacgatttcacagaaacaagagctgtcaaagtatgaaatagacgaattggaagtttttgaaaatttgattaagtcttttccgcttttaatacatgctgttacatctgcggtgtatttggctggtatcgatgatccaaagatccaatccatagtcaagaagttttgcgtggatattgctatatttggaaaaagatatgatgattttacagtatttctagacccaaaaactattggggataaaggacaacacagatatcgttagttttaagatacatggatggccatccaagtctccaaaatggggaagcccaaacagaaaaagactttcatgaaacactactgtcccaccagtcctgaatcagttccccccccaaaaaaaatatatgtttttttaaaaaaaagtccccgcccccgaaaaaaataccccgggaattcctaaacattatggttttccaaattttaattacaggcccccaacaccattttttatttttttttatatttttcttaaaaaaaggttatagtggaaaaaaattttttcctgaaaaacctttaaaattctcacccacaaaaaaaaaaaaagtccggggccgcccccccccccccccgcccacaaaaaaaaata

SEQ ID NO: 3939 - DNA, 1024 bp, Diabrotica virgifera
  misc_feature (13)..(13): n is a, c, g, or t
  misc_feature (16)..(18): n is a, c, g, or t
  misc_feature (27)..(27): n is a, c, g, or t
ttttaggggctcnccnnntaacgattnacggaactgcaaccggacgcgtgggtctgcagtatacataatacagtttacatgttttgttaaataaaaaaagcaacagtgatataaatccaagtacaataagaatatccgcaataaattcaaccagtgaaaatggagtacctcaagaaacctgaattggtagccaaagttcaaaaatatttcggtgttaatacaaaacatatccaaaaagataaagagtacacaatagagaataagttctggtattatttgtttgtttttggtacagctctaggtgatgagaccttctattctgcttttattccattctggttttggaacattgatggggcagttggaagaagagttgtcttggtttggacaattgtcatgtatataggtcaaggcatcaaagatataatccagtggcccagaccaggccctccagtagttaggcttcaaaataagtgggctttggagtatggcatgccttctacacatgccatggttggagtgtccataccattctcagttttgttgtacacaatgggccggtaccagtacaacattcctttggggatgtgcattgcagttctttggtgcactttgataagcatcagcaggctctatttagggatgcatacagttttggatgtcatagttggtttagcgttagccgtactcattatgtttcccattgttcctttggtagacttattcgataattatttacttacaagtcccacatctccgatattattactagtttcgtcgattttgctgatattctactatccaaacagtggcaaatggactccacccagggggagacactaccatgatcctctccgtctgcgctggaatccaaataggttccgggctgactttcccttccggcctgattacccccccaaaagttcccccccccaaattaatcaggtggccccccctacacaatgtcctgaaggcctctccttcctcttcctctctcgcgaattcctcactcgtacaacttccc

SEQ ID NO: 3940 - DNA, 1158 bp, Diabrotica virgifera
  misc_feature (1039)..(1039): n is a, c, g, or t
  misc_feature (1143)..(1143): n is a, c, g, or t
gtgacaacaaattcttgttcctgggagctggagaagcggctataggtattgccgatttgacggttaaagctttagaaaatgaaggattaagtgaacaagaagccagagacaaaatttggatggttgacatcgacggattgttagcgttggaaaggcccgaaggcggtttggatggccacaagaagtattacgccaaaaatcacgctcccatcaaagattttgccgccattgttaacgaaatcaaaccgtcaatattaataggcgcttctgctgctgcaggtgcatttacaccggaaattttaaagaatatggctgcgtttaatgaaagaccaattatttttgctctcagtaatccgacaagtaaagctgaatgtacagccgaacaggcgtacgttaatacagagggccgtgcgatattctctagtggttcccccttcggcaaagtccactatggggacaaagttttccaaccgggtcaaggcaacaacgcctacatcttcccaggagtagctttaggagtaatcctcgcgggaatccaccatattaacgaacaaattttcttgatagcctcagaaacagtggccaaaaacgtttcagatgaagaccttaagagaggtagtttgtatccacccctaagttcgatcaaggagtgttccatgcagatagcttgtgaagtattggaatatgcctaccaagaacgtatcgcatcagtatatcccaaaccaaaagacatgagaaaatatatcgagagccaccaatacaactacaactacgaaccatccctaccccaaatctggccctggcccaaccccccttacatcaaaaccagaccaatggaaccgacgaaattgaaagcctagtcaaaattttagatagaaatcctccaccattatagatataagataaattattttcttttttatgtataaattaattgttttatatttaagagattatttattttgttggcgattgtacataatgttatgtatgatgaagtctagccgaaatcttaagacacactcgaaatttttagcgnggtcatgacgggaaaattaaggagtatgacgtggattcagtcacgtcatctgtcagttgtcactggatacttcaagtactgtaagtcgcgtcatctgtcagtgnatgtgtcaagtactg

SEQ ID NO: 3941 - DNA, 1557 bp, Diabrotica virgifera
ttcgtccggcttctgagaaaaatgaagttagttggctgctttttagtgtttttgagcgtgttggctcttggagctgcagatggagacgatgaatttgctaactacacaataaccaaccgcaaatttccaaaaggttttacttttggtgttgccacggctgcttaccagattgaaggagcttggaatttggatggaaaaggagaacaggtctgggatactttcttccacgaacatcctgaccgcgtagatgatggaactaacggtgatgtcgctactgattcttaccatctttataaagaagatgttcgttgtatggaagaagttggtgtggactactatagattttcaatagcttggtccagaatcttacctgacggaacccttgacaatgttagtcaagaaggtgttaactattatgtaaatttatttaaggaactgcgtgccaagggaataaaatcttttgttaccttgtaccattgggatataccaacagctcttgagaaacaaggaggttggagaaatccaaaagttgttgactggttccaagattacgcagagttttgtttcaaaacttttggagaatacgtcgatagttgggtaacaattaacgaacctaaacagatctgtcacgccggatacggagtggggggatacgctccgggagtagtttctccaggaattggagagtacgtttgtgctagacacgtcttgttggctcacgctaaaacctggagattgtatgaccgttcatacagacaacaattaaaatccagaattacaattgttattgattccgattggtacgaaccagaaaccgagagtgaagctgatgaaactgcagctgaacataaacgtcaatttgtgtacggcatgtatgctaatccaattgtatacggaaactggccacaaattatgatcgacaacgttgcagattttagtaaaaaacaaggatttaaggaatctcgtttgccagctttctctgaagaggaaattgagctaattaaaggaacatatgattatttagctgttaaccactatacatcattgatggtcaaagctcgagctgaaccaactttaattgttagttgggatgatgacgctggagttgatgcgtatcaaaaatctacatgggaaactgcagcaattggttggtttaaaaaagtaccatggggttttggaaaattacttagatggataaaaaagacttacggagatattgaaattgttattagtgaaaacggtgtgtctgatagaagtggaacattacaagatgagcatagaattaagtttattcaggcatacatgagtcacatgttagatgcaattcatgacggagtaaacgttacggcatatactctatgatactccatagataacttcgaatggactcaaggattcaatggcaaactgggcatctactatgtaaaccaatctgacccttcactgccaagaattgctaaggattcttcgaaatactacgctaatgtgattaaaactaaatgtttggtagattcttgtgtagataactgatagtaataataaataaattattatatt

SEQ ID NO: 3942 - DNA, 2040 bp, Diabrotica virgifera
  misc_feature (843)..(843): n is a, c, g, or t
cggacgcgtgggaacaaatagaaaatttcccaatagaaagacgatcagggggtagaccacgaaaacgatgggacgacaacttactgaaagcacattgaaaaccagtcacctcaacagaaaaagaagaagaacctcataagttgtcgatttctgatattaagaagacatttatacagtagggaaactagtgaaattctatgtttgatcataaaaaaatatatttttgtttccctgaatacggtgctgtaattaccattcacaaaaagccaacttctagtgtaatatatggtaaaaattcttgaacactaccttgaatcaattcgtaacattgattttatgtaattagttgcactgtataaggttctatatttaaagttagcctttcgaatatgtattaatgaaatcgactaattttatggaagctgcaataattgaactgaatgttttatcgtgcacgaaatttcgaatacgtgtttaacactctaaattgttttatattgatatttctaccgcattgttttgtagattctattaatctttacattagatcctctaattctagactatattatctagccttactttctttaaaaattctactagcttcgagactgaaccttccatgtaaagatccttcgcctgatgtaaagaaccacacatttgccaggcagtcgcacccacgcaaaatgtgcactgtttctttctctgggagacagattctgcataggtcatcatctgccaatcttatcagcttcaactgtctattcagattgcagtggcctgttagcagacctactatggctttgactgttttcctgcctgcttattaggtctgctgtattntttggcgaatggtctataatgaactaattcgcctgtctttgtcctggtgaattcctttaccattccagtgatttgtgagctactcactttcttgttactgcctttgcaacgctgcagaacggttccggtccaatgaatagtataatgagccttgtttggccatttcaactgctttttcattgcctttatgaccctcgtgccttactaggcaatctcatactaacttataattgacctctgcagactagagtgtctgaagcgctgcctggctatctgggaagatggcaattgtacattacgttcttttctgcctttcaatttgctttaatctttactttagttgctatcgttttgttgtcttcttctgctttatcttttaatgcttcttttctatttcttgtttattcctttgtatttacaccatatcacttctgttgttagtgaagtatcgtcgacttttcaaatgtctttacaagattcggggtcatcagtgcctattatcggtaggtactttactttttcagttttttttctttttattcgcaaagtaccaaccaaccgacgcacttcctggtttattgtgctgatactaatgttaaagcgcttaaggtgttgcgcaaacaaattttctaattgcttttaaaattggactatttcatacaatattttgtatattatagctgcaacaattttaatgacgacgccgtttgcaattgtgaaatccgtacgaaattgaccgctactaataaagcaatttagcatttcagaaggtttttctacaattttcggatttaaaaagcgtaacggattcgactagaatagaattaatctctctctctctctctaccgttctaaacggagaaatttaactttttttaatattgatatccgacgacgatgtaaaactttcggagaagttgaagcgttaaaaagtaggccgtgtactgaatgcattcccggtcaaccagtggcgcctcgccaagaattataatttcgactaaataaacaataattccattttactcaataatatggctaattttttaatttttttttttaaattttaaaattttacttatacatttggaaaccttgggcttaaaaaggaaaaaattcatgaaaataaattttacaatttttttttttttaaatttaacacccccatctataaaataaaaaaccctctacctttagggt

SEQ ID NO: 3943 - DNA, 1277 bp, Diabrotica virgifera
  misc_feature (1162)..(1162): n is a, c, g, or t
  misc_feature (1242)..(1242): n is a, c, g, or t
caataaaaagtgtggttacgtatagccccaaaaaatattaaaaatatccaaaataaaatgtaatttaactttaatataaacaaatattctccctggacaaaatgtttaagttaacgaacgtatttcaaaagagttgtagcagaagtaatggactagtgccatttataagattcaattttgcctcctcctcatcgccacaattaaagaaaacgaatacagaaagtgaagatgttagtgaaaaggcggaaaatcgtaaaaggctcgtgagggcacctcagccgcataagtcaatggtggcagcagcatttgcatcattaaattctgaggaagttagttcagcaattaaaacaccacaaacagatgggaaactctcgaaagctaccaatattgaagaattactgtctgtgtcagaaggtacaggagtatctagacgacatgctcttaaagttgtttcaatactatccgaatggtcatctacgggtaaagtaactatatcagagtttgagaatgatccaaggttcattaaattgtgccacattctaacaaaatcaaatatagccataaagaatataaagacaaattcacgcagtgaagatttgtcaacagtcctaagtgtcacagctgatgatgaagctgctaaaatggttgcaaacattactctccctcagatggtgaaagtaatgtcaacattgtcactaaagaaaagaagatctacgttgctgttaagatccttatcatataatataactagaagtactgatcaattgaatttgaaacagtgcagtgatttgctattttctatggctactctaaatttccttgatgataatttgttgtcaagagtggcaggtgatattacagttgaacttgagaagaatattaagaggagttcagtaataggttctattttgacaagtataggcctccttaagtataaaaatccagcgttgttggatattcttagtgaatggatacttggtaatcaatcaatttgtagacctcaagatgtctttagcttattaatgacgttagctgttgtaaactacaaaccaaacaattcagaaaatttatttaaggttctgttaccacagttgacattgtctgaggcagggaaaccacaagtttggttagatattgtctggtcattaactctactaaatanagccaacagcagtcatgtgtccagtgttttagataagtcgtttttagatcaattagaagagccgttgagtttttccacanattttgaatattaaatatcgatggtgctgcacagt

SEQ ID NO: 3944 - DNA, 1958 bp, Diabrotica virgifera
cgaagcagttgagagtgtagtcgtttccgtatcaacacaactgccacgtgactctcgtaacttcaagttcctttctaatatttttaattatttatttacccgtgtgacgtttagtgaaagaatttagcaacatgtataattttgttaatgatattaaatgcagcttcgcagttttatccgcactgatcataacagtgtttactaccaaagtcaaggcagaagcatgcaatttccagaactttatcgaatgtgcaaaaccactatcagtattaacggactcagggttaacattctttaataatagacaggacttggagcaagtgtgccctaatcttagaacggccattaagtgcatccacagtttcacaaggcgctgcatgaagaaagaggatagccagcattttagggaagtgtttcgtggaaccggctcaattgtacatgaactatgcagaaacggtcgctatcaagaagaatatttaagacatgcgccttgcatgacccaaatatcagctgaaaatgaaaaatgcttcgagacctacaccacatcaatggctaaactcaaaccaaatacatatgaagtcgaggtggacgctgaaatggttgatgtcaccagtgaattaaagaagaagagagccatcgctgatgaagggatcaagaacgtttgctgtgctttccaacagtacatggaatgttcaacaactgctgtgagggacaagtgcggagacgatacagccgagttcagccgaagattcttaaacagaatgtcggcctcaatgttaaacgttcattgtacagaatacggaaagaggcaatgtggattagaagcaccaatagaagcgtggccagcaagctcatcatcatcctaccaatcagcagtagctctagtaacgtcactgctaacagcacaattattattgcggtaatattctaaaaggcatttagaatggatgcttaaaattgtgatttttcgaatagaactgatttgaaaattgtattttttaagtaggaaattcaaatatgaacgtgtcatagcaattttcaaatatacttcattctcattttgaagagtttttacgaaatatttattctttatttatttccgctaacgtgtataccaaagagcataatagcgagataatcaaaatgagataacatcaagattagcttgaagaacatggaggaatcgatagaaaatctagaccaaaattagttttaaaaaagttatcttgaaaaatttgggaatttagttcaatgtttccgatattgattactgtgtgaactaaataatttcggggaagttttacccactaccattaagttaatgggtttctaaaggtaattttagatagaaaattgtatatctggtgttttcgttaaaaacggggcgtttcaagaaatgtagacatttgtcagttaattataattgtcaagaaaatcccagataaactaaaacagtaaccaaactacttattaccaacatttttgtctgttggtcattttctaaattacagagtaaaattttctgaaaatcaatcgttattttgtgggagaaatagattttattacgattattccaaatttactaaaaataaacttaacctataatatcatgggtaaattgttatacaattcccgatctgttttttgtatttgtttgtggtcccatatgttctccaaattcaaataccgcagcattgcaatacgttctatgtagaaggaatattatataatatccacttaactaacattccaaactggttttggatatttaaaagactgaaatggataattgttcatcaaaaatgttaacttttgcaaatatattaatcatagtagtatttaactagtgtacaaagctgaaaagtattgggtgtaatttttaacatttttgtatgtcttttatcatatatgtataagaaatgatcttaagaatcaatattgggtgatcttgaaactat

SEQ ID NO: 3945 - DNA, 1429 bp, Diabrotica virgifera
  misc_feature (1017)..(1017): n is a, c, g, or t
gtatgaagtgctaggtagatagttggaaaaaagtgttctggtatattttgtgattctatagtattagttagacaagaagtaaatagacgacatgaagataaccttagtgatagccttgctcgttgcggcattattcaaggaatccttacagcaatgcttccctccatttactggtaatcaaccaagtcaaaaagccgccccagacctttattctggacaacaggacttttcgttggctttactgaacgccgtcaacaaagtgattcccaatgaaaatctcttcttctcgccgtattctacgtaccatgctttacttatggcgtatttcttatcaggtcgacagacggaaagttatttaaagaaagttctacgactgaatcaagctcaggagaaagcagacatttacgccgcttataaagtagataaattcgtgacccaacttctagccaaaagtgcaccttatgaattcaccagcgctaacaaaatatatgtagaaaacgaagtaccagtgcgcgaatgtgtattaaatgattttccaagtgaattggaaatgaaagattttaaaagtagtcccgaagctgctagacaacaaataaatcactgggtagaaaatgttacacacaatatgattaaagatctcattcctcctggtacgattgactcatctacaaatttggttttggtaaatgcagcatatttcaaagggttgtgggagaataagtttccaccagaatataccaaacaagaagtgttttatgtgagtcccacaaagcagattatggttgatatgatgcatgtcgaaggaacatttaaacatgacgtgtctgaatctttgggagcccacattttggaaatgccgtataagggagataatataagtatgtacattcttctccctccattttcaaatactgaaaactctatagaagctacattaaagaaattaactttggcaaactttaagaatattgtcgaaaatgacagtttagtgtccaaaactgttcaactcgcctttcncaaattcagtttagaaaccactttggaaatgactccgattttggatttattgggcctgggagatctatttactgagaaagcagatttttcttccttatctcctgaaaaagtatatttaggtggaggaatacataaagctagaattgacgtccacgagaatggtacccaagctgctgctgccacagcgctatttggctttagaatattctctgaagaaaatctgattgtcaagtttgcctgcaaccatccctttttatatattatttataacaaaaatagtaaaacaataatgttcataggaatatttagatctcctcctcaagaaatttattagtaaacgtcaaccactatacagaactgaaaataataattacacatatttaaaaaataaaaaaaaaaaaaaagggcggcc

SEQ ID NO: 3946 - DNA, 989 bp, Diabrotica virgifera
tcttcgtccgatttaacggttctcaggaaaaaatatttttaccagtttttatatttttataaagttttttacaagacgtcctagagtaaaccgtttattatgtcccaatttaaattttggaacgaagtgaatggtttattaaacatggaaggccctgttagcggtcctgttcctcgttggcagaagaaaaaagaagctagttcctcgaataatagctcaaacaattcaatcaaactaagatctctatcttgttcagctctaaattcgacaaagacccctgttaaaggttccgaaaatgattaccagcgcaacaaaacgccttccaagactccaaaaaagaataggactccgactcctaataaaggatcaaagacaccaggtggggatcgatttataccatcaagaagcgctagtaatttagacttagcttatttgaaactatctcaggatgaagctaagaagtctgatagcccaacacataaagatcttcaaaaagctatgtcagagaatctatatggaaccgatattagtaatcaaagaattcttacttataaaaacaagcctccgtcagcacctgaaggctttcagaatcccatgaaagtcatttatactcaaacaaagacacctgcttctgcaaaaagtagtagtagatatattcctcaggctcctgatagaatccttgatgctccagacattgtagatgatttctatttgaacttgatcgattggggatcaaataatgttttagctgcggctttaggatctcatgtatatttatggaatgctggtacaggaaacattgaacagttattagaattagaaggtaacgactatgtttgctccttagcttggatacaagaaggacattgcttagctgtaggaacaactaatggaaccgttgaactatgggattgctcaggatccaaaaaattaagaattatggagggacactctgctagagttggatctttggcttggaattcctttgt

SEQ ID NO: 3947 - DNA, 1035 bp, Diabrotica virgifera
gtcttatttgggagaagtgaacaactaaacaaacagtatggacgtctccaaattgttattgatttgcacttttctcgcctgcgctggtttgagtacccaaacatcacctgaagtaaatttaacaatttattatgaaacttactgtggcccaagtcgacaaatgatagaagatatcctgatacctgcatatgccaagctgggagatattcttaaattaaacttagtctcttatggaggagcaatgtacatgatacattcgaatgggtcaatcgaattcaaatgcagccatggccactatgaatgctttgtaaaccgaattcatgcttgtgctatcaatttatctccaccacaagcacagctattaaaattcattgagtgtgacctcagaaaatcaatgttcaatacaaatgatgaacttttagaattcgcaaaagaatgtgccgatgacagcaatttaccttacgatgatattgaacaatgtgtcaatggctcacttggggacgaggtattattgtcatttgcagacgaacaagctaaggctatacctaatccatactacagtcctgatttcagattttttgatatatttgaaagtaatcaagatatatttaccgtagaagcttttattcagcacacctgtagttttatagaaggtgaaaaacctacagtgtgtcaaaaaaatataaaattatagaaagattttattcacagttataaaattttagcacgtgaataatttgtattcattcgtatgcttatcgggcaaacttttagaagtataatacattaaatattgctacattaacagttgttaattatttataatttataaattgatataaacatattattcaaagaaagaaaaggaaaaagaatgaaactggcgaaaagactatgtcaatgaaaaaattcaaataagattgatagattggtggaatagagagaaaaatcgaggggagaaagtttttgagaaaggaattgtaaaaaaataccacaaaaaggagcaacactagggcaaaaaaaattggggggggg

SEQ ID NO: 3948 - DNA, 1263 bp, Diabrotica virgifera
gtattgacatgtttttgtaaagatgtgaaaagttttatgtttttcgaaatgaaatttttatttatagtaataaacttcttaagttttataatttattcaagaagcgacattccttctttgccttactgccatggatcagaaccgggcttggtgatagtgagtactttggatggaaaattgtctgcgttaaattcgattggatcgttaatgtggacatttgatactgggcctggtcccctgctcttatcaaacatacataacctagaattaactaataatggagaatggataaggattataccttctttaacaggaggtttatataaatttgatggttctactgttgacccaatacccatcactacagaagaactacttaaatcatcatttaagtattcagatgatcttgtagttgcaggtagtattgatgttcgaacatatggtattggatttcattctggtacagtctattatgaatgcacctccctaaagtgttctaacagtgatgaccaaagagatgaagatgatttgcttatattggaacgtatgactcatacaataagggctgttgaacctagaaatggccaagaaagatggaacttcagtgttggtctccatgatatcaaattgtccaagataagttgtatttacagtaatactgataaaattgattggaacgtgtcagctattttaccagatggagttttgaaggtgtcgtttaaccacaatgacgttaaaaacaaatggagtcatgtgtttccatctcctattgttcgtgcgtggatatggtctggaaagaatatgtctgaaattgatctttttgtcccagaacagacaccgtctatttacctagggatgcatgaaaaacaactctacatacatgaatcttcattattacaaaatgcaattgtaaatagaagatcagggacaaacgttgtagcagaaagtagaagtattgcaaaaataccatggaaaccaattggtgcttctactactaatacagaagaagattcaacagcgttgtcagttttaaatgcttcagaatatgttaatggacaaggattttacctccatgcaattatggaagagcagttattatgcaatgatagtaacaaaaacaaatggctagatatagagcctggagaaatgacatatttgtattatctaattactccttggtattggaagcagttaatcttaatgacagtcccactggtcactgcaatattcgtacttcggaaaccactttaatataaacaaaaa

SEQ ID NO: 3949 - DNA, 857 bp, Diabrotica virgifera
agggaatgcgtctctagtcctcaacctcgttgttttcattatagaacaaaagaatgcggaagtttttgcacagcatctatagtccataaagaggaacaaaagttgtgttcagttaattacccaggggcggcaccatcttgctccaaacaaatctattatataccccaaccacaaccgaaatgtacctaccaatcagtttggccttatgtatcatgtggaatacagaaaaaagaaacctgtcaaggctgctattcccactacgtcaatggaggtactccaaattatctgacctgcccccctcaatgttacgatgatgggtttggtgcagtgggcccaatgtatcgccagggacctgtatatagacctgggtattctcatgcaccttgttaccaatgcttgggatacccaaatccgaacgaatatagcggatatcctgttccttatggtggctcccaaccttatttgggtgaatatcaacaagctccttttagtggttaccagcagccgtatggtggctaccctcttccttatggcggatatgtagctccaccctatttcccagtatctactgaagtcaatggtacgataccaatacaagtaaatgaaaatctaatggatgaaggaagagtgccaagagagctggaaattgaagtaaattatgaacaaccctctgatgctcaagctgaagttaaaattaaggaagatgatgaaagtaatttagtcgtagaagaagagaaaaaggaaattgttgaagagtcctcctaaagtttatgtagatatttttttataattaatgttacttttggtgttataataatgtagcttattaatttgtaaaataaacttaattgtaaagg

SEQ ID NO: 3950 - DNA, 1158 bp, Diabrotica virgifera
aaattttataaccgaacgcacaatcgttttttatctttaagatatacagatatattatctcccacttctctgcaataaattatcccagctctctgtcattctttcagtttctcgttaataattattataggatagtgccaggtcggaagtgggatatacttttcgacgatgagggtgcttgttctaatcctatgcgtcgccttcctccacttggtagcaggagcttgctatgatagcaaggaagaatgtcattcaaccaactatgaaacatacgtcgaatgtgtcagacgacgtcagaaaagatctacagattgtgagtcaagatgtgactctggtaattgtatcgacacttgtcaagaatgtgattgtagctcttgtagctacaatagctgcacgtcatcttgcggaagttgttgcagttcttgttgcagtaattatgtcccctgccacactaaccactgctgccacaaaacctgccacgctcagtgttcaacatcttcgtgccgaagtaactgcagaaagaactgtttcgacattgtaaaagaaagatctcaaaccgttgttgtagagccaggtgaagaaactataagtaaaactaacgccaatataaacaacgtgaacaaacctaatataactacaataattcacttgaataatattattaacaccacaaatcttgtagatattcccattattcttaacaatacaaatacgcagaatataacattatttaatgaagaaactggtctctctacaacattacaatgttgtactgtaattagcccaagggaatgcgtctctagtcctcaacctcgttgttttcattatagaacaaaagaatgcggaagtttttgcacagcatctatagtccataaagaggaacaaaagttgtgttcagttaattacccaggggcggcaccatcttgctccaaacaaatctattatataccccaaccacaaccgaaatgtacctaccaatcagtttggccttatgtatcatgtggaatacagaaaaaagaaacctgtcaaggctgctattcccactacgtcaatggaggtactccaaattatctgacctgcccccccctatgttacgttgagagggccctccccccctccaagggaaaaaaggaggggggggtgggggggggggggggc

SEQ ID NO: 3951 - DNA, 955 bp, Diabrotica virgifera
  misc_feature (753)..(753): n is a, c, g, or t
ctaaaaaggacaaagaaagaaaagaaagaacaagttaaggatgagatagaaactgttgaattaaaaccgcataagaaacaacacgtagaagaagaaactattataaaggatgttactgaagacaaagaagaggttgtggatgtcactacaggcaagaaagtgattaaaaaggttaagaaagacaaaaagttcgaagagaaagatataaaaatagaagaagaagaaaaaccgcaatatctagcgaaagaagtagatgttaaacctgaagattcaacaaccgaaacagttgaggaagtcaagcaaactgatactagatcttggcgaaaaccaaagaaaccaattcaaccagaagttgaagaacaaaaacctgaaagtggcactaccgaacaaccaaaggaagtttatgaggtaacggaagaagagaccgtcttcgaaaagtccaaagaagaagtcattccttggaataagcaacagattacactaaaaaggacaaagaaagaaaagaaagaacaagttaaggatgagatagaaactgttgaattaaaaccgcataagaaacaacacgtagaagaagaaactattataaaagatattattgaagacaaagacgaggatgtaaaagtcactacagacaagaaagtgattaaaaaggttaagaaagacaaaacgttcgaagagaaagatgtaaaaatagaagaagaagaaaaaccgcaatatgtagcgaaagaagtagatgttaaaccctgaagattncacaaccgaaacagttgaggaagtcaagcaaactgatactagatcttggcgaaaaccaaagaaaccaattcaacagaagttgaagacaaaaaactgaaagtggcacaacccgacagccaaggaagttatgaggtaacgaaagagagaccgtcttcgaaaagccaaaaagaagtcattccctggataagcaacagattaaccc

SEQ ID NO: 3952 - DNA, 1708 bp, Diabrotica virgifera
aagcacgacaatacatcaatagaaataatcatgaaggcagtgttagttctaccagttttcttctgtttagtgaacagtgcgccaaaattaaggcttacaccccaattcatagcaccaccttctttactgacgttgcccagtaatgcaactagtataagaactgacatcagtgactcatttcactgtgaaggaagagactatggatactatgctgacgtagaaaacgactgccaactgttccatgtatgcttgccagtgacatactcagatggaagaaatcaaacgttcaggtggagttttatctgtccagaggaaacagttttcaatcaggaaatgttcacatgtaccagagcagatgaagctattgattgtgcagaatcaccacggttttacgagctgaacagaaacttcggcagcgaagaaattattggagaagtcatagattctgttgtaccttcgacaccagaacctcactatcttgaagaagctaccgccctaccagacgttcctcaaggtcttggcagaaacctttccagaagagggggaaataagccagatctaaaaaaacaatagaaatattggaaatctaaattatgctgtatgttcaagctgatatgtcatttataattgttgcgaaaatcaatacgagcaatagttttgacttctcttactattactaaatcggtattttgcaacgtcgtttttttgttttattttagttacgtatttttttatagctttatcaatttttactacataagaaatccaacattgaatctcatcttacgagcttcataccggatacaaagcaatcgcagctgtacttccgaaatgcctttcaggataacggtctagaggaaatactcaaactgtacaacgaccagcaccaacaattagccaagaaagagctacaggtgctattagctgataacctcagtgagaataagcctctacgtgatataattaatgaaatcaaagagattgccttgaaagataatatacaagaacacgaaatagcgtgtattatatggactactgtcatggacattccagaatggtctaaaaaggaggaattggtaacagaacaagctgtaagacacctcaagtactacactaatctctttggcgcattcacggaatcagctcgttcagaaatcaatctgttgttgaaagtccaagactactgttattcaaacatgacctttatgaaggcatttcagaaaatcataatgttgttttacaagaccgacgtgatctcagaacagaccattctgaaatggtataaacaagattacaatgtaaagggtaaaatgatgtttgtcgaacaaatgaaagaattcatcaattggttacagaatgccgaggaagagagtgattctgaaggtgacagtgaatagggaaatgggttttgttggtcgtaaataaatatcagtgccacctatcattgtaaaatattaaaaagtagcattttttccaatgtattcaaattatattgtataaaaattttcaggtgccttactatgttggtgagtggcaggcaatagttttgactggggacatgtaacattgacctcactaaaatgtattcaataattatataaaaaaaaatattagtacaagggaaaaaaatgatattttgtctaaaacgtccgccaataaaatccccaactcaatggtaatatattaatggttttagggtccaattttt

SEQ ID NO: 3953 - DNA, 1863 bp, Diabrotica virgifera
gggtcatcccacgcgtccgaacacgcgtccgcaaacgcgtccgatccccgtagtgtggcggacctttgaaagacaccgaagcacgaagacacatcaatagaaaatacatcatgaagacggtgttagttctaccagttttcttctgtttagtgaacagtgcaccaaaattaaggcttacaccccaattcatagcaccgccttctttactgacgttgcccagtaacgccactagtataagaactgatatcagtgactcatttcactgtgaaggaagagactatggatactatgctgacgtagaaaacgactgccaactgttccatgtgtgcttgccagtgacgtactcagatggaagaaatcaaactttcaggtggagttttatctgtccggaggaaacagttttcaaccaggaaatgttcacatgcactagagcagatgaagccattgattgtgcagaatcacctcggttctacgagctgaacagaaacttcggcagcgaagaaattattggagaagtcatagattctgttgtaccttcgacgccagaacctcactaccttgaagaagctaccgccttaccagacgttcctcaaggtcttggcagaaacctttccagaagagggggaaataagccagatctaaaaaaacaatagaaatattagaattttaaattttcgatataaaattcaagctgatatgtcatttataattgtagcgaaaatcaatacgagcaatagttttggcttatatcaaggtactaaatcggtattttgcttcgccgttttatcttagttatatattttttacagctttatccattttactacctctttaaatgtaataatctaggtcatgctaggttaggtttggtatgagtggttgcttaacaaatattctactcgatctaagaggtctattgtagctgatccctaagataaagttatcccttcagcgtagcctttttaacaaagtctattatgaccttggatgacacttctacaaagtcgtagggctcggtttgataatgctcaaatatattgagccttattctatccaaccctgggcagttaaacacaacgtgttctaacgtttcgtcatcagcatgacagaatctgcaattcgcactctctgtcagtccgattttgtttgtgtgttccttacggtaactgtatcctgttaggaggcctacaataaatcgaagatcaatcctattcttatctggtagatctctggatctcttcttcgaaggttcatttataaaagacccattggttcgtattagtagttacgtttcatctatttaaaccagtctaatattattattttagagatggtgggatagtcgacatcgcttctgttatgattaagcacgcttgtcgttgaagcttattcagcttctcgttggagtctttggataatttagtgaagcattctaatcattgatctgactaagtatcagcagtaggtacatctgccaacgattttgaaacttgttcttctatatttgctaaacccgccaagcaaataagaagaatcgtcgctatgccaaatgtcgcgacgccggcctcagcattgattgaactgctgttcccaccatatatacaattaccaagaaggtgatgctcggtacaaaattggagctatgtatttttaacacgccgcacgaaatcaatatggacataatgaataactgggaacgggagttcatcaaactgctgggtcgctataagttatttggaaaaacttttccacgactaaaccaagaaaatactattgttttgttaagcatttcctaccgtccgatcgcaagaaactgtctgtgatgttgtacatatggatcggcattggaaggaatatcttttt

SEQ ID NO: 3954 - DNA, 1699 bp, Diabrotica virgifera
cccacgcgtccgcccacgcgtctgagagagtgcttattctgttgtgaagtgtgcttcttcaaaaaaagtatacacaattttttgtatgagtcagaaggtagaaaaaccagttctatccggtcaacgcatcaagaccagaaaaagagatgaaaaagagaggtatgatccaactgggtttagggatgcaataatctctggactcgataaatgttctaacgattttgaagctatatctcgatatttggacagtgctggtaacaaattagattatcgtcgctatggcgaatgtctcttcgatgtactcatcgctgggggcatcctggttccaggaggtacactatcacaggaaggtgatggtccgtacagaacggaggcatgtatttttaacacaccggacgaaatcaatatggacataatgaagaactgggaacaggtgttcatcaaactgatgcgtcgctataagtatttggaaaaacttttccaggacgaaatcaagaaaatactattgtttgttaagtatttcctaccgtccgatcgcaagaaactgtctgtgatgctgtacatatggattgcgaatggcagcatacctttcacagccgttcttgtcctgaacaattctcatctggtgaaagatcacctagcgttagacttccttattgacatattcaaagcatggcgtcaagaaaaaggtgtcaactcactgcattctgctatcaagaaatccaacattgaatctcatcttacgagcttcataccggatacaaagcaatcgcagctgtacttccgaaatgcctttcaggataacggtctagaggaaatactcaaactgtacaacgaccagcaccaacaattagccaagaaagagctacaggtgctattagctgataacctcagtgagaataagcctctacgtgatataattaatgaaatcaaagagattgccttgaaagataatatacaagaacacgaaatagcgtgtattatatggactactgtcatggacattccagaatggtctaaaaaggaggaattggtaacagaacaagctgtaagacacctcaagtactacactaatctctttggcgcattcacggaatcagctcgttcagaaatcaatctgttgttgaaagtccaagactactgttattcaaacatgacctttatgaaggcatttcagaaaatcataatgttgttttacaagaccgacgtgatctcagaacagaccattctgaaatggtataaacaagattacaatgtaaagggtaaaatgatgtttgtcgaacaaatggaaaaaaattcatcaattggttaccaaaatgccaaggaagagaaggttcctgaaggggaacgggaaaaagggaaaagggggtttttgtttggccaaaaaaataaaatagccagctccccccctataacttttaaaaaaaactaaaaaagaaacattttaaaattatatttggtaaaaaaaatttttcgggggcctttacattgttgggggaggggaaggaaaaaatttttaaatggggaaattgtaacatttgaccctccctaaaaggaatttcaaaaattatttaaaaaaaaattttaaaaaaagggaaaaaaaaggaaattttgtttaaaccgcccccccaaaaaaaaacccaccccccatgggtttttttttttttatggtttttatttgggccaatttttttttatt

SEQ ID NO: 3955 - DNA, 1141 bp, Diabrotica virgifera
  misc_feature (1136)..(1136): n is a, c, g, or t
aacggacgctcggactgatgtgttggccgtaggtgaatggttagaatttaaagaggtgtattttcggtctttcggaaattaaagaaataaagatgaagtacttatatttattattatttttaaatttagtagctatagttaatgtttatggccaacaaaagagacagccccataccatggctgagcgtgtccagcaactaacggacatggctaataaacgaccagttttgagatttaatgctaataagtttagagatttcgtaaaagcctcaccaaggaactattcagtaatcatcatgttcacagcaatggctcctcaaaggcaatgccaagtgtgtagacatgctagtgaagagtttgccattgtggcaaactcttatagatactcacagagttattcgaataaattattctttgctgtagttgattttgatgaaggatcagatgtgtttcagatgttaagactgaatactgccccagtatttattcacttcccacctaaaggaaaaccaaagaatgcagataccatggatattcaaaggataggttttggtgcagaaaccattgctaaatggatagcagaaagaactgataaccagatcagagtattcagacctcccaactactctggaacctttgcactgattattctttttgccattgtcgctgcattcttatacctgcgcagaaacaacctagaatttttgtacaacaagacgatgtggggactaggagctctctttttctgtttcgctatgacttcaggacaaatgtggaaccacattagaggaccccctttcatacataaaactggaaatggtcaaattgcttacatacatggatcatcgcaaggacagtttgtgtttgagacatacattgttatgtttttgaatggagctgttgtactgggaatgattctgctaactgaatcagcaagaggcaaaggcgaccccaaaaagcgtaaaatctttgctgtctctggcttagtactgctatcagttttcttctctctattgttgtctgtatttaggacaaaaactcaaggctacccttacagcttcctttttaaataaatttaaaaagaagaaatttaaatgtcattgtatgatgttatagattgaataaagttttgttanaacag

SEQ ID NO: 3956 - DNA, 1388 bp, Diabrotica virgifera
  misc_feature (1120)..(1120): n is a, c, g, or t
  misc_feature (1146)..(1147): n is a, c, g, or t
cccacgcgtccggcggctgataaaagcctaatgattggagctgatgtagcagttgcttacattgatggattcagagggtttgctacggactacaatataacagctttaacaccatgtgtaaaagtattaggccaatataaaggagtatgcaaggatgaaatggtaggaggacaggatagcaaccaaatgaatacggcagcgagggaaaatggtattagcataataacttacagaagatccttaatttcacctgatcctggagataaagagtttccagcagagggttccatatacgccgtatggggggtaggaaaactagacgaaatgaaagaacctgcttttcatgatctctactcaaagactgatataaaaatggagatgacaccgaaagaacctcagaataactgcgtctcttttacgagatcgaaacctgaacccaaagaaccctggaagaaaggtcaaatattcgataaaactataaggatatttaagtcttatattggtccatcgggggccaaaaggggataccaagccattaccggccactcatccacagctttagcatggtacataaatggtttcctcagccctgagatatggctacgacgaggtctttcatatgcgtttaaagtatatggaggaaacaatccacacagtgctgaatattatcatccattgataataacagatgaaccccacggaggttttgatagacttactgacgaagctcagtctaaaataagagtcttggctggtgttgaatattctagaagaggaagacctagaccaactacatctggtgtcctttgtctatcagaacacaaagaaggaaaagacagaagactcgatgatgacttcgaaacgttcaaaaaattcaacaaatctttgatgtaccactgcgaaactggagatccgggcgttttggagtttactcccaacacttcttggcccgatatcgtatactacaactccttcacccaagccaacatgggctggaaaattcgaatagtagacagtttcaatcagaggtcttctgctcaatcatggacaatgctgtcgagtaacttttatgttctgtatttagttactggcgtatatgttctatttactatgtgattanagtattaaaatacaatttatttatannaaaaaaaaaaaaaaaaaaataaaaaaaaaaaaaaaaaaaaaacaaaaacccaaagcaaaaatttcaataataaaaccttcaagatacaaagaataaacattttcaagatgaaaaaaaaaaaaccaaattgttttggcgggccgccccccaaaaaataacatttctaaaacgccgggagtggggggcgaaaaaatgtggggggggggggcccaaaaaaaaagaaacagatgcaccggggggg

SEQ ID NO: 3957 - DNA, 1417 bp, Diabrotica virgifera
  misc_feature (1293)..(1293): n is a, c, g, or t
gttttgtagttttaactttttaacttgaatctaaactaaattacaccaatatctataaaatcagttgtttaaaatggcacggagggattatgataaggataaagaacaactcaagacgtttttgatggaatattgtgtacaagatgtttctggtgtcaaaatctttaagtattcaaatcaattaacaaaattagcacatagggaacaagttgctatgtggatagaactggatgatgtgaacgattttgacgatgatctcgccagggctattcaagcgaatacaagaagatacagtacaattcttggcgacattgtgtttgatctgttacctacattcgttcagaaagatgtaatagccaaagatgctctggatgtttatattgaacatcgtttgatgatggaaaatagattgagacagccaaatgaacacagggaagctaggaataaatttccttcagagctaatgcgccggtatgaggtttacttccaagaccttactacaaataagccagtaccaatacgagaaatcaaagctgatcatgttggtcagttggtgacagctagaggtattgttactcgttgcactgaagttaaacctatgatgtgtgttgctacatatacctgtgatcaatgtggggctgaaacataccaacctgtcaatgctttgagttttatgccagctgatatgtgccaaagtgctgactgtaaaactaataggtctggtggaagattatacttgcaaacaagaggatcaaagttcattaaatttcaggaagttaaaatacaggaacatagtgatcaagttccagtgggtcacattccacgcactttaacagtattttgtagaggggaagttacaagacaagcattacctggtgaccatgttgctattaccggtgttttcttaccactattgaagcaaggtttcaaacagataatgggtggactgttatcagatacctacatggaagctcataaaataatttcgttaaacaagatgaacatggaaaattcagacaaccttcttacaccggaggaattggcaacacttacagaagatgatttctacacaaaattggcgatgtcgttagctcctgaaatttatggacatttggatgttaaaaaggcgttgttacttcttttggttggtggtgttgataaaaggcccgatggaatgaaaattcgtggaaatattaatatttgtcttatgggagatcctggtgttgccaaatcacaattgttgggatatatcaatagactggccccaagaagtcagtatacaactgggacggngttcatctgggtgtaggtttaacagcttctgtaatgaaagatccgatgacaggtgaaatgatgttagaaggaggagctctggtattagcgatcaaggtgtatggtgcattgatgatttgataaa

SEQ ID NO: 3958 - DNA, 891 bp, Diabrotica virgifera
  misc_feature (748)..(748): n is a, c, g, or t
  misc_feature (862)..(862): n is a, c, g, or t
  misc_feature (871)..(871): n is a, c, g, or t
ttttcgggccgccaaattcagatttggttggaggagataattttgaagcctctaaatatttaaggatacttcaacaggcaatgaatgaagatgaagaaggattagtagaaagacatagaggaatctatggattgaaagtagtgaaaaaatcaggtgaaactggatattgggtgatcaatactaaggtaggcaaaggacagatagtatttaatggaaaagacaagccagatgttactttcattgttaaggaagaggatgttttagaattattgtctggcaaaattccaccacagaaggcatttttccaaggcaaagtaaaaattcaagggaatatgggtgtagccatgcgattaatagaattacagaaaacagccgctgccaaaattgaggtacttagggctaagttataaattacgtttataggtaattttctttatctttctgtattgtgtacactaaggttttgttttatctttttgggagtatatattatataagtgacaaaacatactttcttgttttacacatcacttcctgtaaaaatattgtacacgctgtacaatgagtcctttatgtaaacaaatatgtaagtataaatacttgctctgttatctcctttttattacatatttttgttgataacttcagaatctattgaccttttgtgaaatactttcaatattttgttaacagttgaagaccagtgtaatttttcctgagatactaaattccaatatttttgtttcanacaagtttgttccgtaaataaactagacatgtatatcattgtatattattaataatatgaaaccttgatgtctgtaggtaaatggtcttaatgatttaatggtttttcataatncatagtccnaagtcacaaaatagcatata

SEQ ID NO: 3959 - DNA, 1505 bp, Diabrotica virgifera
gctgtcctgtgactgatttatagttttttggctagaagtccgtcagattttttctaaaatcaaataaaggtagaatttgagggagacatgaaagagatgttttaaatttatctaagtgctatcgcgttaaataaaatggggacggtgcatgctaaaaattttcaggccgatgaaaacttcacagatagccccaattctaacttaaaaagtaaagccatgtttagggagccaccagataaggaacaaattaaagaaatcgacttggaaggcgtaaaggccagagtagacaaaatacatgtagatgggttatcacgaacaaaaaatgacattatagaagattgtattaaggaactatttaaagcaagagattttcaagatgtacttctaaaagcacataaagctcgtgtaaaattggacgaattgggatgctttaaaaatatttctgtatatatagataccagtaaaggatcaaaatctactccagatggtttagaggttacgtttaatgtaaaagaacacaaaagaataacaggtggagttagtacccatgtgggaaacaatgaaggtgtcctacaaattggaatgagagctccaaatatttttggcagaggtgagagagttcaagttgagtacagccatggttccaagaaatccagtaatttcaatttagcatttattaagccttttagaggcacataccgtcccacattaaccacaagtgtcttccagtcccattcagagtggccagcttctggctataaacaacttgaaagaggattaatatttgacttaggattttattcttggtctttattaaagcataatctgcaatgggaaggaaacattcgagatttgagtgttttaactcgaaatgcctcattcgatgttagaaaagaatctggtttaagtttgaagtcatccctcaggcacatcttatcacttgatcttcgagacgatttaatctttcctagtagtggttcattactccagttgacttctgaagttgctggtttaggtggagatgttggtttcctgaagaatgacatattcgttcaaggaaattattctattgctgaggatatagtttttcaagcatgtttcagcacgggttacatgaccagtattagtaacgatttgaaaataagtctttctgatatgtacttcctaggaggtccattatcactaagaggtttccaaaaccgtggagttggaccccactccgatggagatgcgcttggatccaaggcttactggggctggaggtctacatctttttacaccgttgcctttcaggccaggtcgaggaggaattgggtgatctttttagaacacacttttttatgaatgctgggaatattggaaacgtagaagtacttaaggatggcaacttagtcgatttaatccagaataacttgagggtctcgtatggagttggaattgcgttaagactgggtaatatggctcgcttagaaataatactgctttcatatattacgataaagaga

SEQ ID NO: 3960 - DNA, 1271 bp, Diabrotica virgifera
  misc_feature (1203)..(1203): n is a, c, g, or t
  misc_feature (1228)..(1228): n is a, c, g, or t
ctcctggacctctttgtcatcaactagtttttttttaaatctccttaaccatgtctgacgaagaagaagtttactccgaagaagaggaggaggaagaagtcgttgtaacgactaccaccactaccaccaaagtcgaggaaggagcgatagatccagaattcatcaaacgtgaagatcagaagagatctgattactgtgaaatgcttctttgtgtacatctcttatggaatgaaacgatgttccaagtaagaaatagacaatttgtttatcaaggaaattaaggttatttattaactatatcttgagatgaagaaaggaaaatggcagaacgtaagaaggctgaagaagaacgtcgcgttcgtgaaattgaagagaagaaacaaagagatattgaggaaaagagacaacgtcttgaagaagccgagaagaagcgtcaagccatgatgcaggctcttaaagaccaaaacaaaaacaaaggacctaacttcaccattaccaagagggacgccgcatccaacctctctgccgctcaacttgaaaggaataagactaaggaacaattggaagaagaaaagaaaatctccctttccatccgtatcaaacccttggtccttgatggccttagcgtagataaacttcgcgaaagagccacagaactctgggattgcatcgtcaaattggaaactgaaaagtatgacttggaagaaagacaaaaacgtcaagactacgatcttaaagaattgaaagaaagacaaaagcagcagttgagacacaaagccttgaaaaagggtctagaccctgaagccctcacaggcaaataccctccaaaaatccaagtagcctccaaatatgaacgtcgtgtagacactaggtcgtacagtgataagaaacatctctttgaaggaggatttgaaaatatcgttaaagatctcaacgaaaaatcttggaaagagaaatttggacaattcgactccaggcaaaaaacaagacttccaaaatggttcggtgaaagaccaggcaagaaatctggtgacccagaaactccagaaggtgaggaagaagccgtacgagcaagatgccgaatttatggaatacacgagattgtttagatgttccaacgaaaaaggatatttcattgtttcggagaagtgttcggacttttgtcaggatgatttagcagatgatgatataatgatcctcgancacggcgaaacagtatttttatggnttaggagccagtgtagcgaagtggaaataaattagccttaaat

SEQ ID NO: 3961 - DNA, 1545 bp, Diabrotica virgifera
cggacgcgtgggtaccctttgagtcgaaggttctaaatctcaggatcctaagagtttttttttaaatctccttaaccatgtctgacgaagaagaagtttactccgaagaagaggaggaggaagaagtcgttgaaacgactaccaccactaccaccaaagtcgaggaaggagcgggagatccagaattcatcaaacgtcaagatcagaagagatcagatctcgatgaacagcttcgcgagtacatcacagaatggcgcaaacaacgtgccaaggaagaagaagacttaaagaaactcaaggaaaaacaggctaaacgcaaaattactcgtgctgatgaagaaaggaaaatggcagaacgtaagaaggctgaagaagaacgtcgcgttcgtgaaattgaagagaagaaacaaagagatattgaggaaaagagacaacgtcttgaagaagccgagaagaagcgtcaagccatgatgcaggctcttaaagaccaaaacaaaaacaaaggacctaacttcaccattaccaagagagacgccgcatccaacctctctgccgctcaacttgaaaggaataagactaaggaacaattggaagaagaaaagaaaatctccctttccatccgtatcaaacccttggtccttgatggccttagcgtagataaactccgcgaaagagccacagaactctgggattgcatcgtcaaattggaaactgaaaagtatgacttggaagaaaggcaaaaacgtcaagactacgatcttaaagaattgaaagaaagacaaaagcagcagttgagacacaaagccttgaaaaagggtctagaccctgaagccctcacaggcaaataccctccaaaaatccaagtagcctccaaatatgaacgtcgtgtagacactaggtcgtacagtgataagaaacatctctttgaaggaggatttgaaaatatcgttaaagatctcaacgaaaaatcttggaaagagaaatttggacaattcgactccaggcaaaaaacaagacttccaaaatggttcggtgaaagaccaggcaagaaatctggtgacccagaaactccagaaggtgaggaagaaggtaaacaagctgctgatgatgatgaagatcttaaagaaccagtgatcgaacccgaaccagaagaggaagaggaagaggaggaagtagaggttgacgaagaagaggaagatgatgaggaagaggaagaagaataaatgccaagaaatgtataagatctgttatatactgaatgaaatgtaacatcagattctcaataagaaataaaaacaagttataccaattatcatcaatagaatttgtaatttgttttatttttgttccaacaaatttcaattatttattatatttattattaaataaagttgtactgtaatattgtcaagagaaaattttaatggtgttttatttgtatgttaggtttaagttataaataaaccatttgaatattaaaaaaaaaaaaaaagggcggccgctcgcgatctagaactagtaaaacaccaaagtaattgaataatt

SEQ ID NO: 3962 - DNA, 1443 bp, Diabrotica virgifera
gggggggggggggggtgtgcgacagaaacaccctaaaatataaaatctccctcaaagagggacgccctctttttttttggtttgtgtgcgggataaatcccctcccccctcggggaaaaaaaaagaaggaagaaaaaaaaaaaagggggggggcgtggggggcacgcggaaaattggggggccccgtttccatctcccccccccccccccccccctttttatgtgggtcaggagggggcggcccccttttcccttccggtgcgcccctctgggggggagggggggggggggggggcgcttttttttttcttccccccccggagcatcttgggtcattccgtaggggaaaaatgggttacttcccccttgttttaacccccccgggaagggtaaaataagtgtaagaaaatatttattttggccaatttaatttatgctccctgataaccaccctaagttagttcgagaatggctaacgtggggggttacataaaatttttcctattttatttggtgggtttaattgttgcttgtttggcacattcctttgttggacatctttgtataagattttttcctgtatctggatctgtgcgagcggccgccctttttttttttttttaaaaataaaaaataactttattcctcaagtcatgtatgtacttaaaaaaacacttgtacttttctagtcgaagagtccaagacccatatcatcatcagactcttcaggttcagactccttcttgtcttccttggcaggagctgctgcagctgcagcggctggggcagcagctgaggcaccacctgctggagcgcctccacctactccagatccaatgttggtgattagatccttgatgtttactccctcaagtgctttggcgaaaagaccaggccagtaaggttctacctctacattggcggcttttaagatggtctggattttctcaccagttacggcgatatcatcatcggccaagatgagggctgagtaaacgcaggcaagttcagcgctggtagacatgtttattatttgttatatttcgtgcaagttgccagaaaaataggccttagctcaacgagaacaagcacacgtcttgttgactttgaaaagaaagaggaagaggaagaggaggaagtagaggttgacgaagaagaggaagatgatgaggaagaggaagaagaataaatgccaagaaatgtataagatctgttatatactgaatgaaatgtaacatcagattctcaataagaaataaaaacaagttataccaattatcatcaatagaatttgtaatttgttttatttttgttccaacaaatttcaattatttattatatttattattaaataaagttgtactgtaatattgtcaagagaaaattttaatggtgttttatttgtatgttaggtttaagttataaataaaccatttgaatatt

SEQ ID NO: 3963 - DNA, 1024 bp, Diabrotica virgifera
tttttttcaacttcaccggtcaaaaacggggcacatgtgctttgttaacaatttttagataaaactaactatcgaataattaaaagaacagtaaacttaaaccggtagaagttcttcaaaataacaaaaatgaacagcgaaaagttaaaaaagatgcaatcacaagtccgtatcggaggaaagggcaccccaaggcgtaagaagaaggttgtacactctacacaagcaactgatgacaagaagttacaatcgtcccttaaaaaattatcagtaaacactattccaggcatcgaggaagtaaatatgatcaaagaagatggcacggtaattcactttaataatcctaagactcaggcatcattagcggcaaatactttcgctatcactggacatggagagaacaaacagatcactgatatgttaccgggtatattaagccagttgggacctgaaggtatcacccagctcaagagactagcaaacacagttgccaatgcaggtggcgttggaaagattgttcctgaagatgaggaagatgtgccagatctagtagaaaatttcgatgaggcatcaaaaggggaagtcactaagaaagagggtgaagaaaaaccaaaagaaaactaatttaatgatcaagaaacatttacttttagtaaacgaaacttttttgacacattttcttggtctcgattattgtttttaaattgaagacaacattttttgatatgagttgaaatcgtaaaatctaacccaatcattttttgttgatacttgggcatatgtataggatatttcataggaaatacataaatattctaatatgtgatgttttattttaaataaaaggaaatttttctgtacaagtataatttttgggtgtagtttatatttcaataatacattactttagtgaatatactaaattactctataaaaactctaaagtgtatttatgctacagccttgtaatattaactaaaagggcacagttttcttcattagttttattaaattcttttccacc

SEQ ID NO: 3964 - DNA, 2340 bp, Diabrotica virgifera
tttcaacttcaccggtcaaaaacggggcacatgtgctttgttaacaatttttagataaaactaactatcgaataattaaaagaacagtaaacttaaaccggtagaagttcttcaaaataacaaaaatgaacagcgaaaagttaaaaaagatgcaatcacaagtccgtatcggaggaaagggcaccccaaggcgtaagaagaaggttgtacactctacacaagcaactgatgacaagaagttacaatcgtcccttaaaaaattatcagtaaacactattccaggcatcgaggaagtaaatatgatcaaagaagatggcacggtaattcactttaataatcctaagactcaggcatcattagcagcaaatactttcgctatcactggacatggagagaacaaacagatcactgatatgttaccgggtatattaagccagttgggacctgaaggtatcacccagctcaagagactagcaaacacagttgccaatgcaggtggcgttggaaagattgttcctgaagatgaggaagatgtgccagatctagtagaaaatttcgatgaggcatcaaaaggggaagtcactaagaaagagggtgaagaaaaaccaaaagaaaactaatttaatgatcaagaaacatttacttttagtaaacgaaacttttttgacacattttcttggtctcgattattgtttttaaattgaagacaacattttttgatatgagttgaaatcgtaaaatctaacccaatcattttttgttgatacttgggcttctctgggccgccgagctagaaaataggcagtcactgcggactccctgagttgtgtggtgctcctggacctctttgtcatcaactagtttttttttaaatctccttaaccatgtctgacgaagaagaagtttactccgaagaagaggaggaggaagaagtcgttgaaacgactaccaccactaccaccaaagtcgaggaaggagcgggagatccagaattcatcaaacgtcaagatcagaagagatcagatctcgatgaacagcttcgcgagtacatcacagaatggcgcaaacaacgtgccaaggaagaagaagacttaaagaaactcaaggaaaaacaggctaaacgcaaaattactcgtgctgatgaagaaaggaaaatggcagaacgtaagaaggctgaagaagaacgtcgcgttcgtgaaattgaagagaagaaacaaagagatattgaggaaaagagacaacgtcttgaagaagccgagaagaagcgtcaagccatgatgcaggctcttaaagaccaaaacaaaaacaaaggacctaacttcaccattaccaagagagacgccgcatccaacctctctgccgctcaacttgaaaggaataagactaaggaacaattggaagaagaaaagaaaatctccctttccatccgtatcaaacccttggtccttgatggccttagcgtagataaactccgcgaaagagccacagaactctgggattgcatcgtcaaattggaaactgaaaagtatgacttggaagaaaggcaaaaacgtcaagactacgatcttaaagaattgaaagaaagacaaaagcagcagttgagacacaaagccttgaaaaagggtctagaccctgaagccctcacaggcaaataccctccaaaaatccaagtagcctccaaatatgaacgtcgtgtagacactaggtcgtacagtgataagaaacatctctttgaaggaggatttgaaaatatcgttaaagatctcaacgaaaaatcttggaaagagaaatttggacaattcgactccaggcaaaaaacaagacttccaaaatggttcggtgaaagaccaggcaagaaatctggtgacccagaaactccagaaggtgaggaagaaggtaaacaagctgctgatgatgatgaagatcttaaagaaccagtgatcgaacccgaaccagaagaggaagaggaagaggaggaagtagaggttgacgaagaagaggaagatgatgaggaagaggaagaagaataaatgccaagaaatgtataagatctgttatatactgaatgaaatgtaacatcagattctcaataagaaataaaaacaagttataccaattatcatcaatagaatttgtaatttgttttatttttgttccaacaaatttcaattatttattatatttattattaaataaagttgtactgtaatattgtcaaaaaaaaaaaaaaagggcggccgatcgcgatctagaactagagttataaataaaccattttaatattaaaaaaaaaaaaaaaggggggggcgggtcaaaaagaaaacacagagttaaactaac

SEQ ID NO: 3965 - DNA, 1144 bp, Diabrotica virgifera
cattttgcgatttataatagttttgtcagttttgtttattatagatttaaatagattataaatgggtacattgcttacatttgattattttcattaacatatgtattttctaatagtgtggcgcaattatataattatcaaaagtacgatttatttggaaaatagtaaatccaaacaccaaatagcaaagatgcctcatgaacatattaaatacacaaattctgtatcttcggtaaataattcagatgaagaagaagatgtggaaagtaagacttctcccatgagctacaaagaacgcaggagagaagctcatacacaggccgaacaaaaaagacgtgatgcaattaaaaaaggatatgatacattacaagaactggttccaacttgccaacagcctgatgtttctggctacaaattgagtaaagctactgtcttacaaaaatccatagactatattcagtatctccaaatgcaaaagaagaagcaagaggaggaacgaaatgctttaagaaaagaggtagtagcgttaagaataatgcagaccaactatgaacaaattgttaaggcacaacaatcacaaccgggacacactgaaactagaatttcagatgaagtgaaattttcagtgtttcaagcaataatggacgaactctttgcaacgtttagtggagtttctgtgaataatttttctgaattatctgctggagttttcagttggttagaggaatattgtaagccacttaccctcaaagatactgtgtaccaagttcttagactacaccaccatacacatacgcgtggacagcaaaattagttctgggtttatcgtgtaattaattgattcagtgtatactgtagttaagttatatattttaattttttgttgttattcaattgatagtttatattccatcttttttattttaatatgtaatttaaataaatgtggttttggatttttattccccaaaatcccccaattttttgaaaatattgttttaaaaaaggttggtttttaacaaaaaaaaaaaaaaaaaaggggggggccgcgtctaaaaggaaacccaagctttaaccaaaccggggggcggggggggggcacataaattttttttttaataaggggtcccccctaaaaatttaa

SEQ ID NO: 3966 - DNA, 1789 bp, Diabrotica virgifera
  misc_feature (882)..(882): n is a, c, g, or t
gacgatattgaagggattcgagcactttacggacagaagaccaacaaattccctccaagatttgacgacggtgatcaggacagcgactacgataatagccataacgtacctaaaactaaaccttccggaggctcagatccaagtttgtgcgccgatccgacctttgataccatatttacttctgcagaaggatacacctacgtttttaaaggagaaaagtactggagactgactgacgatagtattgcacctggatttccaaaattgatttctgactactgggtcggattacctggtaatattgatgctgcttttacctacaaaaacggaaagacttacttcttcaaaggatctaaatactggaggtacaagggcaagaaacccgacggcgattacccaaaagaaatctctgtaggcttcacaggaatacctgatgatgtagattcagctttagtatggagtggtaacggaaaaatatacttctacaagggcagtaagttctggagatttgacccatctcaaaaacctcccgtgaagagtaactaccccaaacccatctccaactgggacggaatcccaaataacattgacgcagccttccagtggaccaatggatatacttacttttataaaaataatgcttattataggtttaatgacagagccttcgcagtagacgtgacgacgccggcgttcccaaggtcgacggcgtactggtggttcggttgtaaggacgcaccggctggtaccatcggatctagtgagtcaatgagaggaacactgattggtgaagagagctcatatccgaaatttttcgatacttcgaatgataatgatacagatgtgcaccatgacatgtccgagttaccaccgcaagaattntacagcgggaaacggaaataaccacgctagtcgcacaggaatttcttttcttctagtgacactagcgacactggcggcaatgtttctagctagtgtttcatagaatagacgaagtgatcttttcgttttataaacgaagccactttgactgagactattaacaatattgtgatttgatttaggtttttattagttagaaagtgacatttacgtttatatcatcaaattcattgacgccaaataaatacacattacaataattttagtgaaaatatgtaaaaaccttttgtttactcataagttaaattgtcaagtactacaagagtaaagcttcatttacatttggcaagtttactggctgaaagtgcttccggccactaaacttgccatgtgtaaacaataggtaagcgcttgctagagagactaactagttgacagaccgactagtttacttgccgcttgtccactatttgctaacctagtagcaagatatcgtaatgctagttctacttttgtttcaggagaaacatccatgtttcagactttgtaaatttagattcaactggttttaacagttcttgaaacttttagtgagataacctcataaagatccttcaactctatctcctttaccagttgttctaaacccacccagagtatttctacgccttatccagtctctaatccaaacttatttttcgtgtttttcctgcgttgtaacgactattagactgttgggaattttgacttgccaaaacattgatagctccacgtgcggaagagcgtggtggctggttagtgttttggcaagtgaaaattgccaatagtttgatagttatggtacacctcattgaaaaacaggggaacgagtttttaatttgaacttgggataaggggggaaaaattc

SEQ ID NO: 3967 - DNA, 1184 bp, Diabrotica virgifera
gaaatttccgagagactaaatgagattaaaaagaattccgtctttgaaactttgttgaaagacaaggacgttgaacaggtatttgctaaagtcaaagcaatcgctggtgatgttggtgaagataaattaggaatttcagactcagattggcaactgttaactgagaaaataaacgtaattttccactcagcagcaactttagattttggagatacccttgatactacagtaaatattaacctactgggaacacgaagagttactgagttggccaaagcatgtagaaacttagcagttttcgtccatgtaagcagtgcttacgtcaattcatacaaacttcatgctgatgagattatttatccactacctagagatgccgatgaattaatagctaccgttaaaaaactcagtaaagaggagttactgaaagaaacacctgcactcttaggagaccacccaaatacatacacaattacaaaacatatggctgaacatgaaattcaaaaatgtgaaagtttgtttccttgtaccattgttcgaccaagtatgataattggatgttggaaggaacctgttcctggatggacaataagcaaaaatggaccacaaggtttcttaatgggtgccgcaaaaggagtcatcagaaggttgccagttgcaacaaatttagtgtatgattacattcctgtcgatatagtagttaacagtcttattgttgcaggcgctcatgctggtcataccaaaacatcaaaggtggaagtctaccatgcaacatccagtacacgggaacccttccgttggtcgtccgtagaaaacaaaatcacggagtatctccacaaataccctctgtaaatctgcagtttggtatccacatttgaagtttttacctacaattacatgctacaatgttactgcgtttttcgttcattccatacatgtcatagtgtttatctagatattgcgaaaacaaatctatggttgacgaatattactattggacttacgaaaatagcgtgcataattatagatgcgtgatatcttaattcataacgagaaacagaatattacctgagatctagaaaggatcaactgaattatcgcctaccagagagacatacacatagccctctaaggtgtatttgcagaataacttaatgattaatagaatctctatgactacaagt

SEQ ID NO: 3968 - DNA, 1085 bp, Diabrotica virgifera
  misc_feature (986)..(988): n is a, c, g, or t
tagaaattgtcaaaagttgctattttggtgcatggaagagagcagaggtgactgccgccaagcaccaacatgaactgtaagctgttgacgtcttttgtactcctgttcggctgttgccacgcagcactcatcaccggacaaaacggcctcctcgataaagtcacagatttctttgctattgacaacatcgccagtttggacgccaatgctcgtgccaaagtcctcaacaacgaaataggtgctgacctttctgcaggtattggcaaacaaggaatcggcgcttacggtcaagttaacggcgatgttcttggacaaaaagccaatgtccaggctgatattcttaacggacgtgaaattgatcagcgcaaccacgaagtatacagagacaactacggacgtcagtacacccttaagcgcgaatacgtcggatccaaattagtgatggtccgccaatatttggacgacggacagatctacgttgaaggcaaaaacgacgacaacgaaatccagtacacacaaccagacaacaacaattatatgtgggacgaacgtaccggccaatacatcctcgtcgaccccagttatctccagtcagtcaacggacaatacaatccttccatctactatccctctaacggacaagaagtcatgtatcctaactccggagacagaatgatgtaccaacctaatacacaagtagtttacgaaaatcaacccggagactccagaatcatgtaccagcctggtggacaagtagtttatgaaaagcagcctgaacttgtacttagagaaggtggtggtctcatttcccgtctcagagacagggctcacaaactcatccgtggataaacaaatctatgatactcaaagaagttgaggacctccaatactctgaagctaactctaatcaaagagccaataataaatttgattaagttcttaagtttataatattttaaaataataaaggcattaaatttcaattnnncaaacacagaaaaaaaaaaaaaaaataaaaatatatataaaaaataaaataaaaaaaaattaaaaaaatgggaaagaaaaccaaaaaaagggggggg

SEQ ID NO: 3969 - DNA, 983 bp, Diabrotica virgifera
tggtggggtgatggacactggcatttgagggataattttagaaaattttcttaaaatggtatccccccaagcaatgatcggtatatgtgcaggcgtctcagcaaccctatttatcggatattgtttttactttgataaacagaggcacaacgacccagaattcaagaaaaaattgaggcaaaggagacgtgctcgtagagatgcagctgcatcatctggaaaaaggtctagtacagtgtttcctaacattaaagatcatgaagcagtacaaagatttttcttgcaagaaatccaactaggagaagagttattagctgctggcgaccttgagaatggagtagaccatttgggtaatgcagttactgtttgtggacaaccaaatgatttactgcaagtcttacaacaaacactacaacccaatgtgttccatttacttatcgaaagactgcctgctgtggcacctcgtctcatgaaagcacaaagtggtcaaagcgcttcattgcaagaagatgatgttgagtgattgtagatacctttttgctctttcactagtctcattttgttagaactgttatagattcctgtcatccttcattgttgctgtatcaaagtaataaattagttttacttgagcaatatctcatattttgtatgttgtatgtttttgcggttacttgaaagaatgtgaaatacaaagtgataatttattgtcagttatgaagatatgtatttagatggaaaatatagtaaaatatatttctggatatatttaaatacattctatttttagtttcacaagataaagtttttttaaaagacaaaagaccccttaaaaattaacaaataataaataaaatttttaatttttattttttttttaatataggggggggggcccccaaaaagaaaaaaaatttaccaccgggggggggggaacacaatttttttttttttaggggcccccaaaaatttttttttggggg

SEQ ID NO: 3970 - DNA, 1166 bp, Diabrotica virgifera
cacttttcttccggatgagcgacatatcgctcatccggaggaacagtgtcccatctcaaaaaaccacgtttttcgggggagctaaaaacagattttttagatcttaatttgattataagtttgagacggtaactgctaaaattttataaattaaaaacgaagaatgtggataagtgaatgtttctaattgtgtaagaggcaaatccaaagaaactatgatgtctgatttaacaaagaaaaaagatcagaattttgagttgtgtcacttttcttttgaaatattgaccacttttgttaaaaataacgaaaaatactttacgacacttctcgaaatacaacagtttttgtgttaaataacgataaattcacgtcgaatgtcagagcataactgaaaagtgtcattgttccggaataaaagtattcattttaccaaaccaaagaataatgacactactgccatctttagaagttggaagtaaatatctatgtgacatttttcctgataaaagtataggatatttggagtcaatttaacaagataactggatttatgcattttttgagttatgtcacttttcttccggatgagcgaatatggttttctaagaatcttgtataaaacaagttttacaacaaaatatatttttggcgtggtatggcatattgtatgccagtggttaagggttaaacgaaattgataaatatgcaaattatatttagcggtttacagccacttttttaacgaatacctcaagatatctgattgtatttgtaaatctctcctgtagacgttgtaattattgccatcaaaattgtgccgagcagagtttacattccttgtacagattgatttatctcaaaacttctagattcccatctgttaaataatgtatataagattatcccttcggctatttgctagcatgtcaagatgttgtagacgaatctaggaccgagaccgataattaagtcactttataaatttttatttgaactctatatgtataaataaatgaaaaaatactcgtacatcattaataaatggccaatcttcccttccacctgaaaaatttttaccttttttcatagaataataaaccttttcatctttttaaaaagtcttttttaccctttttcagcccccatttatttctttcctaaatcta

SEQ ID NO: 3971 - DNA, 1339 bp, Diabrotica virgifera
attctcaagaagattgggcgatgaagggcacttcgctggagataaaatcactaaaagagctgacaatatcgatgaacgtagaatggccaacagagagaaagctcaggcactcctggaaagacttagagatcaattggagctacagcagttcttacgagattgcgatgaattgggcgaatggattcaagaaaaacacatcacagctcaagacgaaacctacagatcagccaagactgttcactctaaatggacaaggcatcaagctttcgaagccgagattggtgctaacaaagaacgccttcacaacctccagaaggccgccgaagaattggctaaagagaaaccagaatatgctagtcacattcaaccaaagatcgaagatatggtagatcagttcgatgttttggagcaaacgacgaaagagaagggcgaacgcctgtttgacgctaaccgcgaagtacttatccaccaaacttgcgacgatatcgactcctggatgaacgatctcgaaaaacaaatcgaaagtgacgacactggtgccgatctggcctccgtcaacattctcatgcaaaaacaacagatgatcgagacccaaatggccgtcaaagcccgccaagttggagaactcgagaaacaaaccaagcatctggagaccgctgctcccgaaaaagacatggaagaaatcaaagtcaagaagaagaaggtggaacaacgtttcgcgcaactcaaagaaccgctcatcgaaagacagagggtgttggaaaagaagaaggaagccttacagttcaggcgagacgtcgaggacgaacttttgtggatagccgaaaagatgcctcaggctttgtctacagaatacggaaacagtcttttccaggtgcatatgttagagaagaagaatcaatcgttacagacagaagtagataatcacgaacctaggatcaacacagtttgtaataatggacagaaactaatagatgaaggccatgaagactcaggcgaatttagcagactaataaatgaacttcacaaagcgtggcaagaactcaaagatgccatcgagaaacgcagagaaaacctacttagaaacgaaagagcccaacaatacctgttcgacgccaatgaggccgagagctggatgagcgaacaagaactttacatgatggtggaagaccgaggcaaagacgaaacgtcggcgcgcaactgcatgaagaaacacgaaagcctcgaagctgcagtcgaagcttacgcggatacgatcagatcttttggagaaactgtacgagctttagctgccgaaggtcacccgctggctgagcaagtagctgtcaaacagtcacag

SEQ ID NO: 3972 - DNA, 997 bp, Diabrotica virgifera
cccacgccatgagtcgattaatacttcagtcgttgctggttaccttcttgttgttccaaacaatttcggcgcaaccctacctaccccaatattggaaaagagcagcagatgtaggcgtaaatcatggtttagaaaagcgagatgcatcatggtggaatgaacatgtagtagaacatccgacatattatgttaaaagagcagcagatgtaggcgtaaatcatggtttagacaagcgagatgcatcatggtggaatgaacatgtagtagaacatccgacatattatgttaaaagagcagcagatgtaggcgtaaatcatggtttagacaagcgagatgcatcatggtggaatgaacatgtagtagaacatcctacatattatgttaaaagagcagcagatgtaggcgtaaatcatggtttagacaagcgagatgcatcatggtggaatgaacatgtagtagaacatccgacatattatgttaaaagagcagcagatgaaggcgtaaatcatggttggatatacgacgatgaacgtttagataagcgaaaggctgtcaaccgtgactggataaataacgaacagattttattgaagcgagatgccaaattggcagtgtcaaggtctggtggatggcgtgaggtcaagagaagtccctctatgacttacatccctttaggtgctagatagagaagtccgcaactaggcctcctgcgacaggtcatgagtcatataccttggaatcaataagaagtgtttctggaaatttctgtaaatttagatgagcctattatagaataaaattactgtaattatgtatctgaaaatataaacatattttatctaataataaaacactgaaaacgtttgttttctatacttccacaaaataaattatttatactaagtgactacaaccccaaaaagtgcctttctcatcacttgaccattaagtaaccgggggccgaatccatcaaattaaacatatttttgtttaaccc

SEQ ID NO: 3973 - DNA, 1028 bp, Diabrotica virgifera
aaaataatttattttgttctaacgcgtaattttttgattaaaattaaaaattatagttttgcaatctcaaaacaaccgcgctagagctacaggtttaaaaggaagtcatcaaaaccatttttacgacttttgtggtcatttttgaaaaacgacgatatactgtggactacatatatgagatcattagaacgagaaagatatactcatcgactgttaattttgtattgtttttagtatacctttctctgttttataaatccagatcatgatagattgacgttagaaattattgttcgcttttcaaacgtgtattagcagaattttggcaaattaaatataaaaattcgagatcctttataaaaaggtatatttaaaattccctaagtaagggttatattaagtaacagaacgttttcggattaaaaaatccaccatcagtgttacaaaaaaaaaatagcatgcctgaggcaccgaaatgttacgggtaaaaaccctttaaatgttgacagttgttgtcttatactatgatgttgctaatattcctggatattacccagggcaacacaggactcttcccacgtggttgaaatttgagaatttcaatcacgaatttgacacttccaaaatacgtaaagttttccacatctttaatctgcatgttgtgaatagtaaatagagtgtcgttccttgcattggttctcatggacttgattttactaatattaattttcaaatctattttattggcttcagtggaaagtgaattttgaaaaaaaatctgctaaaaatagtttaaaaaatatttttttttagttgtgacactatacagataaaataacgaaaaatttacgaaataatatttatcaaaagtggctcttgcagtacagaatataatatcattattattatctagttaatagactcgtactttttaacgatgtaactttaaaacaattaacaacgttaaaaaaatactgcaaaaaggaaagataataagtgataaatgtgtcactttttcttgagcacta

SEQ ID NO: 3974 - DNA, 341 bp, Diabrotica virgifera
  misc_feature (199)..(199): n is a, c, g, or t
  misc_feature (317)..(317): n is a, c, g, or t
agaggagtttacataatttgcaaaattccaaacttaatccgaacattccaataatttaacttcagtaaccaaaaattggaattttaatgggttcaataattccagaattaagaaaactttgccggtaagcacatttaatcataacctaaggggcccgtacttaaaaccgaacaagaacgacggttgttgtgctcttttnaagtttgtttttcgattggaacaaatcacggtcaagtagtttagtttgtgtgatatattatatcaacagtataattcataatttattttgttgttaatatgtatagatctatttcaancaatatttgcaataaacaacaagt

SEQ ID NO: 3975 - DNA, 438 bp, Diabrotica virgifera
  misc_feature (29)..(49): n is a, c, g, or t
  misc_feature (62)..(94): n is a, c, g, or t
  misc_feature (247)..(264): n is a, c, g, or t
  misc_feature (378)..(398): n is a, c, g, or t
ccgggccgacccaaacgtcaactttttcnnnnnnnnnnnnnnnnnnnnnatacttataatcnnnnnnnnnnnnnnnnnnnnnnnnnnnnnnnnngcattatggatcgaacacgtgtatattaggttgtgaatcaagcacgttaaaatacacccaattagacacgccaactgcatgttttaaactttttgacagttggtcatatttgcttattgtctgaattaatcaaattagtttaatttttatggnnnnnnnnnnnnnnnnnncaacaaaatatagagtaagaaaacaatatattagatggagattggtagaaattttgttggaaatcaaattgtgtaaatcgaagcacttcaacattttacatttcccaaataggnnnnnnnnnnnnnnnnnnnnnctaaaacatttacagttacagctcccggaacaaaccatga

SEQ ID NO: 3976 - DNA, 293 bp, Diabrotica virgifera
  misc_feature (9)..(147): n is a, c, g, or t
  misc_feature (149)..(197): n is a, c, g, or t
  misc_feature (199)..(219): n is a, c, g, or t
  misc_feature (222)..(250): n is a, c, g, or t
  misc_feature (252)..(265): n is a, c, g, or t
  misc_feature (267)..(280): n is a, c, g, or t
cgcgtccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnannnnnnnnnnnnnnnnnnnnnnnnnnnnnnnnnnnnnnnnnnnnnnnnncnnnnnnnnnnnnnnnnnnnnngtnnnnnnnnnnnnnnnnnnnnnnnnnnnnngnnnnnnnnnnnnnncnnnnnnnnnnnnnnccacaattttttt

SEQ ID NO: 3977 - DNA, 269 bp, Diabrotica virgifera
agtcgtagtactctgacaacgtgattgaaaacaaacttcgtttcgctgtattccaagacaacctcgtagagatcgaggtacacaatgctaagtacgaaagtggtgagagagcctactacatggctgttaagaggggcgccgattggtcgagcgcggatttccaggcaaggttaggtcgtcagtatggatttatgcttatccaatctattatagctaaacacgtagccgttctcatggtccatgcagtatttgaatttgtttgttgagat

SEQ ID NO: 3978 - DNA, 298 bp, Diabrotica virgifera
gtgcgtcgtcataaactgatttcgttggtgggcgaatggtccgacatcgataggaactacgccatatctctgatcgcctgttcgaaaacttggaacaatgccatccagaatggactattagtacggtactatgggcgcggcttgggacggatcacgcatcgatgtctagaggagatgctatcgtcactctcgtctacgatacagtttaaccaacgaccttataaatatggttaagcagtggtagacggatagttatcatcgctctaggatgaatcttacagatatcaaagatatggac

SEQ ID NO: 3979 - DNA, 303 bp, Diabrotica virgifera
acacaacgtgggacactgttgcatgccgttgcatgctggttgtgactgctggttgtagctgcatacggataactacgtgttgcgcgatggccacacgtccgaagcgcagcatgcttcgaccggcatacataattgcgtgactggtgttaacaacgtaccaatctcttctaatagtggcatcatagaacatgtgttgtcagcagaagtacactcggcagctgttgcactcgtaggtctagtttccaacacagcagatcatggaccatggcaattcacctgctagagggatatccacaacaaggt

SEQ ID NO: 3980 - DNA, 342 bp, Diabrotica virgifera
  misc_feature (44)..(64): n is a, c, g, or t
aagagtcggacctacccaaattaaaattattgaaatgacagttnnnnnnnnnnnnnnnnnnnnntagaagattaaatttgacaaaatggcaggtggtacttctgactacaggggtccatcaattaatcccgatcagcaaaacattacttattctaccatcactaagcaacaaccattaacaaaattcccaataaaaaaccaaggccataattttaccggcagtagacggaataagaacagaagagtacaccattgcactacgaactatagtccatccaaaaaatgtactgttctcatccaaaatgtcactcggaagaatatgcatctacctttcaagcatac

SEQ ID NO: 3981 - DNA, 400 bp, Diabrotica virgifera
  misc_feature (20)..(41): n is a, c, g, or t
  misc_feature (132)..(153): n is a, c, g, or t
  misc_feature (201)..(229): n is a, c, g, or t
  misc_feature (234)..(247): n is a, c, g, or t
  misc_feature (249)..(265): n is a, c, g, or t
  misc_feature (287)..(302): n is a, c, g, or t
  misc_feature (305)..(324): n is a, c, g, or t
  misc_feature (335)..(361): n is a, c, g, or t
  misc_feature (364)..(399): n is a, c, g, or t
gtccgataattaaatgttcnnnnnnnnnnnnnnnnnnnnnncaccctttaacttgtggtttaatattattaatacaaacaattttcacatcaattattacaagattaataaattataattaccgaatttcgnnnnnnnnnnnnnnnnnnnnnnttcgagggacaataaaccctttaaattaaaaaccccagaattgctccnnnnnnnnnnnnnnnnnnnnnnnnnnnnntaacnnnnnnnnnnnnnngnnnnnnnnnnnnnnnnnctatattaagatttattttagnnnnnnnnnnnnnnnnctnnnnnnnnnnnnnnnnnnnnatgaataaccnnnnnnnnnnnnnnnnnnnnnnnnnnnctnnnnnnnnnnnnnnnnnnnnnnnnnnnnnnnnnnnnc

SEQ ID NO: 3982 - DNA, 407 bp, Diabrotica virgifera
  misc_feature (343)..(362): n is a, c, g, or t
gagaaaatcaaacggaagttaaaatgcttgtaatattggcatgggtggcttttggcaaattgagctacatcctgaagaataagaaatttgcgcaaaatcttaagtctaaagtcttcaaccagtgtgtgttaccagtaatagacggagaggcagcgctgaaaaatctatttgaatttactaaagctagatttttcacagttgattactgtgagtgtgtagagaaacatactgcggtcggtcaagcgaaacgtagaacaagggttaacgagaaggtatcaaagtttgcttcctacgaaggtaattatttccatttactaaggctgaaaatcagtacacacattcnnnnnnnnnnnnnnnnnnnngttattatagtcggtcagctgtatgacgggacagagccggtcagt

SEQ ID NO: 3983 - DNA, 288 bp, Diabrotica virgifera
aatttttccaaaccgtttttaaaatcgagaaagttttttttaatagtaactggagttgttgttggtattgttctccttattaaaaataacagtagcaaggtccaaaacacaaaacgggacaaaaagttacaaaatccaagattaaacaaaccaaccggatgaaccctcaaggccctgggaaattaaccaaattcaatacaagaatacccaacctcctccggcaacccctaacacaaaccatggtaattaaccacaagggaaagcaaattccataattggcaattacca

SEQ ID NO: 3984 - DNA, 311 bp, Diabrotica virgifera
  misc_feature (165)..(215): n is a, c, g, or t
cacgcgtcaggcaacctcctcctgagcgcgtcaaatagaagtctgggatttcgatttacactgattacgatgtgagttacggaatgccaatcgaaacacgaaaacgaggcgataaactccaacattccgatttcgggtaataaggcttttcatcgattgtgattnnnnnnnnnnnnnnnnnnnnnnnnnnnnnnnnnnnnnnnnnnnnnnnnnnnatacacggtttatacgacatttgacaggagctcgaaataaattactgaatgaaaagccctattacgattcgacttgggtatttcggttcgctttgt

SEQ ID NO: 3985 - DNA, 408 bp, Diabrotica virgifera
  misc_feature (141)..(162): n is a, c, g, or t
  misc_feature (210)..(241): n is a, c, g, or t
  misc_feature (243)..(256): n is a, c, g, or t
  misc_feature (258)..(274): n is a, c, g, or t
  misc_feature (296)..(333): n is a, c, g, or t
  misc_feature (344)..(370): n is a, c, g, or t
  misc_feature (374)..(394): n is a, c, g, or t
actcgcgggccgatgcaagcctctacagtgactcgggttatattattaaatcaccctttaacttgtggtttaatattattaatacaaacaattttcacatcagttattacaggattaataaattataattactgattttcnnnnnnnnnnnnnnnnnnnnnngtaggaggaatattaattctttttatttatataaccagaattgcttcnnnnnnnnnnnnnnnnnnnnnnnnnnnnnnnncnnnnnnnnnnnnnngnnnnnnnnnnnnnnnnnctatattaagatttattttagnnnnnnnnnnnnnnnnnnnnnnnnnnnnnnnnnnnnnnatgaataaccnnnnnnnnnnnnnnnnnnnnnnnnnnncttnnnnnnnnnnnnnnnnnnnnncaaataatttaatc

SEQ ID NO: 3986 - DNA, 210 bp, Diabrotica virgifera
ttgttcttgcttgcgttgcattttggcgttgcttggtggggtggcggtgagtaagtcgcgttgctcaggtgtttcctgtggctgtgtgtggtggcctccatagtgtcgtctaagaagcttctggggatctctcaagcacccagtctcgattacgatctgctgttaagtcatctgtttgctgggttggggcatttgaagatctcttggtag

SEQ ID NO: 3987 - DNA, 364 bp, Diabrotica virgifera
ccccacgcatcaagtaggtgtctatgtctcatattaccgaatcgacattaccgttgactttaatgtcacttgctaaacggtcctagtgaactatggtgggacggacatggtgaccacagcaataaagagcatcttcaattcacgtgaattcaagcatcatgcaaattcacttttaatacacattagagtagcgaattatcctcacacatccattggtacagatgcttcccataataatacacgtcagcaccgtgctatatcatgcccatttggacaaacctaacgacgaccttgtaccaatcaattttgtattgcactatcgtacattgtaccaatacaagatattagattagagactcaccat

SEQ ID NO: 3988 - DNA, 73 bp, Diabrotica virgifera
  misc_feature (25)..(51): n is a, c, g, or t
aactcccaatcaatgagtcctactnnnnnnnnnnnnnnnnnnnnnnnnnnncttccaacaatctagtatctaa

SEQ ID NO: 3989 - DNA, 164 bp, Diabrotica virgifera
cacgcgtcagacttttagttaatttcggctactgtaatattctttagtgtcagtttacatacattttactgaatggtagctccatagtattgtgagagcaaatcataattgtacaacggctaaatttaattattgatacttgtgttacctggagtatcagttca

SEQ ID NO: 3990 - DNA, 405 bp, Diabrotica virgifera
gaagacagttacggcgctaataaaacatgaaagaatagaactaaattatcccagagcaaatgaatcaaggatgtacgctgaaaggttaatatctgatgcaattcgttatggagactgtcacaaaacaactatggagatggcagactactggttgacagaaaaacaactgatccacaaactctttaaagtgttagtttccagatacgaaaattacaacataggctacactagattggtaagagctcccaaacttaatggagaaaccagagagcgagctgtattggaactaagaggtaacccatatccttccttgtggccagagaataattcaaatcgagatttacttcataatgtgttactagatgaggctaaaaatgcatacacgatggtaaaatataatgaaat

SEQ ID NO: 3991 - DNA, 269 bp, Diabrotica virgifera
ttaactttttaactagtggaaccttaattacagtttcagcataatcctgattaagaatgtgaatcggtttacaaattaatttagtgagatttagcgccctaatgaaatctcataataatatttttcccgctgaagccactcttaaatatgttattactcaagctttagcatctgctattgtattgttttcaattcattaacatttacattcttcagattttattttaggaaattgagatttaacataagagttaatcctaaattcagct

SEQ ID NO: 3992 - DNA, 293 bp, Diabrotica virgifera
cgcatcaaccagcccgtgggcggacgcatcgggtgttgtcataccagtgaagtcacacacattctgcagatattgtagatgatgcagctagatatgccaccgaagcaagctaaccgggatgcacacggtgccgtcctatattcgctcggtgagctgcgtatgctataccgagtcaatatgatctagccctatgagatgcttggacagctgtcgagatcattccggactggtcaaaggcttattctatgcagcgagctgctttgtcccatttctgtgcacgcggtagagcgatt

SEQ ID NO: 3993 - DNA, 402 bp, Diabrotica virgifera
accgatgacgtgttcgtttccgtatgcggcagctgtgtcgatgtggcggtagcctagttctaaagcagcgtctagtgctgtctctatctcgctgtcgtctctagcttcccatgtgcccaatccaaccgtgggcatactcaatccaccacaagaaattgttttagccatattttatttataaatgatctccacaataaaaaaatcttgccggtattcgatatttgttcaccggaactgtcttgaaaaagtggttcgattctggcaaactgaccagagacgatctctttattgtcaccaaactcccagctccaggtatacatcccgatagggttgaaaaatatctgacaaaatcgttggctgatctgcagttggattacctggatctttatcctatacactttc

SEQ ID NO: 3994 - DNA, 387 bp, Diabrotica virgifera
gtccaaaacattagacgaaaacggcaaagaagagactttacatggtgttgccaaaaccttaccacaacatgagatgatgaggcaagcattcaaagtacaggtcacgtatacaaatgaaatggccttttacgatttaataataccgacattacaagcttttcaaaaagaactaggaattaagaacgtaattgactgctttcctgaatgctatgccactaggaagaacctaaacgcatctgatattattgacgacaatgctgtaattgttttagaaaatttacaaatagcaggtttccaaaatatagaccgacatatagggtttgatttagaaacaacaaaactggtgttaagggatctagcaagtttgcacgccgtgcctttggcact

SEQ ID NO: 3995 - DNA, 323 bp, Diabrotica virgifera
  misc_feature (17)..(60): n is a, c, g, or t
  misc_feature (186)..(215): n is a, c, g, or t
gcgtcagtaatgaatcnnnnnnnnnnnnnnnnnnnnnnnnnnnnnnnnnnnnnnnnnnnncagaaatacaaaaagatataagaattaaataaaaatggtggtgacaccatagatgggtggctgtcactttggttatattcttctttggccgtggatgttacttcttcctccttgcaaatcccctgnnnnnnnnnnnnnnnnnnnnnnnnnnnnnnaacttcctgtcgggaaatattttcgtgttgctcaagttaacccctttgctagatagccacctttggcaagcggtgatttttattcataggcccacagttttggccctt

SEQ ID NO: 3996 - DNA, 96 bp, Diabrotica virgifera
aggcttgcggctatccacatagttgccacctttctttacgtggttttccctttaagtccgggatttaatctgaaggatttaatggtggaaatttaa

SEQ ID NO: 3997 - DNA, 372 bp, Diabrotica virgifera
  misc_feature (2)..(33): n is a, c, g, or t
  misc_feature (36)..(52): n is a, c, g, or t
  misc_feature (54)..(66): n is a, c, g, or t
cnnnnnnnnnnnnnnnnnnnnnnnnnnnnnnnnaannnnnnnnnnnnnnnnncnnnnnnnnnnnnnaatttcgctagaaaatatactagacttatgtcctcattaacaatcaattcaaaaggggggggtcttctaaaggttttcaacttcaatgcccatgtcagtacattcaatacctctcctaaaggatccataaatttaattacaagggcctttttttaaaaacttcttccctggaaaaaaccttgtgtttcccaaatttaccccttttggtaataccccctttttcccaatttggtttttctgcaaagtgccccaagtttttgccctttcaaaaagttttccactcgtgatggcacattggaccccccc

SEQ ID NO: 3998 - DNA, 231 bp, Diabrotica virgifera
  misc_feature (63)..(63): n is a, c, g, or t
tacaccatcgacgacgagcatcaaaatatcgtgcagattctgcagcaatttcctttggctagnaaaattcatcgtcagaatgttgggggattactcaatggatttttgaacaaataaataagatttatccaaatgatatggccaaaatgggagtatacactgttggacgaatagctccacttacacaactggttgaatcttctcgagtgaccatactacgtatatccaaag

SEQ ID NO: 3999 - DNA, 278 bp, Diabrotica virgifera
aaaaggttcaaacctaatttacccttaaatgcaacttcaaaccccttcaaaaggtccaccaaatttaatttcacgggccttcttttaaaaactctcaaatgggaaaacccttgggttaaccaatttaaacccctttgaaaaaaacccccttttcccaaattgggttaaaaccaaaaaggccccaacaattcccctttccaaaaatttgccaaccttaaagtggaaatggaaccccccttttaccggccaataaaccccgggggttttggggtttaccc

SEQ ID NO: 4000 - DNA, 391 bp, Diabrotica virgifera
  misc_feature (7)..(25): n is a, c, g, or t
  misc_feature (74)..(118): n is a, c, g, or t
  misc_feature (137)..(175): n is a, c, g, or t
  misc_feature (187)..(187): n is a, c, g, or t
  misc_feature (193)..(222): n is a, c, g, or t
  misc_feature (228)..(256): n is a, c, g, or t
  misc_feature (275)..(288): n is a, c, g, or t
  misc_feature (290)..(307): n is a, c, g, or t
  misc_feature (309)..(354): n is a, c, g, or t
  misc_feature (357)..(387): n is a, c, g, or t
aaataannnnnnnnnnnnnnnnnnnggtaaagaaaattttaattaatggaaaagttaattagtattggtgagannnnnnnnnnnnnnnnnnnnnnnnnnnnnnnnnnnnnnnnnnnnnacccttggtgtatcagggnnnnnnnnnnnnnnnnnnnnnnnnnnnnnnnnnnnnnnncgaaatttaaanagagcnnnnnnnnnnnnnnnnnnnnnnnnnnnnnnaataannnnnnnnnnnnnnnnnnnnnnnnnnnnnaatgaaatggttattccgnnnnnnnnnnnnnncnnnnnnnnnnnnnnnnnnannnnnnnnnnnnnnnnnnnnnnnnnnnnnnnnnnnnnnnnnnnnnnttnnnnnnnnnnnnnnnnnnnnnnnnnnnnnnnggga

SEQ ID NO: 4001 - DNA, 345 bp, Diabrotica virgifera
acggacgcgtgggttcatgggccattgcacaaactgttaccactgttgctggtatcatctcattatcccttcgatactgtcagttggcatatgatagatcagtctggacgtaagaagatcaatttcatctacattggcactgatcaatgctgggctacaatctccatgactgatagtatcggtgtcatcttcactggagctttctccatcgtcctcggtggtactggtggagctattgtattgggcatgtacgatgaaatcagattcttgattgagctatttgtttttcattgctactagaatcacgcatcaatatcatcactccaatcgatttttcctatgaaa

SEQ ID NO: 4002 - DNA, 389 bp, Diabrotica virgifera
acggaagcgtgggttcacatttataacttaaatgataagcatgttatttgaaaaaatacctgtaatgttagaaaccataatctttaaacgcgatttcccaacaatctactttgagttgtgcttctatattgctgagggtgcgatatatgttaaaattcctaaaaagggctatatcatagcactagttttcacagaacaaaaaactttgcattatcttatcaggttatacgcattttaggtaagcactgatgatggtcggccatccgatcgaaaactagatctgtgatgtagccctttttatggattttaacaaatataccttttataaaggattttttttcgtttttgtttatagagtattgttaagtttgaaaaataattaaataaat

SEQ ID NO: 4003 - DNA, 332 bp, Diabrotica virgifera
  misc_feature (38)..(55): n is a, c, g, or t
gcacgactcaagagtgagtcgaattagcagttaacagnnnnnnnnnnnnnnnnnncgctgaattccatgctatgttggaccgtcagatggctaacacacttagacaatccgttattgcaaatcacgttgccgatcgcaatgtcgacgctgtagatgaagttgattggtgagatagtgccgttttgggagtcatacatcattgacactgtggatcatgctgggctttcagtagcaccggatctctcgagggtcagatcgcgatccacaagactcatcgtgttcctctcagtgagcaagcactggtaaactgtgatacatcaggaaatgcttgg

SEQ ID NO: 4004 - DNA, 142 bp, Diabrotica virgifera
  misc_feature (119)..(141): n is a, c, g, or t
agaagtaacacgacatatacagtcatttctactacggatgttaaaactgtcattgtggtaggcccgcatagatgttaaatgaaataatataaactcttatgatatacctctttatatgnnnnnnnnnnnnnnnnnnnnnnng

SEQ ID NO: 4005 - DNA, 417 bp, Diabrotica virgifera
  misc_feature (377)..(377): n is a, c, g, or t
agtctatctatatcatagtaatcttttgaatatcaaggatttttatgttaattggaattttttctataggataagctcgtttctttataagttgaacattttcattgttgactttgtagaacaaaggaactgcctagtgctccatcgataaacttcaatgcttcaacaagtctttttttgtattgtgattgtagtggaactccataaagctggaaacagcgaatgggaactttgaatagatgtagcggaaatttcaacagaatagcacgtttttttgttatatttggaccaccaatttttaaaatccagaatgtcattagttcttaccatttgtacagtaaatttctgcctctttggaaaactacagattgcttcanaaacttccattggtgtatacagcctatccatgtgattgag

SEQ ID NO: 4006 - DNA, 332 bp, Diabrotica virgifera
  misc_feature (33)..(47): n is a, c, g, or t
  misc_feature (49)..(84): n is a, c, g, or t
  misc_feature (107)..(133): n is a, c, g, or t
  misc_feature (154)..(172): n is a, c, g, or t
  misc_feature (174)..(204): n is a, c, g, or t
  misc_feature (249)..(266): n is a, c, g, or t
  misc_feature (275)..(322): n is a, c, g, or t
gtaaaggtaaattttatttatagatagtgaaannnnnnnnnnnnnnngnnnnnnnnnnnnnnnnnnnnnnnnnnnnnnnnnnnnacctggtgcatcagggactaggnnnnnnnnnnnnnnnnnnnnnnnnnnncaaattcaaaatagctagagnnnnnnnnnnnnnnnnnnnannnnnnnnnnnnnnnnnnnnnnnnnnnnnnngaatgttaatcgtattcaaatatatctaaatctttatgatatagnnnnnnnnnnnnnnnnnncaatatcannnnnnnnnnnnnnnnnnnnnnnnnnnnnnnnnnnnnnnnnnnnnnnnaagcataagc

SEQ ID NO: 4007 - DNA, 346 bp, Diabrotica virgifera
  misc_feature (188)..(208): n is a, c, g, or t
aaaaaattcatatttgtatagtaaatggtatattttaaagtattttattgtaatcaaacgtaaaacgtttccatcaatatcgtggtctttatgaaatgaatgaatatcacatgattattaactatatttacaagctccgtatttgtatcttagatctacaaaatacatatacggatgcacttaactgnnnnnnnnnnnnnnnnnnnnnggtttatatataagctaagattcattcatttcatatactgcaatatgttatgactctagctttacataggagtatccattaatggatatacaatcatgaatgcaatatgtcttttagctatatcagcttattggggag

SEQ ID NO: 4008 - DNA, 166 bp, Diabrotica virgifera
  misc_feature (34)..(52): n is a, c, g, or t
  misc_feature (59)..(111): n is a, c, g, or t
cattattcaacaaatgtctataattatgtttttnnnnnnnnnnnnnnnnnnnatctccnnnnnnnnnnnnnnnnnnnnnnnnnnnnnnnnnnnnnnnnnnnnnnnnnnnnnaggaaagggggccgtgtgaaagagagaaggagtaaggtgggcggctggggggggg

SEQ ID NO: 4009 - DNA, 319 bp, Diabrotica virgifera
  misc_feature (207)..(219): n is a, c, g, or t
  misc_feature (221)..(235): n is a, c, g, or t
gcagaatcccgccaccttttgtacctacagtggagtcaatggaagacgtaagcaattttgacgaagaatttacatcagaaaggccgcagctgacgccaccaaaagaacccagacaattatccgtacaagatcaacatttgttcagagagtttacatacatggcagactggtgctgacaatagtattaagtattaaaattaacttacnnnnnnnnnnnnntnnnnnnnnnnnnnnntgaggatttcgatttattattattctatattaacaagttattatatatataccatatttttaacaaaaagactccgaatcgtta

SEQ ID NO: 4010 - DNA, 363 bp, Diabrotica virgifera
  misc_feature (120)..(153): n is a, c, g, or t
cccaagacgtccggtgtttttcttttctgaaaatcatccgaatcaatatggtaacaaatttgtttaaagtacactggctaaatttgacaatataactgcaattttaaagatccgtgtatnnnnnnnnnnnnnnnnnnnnnnnnnnnnnnnnnngatgttcatctacaaaaacaataactaaagactaaaagaggccttttccaaagctgcatctaatgcggttctagccctaaaatactttttgtactcacttttttactgtcgtttatataaaacacttgtattgaagaaatataataatatacatcctaaaataaataaaaagaagtaatactacgtaaattgtcaggaagaacgtaaagg

SEQ ID NO: 4011 - DNA, 362 bp, Diabrotica virgifera
  misc_feature (39)..(59): n is a, c, g, or t
  misc_feature (61)..(126): n is a, c, g, or t
  misc_feature (145)..(179): n is a, c, g, or t
  misc_feature (215)..(242): n is a, c, g, or t
  misc_feature (244)..(360): n is a, c, g, or t
attttacgatagtataatattttttagtataagtatagnnnnnnnnnnnnnnnnnnnnnannnnnnnnnnnnnnnnnnnnnnnnnnnnnnnnnnnnnnnnnnnnnnnnnnnnnnnnnnnnnnnnnngcagggattattacttagnnnnnnnnnnnnnnnnnnnnnnnnnnnnnnnnnnnctaataaattaacatttttattgtaaaatatatagnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngg

SEQ ID NO: 4012 - DNA, 376 bp, Diabrotica virgifera
cttacactccagcatacgcatgggccattgtgcttagaaccggtacaattcattacccggtcatggcaatacattggttacggttgatgagtagaccattcatgtaccacatgacattccgtgtgaagtcgcacttgaagattgtgaacctcctctcaatgatatggactgtcttgtacatcactgagtataagatgggtcaagaggtagaattcaccatcacattcatcatggtgatacagactctccaaaaggctagtgtatgtgcatcgttacatgtttccaagggatgtagaacaataagtttcgactaaggtatgcccaacaggaactgtctaatcttactcctacagaacagattatgggcacaacgaca

SEQ ID NO: 4013 - DNA, 371 bp, Diabrotica virgifera
aataccctatagagagtcgtattattatctaggccgacttttgtgtttatttttattgcaacctctagtaaattataaagtatcgattcacataataataagtcatgatgagtttagttgcactgtgggagaacgaagtatattgcaagcatgtcgatgggatcccgcattctttaagactgtcaaagcaatttccagaaggcaactaccactaataaaatgtcgtagattttgcaagaaagaacaaggccattatttaagcatagctcaacaacttcacatataaaatgatgaggaatgggcgcaacagaagtatgccatgtatgaaggtataagggagacacagttatgaagtggctttagtcaattta

SEQ ID NO: 4014 - DNA, 59 bp, Diabrotica virgifera
cactcggtagtgcacgtgaagaaaagtttgatttaacggtaggtcactagtattgtgag

SEQ ID NO: 4015 - DNA, 111 bp, Diabrotica virgifera
ttttcacataaaacatattcataatcttaagaaagtgtacaatctaacaataagtgattaaatctaaatcgtatgaatattgaaagtactttcaagatccagggttttaat

SEQ ID NO: 4016 - DNA, 335 bp, Diabrotica virgifera
  misc_feature (16)..(61): n is a, c, g, or t
gaaatactaaaaatannnnnnnnnnnnnnnnnnnnnnnnnnnnnnnnnnnnnnnnnnnnnngcccaaaaggttcaaactttactaagccttcaaggaaactcaaaacccctccaaaagggccaccaaattcaatttcaagggcgttcatttaaaaacttcgtaatgggaaaaacccggggttacccaaccttaacccccttgaacaaaatccccttttcccaaacggggttaataccaaaaaggcccgaaccattgcccttcccaaaaatttcccaaccctaatggccaatgggaaccccccctttaccggccattaaaccccgccggttttggg

SEQ ID NO: 4017 - DNA, 328 bp, Diabrotica virgifera
aagacgattgtcgctcatttttaaccgttggagaaccattcgggaaattgtccatcaacaagtttatgccgaataattagtcacacgacgacattttttcaatacggccgagtcagcaaaagaactactcaagaagaacaggactttgaaagagttcacttctcgtggactggatgtagactaacgtctggacatgccacatgagcaactcactggaactcatgcattgccgtgccagaaggcgttttacagtgtgattgaaacgtacaccaatggctctaatgaaaacactgcgtgcagccaagaaacatgcccctccactagaaga

SEQ ID NO: 4018 - DNA, 406 bp, Diabrotica virgifera
  misc_feature (181)..(181): n is a, c, g, or t
cagacgcgtgggttgaatttgaatttataagtttaagattaacacattcctcagaggtaactcacctcagaaggcaaagcgtaaatatgtttttcaaacgacttcttttcgttcgtaatgaagtctgttgtaatacccctatcattaaacgttttagttgatgttgttgtacttactgtangagtttttattatttgacctgttactatcttttctgaatttttagagtcgggtgctagttttccttcgctgatagcttgaactattggaatgacctcatgagtctgaggatctgtgtaagtctgctgttcgttattaatcaaacctaacctcaaagattcggtatgtgtcatgatttcttttgtaacatcttgactagcaacagtactagagtacgtgtaacttt

SEQ ID NO: 4019 - DNA, 450 bp, Diabrotica virgifera
cgattatcgaaatctaatttcgacagggtaaatggtgtcgaagtcatttctattcactattccgattgtagagattccgagggagttatggaatatcgattttgactatttctattcgacttggccacttctattcgattttcctgacttctatcatcgaaatgagttacagaataggcatgattttccaaaagcagcaatattaaatccaaaatggatatgcggtatagaaagtaatgacgcaggtaactccaataagcggtagatgaagagtatggtagagataaagtctcacggctcgatgatcggtcgttcattagtccctactgaatggcgttaaggtatttaaaaaccgaaacacacataaattatgagaaacgtttaaagaaacggattattttatttgtcatagtcattggacattaaaaggtaaaataaaaaaagtattgc

SEQ ID NO: 4020 - DNA, 425 bp, Diabrotica virgifera
  misc_feature (272)..(312): n is a, c, g, or t
cacaagcttcagctcacgcgtccgctcacgcgtccgacagcaatgctcatacagtgatcagtggtctgcgaaacatcgaggttcataatgcaatctggatcatcgatagatggatattcatgactgtcactccagctacgaaatggtcgatggtggagaatttctcttcacatcgcgattccgtcagtgagggacatccagatacaatgtgtgatcaagtcagtgatgccatcttagacgcacatcttgaagaagacccagatgctaatctnnnnnnnnnnnnnnnnnnnnnnnnnnnnnnnnnnnnnnnnnccggtgatgttacatcaggagctgtggacaactatcatgacgttgtcacacagagtgttgatcacatatgatatgacgactcttcagcaggatttgattggtcacccctgaat

SEQ ID NO: 4021 - DNA, 354 bp, Diabrotica virgifera
  misc_feature (49)..(138): n is a, c, g, or t
cgcctgcagtaacggtcctagatctccgggtccacccacacgtccgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnncgagagggggcccacaagggggcaagatgacggaaacgtgcaaaggacgccaaaaaactcctaaagagtaacgcaaaaacaaatcactgggggtggcgttaaaaaatcgagacagggaaaaacccggggaaaaaccactcaaaagccgcgcggaagaaaccccattcgccagaaggggaagtagccaaaaggcgcccgcaaatagcccccccaaag

SEQ ID NO: 4022 - DNA, 308 bp, Diabrotica virgifera
  misc_feature (186)..(212): n is a, c, g, or t
cccacgcgtccgaaaatatttcagttgtttatggctccatcggtacccaaacaaatgcggcttcaatttaattttcaaaaaagggcgggtttaataaaatttaatgcctccttcaataattccttggaaatgggtggcctttaattttaatggtccactggtggcttaaagtttaaagttgacagnnnnnnnnnnnnnnnnnnnnnnnnnnncctaaagaccaaatacaataaggggggccaaaaaacccttgaacctcccctggatccgcgcctgggaacaagtttttttcaaaagaaattaataat

SEQ ID NO: 4023 - DNA, 112 bp, Diabrotica virgifera
  misc_feature (70)..(104): n is a, c, g, or t
cccacgcgtccgatcatccttatcatttagtagatattagaccatgacctttaataagaacttttagagnnnnnnnnnnnnnnnnnnnnnnnnnnnnnnnnnnncaattata

SEQ ID NO: 4024 - DNA, 428 bp, Diabrotica virgifera
aaacttttcatatattatacgaacgcataccagctgatgcagtttttcaaaaactaagtcagcatccaagatgtggaaaatgtaaccaagaactgatgatatctccctactttgaaaaggaaaatccaagacatcaatatgagaaggatttaaaagaggctggatttcccgagttttatttccaagagcacagaaatttgacatatacttttccaaacgaaaaatctcttaaagatctgtttatttctataaatgcaaccttaccgtatgtacctgaaagcgaagttgaagaatacaagaaggattatctagatatagtaagacaacgtatgaagcgtgctgcagaagaaaaagtcattcccaatgatcttacagctaaatatactttatttgtaatatctgcacacaaacaataaatacattatttt

SEQ ID NO: 4025 - DNA, 411 bp, Diabrotica virgifera
  misc_feature (105)..(120): n is a, c, g, or t
caatatgctaattgagcgttttaaggcccttatttgacattatttccaaataatgttagagcttaaaacatagatgtgtatagagtaagcttcgaataagaagannnnnnnnnnnnnnnnttctttggataccatatagagatctgacatctgctttgacatattctgtgctttctctatacattcatagactgaaatactagtgtagtcttaaaaacttgcaaaattttacttatttggggcttactgtactgtcaatattggtgtatgtattgacaatgatattgtagttcacatggtgtaagcttattaacattgttctttgaagtgtcatatttaggcatctatgttttaacaaacaatgacttaacttgattgtttaattgtgaattaaagattttttacaatagt

SEQ ID NO: 4026 - DNA, 235 bp, Diabrotica virgifera
  misc_feature (2)..(109): n is a, c, g, or t
  misc_feature (115)..(190): n is a, c, g, or t
  misc_feature (192)..(205): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattacnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnattaaaaattgtaaatttagtaaaaatata

SEQ ID NO: 4027 - DNA, 307 bp, Diabrotica virgifera
gcaggtcgacacaagcctctagacggagtcggaagatgatgtccccacataccgacgtcacaactgcaactcaaggtcccccttcttagagatgtttatttgacgatccaagtcaatccaatattattaaaagttagctctcttagtttagttacgaatgtatccatatcagtaatacaatgtagcgcagtgatatccgcgtacatttatcctctcaaatcacagtacaactaataattagctttagagggacattttacgacacttttatcggagtacctaagggatcatagctgcatcataatgg

SEQ ID NO: 4028 - DNA, 392 bp, Diabrotica virgifera
  misc_feature (124)..(141): n is a, c, g, or t
gatctttcaacgcatagcaaattttgaaccttagaattgttttctactcaaaattttcggtattttactcttgactttaggatgcaggcaattttctaacctcaaaattatttcctgttaatcnnnnnnnnnnnnnnnnnnggaagatgtggctatatcacatttgccttgaattcattcatgttctaatgaatgaaatataagtatgaattaaacagagttcgtatttcgatacagctccaatgacaaatgacatacgtcaaatagtgcagccaactgaaataatgagggcgctctatggtatgacgtacatcgctatttgctatgcttttgcgatatagatttgaaaacgcttcgatgtataaatcacatctaatgattgcatcaataat

SEQ ID NO: 4029 - DNA, 328 bp, Diabrotica virgifera
aagaggcctatgttcattatgaggatcattagtcaatttgaacttaatgtcagctattccatatttagggaatacattaaaccattgaatttgatgagggtatgcaattcaaaatgctactttaatgctaatcaatacattacaatcttacttaaccttttacaatttctgcgctcaaaagtattcatcttttcattgtacaacaatcatgatcaatcattcctttgggaagtaaatgcaatatcactgataaaattccacttcatccttatgatacgtttaacgctcacctcggactcatacctttattattaattatatcaacatt

SEQ ID NO: 4030 - DNA, 252 bp, Diabrotica virgifera
tcatataggcatggcaaatttaagaatgggacgattcccttccggtggttttcaaggcatgcgaaccttttttcagccaacatttcagggaggtcatggcgtaaccccctgatgtgagtctaggaggcccgatcagggaacttatctaatcatttccatcaaatccgggacaatcttctccagttcacagccatcatattacaacctcgacatcgttcaccaccatcgacgcgttatgtgactacatctccc

SEQ ID NO: 4031 - DNA, 428 bp, Diabrotica virgifera
cgcgggtagacccacgcctctacactaagtcccatgaaaccatgtcttcggccaaactcgaaaatctagaaccacaggaatgtttgcacataggagatcagaaatctttagattatgatggtgcaaggaactgcgggtggcacgccgttttagtgaatgataaagaaaaatatccagatattgataaagaacatgtgtttaaaatttgtttgatattcataagcatttcattaaaacttctggcgaatcattatcttctcatacggtataacgtataactgtatattttttaaatgaacttattattgtttttggtgaagtttaggttcttagaacaaaaaacaggatgtggcactccgagagagtgacctaagatgggaagtatagctttcttatcatctacctacgcgatgatttttactttaatt

SEQ ID NO: 4032 - DNA, 418 bp, Diabrotica virgifera
cattttcctagtactcaaatttttgtccaaatatctacgcttcgaactttggtgaatatattgtaagaccatggttggtacagactcaatatgagccttcacaatttttcggttttcagtgcttgttttatttggcagtatatgcttgcctcttttgcccgtatctgcataacaacatataatattcatttttcttacaacatcttgcatttttttacgctgatatacaaagtgtcttacataaaaacttctcacatacctgtacctcttgactattcaaagaaacatagtcgatactatctattttaccagtcgatatgaatgagaaattttaataaaacatacatgtataatgtattaaagacatttatcacctttttactaaatatggtatacagcagtagatatatatttttgt

SEQ ID NO: 4033 - DNA, 345 bp, Diabrotica virgifera
  misc_feature (181)..(181): n is a, c, g, or t
cgtccgattttgtaaaaattaaacatcctacaagcaatatattccaattataaaaaccaaaacaaacaccatgtgtgaatttctgctttgtttggaaatcatttcagagtagccaacattgatttgacgtcacgactatcacggtccattgctcgtccgacataagagtgacacaactcanaaaatgcacaattccagttatcttgttaagtttactccaaaaatcctataggtaattttaccagaaaagtgtcacatagatgtgtacttacaacttcgtaagagagcagtaatgtcattaatcttttagcgctaaaatgaataattttaaatcccgaacaatga

SEQ ID NO: 4034 - DNA, 243 bp, Diabrotica virgifera
  misc_feature (47)..(67): n is a, c, g, or t
cggtcaaccacgcgtgtcatataatgccgatgtatttatttagcgannnnnnnnnnnnnnnnnnnnnggttacgtattaaatacattagatagtaagagtattttatctagtcttcgtagactgaagttttggcaactggtgtctagggttcgagatccatttcagtacaccattagtcgatttccgtgtttgctgattctacggcgtctgaactagtggcagatgttacgtctgacttggat

SEQ ID NO: 4035 - DNA, 384 bp, Diabrotica virgifera
  misc_feature (115)..(136): n is a, c, g, or t
  misc_feature (260)..(321): n is a, c, g, or t
  misc_feature (363)..(382): n is a, c, g, or t
ccgggtagaccacgcgtccgatcatagcggctaatataaatacgatgtatattgttccaagcatcctgtttgccctctttgcttctggagttcgtcaaaagtgggatggatcaannnnnnnnnnnnnnnnnnnnnnatctgaagttagaataaagaaagtctctgtatggtctattatgtctgtgtataatttatataaatattacacagacataatagaccatacagagactttctttatggtctattatgtctgtgtnnnnnnnnnnnnnnnnnnnnnnnnnnnnnnnnnnnnnnnnnnnnnnnnnnnnnnnnnnnnnnggagagaaaaagggagaaaaagacaagagagtaaaaacaagnnnnnnnnnnnnnnnnnnnnac

SEQ ID NO: 4036 - DNA, 149 bp, Diabrotica virgifera
agcaacgacctctgctaaataatctggtacaaaaaagttccagaatacaatcaattctcaaatccaaactgggacggctcacgttgatacagagatttataaggctggagcagccataaatgacaccacaaaacccatggctgatctcg

SEQ ID NO: 4037 - DNA, 419 bp, Diabrotica virgifera
  misc_feature (16)..(36): n is a, c, g, or t
ggttatgtagaatttnnnnnnnnnnnnnnnnnnnnngtagttgttaagtgattaatgattcaaatagataaaatcaagtaaaatgaagcgaacaccattgataatttcacatatccaacgactattttacaatacgtcaactcattcaattataaggaaaaatcaaaatgtaaatgtttcctttttaggaacctctagctcacaaatatctttaaattattgctggcaatgtggtgcagagcgaaaggggtctaacatattttgtgaaaaatgtaacgttatacaagtaccaaatgagaagaataattattttaaggtaatgggagttcaagagacctttaatgttgatcagaaacttttaaaggagaaatttaggagttttcaaagttgtatacatccggataagtttagtaatagta

SEQ ID NO: 4038 - DNA, 318 bp, Diabrotica virgifera
  misc_feature (173)..(244): n is a, c, g, or t
cggacgcgtgggattttttaagaatcataagatcgaacactaaggaacaccatacctacaagtagtttttcatgcatttgtattctttcttactagcactaggtgcttaacatggaaaattgatcgaaatgttactttttgtatatgttctatgaaataaagattatttcaannnnnnnnnnnnnnnnnnnnnnnnnnnnnnnnnnnnnnnnnnnnnnnnnnnnnnnnnnnnnnnnnnnnnnnngataagggaggtcgttctaaagggtcgaaacttacatacccgtgcatgatacgtcaaagatctattttaggggc

SEQ ID NO: 4039 - DNA, 379 bp, Diabrotica virgifera
  misc_feature (46)..(70): n is a, c, g, or t
  misc_feature (81)..(103): n is a, c, g, or t
  misc_feature (109)..(130): n is a, c, g, or t
  misc_feature (132)..(154): n is a, c, g, or t
  misc_feature (216)..(248): n is a, c, g, or t
  misc_feature (250)..(302): n is a, c, g, or t
  misc_feature (313)..(331): n is a, c, g, or t
atttattttaagataataaagtatcttttagtagacgtaaagaacnnnnnnnnnnnnnnnnnnnnnnnnnctattgtgacnnnnnnnnnnnnnnnnnnnnnnnagaacnnnnnnnnnnnnnnnnnnnnnnannnnnnnnnnnnnnnnnnnnnnncatacttattactttcgaatttaacagagctaacaaattaacatttttagtagtaaataacnnnnnnnnnnnnnnnnnnnnnnnnnnnnnnnnngnnnnnnnnnnnnnnnnnnnnnnnnnnnnnnnnnnnnnnnnnnnnnnnnnnnnncaagatattgnnnnnnnnnnnnnnnnnnngtagctaagatcagatatttttatggatgatcttaaaaatcaaatttt

SEQ ID NO: 4040 - DNA, 312 bp, Diabrotica virgifera
acccaagcctccgcgtaaattcagttgcaaataatccacggaaattatacatgtggaccgcaaaatactgttgccatatccttgccatcttaatgtggcatcattacgcgcattgtgagaccgttcatcacgtaatggtcaacacagcatactgtcgattgtactccagtgtcgtaagataatcccatgtttcatccattgtgagatatctactcagaaaatctgttctctaaagattgatgagcatcaaacacttcgtcaaagcacctaatggttagcgattttgattaatattgcacaaggttatcgtat

SEQ ID NO: 4041 - DNA, 434 bp, Diabrotica virgifera
ccggagacaatcatgtggtacaaaattacgaaattacttattttatagtacaattgtaggctaggtaaatagtaaccatgaatggaccgcgtcttggtttaagtcgagaagaaattatcaaaattagtgagacaattagggaaaataatttaaacaaacaggaattgatctttaaaattgtaattattggagattatggagtaggaaaaacatctataattggtagatttacagaagggcaattttctacccagtataaaattacgataggtgcagattttgccgtcaaaaccttagaatgggatgaagatactcgaattagtttacatttatgggatattgcgggcaacgagcgttttggcagtctactaagcgttttttataggcatgccgtagcagcagctatagtatctgatttaacaagaccagagaca

SEQ ID NO: 4042 - DNA, 435 bp, Diabrotica virgifera
  misc_feature (3)..(71): n is a, c, g, or t
  misc_feature (319)..(339): n is a, c, g, or t
  misc_feature (410)..(428): n is a, c, g, or t
gtnnnnnnnnnnnnnnnnnnnnnnnnnnnnnnnnnnnnnnnnnnnnnnnnnnnnnnnnnnnnnnnnnnnnnttgcggtacgtggtacctcatggttccccgataactatgtatgtgacaggtagcaaaagccttggtaaaattacgatggtcgagccagtatgactaaattctggaacgcaaacaatttatggttaccaacttggaatatgacgactgatactagtcattttcaaattgactatataagagtcgacgcgatataagttagtaaattacttaaattgggtagtactttattgaacatttgttatgcaaannnnnnnnnnnnnnnnnnnnnatgttgtaggtatataccttaattttcagcgaaaacatttcgtttataaattcgcaaaagtgtgtgtgttnnnnnnnnnnnnnnnnnnnaagagtc

SEQ ID NO: 4043 - DNA, 273 bp, Diabrotica virgifera
ctcgcgggtcgacacacgcctctacaaagatttcaattatcacataaaaacttcttatatcctaatataagaagtgataaagcgttaaaaaatatacacaatgggctcaagattgggatcctttgtgaatcacatgggttcaacaataacagctgatggaaaaaaattcacaaggacattataagggggtgtgcaaactatcaacataatattatatgaaacgcacgaaaaagtttattcaactacaccacgagtataacaagttatgttggg

SEQ ID NO: 4044 - DNA, 362 bp, Diabrotica virgifera
gagtcgtattactcatccgctcacgcgtccggttgttctttcagtcgctcaatcagattgccgctgttcatccctgcctctgcccttatggtggacacaagtgcccctctaggtgccttctctcaatcgcccatttctaaggcatcccagaccacatcttatcaccttattgaagatcagcttcggttcgctgttttccaagacaccctcagggtgatccatgaacagcctgccacacactatggtgtggacaaggcatagtacttggctgtcaccacattcgccgattgggccaccgctgacttctaagctatcgttggccgtcacatggttaacatacccattccgtcctttattgcaat

SEQ ID NO: 4045 - DNA, 433 bp, Diabrotica virgifera
aatttttctaagtatttttagttcaaaacgtctgagcttttcttcgtttgatttggtcatggtccacgtttcgcatccatatgttagtacaggtgtgacgatggatttatagattttgatcttggaacttcttgtaagattttttgattttataagcttatccagtgcgaatagaaaaaaattgattagatagtcaattaaaccactccctgagattgcgccgccatggcactgcactttctttttctggctgaccacacatcgctatgtgctatttgttatgcgtcttcgctgtatgcgcccaaatatttgtcctttgaagtgtgtcaaaaccgacaaccgggcggatggcgtatttactatgcgtgcttgctggctatgcgcgcgcatcaagcgaatattgacgaatgaaccctccatacttcgtcctatg

SEQ ID NO: 4046 - DNA, 108 bp, Diabrotica virgifera
gtgagtcgtattaaagcctactgcttctatcactagtaacgcttagtgtatctgcccacgacacaggtgctggtaggcaggtgacagtacgagtagctgggaatgttc

SEQ ID NO: 4047 - DNA, 363 bp, Diabrotica virgifera
  misc_feature (199)..(217): n is a, c, g, or t
ctcgcgggtccatacaagactctatagagacgtcgtattaacgcgtccggttcgaatggagagataaaggagctgtattaagtactccaacagtaccaggaatattttgtgctaaatctgattgggcatatgcaatcttacaagaggtattcgcaaagtagtgttaaacggttcatatcttcgtagctatacaggaggnnnnnnnnnnnnnnnnnnntgtaatataaagtaatcctgacctttggaccgtatacttagtatgatatggcagagataatatagtcttctattggagtcctaaaaaatgggttatcagttcactgggatagggaggatttcttagagtaagtagtaatcaaaatg

SEQ ID NO: 4048 - DNA, 401 bp, Diabrotica virgifera
gggtaaacaacgttttatttgttccttaaatctcccatttttgttcctcaactctacaatttacgaacaggttatgggctcaaacgattaagtggaagattttctggtcgttcaaatcaaaacagtgtgtgttcattcgataaaaagttagttagtcggtttgttggttaacaacgtggttattaacagtatcgaaaatggcggtgaattatcttacaagtgtgccgcgtttaaccggtagagataactaccaggactggtcgttcgcggttgagaatgtctttgttctagaaggactatcaaagtgtattcagggaactgaacaagacacaacgcttgttgccaaagccaaagctaagttaatattgactttggatccatccatatatttgcatgtgaaa

SEQ ID NO: 4049 - DNA, 393 bp, Diabrotica virgifera
ctcgttcaacctcttttaactacagccccttcaaaaataaggactttgaaccgatgaaatttgcagatcatataaataatacatacacgattcaagaaacttgtgaagtcgattaagttcatttgagacactaattgggaggtgattttcccgatttgtttgccaagaaaaaggcgactaactttattttgagagtaactttttataaagcaaaagtgaagcttttttgaacacttcgaatgagttgaaatgacttttccccgaaatgtgcttcaattttggttatttcacgtcgaagtattccatttggaatttgaagagtgtgaacctgtttttcattggctgttactctgcatctactaggtatagagacgtgctatatacacctttttt

SEQ ID NO: 4050 - DNA, 272 bp, Diabrotica virgifera
  misc_feature (21)..(41): n is a, c, g, or t
gcgtttgacaatgcaactccnnnnnnnnnnnnnnnnnnnnngactgttgtgtctttgggtgtagtttatcgatggaagaacatttgctctgagttgttttgacgagaacaatcgtgatgtagattggattgttgcatagatagtatctatccatagtgtgcgtggagatattattagtgctgggcttgggcatatttatttaacgtctaccttttcatcagcttggaccttttctaatagttcaatttgggataatagttcccttattggga

SEQ ID NO: 4051 - DNA, 293 bp, Diabrotica virgifera
  misc_feature (19)..(38): n is a, c, g, or t
gtttgtcaatacaacaccnnnnnnnnnnnnnnnnnnnnatattgtaatgccagttgtccgagattctaagaatatctacagcatcgaaagacttatacaacttcacaaagtaaatctatgcagacgcgttttgctgtaatgcttgactttgaattgtttcataattaaactcacatctgtcacatatttgaaccttgtaacatgttgatgcaagtgtgttagataaatgtgcttccattttaaaactaagcgatgataagttcgatccgcccttttgtatattcaaaataacc

SEQ ID NO: 4052 - DNA, 118 bp, Diabrotica virgifera
aaatataacaactggtccaagaaactatctggaagtaaaaaatatacgagagagatgtataatagaaccttatacaatatattaaatttcaagattgtaaatataatgtacctattct

SEQ ID NO: 4053 - DNA, 414 bp, Diabrotica virgifera
cgaaattttaaaacgacaacaaaacgcaacagtactaacagtattcaaccttatggccattattataaacaataatttgacttatcaaacaaaccgcttgactattaaggagttagtaggggaagtaacatggataaggagtgttgtagataagttgggggcttttacccatatcgaaaacgcggaaaaaggtgttagagaggctttaattacacacaacaacttaataagactagataagagaaagatgttgagactgataaagaataaagttagccaacaagtggtaaaccctaaaaaattaaagggacatgcgctcagtgattccacgatgactgaatctgtcccgtttgttatgttacagatatataccaacccagtacttcagtttttgattgatataaatataatttt

SEQ ID NO: 4054 - DNA, 439 bp, Diabrotica virgifera
  misc_feature (210)..(229): n is a, c, g, or t
ggtaaacaaggttccagtgtatggattattatcaaagacaatgtatacgatgtgactgattttatggaagaacatcctggtggtgccgaattaataatggaatgggcaggtcaaaatgcaacaaatgattttgataacttcggtcattcattagacgccaaacgagatctgaagaaactaaaaattggtgaagttgatgtagaggaacgnnnnnnnnnnnnnnnnnnnnaaccaaaagtaaaatctaccaaaataactagtacaaacgacaccaaactatacaatgtcagtgaagttgcaaagcacgatgggatacaagatactagaacctggataattataaagaattgtgtatatgatgtaactgaatatatggaagaacatcctggaagtgcagatgtaatcagagagtgggcaagaaaagacgcaacaaaagcct

SEQ ID NO: 4055 - DNA, 414 bp, Diabrotica virgifera
cacaaagaggtgtaagtgggcggagtttaacactgaattcggttttacataaagatatgggctgtagtgccgcaaaaaatctaacagtagaacctttggatggcagtttagcaaatggacatacagaagcaagaactcttccagtctcaccgaaaaggcaaccaaatatccctccactggaagcggaagatcttcaagaagaattattagaaaatgccgctgtgaataatgttcaacaaggagatactagcacagagaattcagtcagctaaaataagaaatcaaatgaaaaaattgcacttagattccaacacagacgatgaagaagacggtgatttcctcaaggttccaaaagaagatatttcttcacgtaacaatacttacgaaataccttatgcttaaattttgttaacg

SEQ ID NO: 4056 - DNA, 428 bp, Diabrotica virgifera
ctacttgtggcgccggcctgatgatgatctgagtggtgtggagatcgagaccggtcgtcgaagtgttgaatgattgtgaataggtctgtgtttctttacttcatttaatatggactaacatatgcaacccattcaatattttacgaaatgttctctcagtatcagtattattacatagacggtgctatcaatttttctgttattgtacctatatattcttagatttttcattaacattaccagtgttaacaaattttgttttattagttactttttagtttatttgttactctcttgtcatttttacataatttataaaataatgtattaaaaatatgaaaattgataaatttttgctgtatttactataaaacataagtttgatctgcttatctcacgcaactttagtgcaaaactatcaatcaaaa

SEQ ID NO: 4057 - DNA, 418 bp, Diabrotica virgifera
  misc_feature (29)..(50): n is a, c, g, or t
  misc_feature (89)..(104): n is a, c, g, or t
  misc_feature (138)..(163): n is a, c, g, or t
  misc_feature (313)..(336): n is a, c, g, or t
cggacgcgtgggcgattactacggtcttnnnnnnnnnnnnnnnnnnnnnncaaagcgtagaagtgagtttggagtacaggctaattatnnnnnnnnnnnnnnnnattatcggtttaatggttgtattttgattgaagnnnnnnnnnnnnnnnnnnnnnnnnnnacacgtgtgaaaatagactaatacagtactgtagctaaaattttcactcggagcgacgaccggccgcgcaacgtacacttttaataaataatgtatgctgcgtgtcagtcggttcgagtgaacatttcagctccgactctgtatcaggtnnnnnnnnnnnnnnnnnnnnnnnnagtctttgattaaaatatgaccattgcactgatttttgacattctttgtgagtaattagtttgtaccatggactcacattta

SEQ ID NO: 4058 - DNA, 337 bp, Diabrotica virgifera
  misc_feature (322)..(322): n is a, c, g, or t
ctataaaacttagtttgaactaaatgtcctgattattacacaaaaatattaacgtgttgtgatggtagagtaataatcacttgcaaataagtaccaagtgtccccaaaacaaaccctatattatggttcccaaaagtgtccttgttatggataccaaaatccctggtagtagaattagcacagggatggtgctagcttgtaccaattattaaaggtgcccttcggggcgaagtgcagaattcaacgctacgtgggaggagattctccaggctggtctccaagtgacctggcttggcatagaacggttgctcccggttgttangggagctgatggact

SEQ ID NO: 4059 - DNA, 414 bp, Diabrotica virgifera
aaatttttataaggtctttatacctttctcataggccctgtttcttgcatactcaaggaaaactcaacggttattccaaagaacaaaaacaacatccaaattccatccaaaaaaaatccccaaaataatgctttattccataaaggttaagtaaattactttgtgacttaatttcctactgatcttcttccttccgtggctaaaatcataaaactttctatcagctggatttccttgagtatgcaagaaacaggccatataagaaaggtataaagaccttataaaaattttcagacaaaattacagaaaaaacatgagctattgacatttataagtaagtgtcattgaccttgaacaaaaaacggaaatgtaaggacatatgaaccaataagatatgtatacatattacaataa

SEQ ID NO: 4060 - DNA, 390 bp, Diabrotica virgifera
  misc_feature (139)..(156): n is a, c, g, or t
gcagaattttaaaatggcaattgaaaatctttagtttttaaaaggtaaaggtttaaaggccgcaagaaaggtgatactcgcgctatcaacctaacttaaagtagtgatttcactgacagtttttatgctacagtaatgnnnnnnnnnnnnnnnnnngtcaaaaaaatccgatatttttatactgaatcattttttcgtttctctgatcatgatcgagttacacggagaaaaatgtaaatttttaagaaaatttgaaaaggcgctccattatttgatattacttttttcaaagaccatgcttattaaaccagtccaactttttgagcatggaaataacactaaaataaaaggtattgcagataaaaagcagcctttactcaatacaatttt

SEQ ID NO: 4061 - DNA, 379 bp, Diabrotica virgifera
  misc_feature (245)..(264): n is a, c, g, or t
tttatatgtatataagtatatttacatgcatgctaatagatgtaaagttgtgttttatatatcgatattggatatacattgtgatatttatcatttaatgtatcagtagactggttatatattgtcccatgtagtatcatggatcagtatttaacagtgaaagtgttatcagattcaatatttgaagatcgttatcggtatgcttttgagtgagttatcattctattacataatttgtgtggcgnnnnnnnnnnnnnnnnnnnnaataaatctcatacgttaataggggacttatcttgaccaattaacatgctacatagtactatgtcatttaatgacattgcacataaatcaatttatggatgtgctcctgtattac

SEQ ID NO: 4062 - DNA, 384 bp, Diabrotica virgifera
  misc_feature (160)..(181): n is a, c, g, or t
  misc_feature (342)..(342): n is a, c, g, or t
cccacgcgtccggtgtccgtcagcttcattccgatcagcctaaatagtttggacgacatttcaaattcacttaatattttgtataaatatgcactgtttattgagtcatatgcttgtttaaaatcgacgaaaatatagatatttaggtaggtatgtcatnnnnnnnnnnnnnnnnnnnnnnttgcttaaccgtgaacagttggtcgaggttgatattccttgtccaaattctactattttctgacaaatacatcacatttttacaacgcttttatcatatttagagtttctaaatcgctgttggcatatttcaaaatttatgccgaagtactctgacagcanagtacgttatattatttaactccttcatacacttaatatgta

SEQ ID NO: 4063 - DNA, 171 bp, Diabrotica virgifera
acaactccctatagagagtcgtattaattttcagcgagatgatatacttttggttatctaacctattttagagttgaaccaatattttaaccctcctgacgtttttcagtgctttataccagctggggaaagtctcagttatttcactatttattttcttctgttgggtgc

SEQ ID NO: 4064 - DNA, 269 bp, Diabrotica virgifera
  misc_feature (188)..(206): n is a, c, g, or t
aaggtaatacatttttttaatggtgggcccaagacctatgtatatgaatcactctacatatttcagaaatattctgatgtgtatacattggtattaatgaactgctttatatgatatgttttatatttcttagataaatgagtaaaatatacatcttagtactaataaatcaccctgtatatcaaaannnnnnnnnnnnnnnnnnngtcaacttgagaagtagattagtatccaatatattttttctttatgtgaataaaaagtatatc

SEQ ID NO: 4065 - DNA, 71 bp, Diabrotica virgifera
  misc_feature (12)..(48): n is a, c, g, or t
cgcctctataannnnnnnnnnnnnnnnnnnnnnnnnnnnnnnnnnnnnaacaaaaaaggggacgacgctca

SEQ ID NO: 4066 - DNA, 422 bp, Diabrotica virgifera
cataaatatcgctatccatgtttcaacgcttgtggctcttgcagtagctacccctttagaacaaagtctagatattaatttcattgataaaggcattagtggacagggaacagctaaccgttattgggattgttgcataccttcctgctcatggcagggaaacttctataaacctaacggtgtaccagttgcctcatgcgagatatctggagtgttcagggttgatgctaatgcatgatcaggttgtgagggtagtggcagtgcttacatgtgcatcagtcaacaagcataggcactagataacactttggcatatggttttggtgccgcgtcattcagtaacggcattgatgtatccttatgttgctcatgtgtcttacatagcttcacggatcaagtttcaaacaattaaatgattgttc

SEQ ID NO: 4067 - DNA, 434 bp, Diabrotica virgifera
  misc_feature (224)..(241): n is a, c, g, or t
cccacgcgtccggcgatacaattcttttttatatgcgtgtccgcgaagattataactcccaagatatttataacgaaacgatgtagttcataatagatgccgacgaaaacaattatttccctttctgtttctaccgacgaaacaattatttctgagaactttttagtaattataattttcgtggacccaaaaacaaaaatgatgttttttgcagatactcatcnnnnnnnnnnnnnnnnnnctaacactttattagggattataattttcataatcatataatcaaaaataatattcttcgcgacgttcattgaaagttctactcttaccggcatttttcggagttatacttttcgtatgcggcggcgaaatacttagatatttggtgtgcctacgggtggcgtttttctttgatgattaaataacttgttttt

SEQ ID NO: 4068 - DNA, 235 bp, Diabrotica virgifera
actccctatagagacgtcgtattaaaatttttagtaacgccttacgactcgctctatctattgcacaattccccattattgtgacatccaatttttgtcttacacgagaaaggattcattggtgaggcaatgagtatcagggactaggaatttcgcgtcccttcttgctcatggtcgggaattcgtacatacacctatccgagtaccaattgcctcatgccatacatctggagtg

SEQ ID NO: 4069 - DNA, 362 bp, Diabrotica virgifera
  misc_feature (23)..(76): n is a, c, g, or t
  misc_feature (78)..(90): n is a, c, g, or t
  misc_feature (98)..(121): n is a, c, g, or t
  misc_feature (124)..(136): n is a, c, g, or t
  misc_feature (261)..(279): n is a, c, g, or t
  misc_feature (299)..(327): n is a, c, g, or t
atgcaagactctagagtgagtcnnnnnnnnnnnnnnnnnnnnnnnnnnnnnnnnnnnnnnnnnnnnnnnnnnnnnngnnnnnnnnnnnnnccagagtnnnnnnnnnnnnnnnnnnnnnnnngannnnnnnnnnnnnagtgataagtaattttaggttcttctttcgaccctacatctaattttaatttaccaatatactgattaagaagagtattaggtctattagttagtccatctagattttgattaatcgcctctcgnnnnnnnnnnnnnnnnnnnaagattatgataacattacnnnnnnnnnnnnnnnnnnnnnnnnnnnnntatgaatcgcaaggaagaacatgaatttttaggtc

SEQ ID NO: 4070 - DNA, 138 bp, Diabrotica virgifera
  misc_feature (35)..(58): n is a, c, g, or t
acacaagcctcaagaaagagtcctcaaagttttgnnnnnnnnnnnnnnnnnnnnnnnngtaattgttttgatcgaagcttattctttgggctttactccctgagtttataagacacttaaataaatttaataacaatt

SEQ ID NO: 4071 - DNA, 345 bp, Diabrotica virgifera
  misc_feature (80)..(104): n is a, c, g, or t
tcagcattaaggaatacatgatcattattaagtactttgatggcaaaattgacagcataatgaatatgtattctggtccnnnnnnnnnnnnnnnnnnnnnnnnntaatttgcggctataaagtacatttactagataaacatcgatagatgactatcaagtgtacgatattgaaggtattcaatgcgttcatactcaaggatcatacaacaggtttacatagatgaataatcttagctaatacgtcatatctgttagtttttatagcaattttatgctgattttttcatatattactatcacgtccacatgtctcatagctactgtgacatcataaaggaattca

SEQ ID NO: 4072 - DNA, 322 bp, Diabrotica virgifera
  misc_feature (146)..(164): n is a, c, g, or t
ccatccagacgtccgaaaaaaaagaaagagatttgactgccttcgtaggaaaatagctttgctgcactcgcattaacaactgttctgcgtttctcatgatcggccgcattatgtttctctgcacaatcacagtggctaactgttgnnnnnnnnnnnnnnnnnnngtcatggagatttttcagcgcatgcctgcgttaacgcagcttgacatcacggctaagcaattctgtcatcgtgcttgatcgaatctttatatagcggtcgcatatctgtgcacattttgatatcacttgcattgttcttactagagatggtataccaa

SEQ ID NO: 4073 - DNA, 396 bp, Diabrotica virgifera
  misc_feature (350)..(368): n is a, c, g, or t
  misc_feature (370)..(387): n is a, c, g, or t
ggcacgcatccaaaacctatattaattatatgacataacagcatttattggcaagcgtgatgctgtgttttaattctcaataggcgatttccgtcgttcgaaataaccacacatatagaaagttttcatctgagatgttgtgacttgccgttgacggataatctgattacaaattctatggtaattatattcgaatggaagagatcgacgtacttaacttttatatcgacgtcaatgtattttgttcaactattttgtaaggcaatgagaatcgatttaatatatatctaaatttatatgaatataagtaaatttaattattaacattcaatttctgttaaattatcagnnnnnnnnnnnnnnnnnnngnnnnnnnnnnnnnnnnnnggcggacgc

SEQ ID NO: 4074 - DNA, 424 bp, Diabrotica virgifera
aggacgcgtgggcaatggtccaccgccgatttagacgtgtaacacagctcgaagttatcaaaaatcagtagttttggacttcctttttaatgtcctaatggtctgtgataaattggttgaaaagatagcgacgaattcgagaaaacgtaactgctaagggggaataaatctactgattgaagctgtgcgttacgaaatccattccaatgatttaattgaagattttaacacaccaatcactcgtgttttagaatctttaaccgttttttatatttgttttatatttgaacatatatttgtaaatatgtgacttatctctgaaaccgtcgattaaacacgattttgacaattttgtaatattctataaataattaggattagtttttttgtatcgttatcaaaaggaacatttcactatatatct

SEQ ID NO: 4075 - DNA, 386 bp, Diabrotica virgifera
atcaacgagtgcgaagctactgagattgaagcatattctgaagaggtcatcgagcttttggaacggtttaagattctgctggtcagggctaaagacaaggaagaaaaactacgagagcttagaactgctgcctgcgatgcttataacctattatgcacacacgaggccggtcgcatcctatgtccactctgcacgaaacgcaactgggcccaactagacaacgacctctggagactagaaaaatggttacaagtcgccgaaggtacccagaaaactcaaaagaacccaccgtctaacatacaatacctagaagatgttatccaagaacaccgagagttccttcttgacctggacagccacatgagcatcgtgacgtccttgaacat

SEQ ID NO: 4076 - DNA, 326 bp, Diabrotica virgifera
gtccggacaaactgaatagagttggctagcaagagatagaacaacttgacactcaaggatggatacggctcgtttgcatgcctgtcgaagaacagtagctcaaagtagataatgatgactagaaaaggtatatactaagataagaataatgttctgaaaataaataaaggagaataatttctaaagaagaacaaattaaataacactaacaaatcatgggcgccaagaaaatgatcttctatcattctcccaggtatcttacactgctgtcaaatattaaatctgtaaatgtgaacataaaggaacaataaaaataaatgatatat

SEQ ID NO: 4077 - DNA, 177 bp, Diabrotica virgifera
gtccgaatgttcgctggcatgcgaggttgcccgatacagtttcagtctttaattaatttagttctttaattaatatttacatttatatgcttacacttttttaattgacgtgaataggctatacagttatctttttttataagactatattcattatcacatttttgctccaatttt

SEQ ID NO: 4078 - DNA, 251 bp, Diabrotica virgifera
  misc_feature (41)..(41): n is a, c, g, or t
  misc_feature (186)..(186): n is a, c, g, or t
agagccactgtctacggttacagatgaagaatatccaaaanacagataaatacaaataggtcacaatggttagaggagcagatgaacatattcaaaaataaaggtggaatgaactcttcatggatgacaataattagtctaagggaataaaaccgtgaggataaattacatggcccttcaagttangggttgaggagaaccggtgattcaccactcaaaaaaattaatagtacttactaataagcccaaac

SEQ ID NO: 4079 - DNA, 194 bp, Diabrotica virgifera
tgactcataatttttctgttaattctagccgctattctcactgtggccataattccaaatttatcttctctttgatcattgtaccagttttaaagcttcacataacagggttttttgcgttatttacgacttatttccgtcagctgttttccactcaaatctcagttgtatctactaacagagtgcctgatttg

SEQ ID NO: 4080 - DNA, 214 bp, Diabrotica virgifera
ttttggtgtagcggttacttttcagtgcttgtccttacttgttttatttactgatagttagatatcattgtcttacaatactttatttttatgggatagggagccattttttgcaccgagtgtggctcgggggtttgcttatcagttttttctggattagtttcgcctctagatgacctcccttcttgtcatttataccgtttacccactgttt

SEQ ID NO: 4081 - DNA, 322 bp, Diabrotica virgifera
  misc_feature (120)..(147): n is a, c, g, or t
  misc_feature (194)..(223): n is a, c, g, or t
gtccggaatactcaatttgagactgtgaagtctatccgccattctcattgtggacaaagatgacaatttaactgcctctgctcaatgggccacttttaatgcaccatacaggaaatttgnnnnnnnnnnnnnnnnnnnnnnnnnnnntgctgatttccaatacaatcaccatagaatcgatgcacatactgccnnnnnnnnnnnnnnnnnnnnnnnnnnnnnnatggctgttgacaaactcccagattgggccagcacacaattcgaagccatattggcccgtcagatggctaacaagccaccgcaatccttcagtgcagaa

SEQ ID NO: 4082 - DNA, 169 bp, Diabrotica virgifera
  misc_feature (8)..(36): n is a, c, g, or t
  misc_feature (49)..(61): n is a, c, g, or t
  misc_feature (63)..(80): n is a, c, g, or t
  misc_feature (86)..(106): n is a, c, g, or t
gagtcgtnnnnnnnnnnnnnnnnnnnnnnnnnnnnnctccctttccttnnnnnnnnnnnnntnnnnnnnnnnnnnnnnnntcctcnnnnnnnnnnnnnnnnnnnnnggggctttttctttcccctctcttcttcttggtgtgtttcttgtctttcttttttctattttt

SEQ ID NO: 4083 - DNA, 322 bp, Diabrotica virgifera
atacgatgattcttatactgttcgcgttttctgcgatagtttttaacggtgtaaattctgtaagtcttagtaattccataacatctgcaagtggtttagacgcacccaagaacacgagtctctgttctggtcaactgatctttgacgacaacttcaattggttggacacctcgacatgggaccctgagcaaaccttaactggtggtggaaacaacgaaatctagtggtatacggatactacacgtagcagttatacgtacaacggccaattacagatcatacccacttttgtcgcacatgactatcgataagagctcttaaa

SEQ ID NO: 4084 - DNA, 375 bp, Diabrotica virgifera
ccgtacacgctaatgaaggaatatgtaccaatttctggtgtaacttttatctgttgataattcattaagctcgcgcttggagatttcacatcaattttggaagatggtatgttctgtaccgtgtagtgtatcgctggtaccggttccctcaggataatgatgtgcttacttgtttagctttttccctggattacaatttttctagctgccagcctcctcatggggaattcattgtcccatcatgttacacgcatgattatatgtcaagacttataggtattatgatgctattacctgtggattggacttcctatgcatcaatatatgatatttctataatacccgatatttctatggaccatctccacgcctgtg

SEQ ID NO: 4085 - DNA, 283 bp, Diabrotica virgifera
  misc_feature (18)..(99): n is a, c, g, or t
gcgtccggacccacgcannnnnnnnnnnnnnnnnnnnnnnnnnnnnnnnnnnnnnnnnnnnnnnnnnnnnnnnnnnnnnnnnnnnnnnnnnnnnnnnnntcaaacttaatatggaggtcgatctgagtgcggtaaatttctgtactcttgcatgaaagttctgaaaggggtggacgttgtaagggtttttcctttcattggccttggttgaaaactcatgctctttggaatatccccctcgttttacattcaatgcgccttttttgatatcctcctttcgggg

SEQ ID NO: 4086 - DNA, 391 bp, Diabrotica virgifera
  misc_feature (383)..(383): n is a, c, g, or t
cgtccgtactgctaaagaataaggctataacatattaaaaaaatcacttcaatcggacaacaggtttaggaaattcaagacatcaaaaatgacccgtttttaaggtggtgcgttaattttttggagcagtgtatatcaccaacacaaagagtaacaaaagaccagtcgattgataaaacaaatgaccaatttaatttacctacagaaaaaactgcttttatatatgtgcttttgttttgcatacattttactgtaaatatttctttgttcaatgcctcggtagacagtatatcgttattaaatatttcgttattttgtttacacgttatctatagccgatattatctgcattaatgtatctcgttaataatacttttaagtantagccgca

SEQ ID NO: 4087 - DNA, 414 bp, Diabrotica virgifera
cgggtccacccacacgtccgaacccatactcctccttgcgagcatcaattggcaacgtgtgctgatatgatctcaccaactgtatcatgcgactcttaagaatgcattatatatccacctgcagtttacttcgtctattcattttacacgaatggctttaatgattacttcaaatggggtattgctgaacgcttcctccatgccgagaaaggttcccagcatcatcccattgtttgtcaggtggcaggtgtcaggacatacttcaccctctgtcctctgtactagatgaagtgctatttctgttgatacttctgatctatatgcatatttgtcttggtgcatcggtctttcaactagtattcagcctctaatatgtctgccgatcagttttaatgtcttcagtacgagacacat

SEQ ID NO: 4088 - DNA, 256 bp, Diabrotica virgifera
  misc_feature (15)..(16): n is a, c, g, or t
  misc_feature (19)..(22): n is a, c, g, or t
  misc_feature (25)..(25): n is a, c, g, or t
  misc_feature (34)..(34): n is a, c, g, or t
acgcgtccggaaaanntcnnnntgnggctgttcntcattgctgctggcttcattcaggtcgcacatgccaatctatctgctttcggacactgtagcagttttatggtatcacctaatcaatcgtattatgttcttgatgaagatctttctctcgggtttttcgaatagaaccttcgcaaaatcgtttcacattctacgtagtatgacttctgttagtatttctactatctctccgttaatcactttgccgattggt

SEQ ID NO: 4089 - DNA, 376 bp, Diabrotica virgifera
atcgcaatagaagtttctaaagtgccataccataagacagaacaatatttaacacaattttatttaccggtactcgtaatgacgtatactgaaaattacctgaagaataaattgttaaaagaactggatgcttcttatgtgcaagtagtagaccaatcaaatggatgtggcggaaagttcgcttgtgtaatcgtttctgaaaagtttaagggaaaaccattactggcacggcatcggttggttaattctgttttggaagaagaattaaagaccatacacgctttttcccaaaaaacgttaacaccagaacagtggcaggaacaacagcagaaataaaatgaccaataattatcccctcgatctctccaacttcaaa

SEQ ID NO: 4090 - DNA, 442 bp, Diabrotica virgifera
  misc_feature (10)..(10): n is a, c, g, or t
cacgcgtccngaaaagggtcctaagtgtagcataaatggttgaaaagcgtaaaatgcgaatacttgtttttgtatggttttttcgcaattattgctgttttgcaacaggggtgactattttttgaatttttgaccaattctataatgtgtgaaatttagttacgcaacttctatgtcggtacaacttttctcagaaatgaatagttttaaagttataatcaaaagaccaaggaaaaaatcgaaattttccttcagtttttgacattttgattaattaggcaatgttcccggacctttttgagtgggatgattaactcaataattgtaatttgagttgttttcatgcaatttctgcaaaaaaatttgagtcacctcaacgtccaaatgtactaatatttttacagatgcgccctggtctataagagcgatattgccaaaacaa

SEQ ID NO: 4091 - DNA, 436 bp, Diabrotica virgifera
  misc_feature (110)..(110): n is a, c, g, or t
ccggaaccccacgcgtccgccaacgcgtccgaccacgcgtccgcggtcgcgtgggcggtcacgtgggcgtccgtcattggttttgtgggtgcgtctgtctgtttcctgcntgtgttttattattttgtgtttcctgtgtccagggattatgtactaatcgttatttaggtagtacttccggacttaaccgagcttatttattgaattctataatgtaatgtcgatatcttagataattttgttgtgatgtcacgggagtcgcatctgaatatcgcgaattttttaagagatatcactggctttaattatctacatctacgattaatcctacatattcgtagatgcttccaacgatgtaattgttaggatcagactcttggatacattttattacaactaagattgcaaatccaagctgcgcatatgacatttcata

SEQ ID NO: 4092 - DNA, 340 bp, Diabrotica virgifera
ccaagcgtccggaaagatgcgatggactctctgccgaagcacaatatgctgacaacggcagtgatgatcgctgcttcattgttgagaacacatcactctcgtcaacaaatggctacgtagaacttgtcccaactgatgatgcaatcgtgtgcgcagttgctagggtaggtcgagttgtcaccgctgtgtacgctgaaagatgtgaattacacagaagtggagatttccacaactaacgctgttgaaccaaactcaatcagcgagttcgtgctgtaggatagaccttcgatgcaatcattgtcaagaagtcatggggaactagctgaggtgatacacgtta

SEQ ID NO: 4093 - DNA, 424 bp, Diabrotica virgifera
  misc_feature (6)..(51): n is a, c, g, or t
  misc_feature (331)..(349): n is a, c, g, or t
aggaannnnnnnnnnnnnnnnnnnnnnnnnnnnnnnnnnnnnnnnnnnnnntctggcctcgaaatctattagtgtttccttgaaaaaaacattaattttatacaatctgcttagggatacattttgtttcttaaacttaacggtccttgttagcatatggtttgtatattaaatgtgaattttaaatgactaatgttatttcgttttgagaaaagttattgaaaatttagcaaaaatagtaattaaagcgtatcgctatattatatgcatttaacaattcaagaaagaactgtgagttgcctacatttggccccactgaactgaataaccnnnnnnnnnnnnnnnnnnngctcttaaatacaatttttttaattgaatataaatacttaactgacaaatttcatataaacagttgctttgtttc

SEQ ID NO: 4094 - DNA, 129 bp, Diabrotica virgifera
taggccttcatcactgacgctatctaggaacacatggaatgtttatcgggcttcatgcatatacgccgtttgcattgggtatagatcatgagcaagttctacacatgcgtggggtacatttttgtccat

SEQ ID NO: 4095 - DNA, 449 bp, Diabrotica virgifera
  misc_feature (118)..(144): n is a, c, g, or t
  misc_feature (262)..(286): n is a, c, g, or t
  misc_feature (386)..(406): n is a, c, g, or t
acacaaattaattcaatttaaatttaaggtatcgatttctagatttaacataagctgtatttcataatatactaatgttttatttgttttttaccatcatcagcatcagtacaaaatnnnnnnnnnnnnnnnnnnnnnnnnnnntcatattttcacaagtggatatacatcgtagcagaaaaagaaatgaatccctccaattggctgtataccacaataaaaattactcaagaagtaaaaaatcttcctttgtagattgcannnnnnnnnnnnnnnnnnnnnnnnncacttcttaagggggtattagtacgctatagttaaaacgtgtgagagttaaacgaactaacgtttaacaattctttgagtagatggcagcacctgcgtcnnnnnnnnnnnnnnnnnnnnncacgaaattttattctctaaaaccgacattgatgcaaattttc

SEQ ID NO: 4096 - DNA, 476 bp, Diabrotica virgifera
  misc_feature (413)..(413): n is a, c, g, or t
  misc_feature (429)..(429): n is a, c, g, or t
ccggggccacccaagcgtccggaatatttgtaactgtaggaacaacaaaattcccaaaactaattaatacaattactaacgagcaagtaattcgttcttttatatctttagggtatgattatattcaaattcaaactggaaaagatgccatcaaaccaccagttattgatttaccccacacaataaagcaagaagaaacgtctcttattatagaaatccaagacaagttggtaatcaaatatgattcatacttcgaagatttcgaaccagaaatagtaaagagtgatttggtaattagtcatgcaggtgcagggacttgtttggaagtgctcaagaaaggaaaacatctgttagttgtagttaacgaagacttaatggataatcatcaaatagaattagcagggcagcttcangatagtggctacttanattattgtacttgtgatacactcaatgagatgttaaaacaaaacttt

SEQ ID NO: 4097 - DNA, 477 bp, Diabrotica virgifera
  misc_feature (90)..(122): n is a, c, g, or t
  misc_feature (135)..(156): n is a, c, g, or t
  misc_feature (253)..(270): n is a, c, g, or t
  misc_feature (308)..(323): n is a, c, g, or t
  misc_feature (325)..(337): n is a, c, g, or t
  misc_feature (339)..(353): n is a, c, g, or t
  misc_feature (355)..(398): n is a, c, g, or t
  misc_feature (417)..(437): n is a, c, g, or t
  misc_feature (445)..(464): n is a, c, g, or t
ggtccgaaacctccggggccacccaagcgtccgaaattacttacgatagtaatgtatttttgactcaaagtagtgaatggttttatttcnnnnnnnnnnnnnnnnnnnnnnnnnnnnnnnnncatttgtataatnnnnnnnnnnnnnnnnnnnnnnctgtgtatcacggattactaattaatacttatatacttatgatttgcgaatttaggctagctaaattattaaaagttttattgtaaggtaaacatgnnnnnnnnnnnnnnnnnngtgaaatgttatgcgtctctacatatatctagttttgnnnnnnnnnnnnnnnncnnnnnnnnnnnnngnnnnnnnnnnnnnnncnnnnnnnnnnnnnnnnnnnnnnnnnnnnnnnnnnnnnnnnnnnnccaagaaggttttagtagnnnnnnnnnnnnnnnnnnnnngtaggacnnnnnnnnnnnnnnnnnnnngatatgttaatag

SEQ ID NO: 4098 - DNA, 343 bp, Diabrotica virgifera
  misc_feature (43)..(61): n is a, c, g, or t
atcaacagttgtgacgaaatttggacacactgtatatttttgnnnnnnnnnnnnnnnnnnngtatgccaaaataatggtttactattttgccacacaatgaaatataaataaatgcaaaaatttacgccagttatcacgcaattatggatacatacagttttgcatatatttatttagatttcattgtatgcaaaaaatggctattatttcatagaataatagaatgattaataaatttgattgaactaataataattgtatactctgtgttaacatgtttacctgtaattgattaatataatcagtaaataaaagcagccttaaacaagaaagctatatcac

SEQ ID NO: 4099 - DNA, 490 bp, Diabrotica virgifera
  misc_feature (27)..(48): n is a, c, g, or t
ggtccgaacactccggggccccccaannnnnnnnnnnnnnnnnnnnnncaatgacattaaagaacgaagcgcgagccctcccaagcgcattatagactccccgtctcccacaagggagcagaaggcgcgacaggcagtagccgaagctacggcctctgcgggggcccagaagtggaaaatgcaaattgccggcagttcgggcaattccaggttcaaaaagaagcccgaaagagcgcctcctgcttctgattggcagtctgatagagacatacgagagcgggagcgagaacgcgatagagagagggaaagagagagagaacgtgctaagagctcttctgcctctgacgattctccaccaccgaaaaaaatgtctttgcctccacttcctccagctgagaaggccgttagtgtgcgcaaggccatggcattgaaagaaccgccactcaaaaagcctgagtctcccaaaaagttaaaactgactccagctcca

SEQ ID NO: 4100 - DNA, 459 bp, Diabrotica virgifera
  misc_feature (266)..(288): n is a, c, g, or t
gcgtccgcataaacttgacaatgtagctaaaccgccatatcccaacgaaatgccagagagtaccagaaggctggcatcttattttaaactttcctctttcgtttatgagctgtggtataaactttggattgttttatgaaaatcacaaataactttatcaaaaagatcaattttattattagttccatgtttctcaccattcgggcagcttgagaatatttgttccaaactgccccaccatggggcacattgggaaaatgatgtannnnnnnnnnnnnnnnnnnnnnncataaactatttaaaaatttatacctatttcacaaaaaataatatcgtttaacctcatactaactatttccatgtttactggacttgttaataaaaccaattccaaaatataagctcccgaaaaaaagtgttcaaactaccccaacctcccctatacatatgcccgccaat

SEQ ID NO: 4101 - DNA, 408 bp, Diabrotica virgifera
  misc_feature (284)..(304): n is a, c, g, or t
atatgctgatcaagaatatgtacttagtttttctccttttctgtcaggtttttaggaaaagtgtgttcgaaatttttcacagaaactgacaaaaatactaacaaaatatttattgaaactacagagtgtaacaaaaaggcatgccataaactaaatcacatattcttggaccaaaaatagttcgattgaacctaacttaccttagtacaagtgtgcacataaaaaaaattgcaaccgttgaagtcacagaatgaaaatcgattttttccaatatatcgaaaacnnnnnnnnnnnnnnnnnnnnntgtacacgtggcattcttatggcaggaagatcttataaaaaaagaacagtgaaatttgtgaaccccataaacattttataaatgtttttgttccctgcaacccc

SEQ ID NO: 4102 - DNA, 437 bp, Diabrotica virgifera
  misc_feature (17)..(17): n is a, c, g, or t
  misc_feature (100)..(100): n is a, c, g, or t
  misc_feature (421)..(421): n is a, c, g, or t
  misc_feature (426)..(426): n is a, c, g, or t
tccgaacctgtggaggnaaaacttctgtcggggtttctgttgagtgaaggtccgcattgggatgataaaaaacaatgtttatattttgtggatatattanaaagtacatcaatagatacgtacccagtactaaagaacatacttgggcaaagcttgatgatcataacgtctccctaataataccggtgaaagatagagaaaacattttcttgtagctttagacagatctgtctgtttggtaaattgggacggtcaaagcaagcaagtcaccaagattgagagacttgttgaagtagaagaaggtacagaacatgtattgaacgatgggaaatgtgattacactggaagattatggataggcaccatgggagcagctgcgaaagcattacaaaatctgcaagacggacaaggagcattttanagtanatctaataaaa

SEQ ID NO: 4103 - DNA, 356 bp, Diabrotica virgifera
accacacttccgtccacgcctacggtgactgctgtaaactatgcttgggctctactacggtaatgtttacttcgtccacagtatgactaatatcacgtgatatagatctagaatcatttgctatgcagcttatcaagttttgtatggccagtagtgtagacatgactatgtacatcataaggacgcatgactctcgatattgacgattgagtagaatctatacgggaacgtatagtggcatgcaattctaacaagtcctcaagatgatcgacaacacagataggctccagacaaattcttcctacctatcatgtaaattagctatagtaatattgcatcaagtgcatttgtggcac

SEQ ID NO: 4104 - DNA, 311 bp, Diabrotica virgifera
aggactctcgggtggcaatagccactctattttaatagtagatgaatctttcgggaacttgtccatcaaaaaggttatggggataaaatagctaccctgttcagtttatcgttatgggtgaatacgcataattccgatggataaagaagataactttcaggcacttcaatgtgcgtgaagtggctttacatgatggtgtcgcaaagccgatggatcaacacaagcaacgcatgcagtgccatgggacaaagggttttagatagggattgatacatacaccaatggtcctagcgttggaacttgatttagca

SEQ ID NO: 4105 - DNA, 426 bp, Diabrotica virgifera
  misc_feature (262)..(278): n is a, c, g, or t
cacccacccgtccggatttcaccaatagccagaagaaacttatcgcagattgggctagatatttttgaaaaaactctcattaaaaatggtttttaaagtatcccttttgtgtacactgctggtgttagttgcgtattctagtgcatacgattacagcaattgtcctggaaataccaacagacaaaaaaatctgatatacagctctttactgccaccaggatatagcgtgaaaactcgtatcccagcaactggatattaccannnnnnnnnnnnnnnnntactgctaatcgatcaaaaaggaagcgccagctcaccaaaaattatagaaggtggatatctcgacacttttgctgtagtaaatatcacttccacaactgcgcaaccagttagttactatgcaatagtatttattgattagcctattga

SEQ ID NO: 4106 - DNA, 230 bp, Diabrotica virgifera
acgcgtacggtgtgggtggttgaatttttggcccctgggggtggcaatggtagaaattaagaacaaaattttccaaagcaaccaatgccattaaaaggaatggtaaaggttggggcgttaatgttaaacaacccaaagaaatccggaggccattttggaattaaaggattcccaacaataaaatttttggggcaaaataaccttaaccctgaaaattttaatgggggtaa

SEQ ID NO: 4107 - DNA, 302 bp, Diabrotica virgifera
cccaaacgtccgactattcatcagcccacacatctatttcattgaaaattattaatgattgatgatattatatatctacgacaatgttgagtctaatcaaaattgaggtgtttaataaaggcattcggttacatgtatctcaacagtataatatgagtatgatcattagtattgaagatgttgtctcgcatgcccattgattacattaagtggacgtagcattattaccatgctatgtatcataatcaagatttttggttacagatagcttttgtgcagggttggatgaattttttactgtc

SEQ ID NO: 4108 - DNA, 420 bp, Diabrotica virgifera
gggtccacccaaacgtccgaatttattatacctctataatttttaattaatgtatcactaattattataccaagcccctcaaatagtactgcgagataatattttggttcaataataggactatgtataggatgtcacttgagtaccagggaatattaagcaatacataactgcccaatagtttcgatatcatttgagctagttgctcataattgctaatgtgtaatatatggttgatttaaatgatcagtacaggcatgtgagtcatcattaaatatatctaagtttatacgaccttattggtctatgaatattatcaatatcttaatatataattgatactagaatattatggagtaactatttttatgcatacacttacaactgcaattctaggataagttatatcatgaagtcaaa

SEQ ID NO: 4109 - DNA, 399 bp, Diabrotica virgifera
  misc_feature (2)..(65): n is a, c, g, or t
  misc_feature (81)..(110): n is a, c, g, or t
  misc_feature (115)..(144): n is a, c, g, or t
  misc_feature (164)..(391): n is a, c, g, or t
annnnnnnnnnnnnnnnnnnnnnnnnnnnnnnnnnnnnnnnnnnnnnnnnnnnnnnnnnnnnnnngcaatatatttagaannnnnnnnnnnnnnnnnnnnnnnnnnnnnnggggnnnnnnnnnnnnnnnnnnnnnnnnnnnnnngtataatttactttttaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttttgta

SEQ ID NO: 4110 - DNA, 268 bp, Diabrotica virgifera
  misc_feature (86)..(86): n is a, c, g, or t
  misc_feature (193)..(193): n is a, c, g, or t
cgtctccttctttcgtgctttggtctttgtcttggttgtcgtcgtcctctcttttatttctccggctgtccttggccccgttcttnccttgcttttgtgtttggtggttgggctttcttttttgtcccttgtctgtcttgtctttgttctcttctgttcggctgttccctctgttcgcttttcgctttctctntccctttccgctttttcgtgtcctttttcttttttgtgcttcctttttttgtcttgcggtgttcttcgctttttc

SEQ ID NO: 4111 - DNA, 431 bp, Diabrotica virgifera
ctccgcagacgcgaaggcggacgcgtgggaaacgagcgattttgtagaaaaagttataggcgaccttttttgtccagaatgttccaaaaactcaagaaaaacgtgttggggccaaagatattgatttttgcaatttgattagaaaaattgaaaaaaggatttggaccacttttcacgtgggcaactttttgaaccttgttctgagatgtctcacgaatgtgattatgcaaagtaatctcatggtaatattttctcaaacgaacaaggtttcgccttgtctatttggtcgttttctgttttaagagaatatatttttagtttattagtgcgtaaaatataaacgtcactgataagtatcatatagtaaatcgatgtttataagaatgtgtgatatagataataaagatgacattattatttcatatttaaaa

SEQ ID NO: 4112 - DNA, 350 bp, Diabrotica virgifera
tacggtccttactcccgggagcccccacgcgtccggaatggggccaagctcaccccagaccacggcttccccgtccggttaatcgtgccgggtgttattggcgggcggatgatcaagtatctctccaagattatggtgacagaggtcaggtccgacagctggtaccactatcacgacaaccgagttctgccgtcgatcgtcaacaatgcatacatggacaagcgggaacaatggtggacacgaccggaatacactatcaacgagctcaacatcaacagcgccatgggctcaccagcgcatggatcagatgtaaccatctctgagtcgcaagcgctgggaacagaaatcat

SEQ ID NO: 4113 - DNA, 433 bp, Diabrotica virgifera
  misc_feature (5)..(17): n is a, c, g, or t
  misc_feature (19)..(31): n is a, c, g, or t
  misc_feature (352)..(387): n is a, c, g, or t
ccgannnnnnnnnnnnngnnnnnnnnnnnnncaggattcgaaaaaagtgaatgcatttaaaaggcattggtccgaaattttgcgcctgcacttttaattggttaacctacaccgaattttagtaagttttaattttgttttatctgagaatcagtcttccaaataattttgtttattaggttgcaagattagcgttttagcagactaaaccttatttttaagaaaatttatttctttttgatagttcatttttgttaaaggtaatgctattttaaaaaaaagttaggtgtttaaagaaaacatataatctgaaagtttaaaaggctgaaaaaagttcataggctaacatagnnnnnnnnnnnnnnnnnnnnnnnnnnnnnnnnnnnntcaatatagttcatttaagggcgtacaacgattatagcggtcatac

SEQ ID NO: 4114 - DNA, 400 bp, Diabrotica virgifera
  misc_feature (127)..(150): n is a, c, g, or t
  misc_feature (221)..(246): n is a, c, g, or t
  misc_feature (305)..(330): n is a, c, g, or t
gattttaaatttataatgtgagagtttattttatgtaccttgtgtatcaaggaatattatgtaccatgtgtatcatggataattacgtatttattagagctttggtattatcgattttattgtagcnnnnnnnnnnnnnnnnnnnnnnnngtatagatatgttattcgattttatagatatctaatgttatacgatattaattatatctaattatttacgnnnnnnnnnnnnnnnnnnnnnnnnnnataaatataagtatatatatttatggattaaccttattaaataattttagggatgatcnnnnnnnnnnnnnnnnnnnnnnnnnnaaattttcataatttaatatgagttaatatttacatttattaaataatgattttagttattattaaattt

SEQ ID NO: 4115 - DNA, 187 bp, Diabrotica virgifera
cccattttgtctctacgtcgttgctgctctgtatgatgactacctgcactgcttgatgtatgatggtacacttactgccaatgttgtggaaggagttacatccattgatgggagatagatatctattgcccttccctttgttagatcatcatgagtctgatttttatgttcacggtcactgttaaag

SEQ ID NO: 4116 - DNA, 431 bp, Diabrotica virgifera
gtcggactcagggtcgcacacgcgtccgcccaagcgtccgcgtataggttttggcagcatgagttcgtccattgtgctccagagattgatgaattattcgagtcagtcgcaagatcttgtatggtaaaatccacagcgcaagcgcaggaaggcgacatacaagagtgataagcagttttgtgatttggatatacttctataaaaattgaacgattgattgtgacttttttaattttttgtgaataattgatagcttaattttgggagcaacgcattttatttttagaatctaaggtgattatagtgtatagagattaattagtgtaatatattagctatttttaacaagattttcaagtatttgtaacgattacacatataaatgtggatgtaacacatgggtttcaatgttttgagcattaacagcgtcg

SEQ ID NO: 4117 - DNA, 459 bp, Diabrotica virgifera
  misc_feature (136)..(153): n is a, c, g, or t
gatattttctatacaaaactaacactttcgatagcgaataaatcgaaaactattaatttgatcaaaaaaatgtatttaatgcaaaaaaacattttttgcttagaattaaagtttttatcaacttttgcggtcaaannnnnnnnnnnnnnnnnnccacccccgagatggggtggcaaccaccccatggcaaaagcgcctttcggaatcatatagattttgatccttgaactatccactacttattttcaaattttcaagcaaatcgatccattttgtaaaaactgcgaggtgaaaagcttcggttcctggcctataatattaggaaacaaaccaagtatgtatgtgtaaggtaaggaattatactgaacaacaatttgagacagtgatttatgagactctttatgagactaattacctgaagtttacaaatgatatggaaattcctcatctcataatctc

SEQ ID NO: 4118 - DNA, 408 bp, Diabrotica virgifera
tccacacacaatgaaaaaaattacactcttcttctgcgccattatcttggcttcggttgccgctttgccaaacaaagtagctgacgataatttcatcgacgacgtcaaaaagatcgtccacacgattgaaggcctcattgatgagcttttcactacaggtccaaatttcatcggaactttcgctgacaagtaccattggtacctcactaaagtcttaaactatacaagaacggctattacaagagctttagaagcacttgaacctattttaaatcaaatcgctgcacaaagcactgattctgtaaagaaattgatttcttgcatcgaagaacaagaaaatggcatcatggcacttcgcgtcaatttcgtagcaagcgtcggtaaatgcataaaggacgatctcgtcgc

SEQ ID NO: 4119 - DNA, 403 bp, Diabrotica virgifera
caaataactactcatgtaaagtgttgatatagataaacaaagtacctaaacaatacctggcgtcgtaatgttgtgaacaagtcatagtaaaattaacaacttctgtgaaaacatttaagaaattatttcatatacgtcttttgacaatttctagtcgatatgaagtgctacattgtgtacgcttcggcagtattattcagctatatcagcgctgagaccgtacaatcatgtgatagtttaatttattgtcaaggggagctgttggacacagtgcaatccgcaaggatcttcagtgactcaaagacgttcgtggatttgagccaacgccaatccccggatgaaactttaggaaatttcaaaaagtttatggcaaaatgtaacgataatccgactaaagatgaag

SEQ ID NO: 4120 - DNA, 262 bp, Diabrotica virgifera
  misc_feature (76)..(107): n is a, c, g, or t
  misc_feature (128)..(155): n is a, c, g, or t
  misc_feature (157)..(169): n is a, c, g, or t
attattatttagttgacactagtacagtattttttactatcagtaaagaaatcttttagttactgatagttaatgnnnnnnnnnnnnnnnnnnnnnnnnnnnnnnnncgagtgatttactttttgtgnnnnnnnnnnnnnnnnnnnnnnnnnnnncnnnnnnnnnnnnngatttccgacttcaaaacaccgaattcattaacatttttattgtaacctaggtatttaaggtaattttttggtagtgaaatgtaatccgtttt

SEQ ID NO: 4121 - DNA, 443 bp, Diabrotica virgifera
  misc_feature (188)..(211): n is a, c, g, or t
  misc_feature (264)..(282): n is a, c, g, or t
attacagataataagtattgtatcgacattaatattgctaaggtatgtattgtgtcggtatcatattgattttcgatacgatatcaatacaaaatcgatatttttatcgaatatcgtgaagctctacttaattgagattaatgctcaaaatcctggtactataactggattaagataaaaattggatnnnnnnnnnnnnnnnnnnnnnnnnaaaaattgggacaataaataaattaatcctcatcgtttttaatctttttacgnnnnnnnnnnnnnnnnnnncttaacaaattgccagactttataataattattgtcttcaattttgcgtcatttatctaaatctataaatgatatcaagtcaattcaagttataaagtttaataaaatttccaacagaagtgtatctaatatctatcctaaaacagagtttatactacaaa

SEQ ID NO: 4122 - DNA, 416 bp, Diabrotica virgifera
  misc_feature (397)..(397): n is a, c, g, or t
aactatagcactgtgggaaaaggagaaaagacccgaagccttctggtcaagctctttaagttatgtattcatgacactcctaaaatcctactacgaaagtattaaaaatggaaagattttatattactggaataaaaacaataaccttatcaatggtccttcagccgcaacattaactaatgttgaaaacagattgaaagcaattataaatgacattgataaaaatttgacggtcgatcctaacgttgttgcaaaatatattttgtcagcacaggaactcatcgaatttaagatgtcaaatatgaaagtgaaaggttaggttgaccaaaataattctataagtaagcattaagtgaaattattttttatactttgtactgcaaaattttagaaatanataacatgtgaattgtcaa

SEQ ID NO: 4123 - DNA, 452 bp, Diabrotica virgifera
  misc_feature (420)..(421): n is a, c, g, or t
atcaaattattaatttgtacactatgtttacagtagttgcccttttattgtgtgttgctttatgtgaagtacatagcggtattaaagtctgcaaaagattatcgtgcaagatttacagcatgtgctgatccccttaatctagtaatattggaatccgacagtcacatttcacgacgtctcatcttgtctagcagctgaagagttccagtgctaaggttgcaagaaccgcctatttcatacagattgctcgttgataaggttaggagttcaactgaaccacttaatggtgcatgaagtgtatgttctccatatgttgaaatacgtatcattccatgattcgtcggatctcttcattataggattgaagtgtacatgaaagcatctgataccacgcctgcatcaacagcaacaactaattanntagaggagatcaaaatttttaaataactttt

SEQ ID NO: 4124 - DNA, 357 bp, Diabrotica virgifera
cttatgtgcagcttggcccaaaatctgcccaacagtatgatattgaccgatgccaagattcacgctaccaagatccaaggcatcaagggatcgggatccaagaagatgtttttccgccattaagattcaactcatctggtaggactcctccatatcatagatccctcggtgtccataatcattgccatcgagaacgactattccatgtcaggcatcatctgaaaggtctatgacatctgccgactggccattagatacggtgccatcaccattatggacgaagtgcatgccgtctgtatgtatggacgccaaggtgccgacgtcggcaaccatcttgacatcggcgaaaacctcaac

SEQ ID NO: 4125 - DNA, 372 bp, Diabrotica virgifera
  misc_feature (13)..(30): n is a, c, g, or t
tttaatttacaannnnnnnnnnnnnnnnnngtaatcttcagaaaccttttatctaatgcaagtctatctactatgtgtgagagaatatttgatgtttataaagttataaatctattttatgtagcttgagtagcacggattgataattcaatattagatatttagcaatttcgcagttagaactagctaaacaatgtaatatttttattgttggtctaaatatacttatctagatttgatgtgataaagtgtgaatctgatttaaagatatccaaattttcaagaatgatattatatacatctatcagcattcagcttaaagttgaatatatctctattacgactatcatatatttttatggatgagccttt

SEQ ID NO: 4126 - DNA, 399 bp, Diabrotica virgifera
  misc_feature (34)..(99): n is a, c, g, or t
  misc_feature (130)..(151): n is a, c, g, or t
  misc_feature (366)..(386): n is a, c, g, or t
ttcagatcacacgtcaggttaataataagttatnnnnnnnnnnnnnnnnnnnnnnnnnnnnnnnnnnnnnnnnnnnnnnnnnnnnnnnnnnnnnnnnnngtatatgatgaaattatgatgattatattannnnnnnnnnnnnnnnnnnnnngtggtttaatataggatttcggcaggatttctgtcacatgtttatcacctgcatgtcattttgaagtcattatgtagtctcgcctgcgtatcgactgattacggaggacgctgtatggtgaccgtgctatggtcgtacaaacgttacattatcaatagatagctgatatgaaggggtggttgaaggttggactgtcattaattcagtcattaagnnnnnnnnnnnnnnnnnnnnntgcctgatatttt

SEQ ID NO: 4127 - DNA, 307 bp, Diabrotica virgifera
cttacacgaccattgctcttaatatacgatgattcgtatactgtgcgcgatttccgctataccttttaccggggtataatcggtatgtcgcactcattcgtgaatatctgcacatgtattacacgcgacctattgctccaatcactgttctggtcactggctctgtgaatacatcttgagttgcctcgctcccgcgcactgctaccacaatcatcacttaactggtggtggaaacacgccatccacgccagaggataataggaatggcagttatacgtagaatggccagatagacatcaaccccact

SEQ ID NO: 4128 - DNA, 383 bp, Diabrotica virgifera
  misc_feature (3)..(22): n is a, c, g, or t
  misc_feature (269)..(290): n is a, c, g, or t
ctnnnnnnnnnnnnnnnnnnnncgccgacgcctgcgctttcataagattggtcacaatgaatctgttcatccttgacgctgcccttagtggggccacaagtgccaatctaagtgccttcgacaaatggaccaattttaaggcaaccgataacacatcttgcaacgttattgacgacacacttcgtttcgctgttttccaacacaacctcaaagtgctcgatgaacacaatgctatatacaatagtggcgaacaaacatactacttggcnnnnnnnnnnnnnnnnnnnnnntctagcgctgaattccaagctatgttggcccgtcatatggctaacaagcccaatcactcctttattgcaatacacctagccgatcgcaatgtc

SEQ ID NO: 4129 - DNA, 412 bp, Diabrotica virgifera
  misc_feature (17)..(52): n is a, c, g, or t
  misc_feature (99)..(133): n is a, c, g, or t
  misc_feature (153)..(184): n is a, c, g, or t
  misc_feature (201)..(249): n is a, c, g, or t
  misc_feature (281)..(411): n is a, c, g, or t
tgggcggacccttgggnnnnnnnnnnnnnnnnnnnnnnnnnnnnnnnnnnnngtaaggaaaaatttaatttaaggaaagttaattagtatggtgaaagnnnnnnnnnnnnnnnnnnnnnnnnnnnnnnnnnnnggtacctggggtaccagggnnnnnnnnnnnnnnnnnnnnnnnnnnnnnnnnccgaatttaaaagaccnnnnnnnnnnnnnnnnnnnnnnnnnnnnnnnnnnnnnnnnnnnnnnnnngtaatgaaatgtaatccgtttttaaataaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnc

SEQ ID NO: 4130 - DNA, 133 bp, Diabrotica virgifera
  misc_feature (12)..(120): n is a, c, g, or t
cccacgcgaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatggggaggagg

SEQ ID NO: 4131 - DNA, 322 bp, Diabrotica virgifera
caataactaatatacaacctgagcgatctcaatgtaagaaatcttgtgccttcagttaccacttgggaacccggtgtaagtgccttaaattaagctcatcagttggtagcttcagttacaaggaagatcagaaatgataccaaatggggtgaataaagctgtatctttcaactattatcagctagtcgactacctggcaggttactgcttaagataatatgaccatggacatagagacctctccggataagtatcggatttacactggatagttgcaatccacggtgcacatggcgaccggcatgttggcataaagcttcaa

SEQ ID NO: 4132 - DNA, 304 bp, Diabrotica virgifera
ggtcgacattccgggtcaaccacgcgtccgcaagactcgtgagcgagaagcgtgttgtgagaacacaatcaatagtcattattgaggctacaacgtagaagatcgattttgcgcacctgctgaggtggagacgacatctcaaattactaggctgggtatgacgtatcaccaacacgactcaatatgctcttcgattggcagtcgtgtaagcaacgaccaggtagtgttagcatctagtcacatcaaacatctttcagttattactcacatcgattctattacgaagaatattgcggacacagag

SEQ ID NO: 4133 - DNA, 331 bp, Diabrotica virgifera
tctagactgagtcatattacgataaacggactagaagaaattgactacacgacagacgttgcgaatttgtaatgaaacagtatattcaacatttatctcccattctttggtggagcctgagtaaccgtcgagtcatgattgtaactgtaggttgtaatcaatacaaatatcgttttacatcttttttagagatttaaaggaaaatttcttaccattaagaacattatatgaattacatgtgtgaccatattacatgtctacctagtttttaagatggatactctcattgcttatataccatatattgagtctcacgagaatatacatggtg

SEQ ID NO: 4134 - DNA, 81 bp, Diabrotica virgifera
ttccgggcattttgcgctaacgaccccttaacaagcccgtccgatacgggttttcttttaccaaatgaacactttcatttt

SEQ ID NO: 4135 - DNA, 364 bp, Diabrotica virgifera
tccgggtctaccacgcgtccgaatacaagtcttttagtaatgaatctaacatgtctccgtcccacagacgaagctttatgcgcgctgaactcagtacctgcccctgcagcttcggcagaatcatcatttaaatgaacactcaaatgaacggctggttcaacatcagattctccatactgacacttatactgaattatcatctactgtacctacacattcattttttacccaacaacaggactcatcaacaattgtacctacttattactcacttatttcagcatcagattcatctacaacagcaccttaattatctgcagtgaatccaacatctgattcaccatctacagcatctacagattct

SEQ ID NO: 4136 - DNA, 438 bp, Diabrotica virgifera
cacacgcgtccgcagcattgacggcaccgatgttggtctttacagatccaccacacaggaaatgaacaagaaaatcggatacgatgtaacttacttaggagaactaagcgacacggatagctatgaagatcccaaattcttactgaaaggagattcgcaatctaagccaagaatcatagatttcgttccgctggattacgcaaccaagagcatgtttccgaacaatagtaatattcccgaatatcagactttggaacgagagaaggtttatcacgtgttaaattctgctcctaaatccacagttaacaaagcagacattaaacaggtagatgatgtagatggtaaacccagaagtacgaaccccttcgtagaacctgaaccaaataaatctcctgagggcgcgactaaattggaaggtactattggtcaagaaagaag

SEQ ID NO: 4137 - DNA, 122 bp, Diabrotica virgifera
gacggcatcgatgttggtctttacagatccagcacagatgaaatgaacgtgacgatcagatacgatgtaacttaattaggagaagtaagcgacagggatagctatgaagatcccaagttctt

SEQ ID NO: 4138 - DNA, 410 bp, Diabrotica virgifera
  misc_feature (31)..(52): n is a, c, g, or t
acgcatccgcacacacgtccgatttctgatnnnnnnnnnnnnnnnnnnnnnncgtaattaattaaaacgtaaaataaatctgcaaaaatatacagggtgtcccatttaaattaaataagttgagggtatttctggtgaaactggtgtagtaacaaaaaatatggcgtcagatgctttcagtgtcattgtacttgcatgcaatggcgtcttctttatttcaaagatatttagtatgtttcattcttcaacgcaaccctgtataaacaaaatcaaagcttgactatcctatacgaagactgttattttatgatagagcacatcgatttaccattatttattggtttgtattttgcctgccattctattttatcatagttacttccttataaattcctatgagatttattaat

SEQ ID NO: 4139 - DNA, 350 bp, Diabrotica virgifera
caaaaccaacagcatactcgtcgtcgaacgtcgttgatgtacagagcctaattacgatggcaaatattgctagcggggattcagagattaactcgaaatacaaaccggtgatagctaaaagtgttccagtatcgatctcagatgacctgcttgaggaacccatttacgtgttaactacgaaagctcccgtatcaatcttctagattctatgcagtggatcataagtaagacattgtggcagttcattaggtttaccatatatatttgtcaaaatgagtgtcccatggtgattgactacatggatgatgtatctgcacgatgaaaagatgctgatttagatgactactttt

SEQ ID NO: 4140 - DNA, 451 bp, Diabrotica virgifera
cagactctaagtggtgtttccgctaaagatgtatctaaagtagacatcgtgaagcaaacggagtggttgctggaggatttgtccaaagagctcaagaagaaagacgacgacttggtgcaattggaatcagatccagaaataaccataatcacggagatgacggaaaccgacaaggacgctctggtcaacgaaaacgaaaacaagaggcggaaagaaatcagttcgtttctggaggaagaaatgaacaagatagacgaagtgtttaacaaacttaaaatcaaagtaaacgatgatatcatagttggtgatttagctaaaagtgttaaccaaatcaaacaagaaaaaattaggaacaataaagttaaaagtaagcattcgatcgatgagttatgatgaatgtaagattgtgtttagttgcgatatcgattgattgaagcggtatattaatttg

SEQ ID NO: 4141 - DNA, 439 bp, Diabrotica virgifera
  misc_feature (329)..(329): n is a, c, g, or t
  misc_feature (333)..(350): n is a, c, g, or t
gatggataggcatatttgccatgtatgcttatgtgctatgtgtgcacataaagcgaattttgatgaatgaaccctccacacttagtcctatgtggctgaataaggtgcataacaaataacacacagtgaagtgtgttgcggcaacattagataaaccacattcaaaagtgacctcatgctgttgaatacttctgtaccttggcattttgttagcccagagttatactgttgtatgttctagttttgagaaaagggaaaaacaaaaaagattttagttttattaatcattttttgttttttcccttggcattttgttgatattcattaanatgnnnnnnnnnnnnnnnnnncgcttttttcaaaacatacaacaatataactgagctgacgaaatgccaaaggaaagaagtttttaacagcatgaggtcacctttcaatg

SEQ ID NO: 4142 - DNA, 452 bp, Diabrotica virgifera
  misc_feature (318)..(333): n is a, c, g, or t
cgcgggtcgatgcaagcgtctgcactgacgtcctggtaattattgattaacctgtagaaacactaaaaactgagtgaatctttttttccttattattttttaagatctactttttactttagtatcaactacttattatcttattatcaactttacttattatcaacaatttaattactgttcgatattttagccactttaaggttaagtgaatcaatgaaatgtgtaataaattaaatagctaaattgtatgtgctattattaatttcagttttatgtaccaactaataaatgagtttctcaaatgaaggtattaannnnnnnnnnnnnnnnaatgaaattgaaaaaatgggttttaagagtatctccaggttttcaaacgaaaacatcttgtatagtctgtttaaattattagagaattgtaaagtctatccacactgttatatagcata

SEQ ID NO: 4143 - DNA, 330 bp, Diabrotica virgifera
aaaattttcaacattagagtgttcaatatatctatcaaatatgtctctggaacggcaaggctgttcgattccaccgacatcaagcgtatttcagaaagacattgaagctcatgcatggctcgagactaaccatggcgccattttacctcaaggagatgcctatagattatatggaccatcatagaactgtcctctgacaactcatcaacttataggcaccaggatcgatcgccaatttccacacatcaggaggagtaatcatttagatggatatcatcaacaacttcaatgccgaaaacattgccaacagtgtagctgataatgatgttt

SEQ ID NO: 4144 - DNA, 388 bp, Diabrotica virgifera
accaagcctccggtaaagccttaggaaaaaattttgatttaatggaaagcaacggtttaattaaagaacagtggttggtaaaagaaactttacaattaaactgcgcccaaaaaagcccaaatccccgaacctagagtttcacggataatgtacacctcagcagataggtaggaggccctgacataatggcacaagctttgtacatgcttttagaggttgacaagtataatttaaaacatgatctgttgcaacacgatgtgctgtgatacctcgtacagtgttgcgacggcccagtttgcatcttttcactagtaatccacgatccctatcatacatatatcctggtctaccaaaaaatttgtcaagatgagcattgccactttcacga

SEQ ID NO: 4145 - DNA, 416 bp, Diabrotica virgifera
  misc_feature (200)..(238): n is a, c, g, or t
ggaaagttgcttttgttaattggtgtaattgcgtgaaagatggaggtagagcaattgtgtcttaaggagccccagtggatactggacaggaaggattccggtcctctcttttggagaagagactcgtcggaaactgccagagtaaaattccgctacgaagttgatatcaaagagttccaaagaggtgaacacgaattcgnnnnnnnnnnnnnnnnnnnnnnnnnnnnnnnnnnnnnnnccaccagcatgagtgttatgttctgcattacggtaacagtcatcctaccatggctgttgtttgcacagaaaggtttctaaccaaggttagattgagagatgagttaaatcgacgatattagaagaagagatgaatttcacgtcagccaatgacagggagtgcgggaattaccaataac

SEQ ID NO: 4146 - DNA, 114 bp, Diabrotica virgifera
  misc_feature (11)..(30): n is a, c, g, or t
ttgcaactccnnnnnnnnnnnnnnnnnnnntttgttagcactctgtctacacataatcgtctgtagcttcctaatattattcagtttgaagggttacctcatcactacgcgttt

SEQ ID NO: 4147 - DNA, 376 bp, Diabrotica virgifera
cattaagttcactaaccttgtttcaacccttgttgctcatgcattttctttcccgttagttcattatccatgtgttagattcattgatatttgcattagtggagatggatttttgacccgtgagtgggatggatgcataccttcctgctcatggttgggaaatttcgatacttctagcagcgtaccagttgcctcatgagagagatctggagtgttcagggttgattgtttgtcatgatctggtatgtcatggtggcgtgtgtgcttatatgtgcgacattcattaaccataggtagtaactatcactttggcataaggtattggtaccgcatcattcagtaacagttttaaggatcatctagttgcgcttgtttc

SEQ ID NO: 4148 - DNA, 301 bp, Diabrotica virgifera
cccactcgtcagccacgcatcagctgacacctgggttcttgtcacagttagtacagtttttcgcatccatggcatgagtgtcaaccaacgtgcatgatgctggtctgactcttagcgtgtcatatgaaaggcaatgacatgacagtcaacgatttattctatgacagcaatatcgttcagaatcggggatcggaattcatcataaaatcggacttgatgcacattaaatccagtgaatcttcacgtagcgcagttggaatagtcacactgacctgccaacatggtgatcagggatgttata

SEQ ID NO: 4149 - DNA, 412 bp, Diabrotica virgifera
cccacgcgtccggtgacgcgtggcctgacgcatgggcagaaccatgttctacgtattcttaatgtacatcgattcgaagtggactttgtcactactcataactaacattatcttttgccttatggataatgactatatttacttaatcgttccagcgattcaaacagacaaatattttattgtacagtgtcttatattggtaatgacgtagatgaggaggtttcttacatgctaattttggaaaatggaaataggtcttgctcgcaccaactacaaattaaaattcatgtaacgacaccacttgaaaactctgatttaaagaatattttatatgatcctacatcagtagtagccagaattgaaattttcaacaatgaggatgaggtattagagtttagtgatcctgatgatg

SEQ ID NO: 4150 - DNA, 417 bp, Diabrotica virgifera
aagaaggttgataacaagccgcagtaatttgtggatttgttttgaataattttatcatatttgagttttaatttggtcagggttatagtggatttgaaacgtgcaattaatacttattttgtatgtaatttaaataaaataagaagtctgtacatattttattagccattcaattattatttcttcgtagtagtttcttctagatgacatttggaattggttcaatagtgactctttcattttctgatgctatatagatataaaagtggaaccaaccctgaaaacagggtacgtctccatacttgttccatttcgtgaatttttagtcacactattcgattattgacttgtttaattaaaagcgaatctattttttttttacacaaaattactgtccaaatagaataccattaattc

SEQ ID NO: 4151 - DNA, 97 bp, Diabrotica virgifera
  misc_feature (24)..(42): n is a, c, g, or t
gacgcgttgttcaatgcaaccccnnnnnnnnnnnnnnnnnnnaccgctatcttttattgatttgataggaaaattttatgcatcgatagttacttag

SEQ ID NO: 4152 - DNA, 322 bp, Diabrotica virgifera
tatagagagtcgtattaatcgcagccaacaatctgaacgtcactgctttgtcactcaacaatcattgggaagactttaaggtcaaacactggttagcttacaacaacccactcgaggatagggtccgcatttcagttttccaaaccaatctgataggcatcatcgaacattggtgcaaagacactatcaacgtcttgtccgttcactacggaagtcatgcagttcgctgacatgacctcggaacagttcatagccactctcagtgagcatgcatagattatccctatcatcattacaactcttcatgttcaagatgtaaacg

SEQ ID NO: 4153 - DNA, 420 bp, Diabrotica virgifera
  misc_feature (374)..(374): n is a, c, g, or t
atactataacggctgaaccgtctccattcacagtaacaactgaaccgtccccattcacagtaacagctgaaccgtccccgttgacaataacaaaagaacccacaccatttactataacagctgaaccgtccccatttacaataacaactgaaccgtcaccattcacgatgacaaccgaaacgtcccctttcacaataacaactgaacagactccattcacaatgactactgaaccgtccccattttcaatatcaactgaagagtcgccattcacaataaccactgaaacgtccccattcacagtaacaactgaacaaacaccattcgcagtaacaactgaaccgtcaccgttcacaataactactgaaacgtcnccattcacaataacaactgaaaagactccattcacaataacaactg

SEQ ID NO: 4154 - DNA, 190 bp, Diabrotica virgifera
  misc_feature (2)..(116): n is a, c, g, or t
annnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtctatgagacgaattcgggaacactgttgtgacactggttagcagaggcatgtccttctgcgttcattatcga

SEQ ID NO: 4155 - DNA, 427 bp, Diabrotica virgifera
atatcaaaacataaatcagattgaagctgttcaccgctgctgctgcactcactgttcccataactgctaatctaagttccttcgagcaatggactatctttaaggccatacatatcatatcgtacaacgttaatgtagacatcattcgtgtcactgtattccaatttatcctcaacgttgtctacgagcatattgctaatcactagagtgtttaacaaacctactatattggctgtaaatacattcgcacgattggtctatcgcttaattccagtccagtttggctcttcaaatggttatcaagccacttgaaaccttcaatggaaaacacgtataatatccattgtcaacgctgcaaatgaagttgataggagatcaagcgctgacctgggagtcaaggatctcggaatctgtggatcatgctggg

SEQ ID NO: 4156 - DNA, 257 bp, Diabrotica virgifera
caaacggaacgaatataaaagatacaaacatacgtaagcaatgcaaagataagatcctcacccaatcattaacaaccagaaatcatttcaaggtcatccgtcttttcattttactgggtggctcacaccggcccactgtccattacgcaccttacccggcttcatgcccctcctcctgttgccggcctgcctactaggcgggcggcttttttcactctcccttcggggaaaccccgcggttgtacaggtaatccccc

SEQ ID NO: 4157 - DNA, 145 bp, Diabrotica virgifera
aacaccgtaaagtgagtcgtatataaactcgtgtgatactctctgtgggatgttacgaagtcattagtgagtttacgtgcccccacaaatgcttcttcagtaggaagtttgggatcaagagtacgacgatgggtcagggttcaca

SEQ ID NO: 4158 - DNA, 453 bp, Diabrotica virgifera
  misc_feature (428)..(428): n is a, c, g, or t
  misc_feature (442)..(442): n is a, c, g, or t
gtacataacattgtattatggaagaacgagatttagtttctaatagacgcagatcattgcataactatggcgaagagaaacctgtttgtcgaaaatttccggataatgatgaacaaaatttccaatatcctccagattatatccacaaagtaaatacagaaacggaaaaatggaatgctcacctcagtaacatcttagtcgaccaacagaggtacaaagaaaaaatacgtgaacttaaaactgtagtgtacaatgaaaacgttttgtcacatgatcagcaggaatttttaaaatctatagactttaatacatacttgagacaaactgaaatattttgtaaaaaggtgcatttagccgcagaactatacagtttcaataaaagtgaaaaatatcaagagttacagaaaaccattgaacatgttcaaganatcattgatagtanactgaagacat

SEQ ID NO: 4159 - DNA, 164 bp, Diabrotica virgifera
  misc_feature (32)..(94): n is a, c, g, or t
  misc_feature (96)..(119): n is a, c, g, or t
  misc_feature (127)..(144): n is a, c, g, or t
cacgggtcgacacaagcgtctaaacagacgtnnnnnnnnnnnnnnnnnnnnnnnnnnnnnnnnnnnnnnnnnnnnnnnnnnnnnnnnnnnnnnncnnnnnnnnnnnnnnnnnnnnnnnnacaaatgnnnnnnnnnnnnnnnnnnctgggaaagagtcaacaaag

SEQ ID NO: 4160 - DNA, 428 bp, Diabrotica virgifera
  misc_feature (353)..(375): n is a, c, g, or t
ctgactcgtctagtttttatcatgttattggggattttccccattttatagaaaagagatcagatcaaagtatttcataggttatatataattcgatgtaactaagccctttagaacaaacaaaaatgggaggaacacattcaaaccccccaaaatggctttggagtttttagggggtttgaacgtgtttttccaatttttgatacagttgaagtcctacagttacttcaaattatatataacctataaaaaccttgatctgatatattttgaagttgataaaatggggaaaattcttaaaaaccccataaaaaacagtttttcgaacttatgaagatggcgcaccttacggnnnnnnnnnnnnnnnnnnnnnnntacagtttttgataaaaacacaagacaaaaaaattaaatctgctgcaatctcc

SEQ ID NO: 4161 - DNA, 254 bp, Diabrotica virgifera
  misc_feature (5)..(85): n is a, c, g, or t
acggnnnnnnnnnnnnnnnnnnnnnnnnnnnnnnnnnnnnnnnnnnnnnnnnnnnnnnnnnnnnnnnnnnnnnnnnnnnnnnnnnaagatggaagggtatagtgaatacattagggtggatggaagattagattcaccgttcaaaggggggggcgagggtaattcaatggggtttgattttggagttcctgtccgggaaaaacctggggtttgccaaccttatccccttggatggtagcgggcttttccttgat

SEQ ID NO: 4162 - DNA, 222 bp, Diabrotica virgifera
ggtggacgcactatgaggttaatcgccttcattaagtcttgcacgtgatttcatgtcgcttctatgaggattcggaacttcttatcggtggccatcgcttttacttagtcgtgactgggaatgccctgagtcttactatcattaatcgacttgaagcatatcctcattactctacatggtgtaatatttaataggcgtctagtgatttccattctgacaatt

SEQ ID NO: 4163 - DNA, 390 bp, Diabrotica virgifera
cagaaaatgcacaataactgcctcttaaaatttaccaagtttcatttgcatatctctattggttttggagcaataaatgggtcgtcggtttgtaagaaagatttcaacatcccgtatctcggaaactaagcacttcaggacatatgtttataaagcaaactgtcgttattttttcatgcggaattgccccttaacgtgtgtcgcacttaattggaaacaccctgtattgatgaagaacatggccagttgttaacgtgattaacttttttattgtccaacgtaaacgaatggatcaacaaataaggtgttaagaaggcctaaggctgcagttgagttttggttccaatattttatcgatgctaaaacattccacggagtgttgcgaacttt

SEQ ID NO: 4164 - DNA, 357 bp, Diabrotica virgifera
  misc_feature (4)..(44): n is a, c, g, or t
cccnnnnnnnnnnnnnnnnnnnnnnnnnnnnnnnnnnnnnnnnntcaggcaactcatcattcccgaagtttgaatgagtgcgaattcgacaatagggctgatctaacattaccttgccgtcttgtcacaagtcatcgacatgttcgttgttggacaattattgttggatttttgcattaatatcaacctttcactgtacgacagtacatatttaccatttaatcacattcagccatattgttgcaaaatcaagattatcacatctttctaccgattcaaatttaactccagctaaaccttcagaaaattgtaatacttttgaaaccacatttggtgtcacatatcatataatcacca

SEQ ID NO: 4165 - DNA, 367 bp, Diabrotica virgifera
  misc_feature (4)..(16): n is a, c, g, or t
  misc_feature (19)..(31): n is a, c, g, or t
  misc_feature (335)..(362): n is a, c, g, or t
aagnnnnnnnnnnnnnctnnnnnnnnnnnnncatccctgactaaaaagtaattttgaagaaggaaaaacgtatctggcagttcgtataattagttttaagtgatatatttgttgttaatagtgttgttattgagagaattatggttgagaaaaaggctgtacagaagcccgctggggatgcaccaaaaaaggtgcacaaaccaggaaaacctagaaactatgatttgggaaatggagtactcagattctctaggtctaaaatgttccacaaaaaagcattatacaaattcgttggcaagaaagtagaagctaccaagaaacctcaaaagccccannnnnnnnnnnnnnnnnnnnnnnnnnnnaaaaa

SEQ ID NO: 4166 - DNA, 332 bp, Diabrotica virgifera
  misc_feature (61)..(101): n is a, c, g, or t
  misc_feature (110)..(135): n is a, c, g, or t
tatgactgtgccaaagtatataaacaatgcgctagaaatcgccaaagaagacgggcttctnnnnnnnnnnnnnnnnnnnnnnnnnnnnnnnnnnnnnnnnnatatacaannnnnnnnnnnnnnnnnnnnnnnnnncaacaatgattcaacaataaaataaaaaaggatactgcaacacctagataaatacctatcataagtcaaagtggggggccgccttaggggttccatgttaacttgcccttgtaagctagttcaaactccttccaggggttccctaaaattcatttcatgggccttctttttaaaacctcttgtcgggaaaacccctg

SEQ ID NO: 4167 - DNA, 357 bp, Diabrotica virgifera
acacatgaattattttacacttacacccttcaaaaactcatttataaactaaaaatgggtgcatctgtaattcctttcatagttttcactgtattatggggaggagttggagctgttctacccatttttgtacctaaaggacccaatagaggaattatccaagttattcttatgataacaggtgtgtcgtgctggttgttctggctgtgttgttacgtagctcaaatgaatcctctgatcggtcctaaactagaacaaaacatcgtgctgattatggcaaaacaatggaaatatgcattaccatcgtcagcttgaatgaaggtgtgagtgaccattccatctggatagtgtgtataa

SEQ ID NO: 4168 - DNA, 362 bp, Diabrotica virgifera
  misc_feature (234)..(259): n is a, c, g, or t
acggacgcgtgggaggatgtgttcgaacagagaatggaaacactaattacataaacatagaacgaggagtgcatcaaaacacttttgcattttgttccacctattatgtaatgtatatgccgaatatgtaatcagagcttctcttaaagatcgccctgaaggtgccataattaatggaatcatcattaacaatgtaatatattaactatttagatgggaaataagccacaattnnnnnnnnnnnnnnnnnnnnnnnnnncgtttcgactcccaaatcgggtgtcgttgtcaaaatacaaaatactactaaattaaacaaaaatgttgttccttagtaaaaaattcttctaataaattattta

SEQ ID NO: 4169 - DNA, 156 bp, Diabrotica virgifera
tacacgcaactacactgagtcgaattaaacacaatggaatggtttcaacaacaactcatcattcattcgacgtagtgatagttcttgcgactcgtgagaggatatttgacttttatcaggtaaaaatttactctttggatcgtgagtggcagggat

SEQ ID NO: 4170 - DNA, 265 bp, Diabrotica virgifera
acgtaatcagcgatggtaaaaatccttaaatacgaaagtaatcccaaagtatatgaacaatatataccgttaaaggttcatgaccaccttttcggcatttggaaccagagtacatcgctatgataaatccttgtaatgtataccgagcgttagtatttccgactgttgtccaaaagcagttattggcgatgtaaacactgatcggctgggtgccatatggtataaaaatgataatttgcactggctcttgttaactggcgggtat

SEQ ID NO: 4171 - DNA, 307 bp, Diabrotica virgifera
  misc_feature (38)..(56): n is a, c, g, or t
  misc_feature (241)..(241): n is a, c, g, or t
taatattctcagacaaatgaatacaatacaatggggannnnnnnnnnnnnnnnnnncgcttacttagttgcattttgtggaaaccttctggctctaactggcgatacaactttaacatggtcttcaccaattttaacgaaactggattcaaacgatacagatataaatccattgggaaggaagataacattagatgaaatatcatggatcggatctttgcagtatataggcgcaatggtangaattctgcccttcgccgttttagctgatgtaataggaagaaaacctgtactgctcctattggccg

SEQ ID NO: 4172 - DNA, 415 bp, Diabrotica virgifera
  misc_feature (20)..(47): n is a, c, g, or t
gcgtcaattttaattaaacnnnnnnnnnnnnnnnnnnnnnnnnnnnnaccattcgtctattgttcccccgaatgcatatgtctgcaaattttcattcatttgcattgaagaaaagtcagtcaaattaacgtctaaagatttgatgcaaactattgaagtaaagaaaagcgtttaaaaaacgagcctgtaccgccattaacaagaacaaaaaaataaacttttttatcccattcctagattttgtgtaatcttcgaactactaaaattttttatttctaacaagaaatcgaacatattataactaataactaattaggcaacataaagaaattatcactgtcatagcctgcgtcagattttctctaatatgttctgtcatctttatcgatatctgttcagtgcagtagtgtgttaa

SEQ ID NO: 4173 - DNA, 335 bp, Diabrotica virgifera
  misc_feature (9)..(45): n is a, c, g, or t
  misc_feature (53)..(72): n is a, c, g, or t
  misc_feature (81)..(111): n is a, c, g, or t
  misc_feature (135)..(156): n is a, c, g, or t
  misc_feature (160)..(207): n is a, c, g, or t
  misc_feature (209)..(228): n is a, c, g, or t
  misc_feature (248)..(289): n is a, c, g, or t
agttcttannnnnnnnnnnnnnnnnnnnnnnnnnnnnnnnnnnnntgccctcnnnnnnnnnnnnnnnnnnnncctaggcgnnnnnnnnnnnnnnnnnnnnnnnnnnnnnnnacataacaaatcctactcccttgnnnnnnnnnnnnnnnnnnnnnnagtnnnnnnnnnnnnnnnnnnnnnnnnnnnnnnnnnnnnnnnnnnnnnnnngnnnnnnnnnnnnnnnnnnnntcttgccgtcaatcaatttnnnnnnnnnnnnnnnnnnnnnnnnnnnnnnnnnnnnnnnnnncaaattatcaacagaccagaactatcctttatcgaaacatacgaag

SEQ ID NO: 4174 - DNA, 294 bp, Diabrotica virgifera
acatccgcgtacaatccccattaatatatccgtattttatacacaattaattcacactgccacccaagttcgctcccaccgacattaaatatgtctacatgagatgtgtcggcagacaacttggagctacctcttctttggctcctacaattggtcctctacgtttgctctccagtccgtcttgtgactatccagtcagttgcacttcctctctgggaaggtcttactttcacagttcatttgaaaatccataatcgtcaacctaccatttccgtactcccatctgcctcctcc

SEQ ID NO: 4175 - DNA, 355 bp, Diabrotica virgifera
catctcttttctcactcactgttactgtatttaatctctcatctttctatacttctacctttgttctccatccacctttcctattccttctagctctacttgccgtattcttttctgaatctgtaaaataccaagttcttctcccgcgttctcatcttgtttattgtctcccattgtctctcttccttctcccttttgtcatatgtcctcactgttttttttcctcaattactcgtctatctcatactatgatcatcattaagtttttcatcctatctgactccttcaggtttaccacgcctggaaagcgaagaaccgcaaacgcaccatcatggacgaaaacgaacgcgcccct

SEQ ID NO: 4176 - DNA, 325 bp, Diabrotica virgifera
cttggtgggaaccattacagaatcttcgtgaaaacaatatgcaaatattagtgttcaaatatcggtcagtggtctgcgacttgaaattaaactatatttatttcagaattcaatatttcgttgaatgtttattttttcaacttcttcagaaattaagttacaattaaatgcaaacataacttacatgcaatcatttataagacaagcaagttaagagacatcttttgcaatattttaaaattctgagaaactaaaaacatccggttcgataataaaattagttaaaattgcaaaaaataaatttgacaaagataagatgaatttt

SEQ ID NO: 4177 - DNA, 349 bp, Diabrotica virgifera
  misc_feature (279)..(297): n is a, c, g, or t
gggtcggccacgcgtccactaagtcataccttattcatgaacacccatatacggtttttgattcacctataaggtatttaatttgggcattacatcacctgataaaaagggacacctctatgattgtaagtttgtatgtatttagcgctgaatttcccacctctactacgttcaattctgtttgtctaacaacataagaagttttccatcttttgcgtaattttgccgctaactagagtgctcaacaatgtattactcgtataagtataggcgaatttnnnnnnnnnnnnnnnnnnntatgtatgtattaatatattattcataaaattagaatctgatttaaaaagaa

SEQ ID NO: 4178 - DNA, 326 bp, Diabrotica virgifera
acccacgcgtccgggctcttattccggattctgttcatgtcaggtacacagaagttcatcaatggagatcctgtatggtggaaccttaaaggtatatctcgtgtttatgaagtattacctttacctacgcctctgtcttggtatgcatatgcccttcctgaatggcagctgaagctcacacaagttttcgtcaacgtcgctgagattattttacctttcctgtttttcgtacctataagatgcgccagacattttgcattcttagcacagttattcttacaaatatgcgttattgtaactggtaatttcggatttgccaacatact

SEQ ID NO: 4179 - DNA, 407 bp, Diabrotica virgifera
gtgaacagcgcttggctccgcgttctacgaatacgaggtctttcctaagtactaacgtacctaacctaccccaaattgtttttgtctggccactccacccaaacgattttataaaaatactggaatattacgtagtgatggtaaatttgagatcacccttgatcaaaggaagttaaaaacacccaagggaaatatttttgcagttgagagtgaagctttagcattagcagtggcaacagaatggaattctcagaaagataaaattattagaagtaaaatgcatttgacaactctgtgtaataccaccatggacaatcctaataacttgacaaaatatgatattgccaattatattgtaaattacttggatactgatactgtcctatttcaagctaatgaagatgaag

SEQ ID NO: 4180 - DNA, 392 bp, Diabrotica virgifera
accacgcgtccgaagagggatcatctgaagcaataaccacaggaaaaccattagcaatcaacaggttcccagggtggtttcttaaatccgtaaccaacttgaggacttggttcgaaatggggcatatctccaaggcgatctgttgctctttgacgtattttgctaatagaggatgttttagtatcgaatatccatgcccaattcgggtggagtttaacaagatggcgtcaaataagttcaggtctgtttctccgtaccagtttgtttcgccagcgtggaagaagaatttggctccaagatttttgagttctatcaattggggcacaaaggctgttagtggttgaccattaatcgatttgaaaatcgcctgaaaagttttccagactttgttt

SEQ ID NO: 4181 - DNA, 432 bp, Diabrotica virgifera
ggccgagccacgcgtccaggggtaacataagaaaaccctttatagtttaactgttagcaggacaatgttacagttccatactttgaagtttcaaggtggtaagaaaaaaaacggccaatttggccccaattgggaatcaacacacaaaactgtgacctgtggcgatatcaaatcgctgagatacacatatgtggcgagatcactaccaaattcggaactcctttgccgattttggggagaggggttataatacttacagaaatggggggtaatgggaaaaacggtgaaaaattaatagggggaaacaaaatcgggagaatcgcaactacagatcatcccaaaacactttttcagtgcggcataaattatcgaaatctctcaaacgcattacaattggggaagacagaaaaaaaaggtgcccccccggggaat

SEQ ID NO: 4182 - DNA, 248 bp, Diabrotica virgifera
gggtgaccgcccatcaggttcaaaccttacttacccttaaaaccaagttctaacccctcctaaacgcccaccaaaataaattccatgggccatcttttaataatttcgaaaagggaaaacccatggcttattccaactaaaccccattccagaatacccccttttacccaccgggtttaataccaaaaagccccgcacgtttggccgttccaaacattttcccagcttaaatggcaaatggaataccc

SEQ ID NO: 4183 - DNA, 391 bp, Diabrotica virgifera
aactaatcgattggatggcgattgtgtctgctgaatgcaccctttatcttttatctttatgtcagtaaatatgtttatctgattgttagcaataatattaaaatcctgatttagataaaatggattcaaagacagtttttgaaacataacgaatgtgatttgatgatccctatgaagatcaaattcctagcttacatttgcatggtgagttcaacatgtatatgttattagagaacaagtaacacaagtggtgtacggaagcaaacgaatgtaacaccaattgaaagtccttcaacatgatttagatgcacacatgtttcaatcatttgagatacacatttgtagaagtatttggttggaagataactattaataatttcaattgtaaaaa

SEQ ID NO: 4184 - DNA, 407 bp, Diabrotica virgifera
  misc_feature (244)..(262): n is a, c, g, or t
caaacagtaaacaggtcagtagagtccgtttttatagataaaggtaatttatagtctgctgtgtaatctgatgagtagatcgctgctccagtttggtctgtgtcttcatttttgaagacgtcggtataaactctttacagagagacatctgaataatatccagtgggaaatgctgagattgctcttaatttagttttataaagttcgaagactatctttgtgtagtaagcataaagttgtaagnnnnnnnnnnnnnnnnnnngctctggaataacttttcagtaagttgcaccaagttaattttcccattttttttcacatctttcactttttggatttatattatatcgtaaaattattttagtcttacaaaaggctacatacctacttctttagcaggactatca

SEQ ID NO: 4185 - DNA, 284 bp, Diabrotica virgifera
ctcgtagcatcttggggaagatgggggctagcggagccactcgtagatacgtatatttggtggcaattgcctgcgaatatttcagtctttgtctgcggtagcgcactccgatggtcaaccccagtactcccgcgtttggagaacttggccgcttgcccgttagatcatgttacatctacatccgaagacggattgatcgcttcgtgcctacagctagcagtcgtcttcagacccgtcgtatgtggaatactgggcgagttaaattggcacggagctgatacgac

SEQ ID NO: 4186 - DNA, 379 bp, Diabrotica virgifera
accacgcgtccgcgcaaagggatgttacaatggagaggcaaagaacgcctggtttgtctccacgaagggacgatcctcatgagttcagagtggggagattaaagcacgaaagggtgaaagttcctagaggagagcagttgctggaatgggcaatgcaagtgatgaaaattcacgcagctaggaagtccattttggaagttgaattcgctgaagaggagggaacaggtttaggcccaacactcgaattttatgctctggtagccgcagaactacagaggagagatttaggcatgtggatttgtgacgatgaagctataagcctgaacgaaccggtagacttaggagaaggaatgaaacctccaggatactatgtccggag

SEQ ID NO: 4187 - DNA, 387 bp, Diabrotica virgifera
actcaaaagaaatacgtagaaaataagaatagtattaggagagtatcgagtagcgaagattttcagagccaaagagctagttctgtagaaagagtggctagttctacggcgaaaaaaggttctgataagcttttgacttacgacgactgtgaacatgaaaaaagaagatcccacgagagattcgcaagaccgctagcaaccaaaggaaagaaacaccccaccaaaagacttaaagtaaaatgtattccacgccctaagtacaagcctgaactatctttcgatacaagagaccagcacaaaaagctccagctcacccacggtggctttctagccgaacacgacagctctagaaccggatttttgaaactacacattgaagaaggaaac

SEQ ID NO: 4188 - DNA, 375 bp, Diabrotica virgifera
aagattatatatacgttcagacaaagtttctatttcaaataataccaacagagatttcctatttcacatgaaatagggactgtccaacttatgcacatttttttgatacaattgttcatagtaatttcaagtgctaaatatggttcaatcatctttccgtacaataagtatttcatgttttttttcaactggagattacccttgtttcaatccttttttttctttcattcatactcgttcattttaatgttttttatggttatcggcacagcttttacaattcatccccttactagtcatactctctgtaaacagtagttcaattaatttcattaacatcattttccaataccgctgactacaactgacatatat

SEQ ID NO: 4189 - DNA, 411 bp, Diabrotica virgifera
  misc_feature (134)..(156): n is a, c, g, or t
accaagcaacaagctttcgaaatctgttataaaattttttcgaacaattatcaatgtccttgggttattactactgataattacatttttgttagtttttgacgtttcgacttccatttcggaaattgttctcnnnnnnnnnnnnnnnnnnnnnnncaactaatattggatttccaacattatcattacaaccaatggtggcttaatcccatcaaaaatataattgtcaaacatgccaaaaaaaaaccgcttcagaatatttttatgtcgattacttcttactattcgggccatgtcccagatttttctagctagttggtcacactatgtatgatagagacgaaatacttatcagaacgagaaaattatttctggagttcctaagttcatggacctaacaaccagtgaatc

SEQ ID NO: 4190 - DNA, 277 bp, Diabrotica virgifera
  misc_feature (97)..(168): n is a, c, g, or t
  misc_feature (176)..(207): n is a, c, g, or t
gattggtacagcaaggaaatgccaaatccaccatattaaattcaccacacaatgatattcactgtagtattattaaaacaaattgtattacattgcnnnnnnnnnnnnnnnnnnnnnnnnnnnnnnnnnnnnnnnnnnnnnnnnnnnnnnnnnnnnnnnnnnnnnnnngtggaaannnnnnnnnnnnnnnnnnnnnnnnnnnnnnnncaatcacagtgttcatgacatgttaaaggggcggcccctccaaggattcgacattaactcacggggaaat

SEQ ID NO: 4191 - DNA, 387 bp, Diabrotica virgifera
  misc_feature (7)..(27): n is a, c, g, or t
aggacannnnnnnnnnnnnnnnnnnnntgcgcaccattattacacaactagatgccgaacaccaagcagagcatgtcagtaggctgggtataatcggtgctttgattggagtgggagcagctttactttcagggcatcttatggaattatccaatggattctcttacttagacagtattagtatactaaacagtattttaggcttaggatttgtgaaacttttaaccgttattcatccgagcaataaggaagaatcagagctttcacaaccagtacttgaagaaattactacagcactcataaacctcaaaacctactctacgtctacaacatactctcatatcttccttcctaaagctttaacagcgatcagttatggtatacccg

SEQ ID NO: 4192 - DNA, 406 bp, Diabrotica virgifera
cgtctggaacttttcaatgagggttactgtattaattgcttgtattgtgctgattgctaatcagtgtgagtcagcagttttaggtaataattaccgcattgttggaggtaacgataccactatcgagcagcatccatggatagtgtcaatccagttcttaagggtacacttttgtggcggagctcttgtagatgaagaaacagttataaccgctgcgcattgttttaatgatgtatctggtaggataaccatattagcgggaactgctgatttgactcaagaaggtacgtccattaaagttaaaagtattttgattcacgagaactacaatcctgatgttggttctttagatcatgacattgcaatattaaagctatccgagaagattacattttctgacaaaata

SEQ ID NO: 4193 - DNA, 372 bp, Diabrotica virgifera
agttgagacttctttttcaaataacggtacgacagatggctaagaagatgaattaaccgaacaatttataattatataatcagatgaacattatctatatttacacaatatacattactagagttactgtatttggcaagttttcttttctaaatgtttaatatggtgtttttaaacgcaaattcattttttatgttataaatacctgtggtaatcattttatagatatcttttgtgggctaactgataatgtcaatatacttatacccaagtgtttataaaatggtatggtttaaagaagaagttgccatatggagccatattagatttaattaaagttttgtttaattaatattacagataatacttttt

SEQ ID NO: 4194 - DNA, 107 bp, Diabrotica virgifera
cgcacgaatctaaatcgagtcgtattaggtcaatctctttgttggagaactcgcgtggcatggccggtaggaccttagcacagtgacacgtgccttccgtcgtttga

SEQ ID NO: 4195 - DNA, 79 bp, Diabrotica virgifera
aatttctaaaatatatttccttatttttgcatattattcaacatgtctgtaacataattttcaaaataaatccactctt

SEQ ID NO: 4196 - DNA, 238 bp, Diabrotica virgifera
gacgcgtccgcgaacccatctgcagactcgtggggatggcgagcttcagcctggtatccatgggtggtatagtcgcaccagcgagaagtgatccatcagtcctagaatggactgacacttagcccgtagaaggaactatccagctgccctatgcataggtagtagaacctttccatgcttggtacgatggatactctaatgggacgcgcattgattactaccatgggacgagctggac

SEQ ID NO: 4197 - DNA, 372 bp, Diabrotica virgifera
attagttgtaaacaactcctgggatttaacatcagcgagttccgtcaaatcaaatgcccaatgcgctacattgatcaagatctactctggtttcgtacagtactagacccgtcgcgtcaatcatttaggagttcaacaattggatgacatcctgcttatacgatgaatgaatctcgcaatccatctattgaggatactgctttggtataactagatctcgatgtggaactaaacgacagtgataaaatcgtcatacctcaagaagcacgatgcagacattactaacactttcaccatctgctggttggacttatgcggctactacgatggaacatcccgacatcctacaattacgaagtgtaacatttatac

SEQ ID NO: 4198 - DNA, 211 bp, Diabrotica virgifera
cacatgttcgacgtttcatactttagatgaattagacactagtccatagcgtactccaccctcttgtccccaacctaaaattctgaccgcatgtcttcctaaatattccccagcaacatgtttatagacactacctttataattcatgaagtcgctgtacacatcaaaagctggctcgaccggaccattcgtcaatatttccttttgacta

SEQ ID NO: 4199 - DNA, 344 bp, Diabrotica virgifera
  misc_feature (334)..(334): n is a, c, g, or t
aggaaatgtggaatacaaaaagccagtaaaagcgtgccaggctgacggagaaaacgccaatgatccagaaaatgagtctggatgtattggtggtcaatcttatatatgtacaaagcaatctggtttcgcaattaactcaactttagcctatgggtatgttgctgctcgtttccatggaacaactagaaacatgtgttgttcgtgcgttctcttcagtttccaacctcaagagttggctaataagaaaatgttggtacaagtaaccaacactggaaatgcacctgaaacaaacactaacttatttgatatcgccatgcctggaagtggagttggntattacacac

SEQ ID NO: 4200 - DNA, 395 bp, Diabrotica virgifera
  misc_feature (66)..(82): n is a, c, g, or t
aaagcagtacagtacgagtacggcgatcctcagtaactacgcaggtagattatgctgtaccggtannnnnnnnnnnnnnnnngaagaacataatgttttgatatttctttttaattttcgtccaagaacaatatttgtttatttatttgtgttaaaaaagtgcaagttttgcttcaaataaaaattaagtatagatatgggactgctactttacaccttgggatctttaacgctgctggctatattatggacggtcagctccgtagccagatatgtcctgaaatttgcctgtttcggagtgttatgcatgatatttgcttgtgcgccgatacctttgatgttgttgaatccaagaaatagcaaaaacgccttaattccatcagctctgctaagat

SEQ ID NO: 4201 - DNA, 259 bp, Diabrotica virgifera
  misc_feature (7)..(43): n is a, c, g, or t
  misc_feature (62)..(93): n is a, c, g, or t
  misc_feature (108)..(127): n is a, c, g, or t
  misc_feature (129)..(163): n is a, c, g, or t
  misc_feature (192)..(258): n is a, c, g, or t
ggagagnnnnnnnnnnnnnnnnnnnnnnnnnnnnnnnnnnnnngaccctggggaaccagggnnnnnnnnnnnnnnnnnnnnnnnnnnnnnnnnccgaatttaagaacnnnnnnnnnnnnnnnnnnnngnnnnnnnnnnnnnnnnnnnnnnnnnnnnnnnnnnngaaatgttactcgtttttaaatatctcannnnnnnnnnnnnnnnnnnnnnnnnnnnnnnnnnnnnnnnnnnnnnnnnnnnnnnnnnnnnnnnnnnc

SEQ ID NO: 4202 - DNA, 353 bp, Diabrotica virgifera
  misc_feature (239)..(339): n is a, c, g, or t
acaagaagatcagtagatctacaggctctaaaggacgtaaaaagggctttattggatatttttgcttttatgacaacggcagagttagcagcttggaacaaaatgcttgattacttcgcaaaaaccgcaattaaaggcattcatgaagaaaatgaataatcatttccatttaagcttgagatgtgtggagagtgtgagatgaaatgaaattaaacaatttgtatgattcaaagacattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccccccaaaaggg

SEQ ID NO: 4203 - DNA, 388 bp, Diabrotica virgifera
ctttgatcagtacaagtggaatcgatctcaatcaaaatatacgcaacttaggttcgagagacaatagcgatgttgcagtcgacaaattattacgttatgtaccttgagttggcaggacaaagatatagagaactatacgagcagcatatgccaattcagaagaccccaaaaaagcgaattttgaaagtatggtgcatattcagactgtgatgattgagatgaggtgtaagacgatgccattgaagatcaggattacacggacgaacaagacgtagatgtaggggatgatgaataaatatatgctgatcatgatgatgatgtaaagggcgacggtgtagagaaagactaggatgttgactcataataaaatgggagccgtcaaaccctg

SEQ ID NO: 4204 - DNA, 355 bp, Diabrotica virgifera
tcatgagcggacgcttgcacagtctcgtgtacgttgttctacagtttaacacccaattatgttttattgccataaatgtatataatatcttgactattaattctgatttaatgtaatatggattataatattaatatctgaaaattgaatacatacaaaagatatataggaataactataggaattcagcgacctgatattcacatgtcaatgtataacatgtctgtttgtcataaatatcttgacacatatcgacgaactgttaaattgaatcggcgtagaagttgaattgtacctatggatcatttgcagtactattgatatagaagactggtattgtagctgcgtctaagac

SEQ ID NO: 4205 - DNA, 388 bp, Diabrotica virgifera
tcgtattaccaccaactcctccaccaagcagacgtccaattctacaaggtcctctatctaccaaacgtcctagacgaccaggccctctaccatgccgactgccctataccaccatgatgtctagcatgcagacgtgcaagaccgccaggctttcgaccaagcagaggtctaaaaacagcaggtcctccactatgcagccgtctaagactaccaggcgctccaccaagcagacgtccaagacgaccaggccctctaccaagcatacgtcctagaccatcatgtcctccatcaagcagatgtccaagaccgcctggtcctccatcaagcagacgtctaagaccactaggccctccaccagtcagacgtctaagaccaccaggtcctccac

SEQ ID NO: 4206 - DNA, 309 bp, Diabrotica virgifera
  misc_feature (164)..(181): n is a, c, g, or t
actatagttttagcaccgaactgtttattttttgtacctagtgtaacgtggattactacttgtcactacctagtattattttcgagtttagtatagctactaagtacagtttttattgaaaaatacatattttatgcaaatttcttgtaatgcactgttactcnnnnnnnnnnnnnnnnnnctttttacgcactaagttacatttatttattaccaatatatttaccattaagcatatttatattcctattatcaagtatgtttagggatgagcttaacaataagcctttattaaagtttacgttttag

SEQ ID NO: 4207 - DNA, 380 bp, Diabrotica virgifera
  misc_feature (78)..(97): n is a, c, g, or t
  misc_feature (192)..(210): n is a, c, g, or t
  misc_feature (270)..(297): n is a, c, g, or t
ttaattttatttgtagtttttagtggaagattattttcttgattagtattttcaaccccaatttttatttgtcttccnnnnnnnnnnnnnnnnnnnnctttgatttttattatagttggagtttgattaggttatgagttagctaaatttaaaatttcttataatttattaaggttaaataatatttctagnnnnnnnnnnnnnnnnnnnatatgaaatataccttttttatctactttaggaattaattattatccaatttattttggnnnnnnnnnnnnnnnnnnnnnnnnnnnnggatgatttgaatattatggaagttcaagtgtaataaaacaatttaattaatagaatattttacagttattttctcttaatca

SEQ ID NO: 4208 - DNA, 296 bp, Diabrotica virgifera
  misc_feature (104)..(117): n is a, c, g, or t
  misc_feature (120)..(137): n is a, c, g, or t
  misc_feature (154)..(171): n is a, c, g, or t
aaaccgtgcaaaggtttcatttacagaaatttttttaataatggctagaaaacaagggtagtttaaaaagaactgttcatatttagtaccttgtgtatcatggnnnnnnnnnnnnnngcnnnnnnnnnnnnnnnnnncaatttgaccctacatnnnnnnnnnnnnnnnnnnctgatttatatcatatagttaaatgaaattttttgtaaagatctgttaaacggcgtgaatatatcaaattttttaccatatttataacattaacttaataacaatatatttaatacaaattattt

SEQ ID NO: 4209 - DNA, 407 bp, Diabrotica virgifera
acggtgtcgactcggatcaatcgtatccttatgaaggagtgaacggacagtgcagatttaggagagaggatgttgttgccacatgtactggttttgtggatataggagagaacgacgaaaaaggtttagagatagctctagcaactttaggtccagtgacagcagcaatcgatgccggtaaggagactttccagttttactcagagggaatatacgatgatccagcttgcggaaatacccctgaacaaatgaaccacgcagttctaatagttggatatggacaagaagctgatggtagaaaatactggttggtgaaaaattcatacggtcccaactggggtataggaggatatgtaaagatggccaaggaaaataataaccaatgtggtattgccattcaagctagt

SEQ ID NO: 4210 - DNA, 88 bp, Diabrotica virgifera
  misc_feature (2)..(71): n is a, c, g, or t
gnnnnnnnnnnnnnnnnnnnnnnnnnnnnnnnnnnnnnnnnnnnnnnnnnnnnnnnnnnnnnnnnnnnnnngcggtcggatgcgtagg

SEQ ID NO: 4211 - DNA, 302 bp, Diabrotica virgifera
  misc_feature (53)..(127): n is a, c, g, or t
aaatttggtaatttggtaaaggaaaggattaaaaaggagtataaatccaaggnnnnnnnnnnnnnnnnnnnnnnnnnnnnnnnnnnnnnnnnnnnnnnnnnnnnnnnnnnnnnnnnnnnnnnnnnnngaaggccaaacgggggggccgccccaagggatccaacctaacgaacccgggcaggcaacgccaaagccctccaaaagggccaccaaaatccaacccacgggccgccgtttaaaaacgccgtaacggggaaaccccgggggttacccacctaaaccgcctggcagcagacccccct

SEQ ID NO: 4212 - DNA, 383 bp, Diabrotica virgifera
  misc_feature (228)..(252): n is a, c, g, or t
  misc_feature (370)..(370): n is a, c, g, or t
cggcccggtgttgtattggtttcccgtcccaaaatctctctctcaaaaaattatcctccaattgtcgacccaccacctattttgcgctaacgccacgagaatgacggtgttggggctcacctaagtgtcctaagtgattgtttgctgcatatcgcggaagatatgcacactgtgttctgcgtgcctgcctccatctaccttttgctcattatcaccccctacacgacnnnnnnnnnnnnnnnnnnnnnnnnnttggtaatggatccaaaccaaacctgtaagagggcaagatgggcacgcggaaaaatggcagacatatgccacaataaaccaggattattaaatcaaatagccaaaggtatagccctgngtcaaaccgaatg

SEQ ID NO: 4213 - DNA, 321 bp, Diabrotica virgifera
aaaatgaagagaagaatcggtctttgggtgggggcagcatgtggaaaattgagagaaactttaaaagtgagttgctcacatgtctaaagagaaaggtatttgatccgtgcgtccttccagtcttgttagcctcagctaccaaactaagagtgacacagagaagaatggaatggtccatttgcgaataactctgcgagacataatcaaaaacgaagaggtcaggagaagaacaaaggtgactgacgtcatcaaaggatagccagactaaaatggagatgggcaggacacatagccagaatgacagatgggcgatgaacaaag

SEQ ID NO: 4214 - DNA, 295 bp, Diabrotica virgifera
  misc_feature (6)..(28): n is a, c, g, or t
  misc_feature (30)..(50): n is a, c, g, or t
  misc_feature (247)..(268): n is a, c, g, or t
  misc_feature (270)..(282): n is a, c, g, or t
ggtggnnnnnnnnnnnnnnnnnnnnnnngnnnnnnnnnnnnnnnnnnnnngttaaaaaagggaatccggaaaaattttttccaccggtttttaaaaacaatgccttttggagtaaaaaaaaaatcccccctggccaacggataaattggacggccccgggaatttggcccttccaagggacccaaaaccataacttttttaagggaacccgggaataagggtttggatgaaaaaaaaccggccttgnnnnnnnnnnnnnnnnnnnnnntnnnnnnnnnnnnngcctaaatttttt

SEQ ID NO: 4215 - DNA, 393 bp, Diabrotica virgifera
  misc_feature (342)..(342): n is a, c, g, or t
tactttaccacttggaatataagggtacccaaatttggtggtacttaaaagtaccgtcgggagactaagggttaaacttaagtatttctattgttaggaccgtttctgaagctagcaacaataagacttaatatcacctaaagcattcccgtctgtatgtttactaatagcaggtattgaacgagactattaataaatttaaaacaaaatcaacagacactaattacaatacctactaatcaactataccttcgatggcctattgttgagagaaaatggtagttctccacaagcgcaatataatacacacaaatttacattggttgctcaacaattcataanaacaatagacggataataatatataaaaggtaattcaatttacgtaaaaac

SEQ ID NO: 4216 - DNA, 400 bp, Diabrotica virgifera
gggttatccttgattgaagtcatgcataaatcaatagtttatttttatcttgttttaaaactgagtttctttattagtttgtatgttaaatctgtgcattgcatcattaacatatgttgtcgaataagcatagctaatgatacaaacgagaaatttgtaccagtgttgctgaagactggtccagcgggatttgatttggcgatttcacaaaataacacaattaaattaaaaagaggtgaacatattgcgttttattgtccaaagaagaactatcttagaataactaatacaagtgtagaacatggaagatgccttactggcaatagtttaagtattaaaggaaatcgctttgatttttcttatatcttgtgtaagaatcatgttgtgggcgaactgcaaa

SEQ ID NO: 4217 - DNA, 359 bp, Diabrotica virgifera
  misc_feature (72)..(148): n is a, c, g, or t
  misc_feature (196)..(225): n is a, c, g, or t
  misc_feature (231)..(264): n is a, c, g, or t
  misc_feature (266)..(278): n is a, c, g, or t
  misc_feature (281)..(314): n is a, c, g, or t
  misc_feature (316)..(338): n is a, c, g, or t
attttaatccgttatgtaattttattgtaaattatcaaatacatttggatttggaataaaaagatacacttnnnnnnnnnnnnnnnnnnnnnnnnnnnnnnnnnnnnnnnnnnnnnnnnnnnnnnnnnnnnnnnnnnnnnnnnnnnnnaaatttgcatatttgacaatatgttattagttacttttatatattagnnnnnnnnnnnnnnnnnnnnnnnnnnnnnngatacnnnnnnnnnnnnnnnnnnnnnnnnnnnnnnnnnngnnnnnnnnnnnnngtnnnnnnnnnnnnnnnnnnnnnnnnnnnnnnnnnntnnnnnnnnnnnnnnnnnnnnnnnacctgtttagtaaaaacatgt

SEQ ID NO: 4218 - DNA, 405 bp, Diabrotica virgifera
ccagttctagtgtaattacaaagtgtagtagtgaaaaatagtattcaggatcaatcaaaattttaataggtaaatctaccagtacctttgcctttttgtggttttgtattgttttagcgttatggagaccgatactctacaaactgcaactcccgctgaagcagagatacctgcagagattttggctgtaattaaagcagcagttgaacaaactctcgtcagtttaatggaaaaacatcttggtaaacgtaaacattgcaggtccaggtctagatctaagagcagaaaccgttccagttctcgaagccgtggcggacgttctagatcaaaaagcaaaggtagatatgacagatcaaaaagtagaggcagacgtgacagatcaagaagcagaggtaggcatgacag

SEQ ID NO: 4219 - DNA, 345 bp, Diabrotica virgifera
agcgaaactacagggtagtattccatggtgcctaatgtatgctgatgatatagtgttaatatgaaatagagtgagagacttaaaacaaattctggaacagtggagacaagctctggaggaatgaggtttaaggcttagtaagacaaaaacagagtatttggaatgttcatttatagatggacttactacatataatatggaatctttggatggtgaaatgattgtgaaaagcataagtacctatgatccgtattacagagtaatggagaaatatatggagatgcatgcagtagaattatggctggatggatgaagtgagaagaagcgagtggtgtgttgtgtgac

SEQ ID NO: 4220 - DNA, 229 bp, Diabrotica virgifera
  misc_feature (18)..(119): n is a, c, g, or t
agtttattttacctttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagaatggggaggatcccttctggtttcagccttacttgtacgtgcaaggttcattaaaactgcttccttactgcaactaaaatgcaatccactgacggtcttttgaatg

SEQ ID NO: 4221 - DNA, 279 bp, Diabrotica virgifera
  misc_feature (86)..(111): n is a, c, g, or t
  misc_feature (202)..(241): n is a, c, g, or t
cacgactctaccctcacgtcctgttacatcatatattacttctgagtacaagtcacgtgtcattttagttaatgatagttaactcnnnnnnnnnnnnnnnnnnnnnnnnnnatgcggtataaagttagttgctgtgccttgtgtaccatggattattaattgatagctagatagttaggatttgcgaatttaaaagaggtcnnnnnnnnnnnnnnnnnnnnnnnnnnnnnnnnnnnnnnnngcttttttgtattgaaatgtcattcgtttccaaatatg

SEQ ID NO: 4222 - DNA, 402 bp, Diabrotica virgifera
cgcacgaatctacattgacttgtaagatagcaattcaaagacatacataaataaagatagcagatagttgaaaaacgcagatagatcaagttgaaattgaaatccttgtcgaatctttgtgaaatacaagacacatacaataacattcaagatgattgtgggaagtttatttttaatcttattagctacagttcatttcggaaactcctacgtttgtcgaccttgcgaggaaaaaacagtatgtgaaccactttcatgtcgagaaggacaaaaacctgttccaaaatggtcatgtaattgttgtgatacctgtctcacagtgttgaaagaaggagataattgcagtggtaatcctttcttaggagttccaagtcaggttgtatgtgacacaggcctcatttg

SEQ ID NO: 4223 - DNA, 228 bp, Diabrotica virgifera
tgctgttaaaccaggactagccttcgagttccactttttcaggtggctaaagagtctaatactcatatgcatgggaatggcgtgtcgaggcttacgaacaaatcagcgtcactccagttcatcccggcttgggcgtgacctcttcgcagttaaatgaggacagtgagcacttttcaaattagaagacgatatcattaatcagccacagtgcacggtcatttggtgaat

SEQ ID NO: 4224 - DNA, 201 bp, Diabrotica virgifera
  misc_feature (24)..(54): n is a, c, g, or t
  misc_feature (89)..(131): n is a, c, g, or t
  misc_feature (160)..(183): n is a, c, g, or t
tatttttaaggtcataggtaaagnnnnnnnnnnnnnnnnnnnnnnnnnnnnnnngttataagtgtattgtgaatagatacatttatgannnnnnnnnnnnnnnnnnnnnnnnnnnnnnnnnnnnnnnnnnntagcttagaattaaaattttactaaaagnnnnnnnnnnnnnnnnnnnnnnnngtaaattttttcatagtt

SEQ ID NO: 4225 - DNA, 67 bp, Diabrotica virgifera
  misc_feature (3)..(39): n is a, c, g, or t
  misc_feature (41)..(60): n is a, c, g, or t
agnnnnnnnnnnnnnnnnnnnnnnnnnnnnnnnnnnnnncnnnnnnnnnnnnnnnnnnnnctcatcc

SEQ ID NO: 4226 - DNA, 357 bp, Diabrotica virgifera
aatttaatgatagttgcttatattataacactagtactacctattgtaatatagttgcaagggaaatactaatccgcgttaatattacatttttatctacatcaaatttatttattgtacattgggtgccagggattactttgtagaaaatctttcattcaaagtatcaaatttttgagagcgacaaaattaggttttttatgggtggctaaataatttacacacattgattgtaatcaagtgctcatctctttctaaagtataactaatattgttaagaatgttcatatgtttacataatcgtagtatatcaatccgaatgtagatctagctgagccgtatcagcaacttctacgg

SEQ ID NO: 4227 - DNA, 172 bp, Diabrotica virgifera
acccacgcgtccgtgttgctagtcaaaaaaatcattcgatttattttttttactgtgaaatatatagccaattttacacgtactcaactagagttaaggtaaaatcacttattgtttacagctaatgaattagtgtctttatatttgtatttaataaattgatacataatgc

SEQ ID NO: 4228 - DNA, 67 bp, Diabrotica virgifera
actaattctagatctgataaacaaacttgtgtaccttaaaacaatgtaacttagcaattatttttat

SEQ ID NO: 4229 - DNA, 314 bp, Diabrotica virgifera
  misc_feature (20)..(40): n is a, c, g, or t
  misc_feature (42)..(82): n is a, c, g, or t
  misc_feature (152)..(171): n is a, c, g, or t
  misc_feature (182)..(213): n is a, c, g, or t
  misc_feature (216)..(244): n is a, c, g, or t
  misc_feature (252)..(292): n is a, c, g, or t
  misc_feature (300)..(313): n is a, c, g, or t
aatggaaatggcttaaaaannnnnnnnnnnnnnnnnnnnngnnnnnnnnnnnnnnnnnnnnnnnnnnnnnnnnnnnnnnnnnccaataaaattttgtaaaggtccttaaggttaaccaatttaaattataaaagttcgtgttaatggtaatnnnnnnnnnnnnnnnnnnnnttctttatgannnnnnnnnnnnnnnnnnnnnnnnnnnnnnnnccnnnnnnnnnnnnnnnnnnnnnnnnnnnnnttcaatgnnnnnnnnnnnnnnnnnnnnnnnnnnnnnnnnnnnnnnnnngtagaagnnnnnnnnnnnnnnc

SEQ ID NO: 4230 - DNA, 380 bp, Diabrotica virgifera
  misc_feature (133)..(149): n is a, c, g, or t
acgcgtctactatgagtcgtgatattaccagagatgacgcgtatgatgtagtgtgttaagaggactttgtactgcctaaaggaagtcatggccttcatggcatctacgttccctttgattagatactttaatnnnnnnnnnnnnnnnnntaactgtaacttgagacgattacatccgggacttattttacttttctcatggacttcaacgaccgatttttagactcacagtacgtaatcaggtcattaatttaacagataggattatgaatcgatcacctcttaggcattgtctgtttcaatttatggagtattcattttttgtacaattttggtttcatgagatacatgtctacattggaagaagcttccaattctttt

SEQ ID NO: 4231 - DNA, 367 bp, Diabrotica virgifera
ttaaccaaattaagaaataaagacattatatttcctcccgacttctctgaaaaaaatactggaaaacaggagctattaattaggtggctactagaccatgacatctctcagcgtctcatgtctcaggggcttctctcaactctaaacatacctccccccgttttacaagaatgcgaaattctcgaaatatttagacacaccttttataatcctcacttgaaaaggtgtaaatatctgataacatcctgtttcaagcaatctgtctcacacgttcaacatataacctatgataaagatccttctgcgcaaaacgttgtctaacctttactcctgcaagagttcgttcaagacatatgtatttcaatat

SEQ ID NO: 4232 - DNA, 361 bp, Diabrotica virgifera
ccagtacagcccagtgaagtgctaggaactataaatcagaaatagagatgttcaaattaaacttcatttgtaaataaacttaattgattgtgttaattgtttctaaacctttttattgtccatatgatataattatattattatgaagaccttagactccttaaagtttagagcaacaacgctagatgccgcaagaactattgtactattaatgggtcgtactcaacttatccagtcacaactcccagatgcccaaaacgcatacgcaccaaatcgtatacgaccttattcaaatacacacccactcacatatattaattaacgtagtaattatgttgtattataataaacatttataact

SEQ ID NO: 4233 - DNA, 270 bp, Diabrotica virgifera
  misc_feature (103)..(122): n is a, c, g, or t
  misc_feature (174)..(192): n is a, c, g, or t
ccctatcatgagtcgtattattcaatctactatactatctcttaggaccactcatgaactattttacttactgatagttaactattcttgtgagacaatatcnnnnnnnnnnnnnnnnnnnncttattttatgtaccttgtgtaccagggactatcaattaataattagaaacnnnnnnnnnnnnnnnnnnngagagctaaacattctatctttttattgtagaatacataatttaaccaatttttttgtcctgcaatgtcaatcgtttt

SEQ ID NO: 4234 - DNA, 420 bp, Diabrotica virgifera
  misc_feature (389)..(406): n is a, c, g, or t
tattagggaacttaaaaaattatggcattggacgaattatagtcagaagtaaattagaaagatatccagagaaatcttatatgaaggttctaaaagttgagacgttaccaaatcctgaaaacccatcaatggataacactagaaaaattaaagtttgggtagaagacacatttagaggcaaaactttcccggaacctgttcttattgaaggtatcagttacaaaacggattatagattattaccaaaggatgaagaggaagcatattgtaaaacgtcagaatataaatatcaaaagattcttcctaaaactatggatttccctccgctccttaaagaaataataaaaaggatagcaaaatctaaaggagaaaatgttacagaagatccnnnnnnnnnnnnnnnnnncaatcaaacgagtt

SEQ ID NO: 4235 - DNA, 273 bp, Diabrotica virgifera
tgccaataacaagaccagtagcggagcgtgcggaggaagcgcatcacgatcgactatataggtgaccgtatcgcgagggatgaattcagttgacttcaagcagcagcgagaggcggaactacctgacctaacaatggctactctacttggcgctgagaagttttattagatcatcatagcttaatttgtgtagcagtagccctaaataattgttttgagcggcaaccaaaccattcccgcaagttcggcagacatgaagttcctcctcctccg

SEQ ID NO: 4236 - DNA, 369 bp, Diabrotica virgifera
  misc_feature (147)..(166): n is a, c, g, or t
aaaaaataaaaaccttcttaaaactttattttcttaagcaactggtttttaaggtgcttttaaaaccatgttaaaagacactttaagtgcaggcagttttatagcaaacttaaaaaggttatggagacttttaaagacaatttaccnnnnnnnnnnnnnnnnnnnncccgtatacttctatacaggccaacaaatttttacatgtgttatgataggtagatacgtatttgtaaccataaaatattaaaaagtacttggttatttcagatcaagatagagacacacttgcgtacctaactttattgataatgttaacaaaaataggtctaaataactcacgcgtcctataatttctaaatttttactaca

SEQ ID NO: 4237 - DNA, 372 bp, Diabrotica virgifera
  misc_feature (352)..(352): n is a, c, g, or t
acgaacgcgtgggcgggcacgatgggcggtcacttgaggttcaattctcaggttttacgctgtatagtacacatgattctaggtttatgtcgatgaaagtgttcattttattcacattccgttcgttcggatatgacgtacgttcggcataccggtgttcaaaattgcggcgttcgacggtaaatgaaaacttttgctcactaaagctcaaaacttatctagacagaccataatattgatcaacaaccatacttatcaacgtttatgacattaaggtattactaccggtgataatttcgactgtatgtgcctacagatgctcacaatacatttttcttatattacacgtcanacatgagaaatcaaccacaa

SEQ ID NO: 4238 - DNA, 423 bp, Diabrotica virgifera
  misc_feature (390)..(390): n is a, c, g, or t
cccacgcgtccgctcggcctatgaaatttctgtcttgactcaatcgtttccaatcgcatctgaaaaacgctttttaaaacagttgtttaccagcaatctgccgtatacgtacaatcgttgtccatatttcgccggtcgccggaacaaaaaaattcagtgaacgtgaacataaagaagcaaaaattcgttcttcggtatcggcaaatgtggacaacgtaagaacaaaccatggcgaaaggcattttgagtctccattattccagaaagcaaatcaacaacgttacctacctactaacaaattggcagaaagttcaaaaggctaaatcatacacagaacatgctggtaaacggtatttttctactgggaaaccgtcaaataaggaagcgtcngaggttaagggaaattcatacaacaagttaagc

SEQ ID NO: 4239 - DNA, 408 bp, Diabrotica virgifera
  misc_feature (111)..(146): n is a, c, g, or t
tccatgaggtaaaaagtgaaaagtgtgtaagtggaagcaggaagagaaaacggaacttcgggattttcgcaattagaaaaaaattaatttgatggaaaagaaaactctaannnnnnnnnnnnnnnnnnnnnnnnnnnnnnnnnnnngtcatttactggtttcttctggaataccgtccctggatactctgttaggaggtggaataccggtcggaactgtggtattaatagaggaagattttcacggatcttactctaagatagtattaaaatactttcttgccgagggtattgtctctaatcattctactttagttgctagtcaagatgtaaatccttccaatattatcaaagaattacctgctgtgattgatagtgatctagagccagaaagggtactacaatcccc

SEQ ID NO: 4240 - DNA, 191 bp, Diabrotica virgifera
aaacaatttgagccgatgagattctacggtgtgacttttgtaaatacttaaagagcgtgtttcaaaaatgcgcttaatataagtatattatcaggacagagcacactttttttcgtaattaatttttcgtgtagaacaatagatatagttcttgaactcgctaagtggtacatccagcttcagtgacgatg

SEQ ID NO: 4241 - DNA, 265 bp, Diabrotica virgifera
  misc_feature (8)..(48): n is a, c, g, or t
  misc_feature (56)..(69): n is a, c, g, or t
  misc_feature (71)..(101): n is a, c, g, or t
  misc_feature (139)..(157): n is a, c, g, or t
  misc_feature (185)..(236): n is a, c, g, or t
  misc_feature (252)..(252): n is a, c, g, or t
ttcaatgnnnnnnnnnnnnnnnnnnnnnnnnnnnnnnnnnnnnnnnnngtagaggnnnnnnnnnnnnnncnnnnnnnnnnnnnnnnnnnnnnnnnnnnnnntcttatagtttaattttactaagattttgagtttgtannnnnnnnnnnnnnnnnnnaggaaaattatataaatatggaatttannnnnnnnnnnnnnnnnnnnnnnnnnnnnnnnnnnnnnnnnnnnnnnnnnnngtattttcttcattanatatttcattttt

SEQ ID NO: 4242 - DNA, 353 bp, Diabrotica virgifera
gaagctagaagttgttttaaacatttgattaatatttattggtaccgtttatgcatctgaaaccaattctaccaatgtggataaatgtccaaatggagcattattgcctatagtgcaagtagtatcgaaagagcaactgtgtatagagcctccttgtgatgtacatgctggatcacctgcttacataactgtcaattttacttcacctgagtatctaccatccatgacacctacctacttagtccaggcactacgcttaccaatacgttacccagttggaaaggatgcctgtacctcgctcaacaatacgatatgtcccttagttaaagatgaatttgtatcctaaagttacg

SEQ ID NO: 4243 - DNA, 273 bp, Diabrotica virgifera
gagtcgtaatagcaccatatgggtcagttcatacatccatatgcatccaagcagttcactttgtgcctataattccagccgcagacagattcaaagctacgaacacaggtggctcaaattcatgctaatatcatatgggccgcccaaacatctgtcagacacgatgctcaaagacaaattactgtataccgcggtatgcttttcacatagatcacgacagcccgcctaccagttcattcactagacatgcgtaatagcatgagtgtatctatg

SEQ ID NO: 4244 - DNA, 404 bp, Diabrotica virgifera
aggatgtgcaggtggatatatggacaaggctctagaatacattgaagcagctggaggaataatggccgaaaatgattatccttatgaaggcattgatgataagtgtagatttgataggtctaaagtagctgccaaaattagcaactttacttatattaagaaaaatgacgaagatgacctaaaaaatgcagttgtagtaaaaggacctatatcagtggctattgatgctagttataattttcaattatatgactcaggaatactcgatgatatttcctgcagcagtgacttcaattatttgaaccatggggtactggttgtaggctatggtacagagaaaggacatgattactggatcgtgaaaaattcctggggtgctgactggggaatggatggatatatat

SEQ ID NO: 4245 - DNA, 171 bp, Diabrotica virgifera
tacacgcctaaatattgagtcgtactaaaacttgtctcatattttttaccaagcatgtctcattagaaactatagtaacgagaatcacgacaggcaagattctctagttaagtacaattagatacgtcttagatctacttgcatatgtgtggtacttctaagtgctaatac

SEQ ID NO: 4246 - DNA, 412 bp, Diabrotica virgifera
aaatggtaataaagtacattagagctctgcaagctttagaatttctagatgaggaagacaaagtgaaaccttccgatatcggtattgttacgccgtatgccagacaggtgtatacattgaaagccctccttaaaggaaatcaaatcgaaggtgtcgatgtcggaacaactgaaacgtttcagggacgggagaaaagaattattattatatctactgtaagagcccaaaaagatttgttgctgtacgataaactttataagttaggcttcgttaaaaatgaaaagagattcaatgttgcacttaccagagctatgagtaaattaataatcatcggatgcgcgcaagttttggctacggacagaaaatggttgaaatacatggatctatgtgatacgctatccaatttccgggg

SEQ ID NO: 4247 - DNA, 411 bp, Diabrotica virgifera
  misc_feature (83)..(105): n is a, c, g, or t
aattcgggcccgaacacgtccaaatttttaaagataagttgaaagtattaccgaagtaaaagtaagtttttagggaactctannnnnnnnnnnnnnnnnnnnnnnagttaaaataccacaatttgttttgtatatattatatatacataaacagtaagcgccacgctactcgacacatgggtaggtacctaattgctatgcttatgggctaacccggtctgttcttagatgtgactttcatctctatcatgttactactgtcaaagaactattcaaaataataattgtttttccatacaaaaaaatacattagttaatattattgttactctgctttaaaataactttttaaacaccatgaatattacaatgcttcaaaacttttaccacttcaaatacacgtcaaacttt

SEQ ID NO: 4248 - DNA, 309 bp, Diabrotica virgifera
  misc_feature (7)..(26): n is a, c, g, or t
aacatcnnnnnnnnnnnnnnnnnnnnttatgtgttttggttcaatttggtcctttttactaagagtcccgagttagttttcttaatgccacataactagtcttctgggaaagtatattacttttactggagtatacgttatttttcagggggttgtgtctctaggcgtattcaatttgtctcgagataattatcatcttccagtttaaagccactaaacggttaataattgtatcgtaggaaataggttttaaacagtttttttgggctgagctgtggcttcgtctttacgtaagtcgaattttttagg

SEQ ID NO: 4249 - DNA, 426 bp, Diabrotica virgifera
  misc_feature (201)..(221): n is a, c, g, or t
  misc_feature (391)..(408): n is a, c, g, or t
agcaatactcagcattcaacccatttaaacctaactaaactagtattatgtatttagtaaggtttaaatgggttgaatgctgagtattgctgagggctttaactgaattacatagtactagtttagttaaaagatgtgtttttatgttaaaagatgtgtaattcgtttaaaattatgcaataggtatttcaatacatttcnnnnnnnnnnnnnnnnnnnnnacaaatagtagatacataagtattacctactattaggttggattattttaaatactgttaatcacaatcacaaacgagttcttattatgttattattccgtagtgcgtacgatgttgccagtttattaaaatttccaaacattaaaatacaggtatatggaaaacaatgnnnnnnnnnnnnnnnnnncggttgactttagaaaaa

SEQ ID NO: 4250 - DNA, 325 bp, Diabrotica virgifera
tttactaacaaaactaatttaatgtattggggtgagttaaaatagggtttaatgcttattaatgctaatagcttaatcagaaatatattgatccaatttatttgattatatgaatattatatcatacggatagtagtctaatattattggacagttcgtatctcaattcattactgcgaactctatgttggattaacgtttagtagtggtgtaactgctacctacaagtatgtttgcgaattttaaatactgacaatctctgtctttaacgagttcttatcaagttaggattctatcttgagtacaatattgccagtttattacg

SEQ ID NO: 4251 - DNA, 97 bp, Diabrotica virgifera
aatacaacactctaaagtgagtcgtatagccgactgtattggtcagttaatgtgatatgtgtaataatgttaattgtatgttgtgttaacatataat

SEQ ID NO: 4252 - DNA, 428 bp, Diabrotica virgifera
  misc_feature (359)..(359): n is a, c, g, or t
gctaaacttccagaaatactatgattagaacacaatgaacataaaataatagtctagctaattggttcctatcaaagattgaattttaatttagttcaagttttgtggtggtttgcgcttaggtttgtgtaaaggtttagacatatttattgatgaagatttagatattgaaatttagaaatttaaaagtggaaaatattctactgaaaattaatatttgcaaattgtcagttgcagtaacatgttacgtttcatttttaaaatcatttaagtcatcaaataggtacctaattaatcttttagtgctaattttgtgtttttacgtatgtattataatatccgagttcagatcgggatangtaattttcttttcatcacttggttcatatattgccaaaataatacttcaatcacacttttcatatacg

SEQ ID NO: 4253 - DNA, 307 bp, Diabrotica virgifera
  misc_feature (65)..(65): n is a, c, g, or t
gcgttttggtagtgcatatacggaatatgtgaaaatatgtttagttgtttaggttaattacatcncaacaatcgattgagactatataaaatttaaccactaagagagtagcttccgatgattagggcataaacagacgaaccattctgcagcgctacgctgtattctaaatttttatgtaaattaaaagtgccattccacaagagcgacagtggctggccacggtcgccgatactcgctactgtggcgttcattacaaaatcattggtgctaaaaaatcgcctggttcagccagtttgtgggtcac

SEQ ID NO: 4254 - DNA, 421 bp, Diabrotica virgifera
  misc_feature (184)..(201): n is a, c, g, or t
aatccttcaaatattatttctacgcgtatataataaaatatgtctagtggctgtaattccagtgtattcggcatcgtgattctaaaaaagaacacagctaccgcctaaatatttcgtgttggtatcattcgacgtcccaggctatgacgcggatgacgtgcaacggttagtaaattagatgaannnnnnnnnnnnnnnnnngaaatacgtcacgtcttctgcacggtacttaaaaatattttgtccattgtaaactttggatgaaataatatttcgaatttaaatataaccatcattactaatcaaaagacttaaccgttgttattggaagactgtgatcaacattattatattattacacttatccacatgtatatgacattgtatatctagttagagtaattttttacttcaaatattt

SEQ ID NO: 4255 - DNA, 426 bp, Diabrotica virgifera
attcggggcgcgacccacgcgtacacccacgcgtccgcgttctttaacggtaaaatattgcaaaacatctaaattttaaagaaccgcttggattgacatgacatttggcatacacatagctaataagtcaaagaaaaatagtgatattgtgccaatatgtgcttttgccctgggggtggttttcaccccattttgggggtaaaaaaatattcgtccaaagaaagtcaggaaatggataaactggctaattttaagtaacttttgttctatagagttttttcactaagtcaatacttttcgagttatttggcagtgaatatgttcattttttcaacaaaataaccacgcttttggacggttttttgcaaataactcaaatagtaagaattttgtcgaaaaaatattcttaacaaaaacatagcctgt

SEQ ID NO: 4256 - DNA, 385 bp, Diabrotica virgifera
  misc_feature (62)..(83): n is a, c, g, or t
cacgcgtccgaaatttaactatgaaaattaatttaatagttttggggaatggaactggaacnnnnnnnnnnnnnnnnnnnnnnaaatggggaacattttaggattacccacaccagagtatatgaaattattgaggagaacaatcatcgatccggaatcttaaggaaaaacctgatccgtattaaggaacaaaacaaaagtacgaaaaagtgaatcaacttttaacttcggaatactaaattgcagaccttaccgaagaagaattcctagtcgatttaaatccgctggtagttctaaattaactaaagtcaatagcattatttcgtcttctaaaagcagaagtaaaatctccggtgtatcagatgatttgggcagacaatatgac

SEQ ID NO: 4257 - DNA, 297 bp, Diabrotica virgifera
  misc_feature (9)..(26): n is a, c, g, or t
  misc_feature (73)..(94): n is a, c, g, or t
  misc_feature (129)..(158): n is a, c, g, or t
  misc_feature (199)..(212): n is a, c, g, or t
  misc_feature (214)..(226): n is a, c, g, or t
cataatacnnnnnnnnnnnnnnnnnntggtgacgaaattttttatatgatgattgtttattaatgttatgacnnnnnnnnnnnnnnnnnnnnnngaatgtattttttgttgcttgtggtgcatggaggnnnnnnnnnnnnnnnnnnnnnnnnnnnnnncgtctttattagagctggtaaattatgatttttattgttgnnnnnnnnnnnnnngnnnnnnnnnnnnngtgatgagatgttcgtctttaattaaatctacttttttacgaagtaacttaagtttaatttattagcaata

SEQ ID NO: 4258 - DNA, 372 bp, Diabrotica virgifera
  misc_feature (9)..(64): n is a, c, g, or t
acaatcctnnnnnnnnnnnnnnnnnnnnnnnnnnnnnnnnnnnnnnnnnnnnnnnnnnnnnnnnccgtttttgtacaaaaaattattgtcatattctgcaattccttggatatatttaaaaaccatttgttgaacatacaatgtcagtgatataatttctatcagcaattttttaagcttaaactttattttttatattgaaaagttctttttttcctttaacttaatagctttgttatccaaattataatgttctttgtgttgacactgtttatggttttgcttttgtctttgtaacatgtttttttgtaataatattttctgaattggtcttgtctgtaaataagaaacactatgaacagtttttttatt

SEQ ID NO: 4259 - DNA, 414 bp, Diabrotica virgifera
  misc_feature (51)..(69): n is a, c, g, or t
  misc_feature (117)..(117): n is a, c, g, or t
  misc_feature (161)..(161): n is a, c, g, or t
  misc_feature (170)..(170): n is a, c, g, or t
aaaacttttccaaaaatggcttttttctataatttgttcaaactatcttcnnnnnnnnnnnnnnnnnnntgcttgtacaacctgtacttgtacattctaccccagtatatataacanatataacatttgtttttaataatgtgattataccaatgattganattatacanagaaataaacaaaaaaaagtatagcaacactgtgactcttcagatgccaaataacctcaatattgtttgaatttgcagtgttgccggtgcaaattcttctagtatacgtataacatttcaaaggacgttcaaaaatacacattcagattcgtatacgaaatttttcattcgagttaactcgtatacgaaaaattcgatttaattcgaaaatacgaccccagatcgacgtttgaccgagtttgtc

SEQ ID NO: 4260 - DNA, 132 bp, Diabrotica virgifera
gtccctctgtgtactgattgttaattaatggggtgtgagcaaatttggtttctagggggtagagctccagttggtgtgccgtgtgtatctaggattatttcttggggtttagttagttggtgatttcgacgt

SEQ ID NO: 4261 - DNA, 132 bp, Diabrotica virgifera
  misc_feature (88)..(114): n is a, c, g, or t
agtcttcgcatccgcgacaaactaatccaaacaccttgtccaatcctaaaaccaaaccgaaaattaagccaaaggattccggataacnnnnnnnnnnnnnnnnnnnnnnnnnnnggcaaggataagtaattt

SEQ ID NO: 4262 - DNA, 325 bp, Diabrotica virgifera
tattaatgctattaaccatagtgtcatcgatagagctcagttgcctgtattatcacaatataatacaatgtatgtatttagaaatcgacataagtacagtgtacggtccatatgtcaaactgaacgatgtacgtactgataattcgagatctgtaactgactcttttaaagtgacgctgttgtattaaccatgatacgtatttaaagtaacgatgatgtctatagttgtactgtaagagattggcggtgaagttttaaaaacttcatgtattcatttttttaaagttcatcatctatatacttttaatgcacttactattttttc

SEQ ID NO: 4263 - DNA, 350 bp, Diabrotica virgifera
  misc_feature (50)..(67): n is a, c, g, or t
cacgcctctaaactgagtcgtcttaaagatgttccgtgtttaaattggannnnnnnnnnnnnnnnnngtttccggtaaaaaaattggtactggaaagaaaccatttggctataatgtagaaatgattcaatctatgacccttactggcacggggtaggacctatgcaataaattctccatcaatggtaattccatttctacattgactggaaaattattattactctcgaaagctttgagttaatcaaggtgctgggcaaaggtacttttggtaaggtaattctgtgcatataagagacaactggtatattgtaagccattatgattctcaagatggaagtgatcattca

SEQ ID NO: 4264 - DNA, 365 bp, Diabrotica virgifera
  misc_feature (233)..(251): n is a, c, g, or t
gaaatggctgtttgtttgtttattttattatttgtctgtcataacaaatataatataatgtcagatcaaatatatacttctcaaaatgatcaaatcttactaagagtcgtatcagtttttttaggaaccagctgtacattgtacttttttctatggatgcagttttgtaagagtttaaacttcatgcttgtaggtatattatatgcataaattgaaatagcatacataatagnnnnnnnnnnnnnnnnnnngaataaattatatatatgtaatccattaaaaattctaattaacccgggagcagtcgcgctcacttttgttacgtaagcagtcgcgcgtagagaaaaaatcttacagtacgaatt

SEQ ID NO: 4265 - DNA, 421 bp, Diabrotica virgifera
  misc_feature (73)..(88): n is a, c, g, or t
ttccatagggctggaactagctcatctcctccagaggatttgtactgcttaaaacattttagtaacatgatcnnnnnnnnnnnnnnnntagatacaatttgtttattcctaaatttacaactcaaactttgtggtttaagatactcttaataaatattatgttttacaatattaatatgttttatttcatttattacaaaccacgaattgcacaaatttacttaataactatcatatttttatcattgagagcctaaaattaaacagattctacatatagatttaaagtttgtgatatggatgacatatacagtgaagtagttagaagttgtatcgctttatagtgatcactctagtgacatactgtcacacaaaagtggaagaacgaataacaatccactgcaatagcttcattaaatgc

SEQ ID NO: 4266 - DNA, 339 bp, Diabrotica virgifera
gattggagaccacttgctttcaatttatcaggtcatgatggaattaggttggggtcatttctcgactgtgtggttgtgttgggatgactaggagaagagatttgttgccctaaagattgtctggtcagcagatcacttcacaaaagctgctcgtgatcaaatacacagtttgagttcagttagagagtcgagatccaacatatccaaagcgtattacaactgttcagcttttaaatgagttttaagatcagcgggatcaatggggtacacgtctgtaaggtctgtgaactgcaacgtcatcaattattataattaagtattaaatccaattatagagga

SEQ ID NO: 4267 - DNA, 452 bp, Diabrotica virgifera
  misc_feature (340)..(365): n is a, c, g, or t
tcgcggatcgacccacgcctccaaaaaatttagagattttgcaatattttaccggtaataaaaagtcataaaactgtcaaactgaaaagcagaaattaaaaagttctcttaaaaaatactaaatttaaacgattttggaaagaaattatgtaaaaatggtaaatgaatttgataaactaatcgaggaaatattcaaaattaaaagtgaactgaaaaacgcaatacaggcaagtgaattaaggatactactaaacatagaaaacttgaacgaaaagataaaaaatttagaaaaggaaaattcacaattaaaagagaaagttgagtatttagaaagaggccnnnnnnnnnnnnnnnnnnnnnnnnnnggtattgaaaactccgaaaacttggaagtaagcgaattttgcaataaattaagtcaacttttaaaaattacattgagtgttaatgat

SEQ ID NO: 4268 - DNA, 359 bp, Diabrotica virgifera
  misc_feature (25)..(57): n is a, c, g, or t
acccacgcctccaacacacacgtcnnnnnnnnnnnnnnnnnnnnnnnnnnnnnnnnnctgggcggtcgcgtgggaagtcgcatgactgaacgcgtgcactccattgggagaacagtaagtgcagtttggaaagtgattgttgcaacgtggcacgagtctgtccaatactgagctaggtttgcagctccctcgtatctcaagagaaaacttgcattaatgcacgaaactcagggtcacttatgactgtatatagtaagatccataggcagactgaatgtcacttgccatttcacatcagatctatgttttaggggtattactatcttgacatattacatctagctctatattctccagat

SEQ ID NO: 4269 - DNA, 365 bp, Diabrotica virgifera
ctgatttgaatctacctgatcaattgacattttctagtaaacccgtggatggcaacagtatcagtaaaatatatataaacagtggcgtcactaaggatgcctctgactatcgagatactaacaatttggcaagtgtgcctatatgttggatatgtaatagtgaaattgttagaggtccatttataacagcccttggaaagatttggtgccctaaccatttcatctgctcgactccttcatgcagaagacctcttcaagatattggatttgtagaagaacgtggacaactatactgtgagtactgcttcgaacaatacttagctcctccatgctctaaatgtggtggcaaaatcaaagcggactgc

SEQ ID NO: 4270 - DNA, 340 bp, Diabrotica virgifera
tctctgaattgagtcgtattattgtcattttcttggttccccttggggcccgggtttgcctcgctgctggtgtcttgcttttgtggccgtgccttcggcttttttgctcttcgtggttgttttttgtttcctgttgtctcggggatcggttttcttggtcttgtccggttatatagttgcccgttttaaaacagccctcggcttgcacgtttttaccgttacgctagcaggttgtatagcttttttgtcctcacatgttactcgtttttacatttgtccagtttgtttggaaataggtctgctttatttatctgcactatgattatagcttggtgtgttg

SEQ ID NO: 4271 - DNA, 323 bp, Diabrotica virgifera
atttgaatgtgagatttgctcaaagcagtttttcataaaagctacattaacatcacatctaacacaacatattgagaagaaacaaaatgcgcacattatagagaagtttcactcttaaacacggcagataaactcctctcaaacatcattcttagtggactaaacccttatactaaaaatcgcctaggagaatatcaagctggttttcacgctcagatccacagtatattaatcattcacgctgagacagtttctagacaagggatgggagtataacggacccatacacaatctcttcatatactttctatatgcatatgata

SEQ ID NO: 4272 - DNA, 432 bp, Diabrotica virgifera
  misc_feature (423)..(423): n is a, c, g, or t
cccacgcctccgatcaatccgtatttactacaatcaaataatcgttaagacaagattgattagtaattagtctctcagatttagttctcgttctcaaggtagtcagtggaaacaagtggttttctcatttcactaagaaaatgtcttacgccggacgtgtaatcgtttatggaggtagaggagccctcggcgctaaatgtatatcacattttaaagcaaataatttctgggtaggatctatagatttagccgaaaatgcagaggcagatgtaaacattttagtgaaaagggaagacagtcttcaagatcaggaaacatcaatcctatcttccgttaattcctcattaaatggttccaaactggatggaatattttgtgttgctggtggatgggctggaggaaatgcttctaaagatctagtanaaaattctg

SEQ ID NO: 4273 - DNA, 390 bp, Diabrotica virgifera
  misc_feature (122)..(143): n is a, c, g, or t
  misc_feature (147)..(166): n is a, c, g, or t
  misc_feature (361)..(383): n is a, c, g, or t
gacacacgcccctaaagatgatcaaataactaatgatttagaaaattcaaaattaaataagacaaataaagtaaattcaaatcataccaataaactaaaaacaaaattaggtccatcagacnnnnnnnnnnnnnnnnnnnnnncacnnnnnnnnnnnnnnnnnnnngatattgcaaacattgaatttctaaatgaagctaattctacatattctgtaggtagcatagtaacagtagttactgattccatgtctagtaatagtaatatatccacaagtatttcccataataattctagcgagggtgaaataagtgaaagggaagatgaaatcagtgaaaatagtacaaatataagcaacgtnnnnnnnnnnnnnnnnnnnnnnntcaattc

SEQ ID NO: 4274 - DNA, 371 bp, Diabrotica virgifera
  misc_feature (8)..(27): n is a, c, g, or t
caattctnnnnnnnnnnnnnnnnnnnnttgatgcttttagaagccagggaggaatagctggagtagaaagataagaagcgatccaatagtgctgtgcataataatgaattggtggatctatagtctgagaggagtactttactacatagggtatatataattcattcgaaaattctagtacgtggggaatatttggtatagtgtgcgcatcaacatttggaactcttagattatgttgatatgtagttccagcatttggatacctcactttccatattgaaagagattcttctacacaaagaagatgatcactcaattgttacgattaaatatgcggatcttaatgatttaaaggatgctctcgattctaa

SEQ ID NO: 4275 - DNA, 358 bp, Diabrotica virgifera
  misc_feature (322)..(351): n is a, c, g, or t
ttttttactttaatagaatgtcaaaaacagttgttgttttagctttagtgtgctgtattgtagtacatgtccaatgtgaatcaattatctattgtccagatcctgcaaatccatactccacgataatcataccacaccggccgtaattaaaggaggacttcgatttaagtatgtagtaattgaatttgattttgatttgttactagaatcaagctatgtgattttcatttatactttagagaacgaagattcatctgtttaaattacaatctaaaatagttttataagaaattgttagtttgaaattaataaactgtgaaannnnnnnnnnnnnnnnnnnnnnnnnnnnnncattaag

SEQ ID NO: 4276 - DNA, 419 bp, Diabrotica virgifera
  misc_feature (313)..(333): n is a, c, g, or t
actcgcgggtcgacaaacgcgtctgacacacacgtctgcgaacgcgtgggaaaaattgtttaaataatttttcgaccacggcaccgcccggcaccctgcggatgtgttataaggacctctttttgagtaactttgtgcaaagcaaaaaaacgaatcggaataataatttacctgacgggggcgacgatacagcttggactatagcgctgattgttaatgattaaaaataacagctttgtaataaaatactgacaaaatttcttcaggatcttgaaggagtgattttaaactttgatctgatcacttcctgacnnnnnnnnnnnnnnnnnnnnncgagttaagccttaaaaatggccatttttgcatttttcaaattttaattcgcgtataactcgacaacaatcaattttagagaaaaa

SEQ ID NO: 4277 - DNA, 428 bp, Diabrotica virgifera
  misc_feature (9)..(35): n is a, c, g, or t
  misc_feature (86)..(135): n is a, c, g, or t
cgcgtccgnnnnnnnnnnnnnnnnnnnnnnnnnnnaaaagcaatgctgactttttttgttttacgagatttttggtatctctaacnnnnnnnnnnnnnnnnnnnnnnnnnnnnnnnnnnnnnnnnnnnnnnnnnngattttactttaaaaccaatttttttccaagataagcactttgaatcgatgaaacttacagatcatataaacacaacataagtaaaataatttgtggaacggtggcgattaatttcgtttaagttgctggttgggggctggtcttcctgattttttttgccaaaacaaaagcgaccaactttattttgagcgtaacttacttaaatttaatgttagaaacttgttataaaaacagaggtagagatttttttaaacactttaaaaaagttatatgtaatgggttttccccaaaa

SEQ ID NO: 4278 - DNA, 324 bp, Diabrotica virgifera
  misc_feature (6)..(20): n is a, c, g, or t
  misc_feature (22)..(34): n is a, c, g, or t
acgcgnnnnnnnnnnnnnnncnnnnnnnnnnnnnaattaactaagttaaaacttataaataaaacaaaaaatagggcaggtactggaataagtcgaacacacggtaaagtacacatagtaaaagatatcatcggatcagattctaatgctatatagaagggcctttaaatcctttccccgtcaaagtgaatcctccgaaggaactcatcgccatcgccttaatgaaatgtccttgaaggttcaattcctccgtgaaatccactaagttaaccaccgaagattatataaccaacaaaacgcccaacaccaaacaggccattgttc

SEQ ID NO: 4279 - DNA, 433 bp, Diabrotica virgifera
tcgcgggtcgacacaagcgtctaagttcactcaaagtactgtgatttggattttgtttctaaacttctaaaacggaagaaggtatagttttgtaaccaaatagttttcttaggtttcgctcagttgtaataatttttttaactccagtgaattaaacttttcaaaattatgaagcttcttggaaaaattatcttaatcttattgataggtttcgcttacacccagtattttgaattattccttggtaagcagatcctagaaaaacttgaacgtaaatgtgaacaagctgggttatctgaagtatttcagtctcttcaggaaatgtctcgtcaagttacaacatgcctggatgtcaaacaacttaatttaaatccagatacaatcgttgaagaattttctcgtgctgaacgaacttacgagcttcttaactttt

SEQ ID NO: 4280 - DNA, 213 bp, Diabrotica virgifera
ttagagataacgggaaaatattccactttattgtgaataaactagacgaagcataggttttaataaggtgttattagcgatatcagaatcacgggtgaagacatagagaaccagatgttacgtaggcaggtcaggtcaatgatgtttacttgtgggattccgtttttgtcttaatgcgtgctagcattagaagtccatgctcgtatagcgcag

SEQ ID NO: 4281 - DNA, 432 bp, Diabrotica virgifera
  misc_feature (9)..(37): n is a, c, g, or t
  misc_feature (253)..(304): n is a, c, g, or t
  misc_feature (314)..(353): n is a, c, g, or t
cacgcgtcnnnnnnnnnnnnnnnnnnnnnnnnnnnnncctttatgttttaatgaggattttcgcataatgcacagtattggaccatattggagatatggaatttatttttaatatcgaataggtgcacatgtattctctatttcacatatgtcatgtattaatatttgagcttatagattaattttacagttcttttgacttggaactttaataatttttactagatgaaaattatctaaatatggaatttannnnnnnnnnnnnnnnnnnnnnnnnnnnnnnnnnnnnnnnnnnnnnnnnnnngtattttctnnnnnnnnnnnnnnnnnnnnnnnnnnnnnnnnnnnnnnnngattagtaccagttttattattaattattggttgaggttatcatccagaacgtttagatgctggaatttatttattatt

SEQ ID NO: 4282 - DNA, 94 bp, Diabrotica virgifera
  misc_feature (2)..(14): n is a, c, g, or t
  misc_feature (41)..(58): n is a, c, g, or t
  misc_feature (60)..(90): n is a, c, g, or t
gnnnnnnnnnnnnnttatgaataaggaagaaaagaggaagnnnnnnnnnnnnnnnnnngnnnnnnnnnnnnnnnnnnnnnnnnnnnnnnnggga

SEQ ID NO: 4283 - DNA, 379 bp, Diabrotica virgifera
  misc_feature (14)..(53): n is a, c, g, or t
  misc_feature (56)..(75): n is a, c, g, or t
  misc_feature (91)..(135): n is a, c, g, or t
  misc_feature (154)..(171): n is a, c, g, or t
  misc_feature (196)..(223): n is a, c, g, or t
  misc_feature (304)..(355): n is a, c, g, or t
  misc_feature (357)..(371): n is a, c, g, or t
accaagccttcggnnnnnnnnnnnnnnnnnnnnnnnnnnnnnnnnnnnnnnnngtnnnnnnnnnnnnnnnnnnnnggaaattaagtaatannnnnnnnnnnnnnnnnnnnnnnnnnnnnnnnnnnnnnnnnnnnnggaacctggggaacagggnnnnnnnnnnnnnnnnnncataattaagaatttccaaattaannnnnnnnnnnnnnnnnnnnnnnnnnnngtaaatgaataatttaaatgaattttttggaatgaaatggtaatccgttttaaatagtaccaaatttttaagaaattaagnnnnnnnnnnnnnnnnnnnnnnnnnnnnnnnnnnnnnnnnnnnnnnnnnnnncnnnnnnnnnnnnnnngggacaac

SEQ ID NO: 4284 - DNA, 459 bp, Diabrotica virgifera
  misc_feature (102)..(134): n is a, c, g, or t
  misc_feature (335)..(335): n is a, c, g, or t
  misc_feature (365)..(380): n is a, c, g, or t
  misc_feature (383)..(395): n is a, c, g, or t
acgcgtccattcgattttaaaatattcagccttgctattttttattaaatttgtcagaaaatttttgtattcttgtttaagaatttgttcatgtggtttttnnnnnnnnnnnnnnnnnnnnnnnnnnnnnnnnngccagatgttatccattttttctgtttaacttcagtctgtcttatttttttacataagtagattcttttattttattttgaagtgttgttacaattttagtttcttaatagttctcttaatttgttgtaattaatgtaactagtcttaaatgtattcatatttgttttaccaatgttcatattaaagttaagttcaactantgtacagaaacgatcggtagtaatatgtgnnnnnnnnnnnnnnnntgnnnnnnnnnnnnnttagttactattgggacatttgttatatttgtaagttacaatatgtatttacatattgtaatgt

SEQ ID NO: 4285 - DNA, 262 bp, Diabrotica virgifera
  misc_feature (14)..(41): n is a, c, g, or t
gacccacaagtccnnnnnnnnnnnnnnnnnnnnnnnnnnnnacccaaacaaattaggagacgatacaatgctgatgacagacgaagaaagttacgacgaatttggacctctcgaacaattgttgatccagaacaatgataaaagaactgatgaatgtgaaagggatttagattgcagttacatggcaaattctatatgtgatggtacaacaaaaaactgccttcaaaagtagagtaattcccatatttgcaacggaagtttt

SEQ ID NO: 4286 - DNA, 235 bp, Diabrotica virgifera
  misc_feature (25)..(128): n is a, c, g, or t
acccacgagtccacggacgcgcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacttgtgtatcaaggattaggaacgaatacctaaaggaatagtaagtacgaagtcaaaagagctaaaacacgaaaagttgcaacgtaaaagacacagagcagaaaa

SEQ ID NO: 4287 - DNA, 253 bp, Diabrotica virgifera
  misc_feature (84)..(141): n is a, c, g, or t
  misc_feature (152)..(152): n is a, c, g, or t
  misc_feature (217)..(234): n is a, c, g, or t
acgcgtccatattaattcagaataatcatatatctgttactaaaagtaacgaaataatttagttaatgatagttaattacttcnnnnnnnnnnnnnnnnnnnnnnnnnnnnnnnnnnnnnnnnnnnnnnnnnnnnnnnnnngcaaggattantaattaataagtatgtatttattatatgcgaatttaacagatcatactattttaatttgtactgnnnnnnnnnnnnnnnnnngtatgtctttgtatgaaat

SEQ ID NO: 4288 - DNA, 368 bp, Diabrotica virgifera
  misc_feature (27)..(57): n is a, c, g, or t
  misc_feature (105)..(131): n is a, c, g, or t
  misc_feature (152)..(170): n is a, c, g, or t
  misc_feature (299)..(316): n is a, c, g, or t
gcgtcaacagtaaatcataatattaannnnnnnnnnnnnnnnnnnnnnnnnnnnnnnaagggttaaataataatgtaatgataataaattaagttgtatttgagnnnnnnnnnnnnnnnnnnnnnnnnnnngcagtggattgtaagataagnnnnnnnnnnnnnnnnnnnggggggggtctcctctagcttttttgttaaaatttggcattgtaagatagttattttccttaaatttgtttgtaaagtagttgtaaattcgtgcttttttttatccacttttttatgagaaaaattcgnnnnnnnnnnnnnnnnnncctttataatgtaagtacttttatgccaataaggttaaatatttatagggat

SEQ ID NO: 4289 - DNA, 415 bp, Diabrotica virgifera
cgggtcgagcacgcgtcaagtaaaaggtgtaaatgatataagtaaaatttaataaaaaaaggatgtatgtatgtgtactttgtaaacaagagcatcatcagtgttacaggaacatggtgagccgcccaagggtgcgggggtgaaaaccttttacaaatagactaaaagtcttatatgtatagaaatataataaaatccaaaggatggatataaaatcttgtggatatggccttgagacaacatatatgttgtcctagagccatatccatgggattttatatccatctttaaaaggttttcacctttgtgtttttgggtggctcaccatgttcttgtaacacttcttgttacagagcgaaaacgttttgtttctatgtttgtagccttataggggctttttaaactaatatacctt

SEQ ID NO: 4290 - DNA, 405 bp, Diabrotica virgifera
agcaagcgtcaacccacacgttctgcgaacgcgtgggcttttctactttgggattatttgtcccatctcttctagatattatcgtcaattggaaaaattggggtagatataattggattttggtcagagatttatttataataaccatgttcgtgtttggttttgtgtttggagcttattatgctgttctccattttatccaataagcagcagactatggttagatgattatgtacattccatgtcaagtaactcagacaaaaacttttggatctccgatttgtctgaaatttggtgtacagctactgtttaacataaaaataagacatactaggtaagtcttcttgtgtttttttttcttctgtaaatgtcattttaagcgtttgtatagtgatttggtgttta

SEQ ID NO: 4291 - DNA, 307 bp, Diabrotica virgifera
  misc_feature (6)..(43): n is a, c, g, or t
  misc_feature (139)..(157): n is a, c, g, or t
gttcannnnnnnnnnnnnnnnnnnnnnnnnnnnnnnnnnnnnntgctgcccacattgtaaccacaagtgccaatcgaggtgccttcgataaatggactagttttaaggccaaccatatgaaatcttacatcgttagtannnnnnnnnnnnnnnnnnntgtttatccaagagaacctcaaaaagatcgaggaacacaatgctaaatacgaaagtggagaagattcctactatttggctgttaacaaattcaccgattggtccatcgctgaattccaagctatgttgagccgtcatatggctaacaagc

SEQ ID NO: 4292 - DNA, 459 bp, Diabrotica virgifera
  misc_feature (16)..(133): n is a, c, g, or t
cccacgaatctaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccaaagggttcaaaccttccttacgcgtgcaggccccttcaaggcccttcaattgtgccccctaatttcattccatgggccttctttttaaaactccgtattgggaaaaccccgggctttacctaacttatcccctttggagaacacccccttttcccaagttggcgtatttccaaaaaggcccccttttttccctttcccaaaatttgccaaccctgaagggctttgggaaccccccctgttccggccctttaaccccggcggttttgggggttacccccaccttaaccgccaattttcccagggcctaacccccggcccttt

SEQ ID NO: 4293 - DNA, 61 bp, Diabrotica virgifera
gcgcaagatcagttaaacaatattgagatgaccaataaatgtggtaatatttgtaataatt

SEQ ID NO: 4294 - DNA, 364 bp, Diabrotica virgifera
  misc_feature (161)..(177): n is a, c, g, or t
cccttttgtgtacactgatggtgttagttgcttattctagtgcatacgattacagcaattgtcctggaaataccaacagacaaaaaaatctgatatacagctctttactcccatcagcgtatagcgcgaaaactcgtatcccagcaactggatattaccannnnnnnnnnnnnnnnntactgctaatcgatcaaaaaggaagcaccagctcaccaaaaattatagaaggtggatatctcgacacttttgctgtagtaaatatcacttccacaactgcgcaaccagttagttactatgcaatagtatttattgattagcctattttagtagtatttagctatatttatgcagaaatattatttat

SEQ ID NO: 4295 - DNA, 423 bp, Diabrotica virgifera
  misc_feature (223)..(244): n is a, c, g, or t
ccgggccgacccaagcgtcagggcgtactttattttttttaaggggagcgagtttttcataggaggggggtgcgattgtcaaaggcgaaaaaatttcatttggttttaaagctaagggttaggaataagtgtcacttttgacccgggaatactagctcaaacaggggcgtcacaaaaaaatcactaacttgcgggttgaaggaaaaaattgaaaaaaagggcnnnnnnnnnnnnnnnnnnnnnnagatggacgtaaatcgggtgctttttagagaagaatgttgtgcttttggacttaaccgttcttaattttttgcgattttttatttgaatgtttttccctaccaggagcgtactttccttttttttaaggggagcgagttcttcataggggttgggggtgggttggtcaaacgcgataaa

SEQ ID NO: 4296 - DNA, 219 bp, Diabrotica virgifera
  misc_feature (33)..(58): n is a, c, g, or t
tattgtgagatactaatttacttttataatggnnnnnnnnnnnnnnnnnnnnnnnnnnctcagggattactgaataatgattataaatttatgagtttcgatattagcagagctgataaattacgctttctagtgtatgatagagagatgagataaattttttgtactgagatgtgatacgtttttaaatatacctagctttttaactttcgcattgag

SEQ ID NO: 4297 - DNA, 160 bp, Diabrotica virgifera
acccaagcgtcagaaaactgtctaacaatatcgataaacagacggttgagtatcatacagacgaagatgatcttgcacaggaaacagagtggattcgtgcgaaaaacaggaaagagaggaaaatggacacttccctaacaccaccaaagggaactcagaa

SEQ ID NO: 4298 - DNA, 413 bp, Diabrotica virgifera
  misc_feature (70)..(70): n is a, c, g, or t
  misc_feature (309)..(309): n is a, c, g, or t
  misc_feature (357)..(374): n is a, c, g, or t
acgcgtcaacggaaacgtgggtgctttttgacacatctgcaaagaacataaatatgtagactaatagcanaaatatttcattcttttatttttacatttattatccaaaataatatttgttaaaatattagttaattactgtgaaataatttctcccaaatatgattaaatataaaactttttaagaaatcgtaataaactaatgtgacattttaaaaactccaacgatttctgcacttagttatatagaactctacactgaaatgaagcatattttgttatcattaaatactagtgacctatttatangacagttaaataaactttatactgacgattcaacaattcatattttcnnnnnnnnnnnnnnnnnnttagttatactacattcgctctcgcgagattttttttga

SEQ ID NO: 4299 - DNA, 381 bp, Diabrotica virgifera
cgtcagctgaaaagctagtccattgacaaaggtttcttcacctccgccgtatgtctgtacttctagctctgtccaaccgtatcttaccatcgatttttctaagggttttcatctctggtgtttctagcactctttttattctctctgtatcaggtcgtctttctgtagggtcttcttccactttcaaagaaatacttcttgttttaattctaatttttcaatttaacgtatcttcggaaaacaacatgcctttgaatattttgatatctaataaattattcaatttaattttaacaacttacaacgtaagaatgctaacaattggtttgtttttagctagcgtatgtccagtttccatcgctgttgatgctgatacatggc

SEQ ID NO: 4300 - DNA, 82 bp, Diabrotica virgifera
cagctcgcgcctggtgtaacatcacaagtcctgttccatgtattcgaagttaagtttcgaacagttacatcgtacttgattt

SEQ ID NO: 4301 - DNA, 338 bp, Diabrotica virgifera
acccaagcgtcaggagaatctgaagctgcattctcaatagacgaatagatgattccgtttcatggtcgatgtgtttttcggcaatatgtaaaaaataaacctatacctgtaggtttaaaaaatttcgttttatcataaagtgatagtactgtcctagattttgaaagatctcaaggaacaagtaccaattttaacaaataaagaactgggactcggaccgtcagtcatccataggctagtggaaacgttaccggtttagcattgtagtcgccgacagatatttttcgacgatagctttgtggctcatatgatcggagctacactctcatggcacagga

SEQ ID NO: 4302 - DNA, 80 bp, Diabrotica virgifera
agtaagtcgtattatgcgtctgcccacgcgtccgtgtcctgtctgtttgttgctgttcatccttgctgctgccctcattg

SEQ ID NO: 4303 - DNA, 265 bp, Diabrotica virgifera
  misc_feature (107)..(124): n is a, c, g, or t
  misc_feature (127)..(151): n is a, c, g, or t
gagtcgtaggattgtccgtttctatctgcacctttactattttcgttttcataatagctagagcatgcatatttttattgtagaagatattactgggcatagttggnnnnnnnnnnnnnnnnnnacnnnnnnnnnnnnnnnnnnnnnnnnngcacctaggtggcctttatttatgaacaatatatttctaattacctatttttagattattaatattaagcattcttagggatgagcttaatttaaagacttgatgaaggtttaa

SEQ ID NO: 4304 - DNA, 418 bp, Diabrotica virgifera
gacccaaacgtcagacatttcgaagaaacgctggaggaccacgtgattttgagaaactatcaagatattgatagtttgtgccaattccttcaagtaagggaagcaaaacgaagagaaatgcgaaacagaagacaacatgaacaatataatggaccggcaagaaggtatcaatcaaattatgaccagagaaaccgacatgcccaatcaacaaacgaagataggccgagagaataccaaaattacaatagacaacaaaattatgataacaggaatcacgcaaaaaatagaacatatgaaaatcacaacagaaacagagatgcacaaaatcctccgactaggaatacgaacgaacaaagggacggtagaaacaatcagaatttccaacgacaaaatagaagggagatgaatcatgtaacaa

SEQ ID NO: 4305 - DNA, 394 bp, Diabrotica virgifera
cgaaactatcagaattggcgtttgctatacttgttacttcttcttcttctcatagcactacaaccctgactgtacaactcgcttccatagcattcgtggacgtcaaaagggtcttgggacgtccacggacgtctttaggaagtcggtaaacatggccagcccatattagacgttgggatttactctcttggactacgtcgctagtcttatacatctgtttgacctcagcctttgctctcattcggtgttggttactattaggattgtgattaggtccaaagaatcttctaaggatttttctctctctacctgttaggattttaaaaattagtaaacctgagtattagtaaactctttaaatttttgcatttttgaaaccggagagtccatatac

SEQ ID NO: 4306 - DNA, 269 bp, Diabrotica virgifera
  misc_feature (21)..(39): n is a, c, g, or t
cccacgcctccgcccacgccnnnnnnnnnnnnnnnnnnnttacccattttaacatagtccactattttttagcaatagtaaaggcaaattttatttaaggacagctacccagtattgtgagagaagctttccttcctacacaagaaggggttacttcttgtcccctgtctatcaaggattagccactagcaattattcaggtatgaacttcgaatttactagagctaaatcatgaagacttggagtgctcaatacatacttgacctaca

SEQ ID NO: 4307 - DNA, 269 bp, Diabrotica virgifera
  misc_feature (126)..(159): n is a, c, g, or t
ccacgcgtccagtgacgcttggggtttttcgattatcttatcgtactttgactgctcatattgattctatatacttcagttctcgctttccagtgattggcaaaaattcttccgtggtacactgtnnnnnnnnnnnnnnnnnnnnnnnnnnnnnnnnnntacttttattcatcccctgtgtatctatcatttgacgtcttccctaaagcattaatcctatgtcatttatagttgtttaaatatcttaaataatttttttgcttagatat

SEQ ID NO: 4308 - DNA, 370 bp, Diabrotica virgifera
cgggcagacccacgagtcaacggtcgcttgggtaatgattgacctctctcgtttcagtactgaatactataatatactaatagttaagttatgtgtgataatagtgcattatttttcaacattcgtaattcagtcactgtatcgggtttattatggactttaagtttattattataaacgggatatcatggaactaaaatgggagtagttcattcaatttacattcaaaatataccatcttttggatgtgtagagcaacctgatgtcagccccatttcaacatgacaatcattagtagaagtgtcatcatcatgatccacgcaacgatgactacacagtaaatgagatcagactggcaactatcactaac

SEQ ID NO: 4309 - DNA, 418 bp, Diabrotica virgifera
gggccggcccacgcgtccacccaagcgtccggttgaatcagacaatgataaaaatgatgaaaatgaatcaatagatgaaacttttgacaatagaaatgaaaatttaaatgaaagtatggatgataccgaaaatgaacataatgagttacgtaaatctcaaagagacaaaaatcctccaaagaaatttgatgattattatgtgtataatagtagtatttttgtaaatatgtgtagaactgatataccacatacatttgaggaggcgatgaattctgatgaaagtaagtattgggaaaaggctatggataaggagattgatagtttgaataaaaataaaacttggaaattggtcgaaaatgttgaaaataaaaaagttttggatgttaaatgggtatatactaaaaagtctgatgataat

SEQ ID NO: 4310 - DNA, 209 bp, Diabrotica virgifera
  misc_feature (20)..(44): n is a, c, g, or t
  misc_feature (65)..(99): n is a, c, g, or t
  misc_feature (102)..(114): n is a, c, g, or t
gtccgtgatgatgatattannnnnnnnnnnnnnnnnnnnnnnnntaaatatatacgtttactcgnnnnnnnnnnnnnnnnnnnnnnnnnnnnnnnnnnnctnnnnnnnnnnnnntgtgttgagtataatggtcgcgcctggacattggattagtttcgatggtctgggtattttcacggtgctaatgtatcatgatcattagttttttt

SEQ ID NO: 4311 - DNA, 426 bp, Diabrotica virgifera
  misc_feature (407)..(407): n is a, c, g, or t
acccacgcgtccggggatgtgatgtatcatgtgttgcaatgcaaatattagagaagcgcttttattagagttacttgaagacgatattgatttaaacgtagtaggtgcagctgtagaaatcttagctcagtcagttgatattgatgcaatggacatggacacaccagatgacttccataaccatgttagactgtccaaaggaagatttcagacacaaaaaattgatgttgatggacaaactattaactatgttaaagtcgggaatggtccgaagacagtgttgtgctttcctggagccttaggaacaatttggagcgattttaaacctcaagtggaaaatttagatagagaaaagtttactatagtagcatgggatccccctggttatggttacagtcgtccttcanatagaaaatttggaattca

SEQ ID NO: 4312 - DNA, 405 bp, Diabrotica virgifera
atgcacgactcaacactgacgtcgtagtaatgtgatgtatcatgtgttgcgttgcgaatattataaaatcgcgtttattaaagttacttgagaacgatattgatttatacataataggtgcagctgtataatgcttatcgcattcaatggataatgatgcaatggacatggacacaccatatgacttccataaccatgttagactgtccaaatgaagatgtcagacacaatatattgatgttgatggacgtactattatgtatgtcaaagtcaggaatggcccgattacagtgttgtgctttcctgtaaccttatgaccattttggaacgattttaaacctcaagtggaatatttagatagagatatgtggactatactagcatgggatccccctgattatggat

SEQ ID NO: 4313 - DNA, 384 bp, Diabrotica virgifera
  misc_feature (140)..(155): n is a, c, g, or t
aatcttggtagcctccattaatatattggaaggttacttaaactttgggattgttgtatgatggttactacatttgaagttttgcatctgagagtctttggttgacctcattgggatatcacccatgtagaggtttaccnnnnnnnnnnnnnnnnttgcttccttatctagtttgtgatcaattcttattccctcagtttctacggttaatgctattagtttcagtaatgttattagtggtaataatacttagagataatacaaaattgttaaactcttattattattcaggaatcaggaacagatttgaatgcatattttgtatcggcattgattggtgtaataccattcattatgggcagtactaatgtcgttttgccaaaa

SEQ ID NO: 4314 - DNA, 70 bp, Diabrotica virgifera
  misc_feature (15)..(59): n is a, c, g, or t
ggccgacccacgcannnnnnnnnnnnnnnnnnnnnnnnnnnnnnnnnnnnnnnnnnnnnaggaggcacaa

SEQ ID NO: 4315 - DNA, 393 bp, Diabrotica virgifera
  misc_feature (94)..(137): n is a, c, g, or t
  misc_feature (157)..(176): n is a, c, g, or t
  misc_feature (204)..(224): n is a, c, g, or t
  misc_feature (294)..(322): n is a, c, g, or t
  misc_feature (326)..(360): n is a, c, g, or t
agattttcattcagttcacacgtactacccatacttttctaattataagtgtaataaaaattttattctaatgattagttaaatctatattgtnnnnnnnnnnnnnnnnnnnnnnnnnnnnnnnnnnnnnnnnnnnngtaccttgagtttcagggannnnnnnnnnnnnnnnnnnnaggaattactttcgaatttaatttagcnnnnnnnnnnnnnnnnnnnnngtattatgattattttatatcatttttttgtaaatgataagttattcgttttataatatatcaaatttannnnnnnnnnnnnnnnnnnnnnnnnnnnncacnnnnnnnnnnnnnnnnnnnnnnnnnnnnnnnnnnngtaaatagttttagggattatccttaaaaataa

SEQ ID NO: 4316 - DNA, 366 bp, Diabrotica virgifera
  misc_feature (335)..(359): n is a, c, g, or t
acggacgcgtgggttccattcttttagctattttagcttgcgtcggtttaaccgtcagcgctcccccaaagaacgacgtcctgtgtgatatctgcgtagcattgacaaaagtgagccaggaccacttagaacaagacttgccattggacgaacttgaagaaatagtaagggaggggtgcagtgcattaccagatccacttgcagatttatgcaagaataaactgattccaccagtctacaacatataccaccgatttgaggacgcctcgcctgtagaaatatgcacagttttagacttatgtgagacaaattaatatgaaagtcagaataaactnnnnnnnnnnnnnnnnnnnnnnnnncaagaga

SEQ ID NO: 4317 - DNA, 365 bp, Diabrotica virgifera
  misc_feature (26)..(92): n is a, c, g, or t
  misc_feature (101)..(127): n is a, c, g, or t
acccacgcgtccgccgacgcgtcggnnnnnnnnnnnnnnnnnnnnnnnnnnnnnnnnnnnnnnnnnnnnnnnnnnnnnnnnnnnnnnnnnnngtatatgtnnnnnnnnnnnnnnnnnnnnnnnnnnnggggggttattttattgggatcttgtgtaacatggattagtatgtaatatctaaatactttaatattttcgactttattaaatttaatggctttcgttttatattgtcatgtagggaatttacatggtttttttgtaattaaatgttatgcgtttttacctatttcgaaatttgtaataaatacattaaggttatttattatcactatacttataatttgctaattttaaatgattaa

SEQ ID NO: 4318 - DNA, 385 bp, Diabrotica virgifera
acaaccctctacactgacgtcgtattaagtctttccaattttcacttaactaaatattttccaaaatggctttcggtgattatcctgccgaatataatcctaaagtccacggaccctatgaccctgcacgtttttacggaaagcctgatactccttttggacaagtaaaagttggtgaaattggctcctggttggctcgccgtcacaagtctccagcaactctcgccggtgcattcagcacggcttattggccatggcaacacatgtatgttcaacctaaaaagtctggcaacacagcattcatacatgtagcagttggatccacgattttcttctagacacttaattacactagactcatctaacacataaacgacaaatacca

SEQ ID NO: 4319 - DNA, 378 bp, Diabrotica virgifera
  misc_feature (211)..(233): n is a, c, g, or t
gcgggtcaatgcacgcctctatattgcgtcgaagcatatttcttcttgtattaacatattttctgagattttttcattcagtgtttgtattgtgaattttatctgtgatgaagagagccatatttttattaatttactgtatctaaaaaaatgtatactaataaactaacatttacaatgtatgttttaaaatagtgcaagatttatggtnnnnnnnnnnnnnnnnnnnnnnncggttcgtccacaaattggtcatcaaattaatttttatatccaactggcaacagaattttattgttcattacccaaaatgtatgttttactcatttgtgttaaataaatcttgtacattaatgttattgaataaagaatatggcg

SEQ ID NO: 4320 - DNA, 319 bp, Diabrotica virgifera
atagagattcgtaacaaagcttctgttgagtcatctgttaattcgggtgcccattcttctttccacgcatcggtgctattaaaggttactagagggtttccgatcttcatggtccatgctcaggtgtacgtaagattcagatttaactcttccactgtttcacgaatgtttaagtcaatagcgatagatttattaacgtcgttatgggtaagcctgtgtaatatccattagtaaacgccttgaaattaacactactatccttatcgttggtagatctataactgactatacgattggacaatcccacatgtttgtcaac

SEQ ID NO: 4321 - DNA, 402 bp, Diabrotica virgifera
  misc_feature (217)..(236): n is a, c, g, or t
agcgcgatccaggcctatacgtttattctttcggatctggctcatgtgtttatattcgagtatattaaacgttcgtctgtaagtagtgaatttttttctgtatctgtaaataattttaaactgtgtagtttttagttagtgaatttttattataagactttttgtaggaaatttttcaattcaatttttttgtgtaaagtgcgtcgcccaataggcnnnnnnnnnnnnnnnnnnnnaacgatgatctttatatttttcattgcgttggtatatggtgaagttgaattgaaaaaagtataattattcaccatatttaaagactgtatgtcagttttgtcgatggtgtatggcaatcttgacatattatgacatatatattggtgtcgtaattggttttccaac

SEQ ID NO: 4322 - DNA, 142 bp, Diabrotica virgifera
atatgcctagtggctgtaattccagtgtagttggctaaacgaatgcgaaaggaagagacctacgacttaaacagtttgtgtatggtgtctcgtgaagttacctatgcatgacacgtaacggtatttatactgtccgaatcat

SEQ ID NO: 4323 - DNA, 361 bp, Diabrotica virgifera
  misc_feature (31)..(49): n is a, c, g, or t
gactaatataattattaaacttcaagaattnnnnnnnnnnnnnnnnnnngtatcattagtttggattaaaggacattgtggaataaaagagaatgaagaagtggacgaagatgctaagaaaggaagtagaactggagagcttttaagttataaatgtccccacagtgaaattgcctgccacgtaaaacccataatactagccgaatggagagaaatgtatagtaacagtccaaagggaaaattttataaaaacatagttaccaagcctcctggccagtcttagttctcaagactctcgggaagcaagcggtttttctctgttttgtgcaggttaaggttcaaccatgttttaactccccag

SEQ ID NO: 4324 - DNA, 72 bp, Diabrotica virgifera
gaagcttaaatttttgtagacgacgagacgaccctagagagttgtccaaagttggtagggatttttttgagt

SEQ ID NO: 4325 - DNA, 404 bp, Diabrotica virgifera
aatttgtattatcaatacactcaagaagtttgacctatttaaaaggtctaatgttagaaaaaatggagtttaaagaaaaaaagattttttgcaatttcgtatttttcaccttttacttcaaaatatctccaaacttactggagatacgaaaaaaatgataaattactaaattgtagcttttttaataactaaaattacattgcgcgtagattttattacagtgaacagttagcgagatatagctgtttaaaacctctatttacgatcaaacacatccgtattcgagccctttaaacccactccaattaaaaactaaaggatgtaacgaaatttaatttacacagtcttatagctcttcaaaaatcctacaaaatcatttttgaaaaaactttttgtcgcgaaaa

SEQ ID NO: 4326 - DNA, 246 bp, Diabrotica virgifera
accgacgcgtccgtaaaattataacatcaacatcaattttatgttagggtcagagacatatgttatgcatatcattagcaattgaaatgttagtcgtttttaatgacatcgaagttttaacgacatatatggaatttatttatcaaccttagatttataattgtataatggaaaacttttctggctgtacagtgctaaggattacccaaaggttggaatttcacatatagtcagatataatacttg

SEQ ID NO: 4327 - DNA, 329 bp, Diabrotica virgifera
  misc_feature (31)..(48): n is a, c, g, or t
  misc_feature (310)..(327): n is a, c, g, or t
acggacgcgtgggtggattttcaacataatnnnnnnnnnnnnnnnnnncgaatgtgcacttaaacatttagtattgcaatgcattgtcataatataaaatatcgtttaataatgttctttgcatctgtgtcctgcaatgaatgctgttttctttttaattcgaattttaatttcgatcaaaagcaaaaattagcttcatttaaattagacatgattatataatttctatttaggtgatgtgtacctaataacgcgagatataagtcacacatttagtggaatactgagaatatataggttttaggaagannnnnnnnnnnnnnnnnnag

SEQ ID NO: 4328 - DNA, 223 bp, Diabrotica virgifera
  misc_feature (2)..(21): n is a, c, g, or t
cnnnnnnnnnnnnnnnnnnnnggtatttggctttcttctcatcctggtggagcttaatcaggtctaggagagacttgcatgtggtagtcaatcttcttggaaaggacagattgtctggtgctggtattggtgttttacatgtttgtggtggtattgtttcagctcgtgcagttagtagaattgcttgcgcacatgctttggttacttttggcgggtatgttgt

SEQ ID NO: 4329 - DNA, 431 bp, Diabrotica virgifera
  misc_feature (7)..(31): n is a, c, g, or t
acaacannnnnnnnnnnnnnnnnnnnnnnnngtcagatcgtctttgtgagtgtgactcgaatggcccatctaatgaatacatttagccctaaagctatgacagcccactaggtatggagccagaaggtattattgaatccaactgtgagtacgtcgtcgatacattcaactacatgaagctaagtgacgaagttgtaacacgaatttatgcctatggttttgaacaaccttcggcgacccatgagagagtcatcattccttctgtagcgggacacgatgttactgctcaagctcagtcaagtgctggtattactggcacattcaccatcactattttacatctaatggacacgtcactgagggagtgccacgctcttattttggcaccaacttatgaattggctcaacagattcaaaaagtagtagttgcc

SEQ ID NO: 4330 - DNA, 443 bp, Diabrotica virgifera
ctcgcgggccaatacacgcctctacagatgttcttgaaaattttagagatataggtcacagaactagtggtctagatccagcatggtactataccatccccgggtattcctttgactgtatgctcctgtacacaaaatgtgaattggagctactaagtgatgtagatatgatattatttatcgaaaaaggaattcgtggtggtattagtcaatgttgttcaagatattcagaggctaacaataaatatatgacaaattatgaccctaacaaaccggataaatatatattttatgttaatgttaataatttatatggttgggcaatgtcgcaaccgcttccaattagtaatttcaagtgggttgatacaaatattgatgtaactggtatatctgatgattcattatttggatacatatgtgaagtggatatagaatatccacaa

SEQ ID NO: 4331 - DNA, 293 bp, Diabrotica virgifera
  misc_feature (9)..(27): n is a, c, g, or t
  misc_feature (30)..(137): n is a, c, g, or t
acaattctnnnnnnnnnnnnnnnnnnngtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagtaaaaaaaaattaaaagggggaggtggcttaaagggttagatgttaattttcgagtaatggaaactaaatacctttcattgggggcctcgtaattagatttaatgggcgtttgtttaaaaagttcgtaatgggaaaaacctgggttttgcaag

SEQ ID NO: 4332 - DNA, 376 bp, Diabrotica virgifera
agttttcggggacaccctgtatagaaaataacattcttgaatagtgttcacacaatatattcccaattatgaatgtttgttggtcctatccgactatttcccattgtctcactctcattttctccagatcttatttgactgtatctttccacctttttgtagatcgtcctacagaccttcttccatctggtatttcccaaaacacattgtttatgaggcgattatcgttattacgtatgacatgttctgcccatcttagtctattggcctttatatatctgactagattttcctttccaaagagagagactttaacttattgtatctgagcctccattcgtttgtcacgttatctctacaagggccatacatcatt

SEQ ID NO: 4333 - DNA, 303 bp, Diabrotica virgifera
  misc_feature (233)..(267): n is a, c, g, or t
gaccacgcgtccatgaaaattccttccagtttgagactgatttccttggtttgcattgtcccttcgttaaggggttatacactgtttctagaatggattaatacttatttcgtagtaggaaggatgattttggctgaggatgaggtggtagagtctccccatgcatggtcgtatggaaaatccacaagttcgaacaatgattactactaggcgactgctaacacataactacnnnnnnnnnnnnnnnnnnnnnnnnnnnnnnnnnnncttccattcacaatacatgaggtcctaatgcaaatt

SEQ ID NO: 4334 - DNA, 133 bp, Diabrotica virgifera
acccacgagtcagcagtgacttgtggaaattgctcatcttgtatatcacatttattaatcatcttgtcttggaagttggggaagttcatacaagtgactctcagggcgattctaatgaacattagcaggctgg

SEQ ID NO: 4335 - DNA, 108 bp, Diabrotica virgifera
agcgcatataaagaaatcgcattaaaaaagactttacttgcattgaaaaagtatggatacgtaccgtaattttctaaaatcacataaaatcaagacgtttgtccaccg

SEQ ID NO: 4336 - DNA, 382 bp, Diabrotica virgifera
cgcgtctacccacacgtctgcgaacgcgtgggtaacatacttcttttatcttaaagataaccagcacaaagatgtctctaacatagggtgggtgccaattttaagtcttgtagtcttcattattacgtattgtcttggtttcggacctctaccatgggcagttatgggagaattgttcccaggaaatgtcaaatctgtagcctctacagctacggcttcattttgctggatccttggcttcttgctaactaactactttggtgcagttgcaggagttataggaaaatctggatcttttggtttcttcacaatttgctgccttttgtcggctatttttaccttcaaatttttacctgagactgcgggaaagagtctaacgaaa

SEQ ID NO: 4337 - DNA, 401 bp, Diabrotica virgifera
  misc_feature (139)..(139): n is a, c, g, or t
  misc_feature (201)..(201): n is a, c, g, or t
  misc_feature (266)..(266): n is a, c, g, or t
aaaccccaaaatttgtcgaatccaaccaaattaccagttccaaaagttttcaacggtttggccataattattaattgtatatgcgggccaaaggccaatagtagcataaaaaagtgacaccttatgaattatggtacanaaagaaagtcaataatatttctacactcaagagttttggttctagagtatcagtgcatgtcncaaaagagaagagattaaaatgggatgcaaaaaatatgtttggtttctttattggctacagtgangatgtaaaaggttacaaaatatttgtcccagacaaaaataaagttgaaattcatcgagatgtcatatttttgcccgagaaaaccatagaaatacaaaatggggagacagacatgaataaaaacatacagatgata

SEQ ID NO: 4338 - DNA, 357 bp, Diabrotica virgifera
  misc_feature (10)..(28): n is a, c, g, or t
tacaagactnnnnnnnnnnnnnnnnnnncgtctctagtgtgtatgctcattacagacaccagtggtgatgtgatgtgagtatcacatgttatagctaaggtcggttatcatcccttcacatcaaccgatgacgtgttagtatccaagtaactgcacttttgaggtagcggtctcagaagcgcacacctctgcgaaaccacatagttcgagatagaattgaccaaagtgcgtttgcatatgactagaaggacatccaataacaccctatgctaagatggacatccgtatacgattttacttgacgcatgacatcttattcaatatccattagtacagatccttctattgcaccaggat

SEQ ID NO: 4339 - DNA, 119 bp, Diabrotica virgifera
gtgttgtagtagaagtagtgaatagttttagttaaggatagtgaattagtagtgtgagagaatagtttatgttgagagggggaatggttgaggttttgtaccttgtgtagcagggatgg

SEQ ID NO: 4340 - DNA, 219 bp, Diabrotica virgifera
gaggtaaagtaactacatcagaaataaacgaaaaaaaacttaaattttcggggcggccgtcctacggattcgtaacttacttaccgctcattgcgttttctcaccctttctatacttctcctcaatttattttcatgtgccctttttttcacatccttggactgggaaaacccctgggttaaccctctttagcccccttgcatcttatccccgtttccc

SEQ ID NO: 4341 - DNA, 363 bp, Diabrotica virgifera
acttaaaagtgtttattgaggctgacctaactaacaaacaatgttcagaggttaattctctgaaaacagaacttaaagaaaggcagcgtaatggtgaaccaaaaaacatagaaaatcaacagaattaaaagttcaagccacttcgtcaatacctgtttattttcagaacatcagaggtctgcgaacaaaactcaatctactctatgagaatatatcatactcacaatataacattatattgctaaatgaaacaaggttgactagtgacattaacaattctgaactacaaatgtttgaccacaacatccaccgaaaggatagatctttatcaacaagcattttttctcgtggaggtggggtact

SEQ ID NO: 4342 - DNA, 367 bp, Diabrotica virgifera
caccttcgttccgtaccaccattattgctaaagccatctcatgacatatttaccataaatattgaaaaagtcatgtgaaaaaatgcatccttgtctaacctctctctctctctgctctgctctgcagatttttaatgtctgtaggtgtatcggtgcaccctgctgaaatggaccaaagatttattcagctgacacaatcaaatgccttcttatggtcaacaaagcatattgtcataggtacttatataggtaactgagcgctttgtgccgtaatttgaaatttgccagcgcgcacagtatgttcaggtctattcctattctggttcacctgtaacgctgtgaattatgttggggcaaggaaaaacaa

SEQ ID NO: 4343 - DNA, 398 bp, Diabrotica virgifera
  misc_feature (70)..(93): n is a, c, g, or t
  misc_feature (138)..(200): n is a, c, g, or t
  misc_feature (202)..(227): n is a, c, g, or t
  misc_feature (229)..(255): n is a, c, g, or t
  misc_feature (257)..(280): n is a, c, g, or t
agttactcgtctttaaatatatcaaatttttcatgaattaacttaaattcatttactaacattatactcnnnnnnnnnnnnnnnnnnnnnnnngatatcaaatatttttagggatcatcgtaaaaatacactctcacnnnnnnnnnnnnnnnnnnnnnnnnnnnnnnnnnnnnnnnnnnnnnnnnnnnnnnnnnnnnnnncnnnnnnnnnnnnnnnnnnnnnnnnnncnnnnnnnnnnnnnnnnnnnnnnnnnnncnnnnnnnnnnnnnnnnnnnnnnnncgatgataatagtactattaataaattgtacatttagtacaaatagataggtttaataaacgaattccgcaacatctttttcacctgtttactaaatacatgtccttttgtaataaat

SEQ ID NO: 4344 - DNA, 311 bp, Diabrotica virgifera
gggtcgggcacgcgtccaagaaagttcattgctataataaaatttaccagaactgcgtagagacatttgagattattcgcgtataaattgtgtgactacgactatgtctaatataatacttcatatgattacaattggagccatggtaattttttccggcgtaaagcatgaaaccacagtttgatattcctgtgcaatttatgaatgaaatttgtgaaatgaactgtacctaactaatcgtaagagagtaagatgcccaaatatgcccccagatcgtaatacaacctcaggtgtagcttgctataagattt

SEQ ID NO: 4345 - DNA, 131 bp, Diabrotica virgifera
  misc_feature (6)..(33): n is a, c, g, or t
  misc_feature (52)..(71): n is a, c, g, or t
tacacnnnnnnnnnnnnnnnnnnnnnnnnnnnngaaaaagttattttttgcnnnnnnnnnnnnnnnnnnnnctactccgcaattagatagttacgagtttccaatttagaagagctagtgaaattagaatc

SEQ ID NO: 4346 - DNA, 416 bp, Diabrotica virgifera
gggccgacacacgagtcaacctttgtccaaaaaatgtacatattgccacccagttgcctgttataaaatttttaagaaacagttcgcacatcctaatcgcttgtaaacttataaaacgttttcgggatggccaaaccattgtaaatttttctaatttttataattcagagcaacaaaagtgactagtattttatgtaacaaaaaacaagctacaattaccgattatttttcaagactaaataaataattttcttattaagtatattatgtattttaatacgaaaatatttacataatctatatattgcatacatttcatattaattactgtatgcatccacataatataatgtaatttggttttttaataaatacgttacgctattggacctaatattaacattaaaagaacttaa

SEQ ID NO: 4347 - DNA, 233 bp, Diabrotica virgifera
  misc_feature (2)..(19): n is a, c, g, or t
gnnnnnnnnnnnnnnnnnncttatatgggggggccctcaattaggttcagtgtttgtttttttgcaatgtcatgtttgggaccttctcaagtgttacccaatttaaatttcttggggcatttttttatttcgccagctggggtaaaaccctggttttccccatttatccccctttgaaaaaattccccttttcgaaagtggagtttaaaccgaaaggtccccccttttttacc

SEQ ID NO: 4348 - DNA, 326 bp, Diabrotica virgifera
  misc_feature (165)..(185): n is a, c, g, or t
atacaagcctccaaatttggtttaattacactttatacttcgatgttcagaacaagcagcttatgttgttgtctgcacccaatataacgtgaaaccaaataaaaatagacggtttcgatttgattcaattcgaatctcttaccatcctctgatttttgttttccnnnnnnnnnnnnnnnnnnnnnccgtaattctaatttctacaacttacactagtgaataaaataattaaggttcacttgttttcaccaaaggtcggccaataaccaaaaccggtggatgaaataaaatggaacatttaggaagtggaattttcaataacaaaa

SEQ ID NO: 4349 - DNA, 371 bp, Diabrotica virgifera
acgcgtccaccaagctccgagaacaccaccttgttttacacctgtccttgtgtagaattctagagatgagcaattgttcgttcttacattattacgtgtacatttatatatactcttttttgcttggattaacttcggtttcacatatctacgatttaatatttcccagatcttgttacgtggcgcccgatcaaatgctttttcgaagtccacaaaacagagaaacaacttactgttatgctctatggcttcttctgataactgtctcaccgtgaatatgagatcggttgtacctcgtcctggcctaaagccgcattggctgtcatccagtgtggcctcgatattttctcgcagctttttctcgagtatta

SEQ ID NO: 4350 - DNA, 381 bp, Diabrotica virgifera
  misc_feature (162)..(207): n is a, c, g, or t
  misc_feature (351)..(369): n is a, c, g, or t
cacgcgtccagtcaaatccacatctcagatgttacctggggcagattggcaagtattttgaatatccgcccttaatgtatcattttgaaccaatgtttccttgacggactacttttactgggctttgacccacatatttttgttgtggttggcatgtacatnnnnnnnnnnnnnnnnnnnnnnnnnnnnnnnnnnnnnnnnnnnnnngttgtgatttttatgtggcgcttttgagggtttttaaatataccttttatacagaattttactgttttttgtattacatggtatacagccaactacaggaaaactttttgcttgtaaagtttaataaaaaattgtcgtatttcnnnnnnnnnnnnnnnnnnncatctatttaaa

SEQ ID NO: 4351 - DNA, 302 bp, Diabrotica virgifera
ggtcaggggctcacgggcccatccacgcgtccacccatgcgttcgtttaatataacatatttggaccgttattgtggacgtaaatcgttttgctagttttccgatagatacttacgtattgtgcgagcatattttgcttttatacaagagggatttaattttctgtccttgtgtgtcagggattactccgtatggtctatcgcattattactttcgatgttagaccatctgatggcttacaatttttattgttccttcaatactttacactgtattctatgtcaatgatctgtcattcgttt

SEQ ID NO: 4352 - DNA, 421 bp, Diabrotica virgifera
  misc_feature (2)..(28): n is a, c, g, or t
  misc_feature (400)..(400): n is a, c, g, or t
annnnnnnnnnnnnnnnnnnnnnnnnnngtgtaaaataaaacttttaattttggtaataaccaaattgacattcaattgccggaaaaatatacatatatggaataattttaaggaaacatataaaaaaccgtacaccaccaaaaatgaaaaatttgaccgatttaaaatttttcaagataatctacgtaaaatcaaggaacacaatgcccgtacaagaagggacaagaaacatacaaaatgggccttaaccaattcgccgatttgactcgtgatgaatttgtcaaaatgttgggtctcagtaaaagaactcgtccaactcgtccacagaatgttacttttatgagcttttcccgggaagttttggcagatgttccagaatctgtggattggcgagataangggtgcagtacatcagttaaa

SEQ ID NO: 4353 - DNA, 416 bp, Diabrotica virgifera
gactgaagtcaaggataaaggatcttgtggatcctgttggatttttagtacaactggaacagtggaaggagcttattttcttaaaacaggaaaattggtctctttaagtgaacaaaatctcgtagattgcgcaaaagaagactgttatggatgttcaggtgggtacatggacaaggcattagaatacattgaaacagctggaggaataatgtctgaaaacgattatccttatgaaggtattgatgataaatgcagatttgatagctccaaagtagctgcaaaaattagtaactttacttatattaagaagaacgatgaagatgacctgaaaaatgccgttattgcaaagggacccatatcagtagctattgatgccagttttaattttcaattatatgattcaggaatactcgatg

SEQ ID NO: 4354 - DNA, 310 bp, Diabrotica virgifera
  misc_feature (113)..(132): n is a, c, g, or t
acccacgcgtccgccaagccttcgattaacaatccataaaggcaagccaaaggactaaaaaggaagaatccaaataataattaatggaattggtaactaatggaaaaggtcannnnnnnnnnnnnnnnnnnnccttaaaaatttccaaaccaaccaaaatccagaaaccttcaatggaaggaaaaattaaaccaaccttaaaatagaattcaagggattaagttcgaagaattatgagctaaaataaaccccaattatttggaaattaatttaaacccccccaaaagccaagttcccattaaaaaggtgg

SEQ ID NO: 4355 - DNA, 324 bp, Diabrotica virgifera
  misc_feature (74)..(94): n is a, c, g, or t
  misc_feature (196)..(218): n is a, c, g, or t
agacattatttaagtggggtgtttagaaggtatacttaactttatctatcttatgagacgacgtaataatttcnnnnnnnnnnnnnnnnnnnnnccagaatacattaccttatggatagcagcgtagttttattggagagttcaaatctataatacagattgcgaccgcgatgttggatcacagtttataattggnnnnnnnnnnnnnnnnnnnnnnntgttctacttttaaaatttgacacgatctgagtttaaaccggtgtgagccaagttggcatctagctttaatttattaacagaggttagtacgataggaccaggtat

SEQ ID NO: 4356 - DNA, 351 bp, Diabrotica virgifera
ttcatacacgtttgtgataaaactattttagaagaagaaaaagctcaaaatacccagaagcaagtttcttataatctagtttaccctgccttcgtttcccataactttttagaaaagggaatttgtttagtacctgtaaaaatcctactgcacagtattgtcgataataaaatccttgatgtctttgtaaatacgacggaaccaagtgtaacgcagcctgagataaataaatcaagtttattttgcacctatgcttccagtaatttctgttggttgggaaatagtaaaaacctcagaacattgcaccctctgacgaccgagagtatttcgttaacagctgctgtgtcggga

SEQ ID NO: 4357 - DNA, 74 bp, Diabrotica virgifera
  misc_feature (8)..(27): n is a, c, g, or t
acaacacnnnnnnnnnnnnnnnnnnnngggtcaagggtagtgcacgttcgggagagtacaaggatagtccagtg

SEQ ID NO: 4358 - DNA, 374 bp, Diabrotica virgifera
  misc_feature (80)..(103): n is a, c, g, or t
ttttgatccattttaaaagtacacaatcttctatcggacgtgtccttaagcatctgctttacagctacttaattactacnnnnnnnnnnnnnnnnnnnnnnnngctacaacgcatcaactcgtcgacccctgctggtacgaggattaatcattaacactttagacatttatcattttcgcattgagtagagctaggtgtctagaatttttactgtaacatctgtatgtaatacatgtttctcgtcatgcaatctgattctgtctaaatacactatcgaagtttcaacgagggatgtccaatttattcattaacataatcccgatcattatgtacagttacaacactactacgtcatacttttacggatgagcct

SEQ ID NO: 4359 - DNA, 312 bp, Diabrotica virgifera
aatcaatcttcagctgatacattagttattagtgatagtaatgataattgtgaactccagatgttgcaatagtattgtgggataatactgaaattttatggagatccagttcaatacctgtatcatgcgtatcagggattaacagtaaagtgcgatctacctagtattttcgacatctgtttatgcaaatcaggtcgattcctaatgtagcaaaactattccacatacattgattgaaatgacctgcaagtcgattttaactataccgaagtatttgaagcaataggtttaatatatgtagctgcaatccag

SEQ ID NO: 4360 - DNA, 427 bp, Diabrotica virgifera
ccgacccacgcgtccatttatggagaagcatagaagcgtcagtgccattatgttgattccccgttgcaatacatgcaacaaagactttacgacacaagatgaatacgaaacccacaaaagacttcatgatttcttggaacgccagaaacagcacgagcagaagatgctaatacaacaacaagatggccctcaatcgaagatggcacctaacaaaccaaagtttccctgtaaatactgtaacgccgccttcagcaggtctgatacacttggtggtcatattagacagtaccataaggagcacgttcagactgaattcagatgcaaccagtgcgacagagtattcgagaagcaaaattccttgaccatccatttaaaaactcaagacaggcaaagaagcttcccaaatccagcatcccaaagcaaacca

SEQ ID NO: 4361 - DNA, 193 bp, Diabrotica virgifera
aacaccctatagagagtcgtattagccgatgcgtcgtgtgacggatgggtaggtgtgtctgggtgtacttttacaatttttgttcatgagtgagaaatggagcgtatctcatacatggtggcagcgtggatttcctcctaatttcaacgtgaattttggccgaccagctgtgatatttttcatcgttatagtg

SEQ ID NO: 4362 - DNA, 448 bp, Diabrotica virgifera
actcgcgggccgacacacgcgtcaacacacacttctacgaacgcgtccggtgacgcgtggcgaggtgtaagtacgtgtagttttacaatttttgttcatgagtgataagtggaacttttctcttaaatttttgctgtctaatttactacctaatatcagtatgactatgagacatcgagctgtgacatttttcatcataatagtgtgtatccaatgccaatcatcattaagtgatctatatgctgacaaattaaaaggtaaaatagagcaaggtctatgagatttaaacatagacattccagatgtagatttaaattctacgagtatgccaaatgccgaggatatccaaaaagtgcttagacgaaaatgctataataaaggatgcaactgacgcagtaaatttaataaaggaagaacaggaaaacgctcgtatttgcatagacaaata

SEQ ID NO: 4363 - DNA, 144 bp, Diabrotica virgifera
tatagagagtcgtataaatggcgttaatttagcgctcgttagtactttcatatgacgtgtatgggcagtttaggtcttcacagtgctttggagtgggatgatgtactgttagacaattgcagagtacggtattgtcagatctag

SEQ ID NO: 4364 - DNA, 405 bp, Diabrotica virgifera
  misc_feature (3)..(404): n is a, c, g, or t
agnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnna

SEQ ID NO: 4365 - DNA, 419 bp, Diabrotica virgifera
cgcgggtcgatacaagactctacagggagtcgtagaaaaagaagaatgggtgcaatttaaggttaaaaataacaaaagttacagaagctatgttgaagaacaaacacgattcagaatttttcaagaaaatctgagaaaaatcgaaaatcacaatgaaaaatataacaatggagagtctacttttaagtttggtgttaccaaatttgcagacctaactgaaaaagaatttctggacctgttggtgctatctaaaaatgcaaggcctaatagaactcatgctacacatttgctagccccactaagagatctaccatcagcattagattggagagacaagggagctgtaactgaggtaaaagatcaaggaatgtgtggctcttgttggacctttagtacaactgggtcagtagaaagagctc

SEQ ID NO: 4366 - DNA, 398 bp, Diabrotica virgifera
tgatacatcctatactatttgtgtaatagagtaattatttaacggtatgtcttcaactagtgtaaataaaatgtctaaagatactcatattgaccgagatttggatttatcaaatgccaacagaggtgtttggctggttaaagttccaaaatatgtttctgaactatgggaaaaggcgtctggatatatggaagtgggtaaactaaaaattaccaagcctgttggacacgcggctcagctttcgcttacattatcttcaacaattcggaatttgaatgagcctgtacaagaatgtatgcgacatgatcagagaattgatgtatccacagttacttaacaccctttggggatcattgctcatgttacaccagctaggcattatactgtgttagctcact

SEQ ID NO: 4367 - DNA, 154 bp, Diabrotica virgifera
  misc_feature (107)..(130): n is a, c, g, or t
agaaatgtaatagagattgtttagcaagatttcaaaatggaggatattgcttccaaagggaatgtttctgcattaaagttgatattgatatttaaactattgtaagnnnnnnnnnnnnnnnnnnnnnnnngtataccaataaatatacttaagt

SEQ ID NO: 4368 - DNA, 383 bp, Diabrotica virgifera
  misc_feature (83)..(106): n is a, c, g, or t
tacaagcctcaagattgagtcatgatattgcgctccagcgaaagttcaagtttgtggagctcaagatgcacaaaaattgcaannnnnnnnnnnnnnnnnnnnnnnnatgacatacagagctcctgaactattccatgttgagagctactgtgtaattgatcagagagttgatatttggagtttgggttgtgtgttgtatgcgatgttgtacttcaaatccccctatgatattgtgtatgagaaaggggattctgtaaatttggctgtgatatcaggaactatttcctttccacaagacgcacattttagtgaagatgttcacgatttaatccgctttattttgaaagtaaatcgatccgaaagacccttcattgatgatgtta

SEQ ID NO: 4369 - DNA, 408 bp, Diabrotica virgifera
acagacacttgtggtacaaacgtcatgatttatttacaaataagttaaatcaaaacattaagtgaaaggtgtgtcgatatgtaatatctttgataataaatatgtactgtcaatgtaataattaggtaatggatattatcggtggacgtattttataaaggtatattgtaaatttatatttaactattttataatatatttaacacaatataactttataatacatataaacacaaaataagttataaatttcaataaacacaacaaatgtgctaatatcactgtcactgaaaatgatacacgtcaaaattcatagtaaacaaggtattaaagacatgccgtattgtttatccttgtttagcttattgtggtttctatggacaaatggcttagttttgcgatactagt

SEQ ID NO: 4370 - DNA, 425 bp, Diabrotica virgifera
  misc_feature (419)..(419): n is a, c, g, or t
ctcgcgggccgacacaagcctcaagattcaatcgtagtacaaataaattaggtattgggataattaaggatggcaaagtactttcaaattgtagaagaacctatattacaccaccgggtgagggttttttacctaaggagacagcacaacaccacagggaaaacgttttagtggtattaaacgaagctttacaggaatcacaattaaagcctgaagatatagatgtcatttgttacacaaaaggtcctggaatgggagctcctttagccaccgttgctgttgtggcaaggactgtagctcagttatggaacaagccacttcttggagtaaaccactgtataggacatatcgagatgggtagactaataactggagccagtaatcccactgtcctctatgttagtggtggtaatactcanatcata

SEQ ID NO: 4371 - DNA, 297 bp, Diabrotica virgifera
  misc_feature (9)..(27): n is a, c, g, or t
  misc_feature (68)..(105): n is a, c, g, or t
  misc_feature (147)..(173): n is a, c, g, or t
  misc_feature (250)..(271): n is a, c, g, or t
  misc_feature (273)..(289): n is a, c, g, or t
tgcaactcnnnnnnnnnnnnnnnnnnntgctagagtaagtaatgagattttagtagatgttaaggtannnnnnnnnnnnnnnnnnnnnnnnnnnnnnnnnnnnnnttatggtatttttattaaggacacatttcttttttgtaccgnnnnnnnnnnnnnnnnnnnnnnnnnnncttatatgcttactaatttcgaacttaaaagtgctaatgtaatttgatttttaatggggcatatatagtttacatcnnnnnnnnnnnnnnnnnnnnnngnnnnnnnnnnnnnnnnngaattttt

SEQ ID NO: 4372 - DNA, 407 bp, Diabrotica virgifera
aaaagctattgaaccattgtaaggattgatgactgaagccaaaagcatttaattttcccaataacatgttatgatctactctgtcaaatgccttggagaagtcagtataaatagtatccatctgacttttattctccaacgcgtttaatattttttgttcaaagagtactaaatttgttaccgttgatttattctgagaaaatccatgttgattgtgtattagacgctctttacaataaaattttaattgatcgtgcaatagtctatcaaaaagttttggtatagaggattgtttacaaacgcttcgataatttgttatgtcttgtttattacctgatttaaaaattggacagatataagagtgcttccataaagttgggaaaactgatgtctttaatgatgactca

SEQ ID NO: 4373 - DNA, 440 bp, Diabrotica virgifera
  misc_feature (408)..(430): n is a, c, g, or t
cgggtcgatacaagactctaccataatgtcttaatattagtgcaatgtctaaaaagatcgttattttagctttagtgtgctattttgttgcacatgtccaatgtgaacctgatgtcaattgtccggatcctgcaaatccgggattactgttgtttagccaacaggtctcaacgatatttcgggaccatataagtgaacatattccttcgagtggtacattgaatacaggcatttcgtgtttggtgcttaccagcgataataatacctcaatagaggtagttgcgggaggagttggattcaagtatgtcaaaattgaagttttctcattaaattggttgcaaagatcaaactatggaattgaaatttatgttttacagccagatgttaaattgccttaaataacaaccnnnnnnnnnnnnnnnnnnnnnnngtagcatttc

SEQ ID NO: 4374 - DNA, 300 bp, Diabrotica virgifera
  misc_feature (224)..(246): n is a, c, g, or t
  misc_feature (267)..(294): n is a, c, g, or t
gttagcgcacggatcgttagggatgagcgtgagcagacaatttgactacgagggaagttttagataaatattgggccttgcgtctcagggattgtgacgtacgttatgagatagttagagagaggcacagttttacgtcgttacagagttggtattacaatgtaaatttagggttatttaaatttactactgacgagaatattagtattagggaattgtacagnnnnnnnnnnnnnnnnnnnnnnngacagggagtcggcagcatgnnnnnnnnnnnnnnnnnnnnnnnnnnnngttttg

SEQ ID NO: 4375 - DNA, 329 bp, Diabrotica virgifera
aaataactcatattaaaaataaaaaccttcataaatttcaaatatttttcgggtgtgtaatgggaacactggctgacctactaaagattttttagggcagctacccaagcggttcatctcctaggtggcaatattacaacgtcacaccacttctgtgatgactcctctgttcatgtcactccacgtctatttacgcactcgtttggggtacaacccaacgttgtgacgaatcagacactattgttaaaagccccagttcgtaaccacactttcacttaatgaggccactccttcttcccgttcacatttattgcgactttccattaggc

SEQ ID NO: 4376 - DNA, 114 bp, Diabrotica virgifera
gccctcactgtagccacaagtgacaatcttggtgccatcgagaaatggactaattatagggtcacccagaatattacttactacgttattgatgcaatttttcggatcacagga

SEQ ID NO: 4377 - DNA, 202 bp, Diabrotica virgifera
gtcttgtgatagattgtttcaattgtatgtaactctttgtttactttgtgtgccatgtggatcagggattacgagatgataatgcataatatatcatttcgcgacgtttctcagagctatgggattaaagtattaactttcgacttaatagtttaaagccttattttgtcgtgaaaggtgagtcggttttaaatatgtctag

SEQ ID NO: 4378 - DNA, 248 bp, Diabrotica virgifera
  misc_feature (29)..(50): n is a, c, g, or t
ttggtctcatggcatttgcttgtaatttnnnnnnnnnnnnnnnnnnnnnntggttcctcattcctacagtattagctgcaataatgttttattttcaacgatttgtttagggtaccatatgtagcaaggtttatataggtggtatcatattattatagtccattctttattcatctctctcaatcactacaatgtctaatgtccatcagatcatttagagctcatttttgactcaaaaatgtaattcg

SEQ ID NO: 4379 - DNA, 329 bp, Diabrotica virgifera
  misc_feature (197)..(218): n is a, c, g, or t
tcgatcatgtaccaagtgcacgaaacattgtaagacattaggtgaattgcatacacatattttagaatgtgtacgagactggacttggatgttagcaaggaagaagtgtaaatatatatatggtgctaaatctacacgaatacgaggatgtttggtactaagggttcatcatcataaatcaaagactgattctaccnnnnnnnnnnnnnnnnnnnnnnatcgacccaaccagcgcacaagtgatgctgatacgatccaaaggatgttggccaacctaccagcgaatcgctctactcgaaacttagtatcccactagtaaggaatccgac

SEQ ID NO: 4380 - DNA, 340 bp, Diabrotica virgifera
  misc_feature (10)..(10): n is a, c, g, or t
  misc_feature (219)..(238): n is a, c, g, or t
gtattatatnaatgtgggtattcatataaattgtttcaaactataaaaacatgcaaaataggcaaagctattttaatcttaatgatacatttatagaaatgccaagataccaatattgggacagagaattttttttctttatagagttttgataggcagttatcttttttggattattcctactcaattcgtactactttcgttgacaggtttttcttnnnnnnnnnnnnnnnnnnnnctccagttttcaattcgtgttatttttgagatttctaattgcagattgttaactgctttggaaatttccagttaattatccgtatacttttcactattattc

SEQ ID NO: 4381 - DNA, 51 bp, Diabrotica virgifera
  misc_feature (15)..(38): n is a, c, g, or t
ccctcaacctgatcnnnnnnnnnnnnnnnnnnnnnnnnagcaatctgcggc

SEQ ID NO: 4382 - DNA, 326 bp, Diabrotica virgifera
ctgagtcgtattaaatcaagaggatctgattctcgatttaaattagtcatctgtaattacttcctttactaaatgaggtactatttggtggtactaaagtgtagtatttatgtgctgatactgtcaaggatcactaactagccattatttcgattactatagtgaattgaacaatggccaaaatattgtctcatataatgtatctgatgaatgtgaactactttttttgtaattcggtgttattcatatctacgtaaatccaacttttactgatgttcattcatcttaacctagtcacaatctaattcacattcaatccatatata

SEQ ID NO: 4383 - DNA, 211 bp, Diabrotica virgifera
  misc_feature (170)..(193): n is a, c, g, or t
gtcgtattatttaggccgcgcgcgctttattttttgccccttgtgtgtcacggattattaattaatagctatcgacttactagcttcgagtttaaaagagcggtgggattaagatttttattgtgaaatacagtggttaagtaatttttttgtagtggagtgttattcgnnnnnnnnnnnnnnnnnnnnnnnngcaaataggctgaccttt

SEQ ID NO: 4384 - DNA, 391 bp, Diabrotica virgifera
aagcgagtggttttttgaacaaatttactattctaaaatggcacatacatataaacttatatattttgacggccccggaaaggctgaagcaattagaatgatcttaagctatggagaaattccatttgaggacaaacgtatccagattggggattggccaaaacttaaaccaactacccctcttggacaacttcccttgttagaggtcgatggtaaagcaatccctcaaagtactgcaatctgcaggtacttggcatcaatagtaaaactcgatggcaaagatgcaaaagaaagtcttgcactagatgttgcagtagaaactctttttgatgtacaaaaactgagctccgaagtaagttatgaacaggacgccgctaagaaaaaagaaaaa

SEQ ID NO: 4385 - DNA, 384 bp, Diabrotica virgifera
aaggccagcaaggagaagtatttactcctgaaacttctccataacgtccataggtacgtctaagatatttcaagaatccatgatgggaagcacacggctcaggaaaaattcctcgttggtaaacaatatcagagacaaacaaccagacatcaaaatacagaaaatgactgatacaaattcctacttgaagtatgttagcttactaattttaactctccaaaatgctgtgtttggtttaagtatgagatatgccagaacacgagaaggtgatatgtttttatcctcaacagctgtactgttgatggaagttgtcaaactgatcacctgtttgatgattgtctacatagacgccggtggattattaaaaatgtttcgtttaataga

SEQ ID NO: 4386 - DNA, 320 bp, Diabrotica virgifera
tcgccggtcaatccacgccactaaattcgctctctctacgcgtccgttctctgtttatgctgaaacttgactttaagacagatgaggacttttctgctacaagatctgattttcctaccacaaaccttgagttcatgcaccgtgccgtacatggcatggtacattgtcaatatatcatgaggatattcctggcgaaaacagcgtaacaactaaatttcccattgtaaaatcatgtgtgtaaataacctcattgtcacgtaatgtaattcgtttctaatttaatccaatttattcagaaaatagattactttaattaatat

SEQ ID NO: 4387 - DNA, 399 bp, Diabrotica virgifera
  misc_feature (169)..(196): n is a, c, g, or t
acgcctctacctgatacagtggtctattaatttgtgtgaccacttgatctttgcctctaatgaggcccggggttgaatgtgttaaaaactattttaagatgatggagatccaatcacagttaagcttttgctctaacagttagttaaaatcatcggcagcgcattctgnnnnnnnnnnnnnnnnnnnnnnnnnnnnctagtcgaaaatgtcctaaggggctgataccagtgttaactgaaactattccagatatgcttgtaacttctttaaatttgccttttatcccagtgattaataaacttttatatgaacttaaaatttacagaacatgaactcaaaacactaagggcggccgtacacggactgctggggcagtttaatactgagcgacatacacg

SEQ ID NO: 4388 - DNA, 373 bp, Diabrotica virgifera
  misc_feature (21)..(45): n is a, c, g, or t
gtccaatgaatttagctaacnnnnnnnnnnnnnnnnnnnnnnnnnggttataaaagggtttggtgacttgttagtgcattcatttaatttctgcatcaaacacttagtatgaatgaggttctcggacaaaataaatgtgatttatttgcaggtgactagttaatcaaataataaaaatttacaattcataaggtgtacatatttgtatgctataaaatatggctgatagtgatgatgaatatgatagaaaacgccgagataaattccgaggagaaagagcagaagctagttatagaggtgctgaaagggtagcaagaccaagggacgaatgggcagaaagagattcatggtctcgtcctagaccaagggaata

SEQ ID NO: 4389 - DNA, 410 bp, Diabrotica virgifera
  misc_feature (72)..(89): n is a, c, g, or t
  misc_feature (233)..(255): n is a, c, g, or t
  misc_feature (343)..(343): n is a, c, g, or t
  misc_feature (395)..(395): n is a, c, g, or t
gggtcaaccgtccgacacgagtccgttttttccgaaacattgtatcttttcgttctaattgcactcccctannnnnnnnnnnnnnnnnncagaggtcatccccatacgtacgtttctgtctctccaggcgtcttcagaggtgatcatgtagccccactgaaaacgtctggagggacagaaacgtacgtatggagataatacatcagctctgaaccaaaatgaaacataagctnnnnnnnnnnnnnnnnnnnnnnncatattttgagtacacggaatcaactttcgtgtagttggcattcttcctagacgaataaacggaatgtgattgcatattgtagagtcnccttcatcttctttattcatggtatccttgccttacaaattgtaaaagttanggattaaggatgttg

SEQ ID NO: 4390 - DNA, 429 bp, Diabrotica virgifera
  misc_feature (245)..(262): n is a, c, g, or t
gctttgactataacatatacaagtaacttaaatgtttttatctgtttgattgtcatatgcagcagcttaaatttattagttcctaaggttgtaactctttgtaagctttgtccttaaaattgtaaaatttttaggtgacaataacgcatattatttcctttctgtcgattctcagaaaactataaaatatgtaacaactttcgacttataagcctcatgcctcatttatgctttaaagttatatnnnnnnnnnnnnnnnnnngaggataatgggccagaacaatttggtttaagaaatttatttcacaaatctcctaaccaaattatatcaatatttattatagatttaaacgccaaccccactaaaacgaatgtgaataataaaaaaatttcaaatatgaggtacataagaccttcaacacaaaatct

SEQ ID NO: 4391 - DNA, 83 bp, Diabrotica virgifera
  misc_feature (14)..(34): n is a, c, g, or t
  misc_feature (42)..(62): n is a, c, g, or t
ttttatgggaaagnnnnnnnnnnnnnnnnnnnnntggaaagnnnnnnnnnnnnnnnnnnnnngagagtctaattttttaggaa

SEQ ID NO: 4392 - DNA, 118 bp, Diabrotica virgifera
  misc_feature (9)..(28): n is a, c, g, or t
gctacaacnnnnnnnnnnnnnnnnnnnnattcgccgtttggtccagcgctgcgtgccaggctatgtaggtccgtcagattggtagtgcgccccaacaatccattagtgcatagcacgt

SEQ ID NO: 4393 - DNA, 373 bp, Diabrotica virgifera
  misc_feature (10)..(29): n is a, c, g, or t
  misc_feature (34)..(58): n is a, c, g, or t
  misc_feature (68)..(92): n is a, c, g, or t
  misc_feature (256)..(277): n is a, c, g, or t
tacaatacannnnnnnnnnnnnnnnnnnnatcgnnnnnnnnnnnnnnnnnnnnnnnnnatgtaattgnnnnnnnnnnnnnnnnnnnnnnnnncatgaaatttcataattgttattttactatattgaatatcttgaagatctataatatttgttttaattatttcatcaatagtaatttattaaagtgatgagaatatattaagtgatttatttatttatcgatttattttacgagttgtgaaagtagtattttcnnnnnnnnnnnnnnnnnnnnnncataatttagattcaattttgattaggttgatatgggttatgtatagttgcttagagttaagtaaattagtagcaaaatatgagtcgaattaatgc

SEQ ID NO: 4394 - DNA, 93 bp, Diabrotica virgifera
tgagtcgtattaaacgtccgcccacacgtccgcgcaaacgtcaagccgagggcgtcggcagacgacggtgcatgcattatgtaagcgtacatg

SEQ ID NO: 4395 - DNA, 328 bp, Diabrotica virgifera
  misc_feature (2)..(85): n is a, c, g, or t
  misc_feature (88)..(108): n is a, c, g, or t
  misc_feature (179)..(200): n is a, c, g, or t
  misc_feature (202)..(216): n is a, c, g, or t
  misc_feature (233)..(312): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnncgnnnnnnnnnnnnnnnnnnnnnaagtttttaagtaaaatttaggattatgaatttgcatgttttacaatatgttagtatgttatttttagagnnnnnnnnnnnnnnnnnnnnnngnnnnnnnnnnnnnnngtaaatttaaagttagnnnnnnnnnnnnnnnnnnnnnnnnnnnnnnnnnnnnnnnnnnnnnnnnnnnnnnnnnnnnnnnnnnnnnnnnnnnnnnnntggcaagatttttttc

SEQ ID NO: 4396 - DNA, 72 bp, Diabrotica virgifera
  misc_feature (2)..(62): n is a, c, g, or t
annnnnnnnnnnnnnnnnnnnnnnnnnnnnnnnnnnnnnnnnnnnnnnnnnnnnnnnnnnnncggaattatt

SEQ ID NO: 4397 - DNA, 202 bp, Diabrotica virgifera
  misc_feature (20)..(20): n is a, c, g, or t
tgagtcgtattaaaagacangtttttgtatgagtcagaaggtagaagagccagttctatccggtcaacgcatcaaggagaggggactgagatgaacaagagaggtgtgatccaactgggtttagggatgcaatagtcgctggactcgagtagtgtgcgagcgagggttgagggctatagcgcgagatttgggcagtgctggt

SEQ ID NO: 4398 - DNA, 308 bp, Diabrotica virgifera
  misc_feature (192)..(207): n is a, c, g, or t
ttcaaattccaacttggggggacctaaaagattcagattaacatcgttgtcatcggacactgcatttctgggaaatccgcgaccactgtttattgaactttgagttgcagggacttctagctccgtcttatcgacatgttatgcacacagtcacatgatctgggaacacgttatttcttaatgtcctagagnnnnnnnnnnnnnnnngcctgtgacaatacgcgaatcctcattcactatgccttgttgctgctgaaatgcgatacatagcttgggaccctcaataatcaccatttacaattattttt

SEQ ID NO: 4399 - DNA, 90 bp, Diabrotica virgifera
  misc_feature (12)..(31): n is a, c, g, or t
  misc_feature (34)..(35): n is a, c, g, or t
ttactacaacgnnnnnnnnnnnnnnnnnnnnggnncttttttaggtgtggcccgccagcattttcttcaacggttggttactcggactgg

SEQ ID NO: 4400 - DNA, 300 bp, Diabrotica virgifera
  misc_feature (15)..(15): n is a, c, g, or t
  misc_feature (19)..(19): n is a, c, g, or t
agtcgtattagaacnagangcggggctacaagaaaagtcattaggaaccagtagggttgaataaaaaacagtgagggttaaaatgtcaatggcctatagtgcagtattgggacaaaagcgtgcattattttgtgaaccttgagtggtcgcggaccattagctctgaagtatagatatgtgatatacaatgtcataggtctttgaaactcagtaatttttaacagtgcataaggggaacagctaatgatcgtgtgaggaaatgccaatccttaagcgcgctgacgtgcttctgatgagata

SEQ ID NO: 4401 - DNA, 267 bp, Diabrotica virgifera
gggtttttaactcctcctccggatggaagttggtttggacttggaatttccctagggtaggcccatgctgatcatggttaagaagtgtggatgggatatgcagtacgttcagtgtcatcgacaatttattctggcttatctccagataatgatcgtagatataggcacttgagtcggagagttattggtgagtaatatgtagcttctatgatttacttgtgctcagatgccactcgtcttgagcgattccacgatgtttgagattcg

SEQ ID NO: 4402 - DNA, 250 bp, Diabrotica virgifera
agataagggcacctttagttgtgtaggtattctattatgatattccagtgaagtcatgtagagtaagacattattggaaatgctaaaatatatattgtacaaaagttctttgtctaattgtgcgttatgcactaatgtggtaattaatactccatattcgtgaaacgtacttttattaccttttaatgtattttggatgtgtaagaagatgggaaaactatcgtacatctcattattcagtagcttgtcg

SEQ ID NO: 4403 - DNA, 279 bp, Diabrotica virgifera
gacatttatttcttcgacgtgcgacattaggtgacaaatcataagtctgtttacggacaagattatttgacagaaggtgttgtcagccgacgttgtccatatgctatcggtcggcacaaccgaggtgatgcattaattttgtcagaggatgttgcagtatgggaaatctatgaacattacgacagatcttgcattccggataggttcgatacaggtgtccacaatgaatactacttctgtctaataattggtttgtcctgaaaatgtgcatgaagcagc

SEQ ID NO: 4404 - DNA, 348 bp, Diabrotica virgifera
agctgttcatccctgctgctgccctcattgtagccagtagtgctaatctaggtgccttctaaaaatggactagttttaaggccacccatagtatatcttacaacgttattgtagacatccttcgtttcgctgtcttccatgagaacctcaaatgtatcgaggaatacaatgctaaatactatagtggagaaggtacctactatttggctgttatcatattcgccgattggacaagcgctgaattcgaagctatgttggaccgtcaactggctaacaagcttgtaaaaaccttcattggtaaacacgtatgagatctcaatgtccacgctgcacatgattatgattggc

SEQ ID NO: 4405 - DNA, 331 bp, Diabrotica virgifera
  misc_feature (16)..(16): n is a, c, g, or t
  misc_feature (18)..(18): n is a, c, g, or t
agtgagtcgtattaangntggattttgcacagctgatgaggtggagattacagccaaaattactggttgggtaagtgtaacagtatacgatgaatatgctcttcgtttggcactcgtggtgcatggtgtagttggagttagcatctacgcagtctatgttatgaacatgctcttcgattggaactcgtgaagcaacgaccatttagtgttagcatcgacgctagccaattgtctgtcagtttttattcacatggatgtctattactactgaaaattgcggaaacagagtagaatatttggactattcggttttagctgttggaataggttt

SEQ ID NO: 4406 - DNA, 286 bp, Diabrotica virgifera
  misc_feature (115)..(134): n is a, c, g, or t
gggaattctcagtccacgatactccttaagccctgtggcagaatatctgaagtcattagggagcaggccaatccactgctcagcggattgcgtgggttccgaagttgaagttgannnnnnnnnnnnnnnnnnnngtactgttattttgttagaacactttatgatagtacattgaagattaagggaaaggtgtacatgacactgggtacatcgtttttgcatataccgccaaattcaagacttttatagaaagtcttcgtaaactgggagatgtatacgtaaatga

SEQ ID NO: 4407 - DNA, 241 bp, Diabrotica virgifera
  misc_feature (2)..(24): n is a, c, g, or t
  misc_feature (26)..(47): n is a, c, g, or t
  misc_feature (49)..(69): n is a, c, g, or t
  misc_feature (157)..(180): n is a, c, g, or t
  misc_feature (182)..(207): n is a, c, g, or t
  misc_feature (222)..(240): n is a, c, g, or t
annnnnnnnnnnnnnnnnnnnnnncnnnnnnnnnnnnnnnnnnnnnncnnnnnnnnnnnnnnnnnnnnngttattgtaaaattaatatttgaaataatgtttttgtaagtaaatgttattcgtttactaaatacatctatcttttgaagaagtaaannnnnnnnnnnnnnnnnnnnnnnngnnnnnnnnnnnnnnnnnnnnnnnnnnaatagtaagtatggnnnnnnnnnnnnnnnnnnng

SEQ ID NO: 4408 - DNA, 328 bp, Diabrotica virgifera
tcgtattaaatcgggtacctggtagcggaaccgtcaagaattcaggccctcgcaagatagttcgtcggggtaacctaaatcgacctggagacgtcggccagagatccgggaatagttttcttttctgtataagcgttcgagttctacggaatcctccatcacggagatatggtttggaacgcgaatagcaccgcatttgcagcggtgtccggatcttctccgcgaatcttgtcaatccaggagagggccacttggaggctcgcagcggttcgtacccatatccggagcatgtctccaaagtgaagagcctctagtcgattagataatg

SEQ ID NO: 4409 - DNA, 258 bp, Diabrotica virgifera
aggtccattttccaccgctgtggatgctgatacatggcagttatgcggaggtggaccttgcagcagcactgcctgtcgaagcaacctcagtcacggtgtccatgctgttggatacacaacagatgcatgcattgtcaagaactcatggggaaatagctggggtgaacaatgttacatcagagttgcccgtggtgaacacttgagtgggactaacctcatgaactcttaccctcaattgtaaaaggcttgagtgcttat

SEQ ID NO: 4410 - DNA, 332 bp, Diabrotica virgifera
ttcaatagtaaagcgaccatggctccacggttcgagatcgcagtcggcctcaatttgggtcacaatatcacttcaatctcagacatatccaatctgaataaagttcgtcacgctaggttgaatgggatccagacgatccacatcagtatttgtcagatacatcatccgtgaagtcgtatgacgtgctccatatgaacacgagagccatggatattcgatcaaggtgtcacaggataatagggccctgcaattcctgaagcctcgtcttggcacacacatcagatccatggacgaagctattctaactatccaacagccttacccacatgcgt

SEQ ID NO: 4411 - DNA, 169 bp, Diabrotica virgifera
  misc_feature (2)..(22): n is a, c, g, or t
  misc_feature (57)..(75): n is a, c, g, or t
  misc_feature (117)..(149): n is a, c, g, or t
gnnnnnnnnnnnnnnnnnnnnnagtaacagggattattgatatttaattaggaatgnnnnnnnnnnnnnnnnnnntagagctaaataattagaatttttattgtctaggaaatatgnnnnnnnnnnnnnnnnnnnnnnnnnnnnnnnnntcttgagctatatcgagttt

SEQ ID NO: 4412 - DNA, 235 bp, Diabrotica virgifera
  misc_feature (116)..(139): n is a, c, g, or t
  misc_feature (176)..(193): n is a, c, g, or t
tcatttattttggacagggtaaaagatttcattttattgaaggtcactaggatcgtcatgagagagagcattttacttttacaccagataaatttacgtttcgtgccttgtgtggnnnnnnnnnnnnnnnnnnnnnnnnctattaattactttcgaaattaatcgagctaattccnnnnnnnnnnnnnnnnnncatagctattttaactaacttttttgtaacggtacgtcatcc

SEQ ID NO: 4413 - DNA, 172 bp, Diabrotica virgifera
  misc_feature (4)..(22): n is a, c, g, or t
ccannnnnnnnnnnnnnnnnnngttagggctatgattctcagattcggtttagaccactctcattcagccaggttccatcaccaatatccagctgaccagtccagggggtgtgagacacaggattttgtgcaccgttggaggggtctctatttgcaggatcctgtgatcaca

SEQ ID NO: 4414 - DNA, 372 bp, Diabrotica virgifera
cccttagcactttcgacttttatggagagaaaggaagatttgtaaggaaatttaaaaatacgctctagaatttgatcttattctgttccagaaaccagtcattttggacccgtcaagctttttgaatataagaaatggcactatggtggaaggtattctagaagatgaacgatacatttaaattctggtgtatgaggggttgaatatacctacatctgatttttccttagaatacaatggtcatagtttttttgcaccatatctcgcttagtttgaatgtaaccggacatttaacagttctcgtagtaatggtcttttcaagcactaaagaaggtattcgtagcagtgtacccctaaaatctacaagttctg

SEQ ID NO: 4415 - DNA, 321 bp, Diabrotica virgifera
  misc_feature (26)..(129): n is a, c, g, or t
  misc_feature (158)..(191): n is a, c, g, or t
  misc_feature (239)..(256): n is a, c, g, or t
  misc_feature (258)..(272): n is a, c, g, or t
  misc_feature (279)..(298): n is a, c, g, or t
acgcacgccactgaacagacgtcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagagatttattgtttgtaccgtgtgtagnnnnnnnnnnnnnnnnnnnnnnnnnnnnnnnnnnctttcgaatttaagctagcgaataaattataattttgattgtaaaatnnnnnnnnnnnnnnnnnngnnnnnnnnnnnnnnncattcgnnnnnnnnnnnnnnnnnnnnattaagaaataagatagatttat

SEQ ID NO: 4416 - DNA, 327 bp, Diabrotica virgifera
  misc_feature (2)..(17): n is a, c, g, or t
annnnnnnnnnnnnnnntttgctcttagtgacgtacttgttcccatatgtatacttcacaattattgctgcgacaggcgccatttttatgacaaagtaggttatttcttgtcacttgtgaatcagggagtagacattatgaatcatatagttattgatttccattgaacatttgctaacttcgtaggacttgtatcgtcattgttccaatttcaagtggtttactgttatgatacgtaattcgcttataatgaaaactcatgcgtcaataaatagatcaagtttagtgctgatcacgctaattttaattacggagttgtaacctatc

SEQ ID NO: 4417 - DNA, 280 bp, Diabrotica virgifera
  misc_feature (15)..(15): n is a, c, g, or t
tgagtcgtattaagnttgattattatgaagtcattgtttattttagtaaccccctctaatatttcttcataattaatttttggttcattataatgacttagtgtatggaatcagtgtattacggggtgaattgtgagtaggatggactgcttaattgtagatttagaattaatgagagtggatcagatttgccgagatgtctctgattggtgatgactattaacaatgtatggatattggtctgcaattttttttagttgattaggaattcaatttggtt

SEQ ID NO: 4418 - DNA, 296 bp, Diabrotica virgifera
cgtattaatgcggctgtgcacgcttgcaactgatcgtatgcaatatgtgcacgtggacagattcatgttaaaagatgtccagatgtgttaggattagcgaatttcaattaatattgtgatataggtgtttagttgtatgagacaaaatatcaagttttgtaggatgagtaccatgaatgagtagttaccaattatctagatatcagtaacgagctgataggagtaatgccagtggtattaatagtgagacatgcgaagtttatgttattttatgagaatgagttgtaaattgattt

SEQ ID NO: 4419 - DNA, 207 bp, Diabrotica virgifera
tctttgactgagagtagggtcatattaaggttgggtaatctggcagtcaatctcattgtggtcagaaatgtcaatttagcaggaattgagctctgggccagttttaaggcaacactcggttgcatgtgacaagcgttagtgaggacaaacctcgtttgagctcgtagtcgattagaaactccgacagcttcgacgcacataaggcta

SEQ ID NO: 4420 - DNA, 380 bp, Diabrotica virgifera
  misc_feature (23)..(63): n is a, c, g, or t
  misc_feature (196)..(221): n is a, c, g, or t
  misc_feature (232)..(258): n is a, c, g, or t
  misc_feature (299)..(313): n is a, c, g, or t
  misc_feature (316)..(334): n is a, c, g, or t
caacaccctgatagtgacgtcgnnnnnnnnnnnnnnnnnnnnnnnnnnnnnnnnnnnnnnnnngatttatgatcaatatattgaaatgtgagtgattttgtaatatgaatatcagatatttttacggattggcttatgtgtaacattgtatcaggatttacatttaaaataataattaggactaaaaattttcagnnnnnnnnnnnnnnnnnnnnnnnnnngtacatggggnnnnnnnnnnnnnnnnnnnnnnnnnnnttaacgtattgatttatatcacttatgttgagtaatgatcnnnnnnnnnnnnnnnctnnnnnnnnnnnnnnnnnnntatacataggtttaacaagggaattcggcaacacttttttcacctg

SEQ ID NO: 4421 - DNA, 304 bp, Diabrotica virgifera
cgtccggtgagcatgtccatgatgcagtcctctatgggacttgttgtaaccatgtgttgtgaccttcagtaaggtagttccatatatttaactgacttctggatatctagtcttactgtgcaatatgctggattactcagttctttagcatctaatgctatcactgttgtttcagatttggatctatccaatgctccttacatttttaagatttagatcatggatgcgtgaagtattggtagctccggaatacggagtttaccctttatatttgtgccgatttcctagtgcattgatgggagat

SEQ ID NO: 4422 - DNA, 203 bp, Diabrotica virgifera
gtccgaaaatcttttgtcatgggcccgtgtggaattctggacatttactggaattgtttttggctgtagcaactacactggggagttttacctcaggttacctttgatataaccaaatggtatacagccacccttcgagtattatcccgttctaattgtgggaagattacagtttgtgactacatagcttttaagccattgca

SEQ ID NO: 4423 - DNA, 207 bp, Diabrotica virgifera
aacaccctatagtaagtcgtattattattgttcgctatatctatgggatcatgttatacaacgatattgaatggaattgggtatattatgtcatcctctaagataactttcagtggatgcaagcacattgtaggagccagcaccagcacttagtcatgatctatagaaggatatggagttgctaagcgatcccatatatgaactttg

SEQ ID NO: 4424 - DNA, 188 bp, Diabrotica virgifera
agtgcggcatcacatgggtagatgggattctagcccaaagggagatcgcagacacaccgtggcagggtaaaggctttcccaagagaggatccctcattacctgtccacttgactgggcttcagatgttacgagagctggaaggtacacacatgtggagagaggcagagatacctgcatcattgatcag

SEQ ID NO: 4425 - DNA, 122 bp, Diabrotica virgifera
  misc_feature (11)..(31): n is a, c, g, or t
ttactactacnnnnnnnnnnnnnnnnnnnnntgacacggcatacttgggatactactgcacatccaggtcgcagggaccatgtggcacggtaatggcattcgcggcacatgtctcactcatg

SEQ ID NO: 4426 - DNA, 215 bp, Diabrotica virgifera
ccgtcttgacaaatattttaatttagtcattcgctctacatatgccggtcaggtttatgtgctcaatctacggcctacttccttgtacactttctgcctaaataaagatttcggccacgcgtccggcaccagttttatcacgtgcggacgtactgcaggtcatctagcctttcgtctgccgactggccaggtcacagagcctctgtagtgtcacc

SEQ ID NO: 4427 - DNA, 399 bp, Diabrotica virgifera
acggcaattcgcactttcgataccgctgctctaaagagattgtaacccaaaactctgggtattgaggtttggaagaggaagaactgacaaaatagggggaaatctggaagagcagagatttaagagacaaatgaagaatggcttagctcagacgagcaaatcaaataggcaaagagacactatatctcaagtgagtgttcgggctagcttcaatacactgaatattggctttgagatatacaaatagagagatgagataaggaaatgatgaagacgaggaaaaaaaaaatgagacagggtaatacaaaaattgaaggcaactagataagaatgctggagatcgattgagataagagggacgataaagagagaaggaaatgggcgccaactcaaccaaac

SEQ ID NO: 4428 - DNA, 398 bp, Diabrotica virgifera
gggtcgggcacgcgtccgagcaaatcaaagttatttagggggtgtttaatgagattttttgggtttacatcatgtacaaaaaattttgtttgtatattacctatcaagatatttcagaaaaccgtaccttaataatattacaaagtcatttgtatttgagtagtatcgttaaatgtcgagaggtgaacatacaatagcaggtataagtaataagcttaagattaaggttttctaaaatatattgataggtactatacagttattttactttatatgccgtttagaagaaactatatacgatgcagaagatattgatgatattatatttacgccaacctgtttttttggtatgagttttcttttttgctataaatattgtataataaatataactgttt

SEQ ID NO: 4429 - DNA, 142 bp, Diabrotica virgifera
  misc_feature (98)..(124): n is a, c, g, or t
acaatactctatactgagtcatattactgtacttaattagataattgtgatgtcacagtttgattagtattgtaatgtctgtaatattgtaattttgnnnnnnnnnnnnnnnnnnnnnnnnnnntgtaatggcgatttactt

SEQ ID NO: 4430 - DNA, 89 bp, Diabrotica virgifera
aattggtccttgcttcacgagtgtttacggggttggtgttgtttggggcgtggttggcccgggtgtggtcttcagtagggtgtggtgaa

SEQ ID NO: 4431 - DNA, 409 bp, Diabrotica virgifera
  misc_feature (177)..(194): n is a, c, g, or t
  misc_feature (391)..(408): n is a, c, g, or t
gcgggtcggtccaagcctctaaagtgagtcgtagtacgctacatggcttcagggatttttgtgtactgagatgttatgcgtttttaaatacatcgacttgatgaacaaatagggcacctttagttagtgacaacatacctataattaagtagctttagattagtaatattacatagnnnnnnnnnnnnnnnnnngcataaaattttactagaatttacttgttacataacgattaggattaacaattttaaggcttgacaatctgttattagttactttcaggtagtagtactcatatttttcacaaatttttgatgagcacataagactaagggctttaaatttagtactgacgatactattagtataacaagatggtctatttagtacnnnnnnnnnnnnnnnnnnc

SEQ ID NO: 4432 - DNA, 199 bp, Diabrotica virgifera
  misc_feature (13)..(168): n is a, c, g, or t
  misc_feature (179)..(198): n is a, c, g, or t
ttattgtgaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaatgttaannnnnnnnnnnnnnnnnnnna

SEQ ID NO: 4433 - DNA, 361 bp, Diabrotica virgifera
  misc_feature (21)..(108): n is a, c, g, or t
ttcgatccacgcgtctgaaannnnnnnnnnnnnnnnnnnnnnnnnnnnnnnnnnnnnnnnnnnnnnnnnnnnnnnnnnnnnnnnnnnnnnnnnnnnnnnnnnnnnnnntgaaggctaatctagtaagatatctgataaaatcggattgattcaaataataatagagcatttataatagttaaagaggggggggccccttgtggttttttcactttgttgggtttgtgaaaaagcttgtttttctctaatttggcccccttaatttatttcaggggggtttttttttcacgtttttttaggggggaacctggggtttgggccttgtagttcttgtggaaataaacccttttttgggaagggg

SEQ ID NO: 4434 - DNA, 393 bp, Diabrotica virgifera
aatcaatctaattaggttatacatactggtaacatgaaatgtacttcagtgaatatactagctattctgctggtgttctcatcagccgtcattagatgtgacatcgacacattatccaaaatatatccactctcgaccattgagttagactttcttcagcatctacacaagtcgatagaatatatattggacttctggaatgagccatctactttgagaggacttgttgatgtgcgtgtgtctccatcagactagtatagcttcgaacacattagcggtatgaataatttaaattttgaagttattagtgacatcatgtaagacatattccattaggaatctacagtggacaatcttcagactgtgttaagtgttgtccttactttgggatag

SEQ ID NO: 4435 - DNA, 420 bp, Diabrotica virgifera
gtgggtcgatccaagcctctaaactgagtcagtaatattataaaagtgtacagttcagcaattgtttaaattagaatcgtataaatattgaaattattttcatgatgaaggttgttatttttaattctcgagctattgctgcatttcacgcattacgtgataatgattactgggtacagtttaaggtttaatacggcacatgtcacagaaattaagtccaagaacaaaatcggttcacactttttcaagacattttaacaaaggtctaacatctttttgacattgattgggacggacaatccacttgtacattgggagtaaccaaattttcagatttgactgaaaaagattttaccgctctgtgaggactttctaagtctgacttacccactagactacatgtgacacaatcactcaatc

SEQ ID NO: 4436 - DNA, 441 bp, Diabrotica virgifera
  misc_feature (392)..(404): n is a, c, g, or t
  misc_feature (406)..(419): n is a, c, g, or t
gcgggtcgacacaagcctctacagtaatgtcgtgacacaggacaacatatagccaggctaaaatggagcttcgcaggtcataacgctagacaaacggacagtaggtggaataccacgatacaacaatggagaccatgagcaggaaagagagcaagaggacgatcccagatgaggtggggagacgacattaaaaagataggaggaacgcactggaaacagaatgcactaaacagaagctaatggaggaaactggaggaagcctatgttcaaaattggacgaattaaagggcaaaagaagataatgcttatattttgttgtaaagagtagtttatttctagctcagtttttctcccccgtgtttatatattcaaaagaagattcagatgacggnnnnnnnnnnnnncnnnnnnnnnnnnnncgttcaatttctccgctacata

SEQ ID NO: 4437 - DNA, 431 bp, Diabrotica virgifera
  misc_feature (376)..(393): n is a, c, g, or t
  misc_feature (399)..(399): n is a, c, g, or t
actcaaaaatgccattatatggcattataacaagttattttgattcaaaacaagtttttgatcaaattttatagtgtagaaaaggttaaaataccgttttttttacattttcctccattcccaaaacacatcataatcgatttggctgaaaattttcccgcagatagccaaaacatatgactttaagtggttagaaggatttgaattatattataatacgtaccacggcatcaggattttttttgaatgaacattaatttttggtgctacgcgcaggacaggcagcggtgttagattcgaacaagttgattttcaccaacatttcttccaatctttatgtaatatattactctgtatttactctatattttgttgnnnnnnnnnnnnnnnnnnccacanaaatcaaactaatttgattattgtttgtgaaa

SEQ ID NO: 4438 - DNA, 422 bp, Diabrotica virgifera
  misc_feature (115)..(151): n is a, c, g, or t
  misc_feature (313)..(339): n is a, c, g, or t
ataattttcatgatgtgtggagttgcctggatgatatctgttgttggaagataattgaatgggatatggagaaaagtttcacagttgctaatgcatggtacaaattgcgtttagnnnnnnnnnnnnnnnnnnnnnnnnnnnnnnnnnnnnnaacagcgaagagagctgatgatcttaccaaagaacagttacttagcatctatttctacctcaatgtctatagaaaaagagctgtggactttgaatatgaatttgctctagaaaaacttgtaaatgatatggacattgatgagatgggtgtagttgccatggnnnnnnnnnnnnnnnnnnnnnnnnnnnagctagtaaatattcaagaagctctggcaaaaaaagtaatagaaaattcaagtactgcacatgatattacattaacagcaata

SEQ ID NO: 4439 - DNA, 171 bp, Diabrotica virgifera
cagagagaaagatgtttctttttattaagatcatgtaatgaaaagttctttacatgatcttaataaaaagaacttttcattacactaccagatttttttatatcgaaaatttttgtttattagccctaatttcatctgtcatgggtattgttgtatttttaattaatccat

SEQ ID NO: 4440 - DNA, 328 bp, Diabrotica virgifera
aaaaaaatataaaaacctttgtttatttgaatatgatattcaaagaaaagcaatatacctattatctcatcttcatgtttttcgcgaattctttatataattttttccatataaagggttgacgacccaaatggttcaagcttagcttaacctgtattgcaaatcatacgtcctccaaaattgtcaccaatattaatttaattgcccttcttttaaaacctccttaactggaaaaccccggcgttaccccaattaaaccccttctacaaaatcccctttccccaaccgggcttataaccaaatagccccaaaccatttccctttccaa

SEQ ID NO: 4441 - DNA, 161 bp, Diabrotica virgifera
  misc_feature (2)..(14): n is a, c, g, or t
cnnnnnnnnnnnnncgatgaaaacaaaagggggggtcccccccaggggtcccctcttttatggcgtgggggggtcttcaataggcctcccctattttccccccctgtcgtttgtctggcccctttttttacgggccttactcgggttaccccgggtttttc

SEQ ID NO: 4442 - DNA, 381 bp, Diabrotica virgifera
  misc_feature (264)..(305): n is a, c, g, or t
gttaatttcaccattgcaccatcagtatttgtatcatttttagatattttttcaggccatatagaatccataaaacgatacttcaagatccaaattacataaatatgtaggtccaacagcttgaaacaaactaatcaaaatattttctctcacaaaacaacccacggtattattttcatgagcaagtatctacaatgattaaagaatatttgactgttggtgctgagtccaattgtagtaattttattgtgatgatactttggnnnnnnnnnnnnnnnnnnnnnnnnnnnnnnnnnnnnnnnnnntatacaaccaacattcgtcggagtatattcttttaagtacaagcatagcttgtaccttaaaaacattctaaatttc

SEQ ID NO: 4443 - DNA, 334 bp, Diabrotica virgifera
  misc_feature (199)..(227): n is a, c, g, or t
gtcaaacatcttatgaattataaattatatactgattactgtgcgaattacagttagcaagggggtcaaaatattattgttaaacctgtacatgtaagttgtatactgtaattgaaacgatctacgcttataagttgatcaagatattcagtaaattttgattcttaaatatattgcaacaatataattatttaagaannnnnnnnnnnnnnnnnnnnnnnnnnnnnatgtataatcttaagaatgatacatttatatcatgtaatttcaatctagtaattaggaataactgatatcatcaatgatgatatgttacaagtgatgtttacatatt

SEQ ID NO: 4444 - DNA, 375 bp, Diabrotica virgifera
cccacgcgtccgtgaacatcaagaaactcatcgagctgcagcagcagatactttggcttatttgacagaggttgacagcaatcttcagcaggtggcagctatcagtaaccagttagttagtgctctagtcgatctattgaaatgtcccagtgttgctgctcgtggagctgctttcagggcatttgcttctttgggagccaatgatgaggacatcagaaaaaggatcatcgacaccaaatgtttgatggatcgtgttgtggatggattaggagatgacaataaagaaataaggttagcagctgtaagatgtttacactctttgagcaggtcagtccagcagttgcggacaacttttcaagatcattcagtgtggag

SEQ ID NO: 4445 - DNA, 393 bp, Diabrotica virgifera
  misc_feature (90)..(108): n is a, c, g, or t
  misc_feature (110)..(122): n is a, c, g, or t
attaatgtcaagtcaagaatgttactgtatgttgtagtcaaagtaattaatgattttaatcaatgatagataattagtattgtgatagannnnnnnnnnnnnnnnnnngnnnnnnnnnnnnngtgtaccttgcgtgtcaaggatgattagttaatggttacactcattactaatttcgcatttattgtatctctcgagttataattttgagtgttcggtaaatagtttatatacgtttattcgtcatcagatgatattcgtttttaaatagagcaaattttttaattaacctgttaaatttagttaataacagcataactgtaattagttagttttaaaagattaatgttcaagatctttagggttgatcgtcgcgattaaactttatgaaaa

SEQ ID NO: 4446 - DNA, 65 bp, Diabrotica virgifera
accaatcggtaaaagtacaaaaaaaagtttgggtaaacttttgcacaactgtgtaaatactaacg

SEQ ID NO: 4447 - DNA, 70 bp, Diabrotica virgifera
  misc_feature (4)..(4): n is a, c, g, or t
agtnctcgcagtaggtccgggcgtggtccggcactcaactgttgggtatcgcctcggtggcgttggttta

SEQ ID NO: 4448 - DNA, 107 bp, Diabrotica virgifera
  misc_feature (4)..(53): n is a, c, g, or t
gtcnnnnnnnnnnnnnnnnnnnnnnnnnnnnnnnnnnnnnnnnnnnnnnnnnnttacacttatcattacttatgtgtgaaatagtaagcttagtcagtgttatggac

SEQ ID NO: 4449 - DNA, 412 bp, Diabrotica virgifera
  misc_feature (281)..(320): n is a, c, g, or t
  misc_feature (381)..(381): n is a, c, g, or t
cgacgattacaagaagcgaacccgtgagcagagcgaatgcaatatacgaacccacgagcagtgcgatagtactagcgatatgaatataccgccccgtgaacagaacgacaatggaaaccattcgaacacacgaacccatgaggtgagcgataatgaaaccgattccaataaacgaacgcatgaacaaagctctagtagtgacgcctttaataacagaacccatgaacagagcggtagtggtagcggttccaataaacgaagccttcaacagagccctagtnnnnnnnnnnnnnnnnnnnnnnnnnnnnnnnnnnnnnnnngtggtagcggttacaataaacgaagccatgagcagagcgatcacggtagcggttctaatanatttatccacgaggagagcgataatgatgac

SEQ ID NO: 4450 - DNA, 395 bp, Diabrotica virgifera
aaaaaggtccaaatttgaataatgtctcgctagattctcaaagctatatttgtttaagcaaaaccgaaaagtctatttttatttgaaggatacaaagaaagcttgcaaaatttctggttgaaactgaaatctcccaacaaaatttcaaatacgacgcatacattttttactccccgtttcttataaatctatatcaagaaaaaactacaataaatcttaaatgatacattaatacaaaggtttgacaattttttcacattgaaggggtcgattatttcgaaggtacaataaggtagaactatttcaacactacgatttcaaaaagttatatttctctatgaaaaatcaaaaggtccaaatttgaataatgtctcgctagattctcaaagctatat

SEQ ID NO: 4451 - DNA, 388 bp, Diabrotica virgifera
agttccacaggcagtgtgttgggtccggtcctatacctactatacacgtgtgatatacctgtactggaaaacaacacagttgccacctttgctgatgatacagctattcaagcagtagggacgacaagtgaagaggcgaccaacaaggtccaaatagcagttaaccaaatctataagtggacacaaaaatggagaatcaggctaaatgaagctaaatctgtccatgttaatttcaccaacaaaaaaatacaatatataccagttataatcaacaatatccaagtaccatatgcagatactgctaagtatttgggtataacattagatgcaaaactacgctggaaggtgcacgttaagaaaagaaagggaagaactaaatataagatat

SEQ ID NO: 4452 - DNA, 334 bp, Diabrotica virgifera
agttttatggctgcatccaccagtctcctgtgccaggtttccgttgtcataacatctatcagcaagccaccatgtcgagttgcgatggatatctgaatcgtgccatgtccgtggcatgtgcggaagccgtcgattttgtaaccgtcccatgcttggcaggatggttgctctaggacttcacgctgttgttaactacaatgagacggctaagacatactgtctgtacttagtacgcacgtgagacgatctgcatctagtaccaaacacgtcagttgaagtccgtaaccatacttcatgcgtcaagttcactgattctatttacgattcagtgaca

SEQ ID NO: 4453 - DNA, 372 bp, Diabrotica virgifera
cttctaactaaaacgaaattcatgccagaacccgaaggatggagaaggagtcacaggccatcgatcagggatataagtataattaacgaagaagaggaaaaagaaccgcaagaagtctctagtgattcggggcagatcaaaactatagctgtcatcaaagaggttgtttaaacaagtaaaatgaatctgtcaaaatggaaaaaatagtttgcttggaattatttaaagttcaattttgatgatacttcatgatctaacgaacctacagaagtaacaaaactgatctaaatttgatctttgtctaagtttaaagagttctcgtagaaaaaaaaatagtgtgcgctgtacaatcaacttatttcgaacaacata

SEQ ID NO: 4454 - DNA, 265 bp, Diabrotica virgifera
acttaagaggtgctgatgtgggatcagaccacatgctaatcaaagcgagactaaaaatgaaattagccagagataaaaaccaaaaaatcagcagaaggaacaagtacaacgttgatgccctaaaacaagaatgtataagaaataaattcagtgagaaactggcaattaaccgaacagtatcacaacaaactggagagtcagtcgaagaaacatggaaatattttaaagaagtgatgacgaatacagcaaaagaaacaatcggatt

SEQ ID NO: 4455 - DNA, 371 bp, Diabrotica virgifera
  misc_feature (118)..(146): n is a, c, g, or t
acccacgcgtccggcaccctgatgatggttgtaatcatgaccgaaagcttggattacggaaacttgaaagagtgcgcttttcatttgctgcatagcccaatatcctaaatttctttcnnnnnnnnnnnnnnnnnnnnnnnnnnnnngaataaaagttttcaaaaaaaaactctatatattcaaaggtaaaagtgtaaatttctaaagttttaaagtgattatttcgacatttatattaacctgatatttctgatagatttatgtattcaaatctgtatgtatatatccggtagttccctgtaatttgtgtccatgtgggggacttttttataataggttttactacagaatggctattcttcataaggggc

SEQ ID NO: 4456 - DNA, 263 bp, Diabrotica virgifera
  misc_feature (28)..(57): n is a, c, g, or t
tccaagcctccaaaataaattcttatannnnnnnnnnnnnnnnnnnnnnnnnnnnnnggcgcaacgtaaggattaaatttaaagtgggggtagattccaagtgatgagtccgcaaggggggcctcctagaattggtttaaggtgccgtttgtatcaagggtaattaggaggtttccctaggggtaacacatttaaaatgggcggaccttcgtgttcaaggtatttactgggttaaacctagttttgcccgtttaaatggcctt

SEQ ID NO: 4457 - DNA, 168 bp, Diabrotica virgifera
  misc_feature (111)..(126): n is a, c, g, or t
aatacgcttgggctaacacatgagcggacgcatgtgtccatgttgggaatcggctgacattctgtggcagtagtagcagtttatcacagagaaacatacacggtcagcacnnnnnnnnnnnnnnnnactcttacgcgatccctgactacttgaagtgtcatgtgtagc

SEQ ID NO: 4458 - DNA, 419 bp, Diabrotica virgifera
  misc_feature (5)..(24): n is a, c, g, or t
  misc_feature (165)..(165): n is a, c, g, or t
  misc_feature (384)..(404): n is a, c, g, or t
aaagnnnnnnnnnnnnnnnnnnnngaaataaaattggccaattacccgggttaaacggccttgcgggccgggtaaaacttcaatgcgggagcaaatgaaaatgagggaattcaatgatttgcaattcacatcccacctgtcaagcgcggaaaaaatccaacgaanaaatggaccctacatactaatacaaatgagtaatactaatacaaataaaaatgaataaccattttaagttcggtaagagtgcttgtactgctctttaagagaacaggaatataacgcagctttggcttcgtgttgcaacgaaatgaaaatggttattcgaaaatggaaaatcgaagtaaaacaggcatgagcctaatcataattttcctttgattcctnnnnnnnnnnnnnnnnnnnnnccctgggtttttttt

SEQ ID NO: 4459 - DNA, 422 bp, Diabrotica virgifera
  misc_feature (11)..(41): n is a, c, g, or t
  misc_feature (49)..(68): n is a, c, g, or t
  misc_feature (93)..(129): n is a, c, g, or t
  misc_feature (148)..(179): n is a, c, g, or t
  misc_feature (181)..(216): n is a, c, g, or t
  misc_feature (218)..(246): n is a, c, g, or t
  misc_feature (263)..(294): n is a, c, g, or t
  misc_feature (314)..(421): n is a, c, g, or t
caagcgtccgnnnnnnnnnnnnnnnnnnnnnnnnnnnnnnngaaaagtnnnnnnnnnnnnnnnnnnnngataggtaaataataatgtgagagnnnnnnnnnnnnnnnnnnnnnnnnnnnnnnnnnnnnngaacctgggtaacaaggannnnnnnnnnnnnnnnnnnnnnnnnnnnnnnncnnnnnnnnnnnnnnnnnnnnnnnnnnnnnnnnnnnngnnnnnnnnnnnnnnnnnnnnnnnnnnnnntaaggaaaggtaatccnnnnnnnnnnnnnnnnnnnnnnnnnnnnnnnncatagatttacttaataacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnt

SEQ ID NO: 4460 - DNA, 229 bp, Diabrotica virgifera
  misc_feature (34)..(49): n is a, c, g, or t
acaccttccaacaaatgtggatagagaggccaannnnnnnnnnnnnnnngatacagagtattttctatctgtgggtgcgatgatcgtaagcgacattgtacgatgatccagtggagtgatttctgtccgcagtctttcagcgcgagcagtgaactttgaagtgtctggattcaaaagtatagcagatagagactgagactaagtattagtatctcaattgatgtaagtt

SEQ ID NO: 4461 - DNA, 215 bp, Diabrotica virgifera
  misc_feature (138)..(156): n is a, c, g, or t
tttgaatggccacggcattttaagcgggttaaggtagtataatcattatctttataactgaaagctgggacacatggttggatgaaaaggttactgtctttattgactttagactgaatttatatttatgttcatagnnnnnnnnnnnnnnnnnnnagcagtagagcctatatagttttaagaattagtaataagtttttttaggactaaattta

SEQ ID NO: 4462 - DNA, 351 bp, Diabrotica virgifera
agcgtattgagcgttgaataacgttagaaataacattagaaacaaaaaataaacaatatacttgccactaacaacatcaagcgctagaaagtaatttatcaggtaatatttatgtaccaagtcactaaagtgactctttatcgaacgcgtctgatattacgagcagagggagcgaagcgagcgaggcgagtaaccgactagttctataaagagtctttactggcgtggtgcatacaaaattttatcgccaatcgcaaaaaacataaatacttacttaacacttacttaattacatcatccttctaataaaaaaagagcgtgtgtactttgtacacacttaattatacttct

SEQ ID NO: 4463 - DNA, 218 bp, Diabrotica virgifera
tcgacccacccgtccgaaaaaatatcctacaatttggaatacattttgtcgtctacccgtcgcctacccgaagtatatgtgtagcctacccgcatactgaggtcacgagccgccactgacatctttgccaagtatgccaatttcaaggaaataattaacatttagacgcactcgcgacccctattaaagaaacggcgaaaccaagcgactccattttc

SEQ ID NO: 4464 - DNA, 366 bp, Diabrotica virgifera
gagcgaaagtgccattggtggaaaagataccaaattattgataatcatcggtggtctagttgcagcagtgggagtcgcagcttttgcttataacattatgaaaaagaggaaagctactgctgcagagtccagagttcctacccaaatgaacggaaatggggacaggaatgatcccgaagaaggacgagagatgaaacctttgatgaagtctcctcagccaaacagcagtgtcgaatataaagatgaaaaataggaagtgtgtgagtgggaaacaaaaactctaatatttattatgttatattaatgaataggttgcattatgttaaccgtataagcatggacaaatgcattaaagtacaaacggga

SEQ ID NO: 4465 - DNA, 358 bp, Diabrotica virgifera
  misc_feature (151)..(180): n is a, c, g, or t
acgcgtctgaagtaacttgggcaatgtatttataataggtaatgagttttgaatcgtattagtattatgctagttgaatagtaaatgagtgactataattatatgttcgtagagtgtaaatttacgtagagtttgatgttggtcattggannnnnnnnnnnnnnnnnnnnnnnnnnnnnntaggggtatatattcgagtttacttttaaggagtgttaatgtccttcaaatggggtccacaatttttattttcggggcgtgtttttctaaagtttttacgggggaattccggggagatccccaccagttccccttggaaaaaaatcccttttgttaacaaggggtatatttataaggg

SEQ ID NO: 4466 - DNA, 412 bp, Diabrotica virgifera
  misc_feature (8)..(40): n is a, c, g, or t
  misc_feature (56)..(114): n is a, c, g, or t
  misc_feature (118)..(135): n is a, c, g, or t
  misc_feature (137)..(402): n is a, c, g, or t
ttcggggnnnnnnnnnnnnnnnnnnnnnnnnnnnnnnnnnccaaatttaaagaacnnnnnnnnnnnnnnnnnnnnnnnnnnnnnnnnnnnnnnnnnnnnnnnnnnnnnnnnnnnggtnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatagtaat

SEQ ID NO: 4467 - DNA, 369 bp, Diabrotica virgifera
ctttacccacagttcatgtatcacttaagaagatctcaatttcttcaagtattcactaattctccggacgagacttcattctacagacacatgttgatgagggaagatcttactcaatctttgataatgattcaacctaatttgtatagttatagtttcaatggtccatcatagcctgtattactagatactagctccattcaacctgacagaatattacttatggatactttcttccaaatattaattttccatggagagactatcgcccaatggcgtagtttaaaatatcaagacatgccagaatatgaaaactttagacagctactacaggctccagtagatgatgcacaataaattttgcaaact

SEQ ID NO: 4468 - DNA, 449 bp, Diabrotica virgifera
  misc_feature (69)..(123): n is a, c, g, or t
  misc_feature (125)..(170): n is a, c, g, or t
  misc_feature (181)..(212): n is a, c, g, or t
cgggtccatcaaggcgtctaattttttactatatatttaaattcgtggtaatcacttttttttacttcnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnngtatatgttcnnnnnnnnnnnnnnnnnnnnnnnnnnnnnnnncaaaccaaattaacaaattattcctagtttacaacttgtatttacataatttaacattttacagaaaaccttaatcataagtttattacaaagtcatttatatgtgagtagtgtggttaagtttccggcacaggtagaaagaaataaaggttaatctgttgcccatttaattattatacctgctattcagtatatttactcctcaaaacttaacgactcaactcaaatacaaacgat

SEQ ID NO: 4469 - DNA, 371 bp, Diabrotica virgifera
  misc_feature (287)..(308): n is a, c, g, or t
  misc_feature (325)..(342): n is a, c, g, or t
aaagacgcatgagttaaaatcaataatgatgtttttaacaataataaaacaatgattatattaactgataataaacgattattgtacgaaatcagcaacattttattcacatgtaattaattttcaggaccttgagtagcagggatgattaattaataattacacacctgcccattgcgaatttagaatagccacagtattaagactgtgcttgtgaagcaaatacattaattaatttattggtaactaaaattaatgctttgttaaatacaacactgtctttaagnnnnnnnnnnnnnnnnnnnnnnaacaatacattaacacnnnnnnnnnnnnnnnnnncataagaccaaataattttaaggatgatc

SEQ ID NO: 4470 - DNA, 320 bp, Diabrotica virgifera
gccagtatacaacatgttcgccttcatattcttgtgtttacttctacaaactttaacctttcctccaaccttgggtcgagacgctgatcaaaatgaatatccattgatcgtagcagtagaatcatgcaattttccagtatgttatccacaatgtgctggagtggttctttccaaaagttggatacttacactaggaagctgtgcctatgttgccactaacttcgatcattacaggataaatgcaggagtagtcaatgttaccagtgaaggcgcacaactccgagacatcgaaaaagcattacttcatccagaatttaact

SEQ ID NO: 4471 - DNA, 381 bp, Diabrotica virgifera
aactactcgtccgcatggggtacccgcgaggtcactgtcgcagccaaagcgcacgatgcaactcaagatgctacaccaagtgcatcacctgctcctgcgcccatttcaagccaaccattatcattttttggtaactccaaagataatgcgggatccctcgagttttctttcggacgactttttaaactagtgtgttgtacctacgatagtagtggcgaagaaacggaagtactcacgatcatacaaacctccattcagactatgcatgaattcttggcccagatggacaatcataaactatgagctacagattcgatcctgaaaccaagacaaatcgctagtcacactcagcattttgtgggtttacaagcttgaagattt

SEQ ID NO: 4472 - DNA, 198 bp, Diabrotica virgifera
agtcaatacacagtttgaaatctaggaatcttttttgacagtgtccaacggcatggagtaatgatagtcccgtagtcatgccagagggtattttaattctaggggtgatcaacttcatttttgcaacttgtgtaactgggatcatgaattcatccgtaaattaggaataatgacgtactagttagggctaaaccctta

SEQ ID NO: 4473 - DNA, 438 bp, Diabrotica virgifera
  misc_feature (54)..(84): n is a, c, g, or t
  misc_feature (349)..(365): n is a, c, g, or t
gggccgacccaagcgtccacccacgcgtctgattacttcgtaatttgacagcannnnnnnnnnnnnnnnnnnnnnnnnnnnnnnggatttgactatcaaaaagaaattcttaatcatgttacataggctacaatataattagtcaatctgaagaaacctaacaatctataaaaaatacttcaacgaaataataataattgaattttgtttgaataaaaattcttcaggttggctagtatttgaccgatttctaatatgtcctttcttatttagatgttgagggtataaaatatgttgtaaattacgattatcctcactcctcagaagattacattcacagaatcggtannnnnnnnnnnnnnnnnagtgccggtacgtcctatgcatttttcacaccttccaactataagcaagctagagatctgatctccgttctca

SEQ ID NO: 4474 - DNA, 326 bp, Diabrotica virgifera
  misc_feature (177)..(212): n is a, c, g, or t
ccggatgagttttatgtttatgttagatagcttagtttcgtttaaaagacagctagacgctttagagttttattgtagtataaatatgttagttaagtattatgtttagttatgtgaggcgtttatttaaatggggtgatttataagaaatgtttagctttttatatattaggatcnnnnnnnnnnnnnnnnnnnnnnnnnnnnnnnnnnnntaatagtatcatggagtagggatcacatcgtaatttaaatggatagttcagatcgataataattgaggcgaccacgatgatggtttaaagtttatgattggtgaagcagatata

SEQ ID NO: 4475 - DNA, 442 bp, Diabrotica virgifera
  misc_feature (55)..(76): n is a, c, g, or t
ctcgcgggccgacacaagcgtctacccacgcgtctgcccacgcgtccgaaacacnnnnnnnnnnnnnnnnnnnnnnatggttatcagaagatattccagataactggagagagtaccgggtgattcctattctcaaaacaaatcggaatcctgattcagcagaatcttatagaggtatttcattgagctcctgcataacaaaaacactggaaagaatgataaaacttaggctcgaaagttggctagaaaaaaacaataaattatcacaaacacaatttggatttcgaaaaaatcattctactgtggaagctgtgagtcatttggtaacagatataaatttagcgtttacgaaaaattcttcagtaatcgctcttttattagatgttgaagcagcatacgacaacgttaatttaaatatactatataacagaatgatacaaat

SEQ ID NO: 4476 - DNA, 188 bp, Diabrotica virgifera
  misc_feature (21)..(38): n is a, c, g, or t
acttacagaagaatgatcatnnnnnnnnnnnnnnnnnnagctgctgcccccattgttgctacatgtgcccatctacgtgccgtcacataataggttaattttacggccacccactgtaatccttgcaccttgcgtgttcacgaccaccgtttcgctcattatctacgcaatatttacgaactcaatgc

SEQ ID NO: 4477 - DNA, 351 bp, Diabrotica virgifera
aaaatatcacccagcgttgtcacttctttcaaattttctctttttgttagaaacaggtaccttcctagaaatatctatgggaaaggaggaagacctaacccttcggtcctaacttaactttcgggtattagagtgtagagcgcaaaccggccgatttcaggtaagagcgcaaaacggtcgagcgcataccggccgacaccgataatttgtgttaaaattgccgcatatgccaatgttgaactaaaacaaactctaaaagtatttgtctaaaagtataattttcctataaaaagcctatatcactatgtaaatttcctaagcagtataaatattacacgatttggaaacaat

SEQ ID NO: 4478 - DNA, 215 bp, Diabrotica virgifera
acccacaagtcagcgtcttctgagggttgtttaccttacgttatagctttcataagcatacggcagcaatgtatctgcactgactacaacatttgcgccatgatacttcaagaagtaagacttacgtacaagctctctaaactgaccctacatccaacaagtcagatttcaccacacgatgattccaacagatgtatgctagtacatgagtaatt

SEQ ID NO: 4479 - DNA, 249 bp, Diabrotica virgifera
ccctaggttatggcattaataagcatacggcaccagtggacgtgccaatgagtaacatcgtttcggcgatagagtactgtcatgaagtaggagctacgtagcaggtgacgaaactgacactggaaccagcgagtcagatatcaccagcagagggagctaagcgagggaggcgagtacctgggtagttctactagtagtcgctacgggcgcggtgcatgcgatactcgagcaccaatcgccatgcagatg

SEQ ID NO: 4480 - DNA, 342 bp, Diabrotica virgifera
  misc_feature (43)..(69): n is a, c, g, or t
gacccaagcctctaaaattactcatattattctttttgtgtcnnnnnnnnnnnnnnnnnnnnnnnnnnnggacaccctgtataaataatcatgtaaatatttatattactgaatagggaattgaataacctttcaaatgagctagcaaacgacccccattctcagtttaaaaaatagtcgattacgtcatggtaaacacggaagacatggtaaaaggtttccatttccttgtggatacttttccagctcgagccaagagaatgaacaaaattctcaaagtgaaaaggaagaacaaaatcccctatgtgacaaggaaggtactccgggccgccggcgccgata

SEQ ID NO: 4481 - DNA, 414 bp, Diabrotica virgifera
  misc_feature (225)..(242): n is a, c, g, or t
agtgagtcctagtattagcttgtaatgtactcaaatagtcttatgataattactctgtattagttattaataccccttatttgttaaagtggtcctctcgtttaaaaaataattacgaatataacaagtggtcatgtttgctgtatcgttgggaatcacgagttaagtttcttgttttatttcacaatcaatataattttctaacaactaatattgtgattcagnnnnnnnnnnnnnnnnnncgccttcaagttggttttgcttttgtatcaaccgtaatagatagggtgattcattaagaatgtccagtctctgggttgtagattctagacctcaaaatattacgattctgcccaatatgccttattttaatagtcaagctattgcaaatgtcctagcaatatctacctgttt

SEQ ID NO: 4482 - DNA, 415 bp, Diabrotica virgifera
gtatattccagttaccatggttatggtggaatcgtcaactggattttagtccgacctactttacagataactgcaaagttatcttattgcatgtatctaattcacggtttagtaattacacatgctacgttgataacaagagacaggctatttttcagcgattgggtagagtttaataattggtgcgcatattttatagtatcttttctacttgcatttgtatggtcattggctttcgaatcacccttaattataatagaaaaattaatttttggaggagctaccccaagaaaatctaaacctaaaaataaaagtgaaaacgctgaaaatacacaagatgttcaaaacgcagcagtgtaagaaatatcctattggaggttaatgtaacataaatactcaaatgtctgaaatgtat

SEQ ID NO: 4483 - DNA, 386 bp, Diabrotica virgifera
  misc_feature (47)..(72): n is a, c, g, or t
  misc_feature (74)..(89): n is a, c, g, or t
ctcgcgggtcgacacaagcctctatgatgagtcctaatcattcgatnnnnnnnnnnnnnnnnnnnnnnnnnncnnnnnnnnnnnnnnnnagaatttataagactgttatcagtcctacagtaacatacgcatgcgaaacatgggtgctgaaaaattcagaaacagacctttcagaaagaaggaagagaaaaatcaaagagtaatatatgggggtgtgcaaatagaaggttagtggagaataagaaccaacaaagaatttgaagaactgtataaagagccaaagataacgacgacgatcaaagcacagaatatacgatatttgagccacatcgaaagaatgggaagttaaagaatgccataaatggtactctcacgaaagacaatac

SEQ ID NO: 4484 - DNA, 275 bp, Diabrotica virgifera
  misc_feature (17)..(90): n is a, c, g, or t
cgacccacgacgtcagnnnnnnnnnnnnnnnnnnnnnnnnnnnnnnnnnnnnnnnnnnnnnnnnnnnnnnnnnnnnnnnnnnnnnnnnnncataaggacgtccctggctacctttccagcagtgtagctaagttggtatgtaacgaactcagcagtggtaaccatgttgcgattctcccacattggtcggtggttcacatactttggtcgagcagttcaccctctgcccttagcatagcccgacttacaggatttatccgaattgcactttgacc

SEQ ID NO: 4485 - DNA, 295 bp, Diabrotica virgifera
  misc_feature (70)..(91): n is a, c, g, or t
tgagtcgtattaaggttttcacactttagaataggtcattatttatatttatacagtattatttatacgnnnnnnnnnnnnnnnnnnnnnncaaaaattccaattggttagatctagtaatgatgatcctatcagtcgtccaatattgtaaacagagtaaactgatacaggttgaatactggaattcggtaccattttttgcacctgtttatttgatccatctcgtggtggggatcctattctctcgcgccagcccactgagcaatttggtcggccgcagttatatgaccgtgct

SEQ ID NO: 4486 - DNA, 361 bp, Diabrotica virgifera
  misc_feature (282)..(300): n is a, c, g, or t
  misc_feature (325)..(339): n is a, c, g, or t
  misc_feature (342)..(357): n is a, c, g, or t
aaacctggacaacaaaaaaagaccaattacaatcctggacaaaacaattaaaatggtaaattttttccggtaaggtaattaaccaaagaaattaacccttaaacttgtaaaataacaccttgagacgtgaatctgcgataatatcaaacacatctgaaattgttttgatttttcaattttatttgaataattacaaaaaacaccgttttttttgtaataaaaaacgcaaatattttgtcagcgtgtcgactgtacttatgcatcaccttatgctagttcagnnnnnnnnnnnnnnnnnnngaaataattaaatcgttttaaatgnnnnnnnnnnnnnnngcnnnnnnnnnnnnnnnngtat

SEQ ID NO: 4487 - DNA, 249 bp, Diabrotica virgifera
  misc_feature (120)..(158): n is a, c, g, or t
agctgggtgaatggtgatacatctggagattgttatagagaccttttggccatactcgactatgtctacaaggaaacttttaagcactgtaatcttaggaggaatctgtacgcctttacnnnnnnnnnnnnnnnnnnnnnnnnnnnnnnnnnnnnnnnctagaataaacgcggtttttgagggttgccgtcgaaagttatctacaggcactgagacgcaacgtgtttttcgtttgagtgtaacctaacc

SEQ ID NO: 4488 - DNA, 404 bp, Diabrotica virgifera
ggtccacgcacgcgtccgatcatatacgtcctgaatcttattttcggtaatgacattgggaaattgtaacaaaatgtctgaaaattaatttagaaataaggtgaatactattaaaaagcaaattttattttagtgataacaaaatattgaaatataccaaacatctaataaaaaacattgcctactagaattttttaaataatatcaaaaatataccaaaacagtagatatctactaaatgtggcaacgctgttaaggagaatgatgcacttcattgcactggtcacaatgacctctgtcacagcatagaaaacgcaacagcagtgacacactagtaggcgggaaaagttcgcgcactattactgcgcagatcgtcggccattttgtgcgtagtacagacaatg

SEQ ID NO: 4489 - DNA, 429 bp, Diabrotica virgifera
gtttcgatctttgttttattattaaaggactcttaaatcaatagaaacactcgatcatatatttgattttatatttacctaatatgttactcattaaccattacagaatgctgaatagaccatcgctacactaacaatccaaaatatctaccaaaatgccatgactagtgtaagactagctgaacaaaaagcaaattttgtatacagggaggagtgcgacaaggagacgctgtttctacaaagctcttcacaacataactcttttacgaagtttctgaagccacatctgaacgagtttggtattaacctaatgtttgttccaactcgacgaagaaccgtcatgtaacgattacgttactataacattaatgttccatgggaacgaattaatacgttccatggtactgcacaggacggtgatcgttacat

SEQ ID NO: 4490 - DNA, 379 bp, Diabrotica virgifera
aaccatccatatggctactccaatatgaagtatgtagcatcattgatttcaggtgttggaatcttttgtgtaggtacaggattgtcagtttaccatggcatatctggcctgcttcatccaactccattggaagacttcttttgggcctacttcatattatgtggttctctagtatcggagggtgccacttggttagttgcatttaattcaataagaaaaggtgccagagaagtcaatatgactgtaaaggaatacatttttagaggccaagatcctagtgtaaatgttgtcttgttagaagactttgccgctgtgattggagttatagtggctgctggttgtatgggggtgtcgtctgtaacaaatagtcctgtacctg

SEQ ID NO: 4491 - DNA, 167 bp, Diabrotica virgifera
atagcacatgactatagatctaccataacaattcaaacaataacaacttcaaagaaacaacaagtcacactgggaagtcattcataattctaacaactacgtacttcagttctgacaacataaatatctgtagttctcgtttaactatggtttttcaaatcttccta

SEQ ID NO: 4492 - DNA, 363 bp, Diabrotica virgifera
  misc_feature (25)..(61): n is a, c, g, or t
  misc_feature (79)..(111): n is a, c, g, or t
  misc_feature (128)..(178): n is a, c, g, or t
  misc_feature (189)..(350): n is a, c, g, or t
gaaaggtaattaataatgggagagnnnnnnnnnnnnnnnnnnnnnnnnnnnnnnnnnnnnngaccctggggaacaaggnnnnnnnnnnnnnnnnnnnnnnnnnnnnnnnnnccaaattaaaagaagcnnnnnnnnnnnnnnnnnnnnnnnnnnnnnnnnnnnnnnnnnnnnnnnnnnntatggaatggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggattaaaaatt

SEQ ID NO: 4493 - DNA, 431 bp, Diabrotica virgifera
atagtttcaagcagccccggagtgttatacggactattgagtttccaaaatcggaaagtgaccaccagaaagcgatcaacgcattcaaacgtattactactttagatacgcagtgggccaaaaggtgtttggaagatcgtcagtataatatgaaaatggcgttattgctgtttgtagacctttacaaacaaaataaaattcccccagatggttttgtaaagacaggtacaaataatacatatgaaggagttggaaacgaccagtacaaccaaaataagaagatgagggtgtaaataagtttaccaaaaatgtacgcccaacaaaatataactttatttggtttgatccaagttgaaatatcgtatatttttggtattttgaaatcatgtttcaaggtacaagtgtgtgtgtattaacattttatagtgaaa

SEQ ID NO: 4494 - DNA, 289 bp, Diabrotica virgifera
  misc_feature (6)..(91): n is a, c, g, or t
  misc_feature (219)..(239): n is a, c, g, or t
  misc_feature (276)..(288): n is a, c, g, or t
cgtccnnnnnnnnnnnnnnnnnnnnnnnnnnnnnnnnnnnnnnnnnnnnnnnnnnnnnnnnnnnnnnnnnnnnnnnnnnnnnnnnnnnnnngggtataatattttatttggaaaattgtcaatgtaaggggttgttgtaagttttgagtttagtttgttttgaatgtgagtaattttttaggttttttaatttggtgttttttgttattttgcctaccnnnnnnnnnnnnnnnnnnnnnggctgtttgttctgattggcttttttgctattggggnnnnnnnnnnnnnc

SEQ ID NO: 4495 - DNA, 316 bp, Diabrotica virgifera
agatatcttcagatgagattaaaaacgtttatctacacattcgaaagtatacagaatccgtggtgcacctagtaacatttacagtgtcatggtatgtttaggtctactgcatcgaggatgtactactgtatttataatgaactctcgttcaagatcacagctctcatatctttaatggtcatgacacttacgcattgacattgactgcaattgatataactcacgatggcccgtgtttggaggtgtcaaaagttcgcatgtcactgtagttgtgatattagataataggttgtcaacatggttcggttcctacgta

SEQ ID NO: 4496 - DNA, 271 bp, Diabrotica virgifera
  misc_feature (13)..(122): n is a, c, g, or t
  misc_feature (140)..(238): n is a, c, g, or t
  misc_feature (250)..(250): n is a, c, g, or t
gcgtccgaatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaacctggggaacaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgaaatggtantcgtttttaaatatatccaaa

SEQ ID NO: 4497 - DNA, 439 bp, Diabrotica virgifera
  misc_feature (208)..(226): n is a, c, g, or t
  misc_feature (255)..(271): n is a, c, g, or t
  misc_feature (359)..(380): n is a, c, g, or t
gggtccacgcacgcgtccgaaaaatatgaatttcactcaagagtaaagtatcgttaaatttcacaatatcgaaaattgttattaagaaaagttgtttggaatttaaaaatttgttatagtgttcaattacatccttctaattaaaatattgtgaataataaaggcacttaacaattgagaagaattcatattttttacatacctcgtnnnnnnnnnnnnnnnnnnnatatctgatggttgtatcttagattttannnnnnnnnnnnnnnnntatgaagaatgactttttttcgtaaaagtgataataaaatagttatcataattgtaataaaatgatgatgagtatccgtaatttgagnnnnnnnnnnnnnnnnnnnnnngattagaataatgtaattgtatatttaaacatagttttttaattcaaacacaacacctc

SEQ ID NO: 4498 - DNA, 236 bp, Diabrotica virgifera
  misc_feature (43)..(68): n is a, c, g, or t
acacgcgtccgcattctcagaacttttttatcataataggtgnnnnnnnnnnnnnnnnnnnnnnnnnncactcatgacagcaatactacatttccatagggtacatttatagtttactgctgagtttagtgcaatatacatttatattattgacctttagtactgatgatggtagtagtacaggcaaattgtatatctcgtgatgatatctaggtttaatgtaggaattcagcacc

SEQ ID NO: 4499 - DNA, 413 bp, Diabrotica virgifera
  misc_feature (357)..(375): n is a, c, g, or t
gcacgcgtctgcacatcgcgtctggtagcccgttgggactctttgaccgaattagacattagagataatccatggacttgtgactgtgaaaaccaatggctaatagacgaattaatgcctatttacattaaaatcgatgaaaattctgccaagcaggttatgtgtgctgctcctattgagatggaaaagacttccttccatcagcttctagttcgccaaagtcagatgagatgtttagacagttatggacatagaccagaaaaggacggactactacttgtaggagtcttaacagataagaatgtggaagagaccaacaaaccaccagacgcattaccagaatcagatgagtcactnnnnnnnnnnnnnnnnnnngagcaagaaagtgatgacgattatgttgaaatgaatga

SEQ ID NO: 4500 - DNA, 411 bp, Diabrotica virgifera
  misc_feature (398)..(398): n is a, c, g, or t
aaacatgaaaaccattattcacaaaatagtggaatacggcaggcttttttctagtcgtgactgattttctaaataaaaaggaggcaaccacttttaaattgcatagaaacagtaagtatttacaaagaaaatgttgaatcagacaatgatccaaaatcacctaaactttttgattaggttctggaatgacaaatgatatgctacatccattcattaagacaattgtaaagcatggtttaaacataaacatatcttacactatcatgattacaaattgagtagtcaacagcacgttaaaatcaaaaataaaacgcatgagatatgatttacagagaaatccaaaaccatcaattaaaaaggcgaatctgtcttcgataataggttaggttcaatattantgggtgtataaac

SEQ ID NO: 4501 - DNA, 382 bp, Diabrotica virgifera
  misc_feature (21)..(138): n is a, c, g, or t
caagcctctaacctgacgtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccccaagaggatcaagccttacttttcctagttatcaagttcaaattccttcaaaattgtcccttaagttcatttaatgggccgcctttttaaaaattcctaactgggaaacccctggttttaccttattaaatccctctacatttatacccaattactctaattgacttaataccaaaaaggttttacaggattagcctttcacaaaatttgcactacctatttggatagaggaacccacc

SEQ ID NO: 4502 - DNA, 317 bp, Diabrotica virgifera
gcttatcgatatttgggtaagtgtcgactaagcagactcagttcaattactacttcttccatgagtgttacgcttttaacctgaaccaagtacatgttgtataactgatagactcttaagtacatcattttttgatcagtctggtgatagggatcaatatctcaagcagacattatttagagattgtaggcatcatgacttatgaagttgaattacaccatagattggctttcaatgctcagtcttgtgaggcacatgataggtcaataagtgacatttggaactttcgaaataatatatgctacgactgcaattgg

SEQ ID NO: 4503 - DNA, 370 bp, Diabrotica virgifera
  misc_feature (54)..(74): n is a, c, g, or t
  misc_feature (95)..(116): n is a, c, g, or t
  misc_feature (132)..(165): n is a, c, g, or t
  misc_feature (167)..(180): n is a, c, g, or t
  misc_feature (219)..(242): n is a, c, g, or t
  misc_feature (289)..(320): n is a, c, g, or t
acgcgtctgcacagacgtccgatttttgaataataagtaaaattttaaccgggnnnnnnnnnnnnnnnnnnnnnccgaaggcatttatggtaagnnnnnnnnnnnnnnnnnnnnnnggtaatggcttagatnnnnnnnnnnnnnnnnnnnnnnnnnnnnnnnnnncnnnnnnnnnnnnnngataactttttaacaataagagtttgtaaggttcttatnnnnnnnnnnnnnnnnnnnnnnnnttcgtgtttatggtaatgattatatttaactttttcttctttatgannnnnnnnnnnnnnnnnnnnnnnnnnnnnnnncctttaggttttaacaacaatttttgagtaattcaatgattaatatttgg

SEQ ID NO: 4504 - DNA, 396 bp, Diabrotica virgifera
  misc_feature (13)..(31): n is a, c, g, or t
gtccgcagccgannnnnnnnnnnnnnnnnnnacgatccattcccgttccattttccattatccatatctgttgaagttgaactttaactaaactttttgttattagtgaggccaatagaaaaatactagagagttacaaataattttctaaaaagtgaaagttccagtcatgcttctgccattgttgttgtgcagatgctggatgatggtgccagtgtcattcatcattcagtgctatcaagcctttgtgtgaagtgtaaccccataattgggcgtgggtgtcgctgagttaagattttatgaatgttaagagcagaagcagtaccatcacaatcttaagatacacaaatggatttttggttattaacgaaagcttacaatcacatcaaggtgttt

SEQ ID NO: 4505 - DNA, 426 bp, Diabrotica virgifera
  misc_feature (229)..(229): n is a, c, g, or t
gggtcgacacaagcgtctaaagtaaatcatattatctggtcagtttgcattgttgccaagttgtgtctttattcccttgatcttccgaaaaaccaagaggtctagaatgacaataaaactatcagtaggatcgtaattcactgcaactgtttctcctgtgcacgcagttgttcttgacagccttcagtgtttccacgttgtatatgtattgtcttgatctgctacaatnagaaaaatacaagaacactatcagtatgatctgatttcacttaattaaaactataaaatagacttcgtgtcaaatatcttgcttaaatgtcggtcacaggcgtatttatatagccgcaacactgttacatcgtagattttatctgtaaataaggaattttgattgctaacttgtcctgaaagatttacgatctacaa

SEQ ID NO: 4506 - DNA, 67 bp, Diabrotica virgifera
cacgcgtccgaagaagcgtcggattttatttaaataatgtatagttatagtataaggtgagaaaaat

SEQ ID NO: 4507 - DNA, 179 bp, Diabrotica virgifera
  misc_feature (43)..(74): n is a, c, g, or t
  misc_feature (113)..(141): n is a, c, g, or t
  misc_feature (158)..(176): n is a, c, g, or t
tttataaaggaaaattaatttttggaacctggggtacaagggnnnnnnnnnnnnnnnnnnnnnnnnnnnnnnnnccgaatttaaaggagctaaaaggtgagaattttaatggnnnnnnnnnnnnnnnnnnnnnnnnnnnnntaaggaaaggtaatccnnnnnnnnnnnnnnnnnnnttt

SEQ ID NO: 4508 - DNA, 203 bp, Diabrotica virgifera
  misc_feature (12)..(76): n is a, c, g, or t
  misc_feature (113)..(138): n is a, c, g, or t
  misc_feature (155)..(187): n is a, c, g, or t
aggacacgtggnnnnnnnnnnnnnnnnnnnnnnnnnnnnnnnnnnnnnnnnnnnnnnnnnnnnnnnnnnnnnnnnnggataggtaaatagtaatggtaagaaaaaatttaagnnnnnnnnnnnnnnnnnnnnnnnnnnaacctgggtttcaaggnnnnnnnnnnnnnnnnnnnnnnnnnnnnnnnnnccaatttaaaagaagc

SEQ ID NO: 4509 - DNA, 417 bp, Diabrotica virgifera
acccacgcgtccgtaattaagcaaaaataattctttaaaaatttgatattaaatttataataatacaaaatgaatcgtttattcggaaaaggaaaaccaaaggaaccaggtccaagtataacagacgttatatcaggggtggatcaaagagctgaaggtgtagagaaaaaaattaatgccttagaaaatgacttgcgtaaatttagagaccaaatgtctaaaatgcgagaggggcctgccaaaaatgctgttaaacagaaggccctcaagattctcaagcagaaaaagatgtatgaaggtcagctagagaatttaagggggcagtccttcaacatggagcaagctaactttgcacatcaagcattgaaagatactcaagtcacagtagtagctatgagagatggtatgaaagaaatg

SEQ ID NO: 4510 - DNA, 426 bp, Diabrotica virgifera
aatttattacctcatccaaatgttaaactatttattactcacggaggattcttgagcactatcgaaactctttaccacggaataccaactgtcgcagtacctgtggttcacgatcagcaaacgaatgcaaaacaagcagaaaaaaatggttattccattgttgtagactataatactcttacagaacaacaactttcggcggctatagaagaaattctttcgaatccaaaatatcgccaaaatgcaaaaacccgctctaaaatcttccatgacagaccagtaaagcccatggacgaagcagttttctgggtagaatacatcgcaaggcataatggtgctaaacatctcagagttgcttatgtggatttagcctggtaccaatattacctactagacgtcttcggacttatattcggaactatattc

SEQ ID NO: 4511 - DNA, 421 bp, Diabrotica virgifera
  misc_feature (12)..(80): n is a, c, g, or t
  misc_feature (151)..(174): n is a, c, g, or t
  misc_feature (211)..(239): n is a, c, g, or t
  misc_feature (257)..(269): n is a, c, g, or t
  misc_feature (272)..(359): n is a, c, g, or t
  misc_feature (386)..(420): n is a, c, g, or t
accacacgtccnnnnnnnnnnnnnnnnnnnnnnnnnnnnnnnnnnnnnnnnnnnnnnnnnnnnnnnnnnnnnnnnnnnnngtaattaataatgtgagagaatattttaggtttataaaagaatgattcatgtgttgtaccgtgtgtatcannnnnnnnnnnnnnnnnnnnnnnncgttattattttcgcatttaaaagagctattttattnnnnnnnnnnnnnnnnnnnnnnnnnnnnngataagttttgtgtaacnnnnnnnnnnnnntcnnnnnnnnnnnnnnnnnnnnnnnnnnnnnnnnnnnnnnnnnnnnnnnnnnnnnnnnnnnnnnnnnnnnnnnnnnnnnnnnnnnnnnnnggatagtcttagggatgagcttataannnnnnnnnnnnnnnnnnnnnnnnnnnnnnnnnnna

SEQ ID NO: 4512 - DNA, 447 bp, Diabrotica virgifera
  misc_feature (322)..(346): n is a, c, g, or t
tacacgaatctatattgagtgctcctaaaagacaaaagcatgaaaactaaatgtattaaaataagaaataaaatatacacaaaatttaaatctacattaaaatctacctaaataaatactcttcaaaaactgtattaaaatgttccgaataaactcatcattatgctcgtaaagcaatttagtctagtcacaacataggggatcctgtggggaattctaggttttttgggtcactgaatccaatggaagtggtctggaagcccaaatatgctgcgtttaattttcattaacaaattatggtaaaattagctatttttcaggnnnnnnnnnnnnnnnnnnnnnnnnncttaagttagtagagtaaagttattatacaaactggaacatgaagtaaaaaccacttctatgtgaaaatataagtcaaaaatgacttaattgaaatgtaaa

SEQ ID NO: 4513 - DNA, 444 bp, Diabrotica virgifera
  misc_feature (400)..(400): n is a, c, g, or t
agacaagcgtctaatcaaagtctgcagatacgttaagtttcacaaaaaattggtattgtgaggattagcgaaccgactatacctgtcctccacgtacccatctatgattatggttatgtttataagtttttaaatttgataattttataaacggtacttacaggaaccattttatagttcatatttattcaaattgattgacttttattaacattccaatatataggatgaatcaaaattagttgttttaaataattgtgttattagtgttttaaaatcgtttattcacattgaacaatctctgtacttgtaaaaatgtcgttattgtactttttttaatacctactaatgtaactctgtactaaattgttaatattttctttaaactttctcaattcanataataaaaatgtaatttgtaaaattaaaagagaaacaagtgtg

SEQ ID NO: 4514 - DNA, 368 bp, Diabrotica virgifera
acccaagcatccaaaataatccgtataatgtacggtgccggcaaaaaatctttacaaagtgaataaaacgcattcctcttcttcttcggccttcagtaacccaactttggacatagcctcccgcaattcaatccagtgttgtctattttgtgccacctgtttccagttgtgtcctccaaacttctttatgtcatcggcccatctcatttgtggccttcctctacttcttcctaaccacggtctccattgttgtagttcgtgattccatcttttatccttcagtcgggcattgtgtcctgcgaagctccattttaatttggcagcatggtctcctgccgtctttcacttttaaacgcataaatcaggat

SEQ ID NO: 4515 - DNA, 435 bp, Diabrotica virgifera
  misc_feature (341)..(359): n is a, c, g, or t
  misc_feature (387)..(387): n is a, c, g, or t
gggtcgagacacgcgtccaaattaattcgtagaaaattattagcgttattagtgatgatgtggcctatgtgattcccataccaaaacaagatacagttatctataaactataaaaaaaaatagcaaagcaaacaattttgcgtgtattgtttcagagtaaagtgtttttgtgtagctgttatcaaccaaccaacttttgaaaattaaatatttgctgaccatggctaacccattttctaccatgtaccacagtttggattcaattctgagcattttgagaaaacctgaaaatttagcaatacatggagttaaagaactattacagatttatgaacatgccnnnnnnnnnnnnnnnnnnnctgaaacatcaggagacagtaggagacnacctttcatagtattagagggtttggatggctcaagaaaatccactgt

SEQ ID NO: 4516 - DNA, 221 bp, Diabrotica virgifera
gatttaaattccaccgcccttactgtaatttttacaaattttaaacttaaatttagtagcctaaaatgttcaaagaagacgctaatcccctagctaggcataagcactcattagtaactatctttagtgttaacattaatggataggaaaggttcattaagttgagcgtgcttcaatataaaattaactgtttttagagaagcatataaattaactatttc

SEQ ID NO: 4517 - DNA, 334 bp, Diabrotica virgifera
  misc_feature (222)..(282): n is a, c, g, or t
acgatattgaccacaattataagaaaccgactaaatcaatacacagaaaaaattataggaccatatcaacagggttttagaacaatagatcaaaggaagatcaacaatagatgcaatacacgtactgacacaaacaattgaaaaaagctatgaacatgacatagaattacacatactattcatcgacttccaacaggccttcaacagcatatacagacaacnnnnnnnnnnnnnnnnnnnnnnnnnnnnnnnnnnnnnnnnnnnnnnnnnnnnnnnnnnnnncagatgcccaaaaggaatccaagctaacgtaaacatataagaaaattcacaa

SEQ ID NO: 4518 - DNA, 376 bp, Diabrotica virgifera
  misc_feature (343)..(363): n is a, c, g, or t
taatcataatacttgtaagttgaactggacacattcttaatttaatgatcatgggataatgatgagatagaatacttaaatcgaatgatacatactctaagcataagattgtcggcatacagggatacgtagtgaataatatacagtatagtatttactgtattaaaatttcgatttcatccattcattaacagtgtgccatacacatcaagtaattccttcgtggtgacaagttactcgaatatatttatatcgaatttttcatgacatgactcacatttatttattaacactagatttaccattgattacatacatcttactagtattatgcaattctatnnnnnnnnnnnnnnnnnnnnncatataattctca

SEQ ID NO: 4519 - DNA, 349 bp, Diabrotica virgifera
  misc_feature (4)..(4): n is a, c, g, or t
  misc_feature (8)..(8): n is a, c, g, or t
  misc_feature (67)..(85): n is a, c, g, or t
  misc_feature (119)..(152): n is a, c, g, or t
  misc_feature (284)..(317): n is a, c, g, or t
tggncganccacttctagtgcaagtcaagaacaattttacttaatgatagctgattactatcgtgannnnnnnnnnnnnnnnnnnagtacgtgactttacttcttgtaccttgtatagnnnnnnnnnnnnnnnnnnnnnnnnnnnnnnnnnnctttcgaatttaacagaactaaacaatgaaaatttttattgcacagcacagactttacatcatttgtttgtaacgatctgctattcgttgttaaatatatctaatcttttacgagataatttcgatttatcnnnnnnnnnnnnnnnnnnnnnnnnnnnnnnnnnncttaccaatattcaatacttgtagggatgagc

SEQ ID NO: 4520 - DNA, 424 bp, Diabrotica virgifera
  misc_feature (192)..(192): n is a, c, g, or t
  misc_feature (259)..(259): n is a, c, g, or t
  misc_feature (329)..(329): n is a, c, g, or t
tcgtacgaattctattccatacaacgcaagaagcttaggggtttgccttttaggaagttttaaagatacgaatcctcctaatgtacaactgaaagcattggaagactttttgtcttgtgcagcagctgatcacaaaattattgcagattatcaccttatcggacatcggcaagctgataaaacagaatgtcncggggatcgagtgcatgcagttatcgaaaaatggcctcattttgaagccaatccacaagatgcttcnccaaaaaaactgtaaacatagcgaagttaccttttctcttatggaataaacacctctctatcgcaatgtntttagattacaattattaatacatgtaaatatttaaaagactgtatatatatatactcgtactttaaaaatgtgtgaaaatatatcactatcttt

SEQ ID NO: 4521 - DNA, 153 bp, Diabrotica virgifera
tgggattcacttcatctactcacaacctaacttgtttatcatttaatgttcatgtttacacttagtctaattcactcatattctttattcaatcactagctttatttttacggcattgtctaccttttattactacttaatgtctcttttact

SEQ ID NO: 4522 - DNA, 401 bp, Diabrotica virgifera
acggacgcgtgggcttttttctaaaaacaaaagatgtttcttttcaactgatagaaatacattgttatttttgcttgtaattttgacagtcgtcatgtattggatgacagatgtcaaaattgagagtgatttggtttcacgtgacgccatctgtcgaagattagattaatgtccaaccacccatgaatatttttataaacttgtaatcatgcatatcaagatctaattatagacgtatatattgacatagacagcagtctgtagagctaagtaacgacaccattgttttttcttgtcggacgtgtctctgtcttagattagttaaggatagcgacaagagatcttgtcgccagcatgcgctgtcggtatgatcggtctacgttaatgtatacgtctaattt

SEQ ID NO: 4523 - DNA, 313 bp, Diabrotica virgifera
tcgcccgtcgacccacgcgaccgacctcacgttcctctcacgcgtccaggttaaaaacctgacataagaatcttaaaacattaatacagttttttaagtttacattacatgtgtgaaagggaggccgcatctcccaggttcacagtttaattatccatacatgcaatatgtgcactctcagaacaatcgctcaagatttttatcgatgacctactattaagcacgtgcctcttcggtgcactttgtcatgatattttttaacctcctagtatgttagcgcgacattgtcggaaaggtctgttcaccatgttgc

SEQ ID NO: 4524 - DNA, 238 bp, Diabrotica virgifera
  misc_feature (82)..(96): n is a, c, g, or t
gatgataatattggcaattcagagtaacggtgtccagcaggatggtgggggggtggtcaatcaattgaacaagttatccctnnnnnnnnnnnnnnntttcgatgaatataataatcttctcacttaatagaacttaacactaatactccatttagtgaaattagtgatccactccaatatactgtatttcacatgttctactacatcaggataatctgaatttcgtccaggtatccct

SEQ ID NO: 4525 - DNA, 332 bp, Diabrotica virgifera
  misc_feature (16)..(153): n is a, c, g, or t
atacaacaccctgacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggaccctgtgtaacaaggataatcaattaggaagtataaaattagtaatttcgaatttaagagagctaagtaaataccatagatagtgtaagagaaatatttgaaaaagacgtggctgaaatgaaatgacactcgtagtgaaaaacccaaatgttttaaggaaataacggagataga

SEQ ID NO: 4526 - DNA, 83 bp, Diabrotica virgifera
tgagtcgtattatattgatatcagattatttcttagtcctagtagctattccttttagttgatgatagcttattactgttgtt

SEQ ID NO: 4527 - DNA, 398 bp, Diabrotica virgifera
acacatctggggcatctactgtaccgaccgaatcacctactaatgcacctatataagcacctactgatgtacctaccgttgcacctactgcacgacctgcaccatactagatgacaccagatcttatatgtccagaggataatacctatttcccatctatttttgactgctccacatagtacgattgctcaaacggacacccatttctaatgacatgtcctgctggtcagttatcgtgtaatttacgaagtacatgtgattgggccgcacatgtcaattgctcatacctcgtaaccactcctgatccatatacagcaacaacttattacattatttatatgataatccctgtaaatcttttatttattttagtttcacttgtgtcgaaaatcatgata

SEQ ID NO: 4528 - DNA, 436 bp, Diabrotica virgifera
  misc_feature (188)..(188): n is a, c, g, or t
  misc_feature (375)..(390): n is a, c, g, or t
cacgcgtccgatttattttcatccgcttttcagatcatctgacgttttctagttcctagtgtccattcttgtttgtcgtcccaatcttctgactgaattttcacctcttacatttctctttgatctaattatggctgtttggtcttcctcttttccttccttcaactgacacccatgtttttgcttangaagtcatctgtcatcaatttttttgaacaaatatgttatgtgcgttcattttcgtcaataataattgatgatacttatattttgtcgtatttggtcattgggtatttttacagtcttgattttctggcagattttcgtcagaagtccattttcaaggacaataagcttgcaatggatgtatttgcnnnnnnnnnnnnnnnnagagtacgatacttttaaatattgagttaaataagtgttttccttt

SEQ ID NO: 4529 - DNA, 364 bp, Diabrotica virgifera
  misc_feature (13)..(34): n is a, c, g, or t
  misc_feature (124)..(145): n is a, c, g, or t
  misc_feature (193)..(224): n is a, c, g, or t
  misc_feature (226)..(239): n is a, c, g, or t
  misc_feature (241)..(257): n is a, c, g, or t
  misc_feature (279)..(316): n is a, c, g, or t
  misc_feature (327)..(353): n is a, c, g, or t
aattatatgttcnnnnnnnnnnnnnnnnnnnnnncaccctttaacttgtggtttaatattattaatacaaacaattttcacatcagttattacaggattaataaattataattactgattttcnnnnnnnnnnnnnnnnnnnnnngtaggaggaatattaattctttttatttatataaccagaattgcttcnnnnnnnnnnnnnnnnnnnnnnnnnnnnnnnncnnnnnnnnnnnnnngnnnnnnnnnnnnnnnnnctatattaagatttattttagnnnnnnnnnnnnnnnnnnnnnnnnnnnnnnnnnnnnnnatgaataaccnnnnnnnnnnnnnnnnnnnnnnnnnnnccttaattaaa

SEQ ID NO: 4530 - DNA, 395 bp, Diabrotica virgifera
cgcgtccgcagcttcatatacagctttaaatataaattgaggaggtttacttagtgctgtcggtgataagaacaaacatattaagcaacagcagcagcctgggaagtttactgtggtggaatttgaccaagctgggtctataaatggagtactagcatctgaatttaacttggatagtttagaggataaaccatggtagaagcctggtgctgataacactgaataatttaattaccgcttcaatgaagatacatggagagcttactgtgaaaggcaaaatagaataacagtaaatgagtcaagaacgggcttagtaccaatgaccatgatgagtggcttgcctcgtggtcctatgccaatcatgaatgataacagtatagatactggaaattttg

SEQ ID NO: 4531 - DNA, 180 bp, Diabrotica virgifera
cccacgcgaccgaatatggtctgcgatcattgtgacaacccatgaggatcttgaagctacaagccgtaatgaacgtacccgatgaatgctattcagtgagaccagaataggtggataaggaagaactacacgttatcgagaatgactctcatagactagcacatggtcgggacatattta

SEQ ID NO: 4532 - DNA, 244 bp, Diabrotica virgifera
gtattaagcgtccgcggccgcttgtgacttacctgctgctcctccaggtccttcactaggagcttttacagcatcatctatcaactgcaccgcataattacaggtattgaggttatatacatgttacttcactacgtgattggcttattacttaccctatgccttacatggcattgatgacgatataatgtacaactacgaacttatcaacggcttcatactttagtacttactaaccgtttac

SEQ ID NO: 4533 - DNA, 198 bp, Diabrotica virgifera
aaaatatacaacagggtggaagctctatttgatcttgatgaccatgaccgtgttacgagtgttaacaacttctgtaccatttgtggggggccactaagtgaacatggtgtaacaacgctctgattgggtcttgccagacgttaatgttgacttactactttccgaaatggccccattttatatatttggtaataacaa

SEQ ID NO: 4534 - DNA, 398 bp, Diabrotica virgifera
  misc_feature (125)..(151): n is a, c, g, or t
  misc_feature (376)..(391): n is a, c, g, or t
atagtactgtagttcaaataagtattgataatttaattcctcagatcaggaaaatggttgtgttagtgatgtagttgtgaacttaacagcagtgaaaaatcaccaggatcctccataggtgtagnnnnnnnnnnnnnnnnnnnnnnnnnnngtagataaaaacatcaacagcatatgtcaactatggattccacagtgagcagttctagtcctcctttagatttaaattcaacacaaaataccgagatagtagaatctgctctagaacatgatccaatattcttacaaactaaattatgtcaaactgtagctgggctgtttgtctgggcagctctatttttgacctgtagtcaaatctatcatcatctcaggtggnnnnnnnnnnnnnnnnaacaacg

SEQ ID NO: 4535 - DNA, 421 bp, Diabrotica virgifera
  misc_feature (17)..(43): n is a, c, g, or t
  misc_feature (403)..(403): n is a, c, g, or t
agacatattcagtttannnnnnnnnnnnnnnnnnnnnnnnnnnaattaaatatcgaaatggtataaaaatggtattttgctagcatgcaattgattaacgtgttctttttagcgtccgtaacttcacgcatattatgcttttaaatagacaaatctttcatctttagtaactcggggggtattgatttattttaataacatgatatagagggacagattgtaggtggaatttgttgtttcatgttattaaaataaatcaatactttttgagttgttgaaggtcggagatttgtctgtttaggggcacatgcgtgaagttgcggatgataaaaggaacgtgttaatcggttgtgtgttgctaaagtattgtttttgtattatttcgatattataaatttagcanaagtgtgatcgaatatgt

SEQ ID NO: 4536 - DNA, 300 bp, Diabrotica virgifera
  misc_feature (139)..(247): n is a, c, g, or t
tgtctttaggttctttgcctacgcccctcgttgtgtttcttcagtatgactttttgggtcactatgatgactacgttggggaattcacagtattacgggcctatttttacctatacatttctgcgcacatgtcaaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctccatattgcgcgaggtttcccttataggtcttccaatctggttgtaccttg

SEQ ID NO: 4537 - DNA, 336 bp, Diabrotica virgifera
  misc_feature (42)..(82): n is a, c, g, or t
taccggtctacttccgggcgacccacgcgtacgaagccgcgnnnnnnnnnnnnnnnnnnnnnnnnnnnnnnnnnnnnnnnnngggtggttgcactgaagggttaatccttattaaacatagctgagtttttaagacacatcttaaatgtaactaatatccatatcattggccgtcgatatatatagacgagtaagggaaaatactgttatggatgaacttaatcgctaatgcttacatcccccttacgttataaggcgtaattacgattaaggccctttcacgattgaccacacgtcagtagctaatcctaaatggtaatagggatacgccctata

SEQ ID NO: 4538 - DNA, 376 bp, Diabrotica virgifera
acaagcctctagattgactcatacaatacgagtcttacttcgtagaagtaccggtagatccgtctgaaaggtatacatggatttttgagaaaatagttaagatttttcatgaacctggtgaatctattaataatatcaaggaatatttagatacgtggctactaaatacaatatatatcacacagctcagagatgaagctattgcaagaagggaccagcattcgtctagaaacactagtaatgtatgttgcactatttgtagacgacgttattttacacagtcacaacatccattattaacatgtacttcatatattttactaaacttatatacaactggaaagaccatgggatggttcaagggtgtcactccatt

SEQ ID NO: 4539 - DNA, 101 bp, Diabrotica virgifera
  misc_feature (29)..(100): n is a, c, g, or t
acaagactctaaaatgagtcgctatattnnnnnnnnnnnnnnnnnnnnnnnnnnnnnnnnnnnnnnnnnnnnnnnnnnnnnnnnnnnnnnnnnnnnnnnng

SEQ ID NO: 4540 - DNA, 436 bp, Diabrotica virgifera
  misc_feature (81)..(98): n is a, c, g, or t
  misc_feature (290)..(307): n is a, c, g, or t
  misc_feature (316)..(331): n is a, c, g, or t
  misc_feature (334)..(351): n is a, c, g, or t
gtccgagtacggatacttgcaatcgtataaaaatcgaattaaattcgggtagtattgccaagaaattgattgaagatccannnnnnnnnnnnnnnnnnttgcttatattcccggtgaccttatggaaaaaagtgggttaattagttcagttaataatttctgtaacgagaaggctatcctaaaatttattaattctaatgtacttattaaaaaactaaaaggcatgactagaattatccaacaagataacaatatcgaacgaattcctcgtcaaatgatctttgttacgnnnnnnnnnnnnnnnnnnccccaatgnnnnnnnnnnnnnnnnaannnnnnnnnnnnnnnnnngttagatgcccctgtagaaacttaaattaccccaattaagtaatgttttttatacctccggtacggtcattccggctaaaagtgt

SEQ ID NO: 4541 - DNA, 372 bp, Diabrotica virgifera
  misc_feature (15)..(15): n is a, c, g, or t
  misc_feature (137)..(154): n is a, c, g, or t
tgagtcgtattatancctgggttctaaaaacaccaacatactttttaagacaatccaaacacataacggacacagtggatagatcaataatattcggaagagacaaatttaggtataggggaacacaactttaatcnnnnnnnnnnnnnnnnnnagggttttacccggtcaaattccttgaaccaccattttcgaccctcctagagctgcccccattacgatttttagggcgcgttttttaaactgccttccttgggaaaccccgggtgttacccccttttgcccccggtggacatctcccctttctacattctgggtaacaatcaaaagggccccacccatttcccctccctaaattattcccccccgaaa

SEQ ID NO: 4542 - DNA, 401 bp, Diabrotica virgifera
  misc_feature (153)..(169): n is a, c, g, or t
attttcactttctatattttaataaaattctttagaatggacgttatgaataaaagatatttttgcataaactgtggaaatgaagtcaaaagtttatatagagaatacagcaaaactgtattaaaattaacagaatgtgataattgcaaaaannnnnnnnnnnnnnnnntggaatatgacaccgttatagtagttattgacttacttttacttagaataatggcgtataggcatattttacttaattctgaatttaagaatttttggaaattacctataggtctgatactgttggaaacatatatgacctggatattaaccaaagaattcccactagaaagacacaaagatatttctaacatcacttcttttgaataagctgataattaactagatgatat

SEQ ID NO: 4543 - DNA, 175 bp, Diabrotica virgifera
  misc_feature (8)..(25): n is a, c, g, or t
  misc_feature (135)..(166): n is a, c, g, or t
cccaatcnnnnnnnnnnnnnnnnnntttcaaaaaacataaccaattttccatccaaaaaatataacaacgaaaaaaattcaaaatggaaagcaaagataaaaggacgaagcgagcggcaaaggacaaaacagaannnnnnnnnnnnnnnnnnnnnnnnnnnnnnnntgcaaattc

SEQ ID NO: 4544 - DNA, 392 bp, Diabrotica virgifera
tttagaagaacacagtcccgtcttccagaatttacagatgccgaaaaagctgctttgaaaggtaacgctgactattttgccctaaacacgtacactggaaacctggttaaaagtattcccgatcctcctagattcaatattccatctaggtatcaagatgtgggagttctgacttacactgatccaaaatgggaatctagttctttggattggcttaaggtagctccttggggtattgttgatcttttgaattttatcaaaaataactacaatgatcccgatattatggttacagagaacgggctctgtgataagggaggactagatgatcctcgaagagtcaactaccataaactttatttgagttatattcatgacgcaatgatcaatga

SEQ ID NO: 4545 - DNA, 416 bp, Diabrotica virgifera
aaaaatgaactacgagacactaatgaagatgaaatatttagacatggttatctcagaaagtctaagaaaatggccaagttttcccttgtcagaccgatggtgtaacaaaacctacacgctagaacccgaagctcccaacgagaagccaataatcatccaaaaagacttactaatcatcatccctattaaagcaatccaccgtgatccaaaatacttccccgatccagaacgttttgatccagaaagattcagcgacgaaaacaaggataagattgacccatatacgtatctaccattcggactaggacctaggaattgtatcggttcaagatttgctctgatggagatcaagagctggtttgcacatgtactgcataattttgagatagttccaactgcagacactcaaattcccg

SEQ ID NO: 4546 - DNA, 365 bp, Diabrotica virgifera
  misc_feature (18)..(80): n is a, c, g, or t
acccgtccgacacgcgannnnnnnnnnnnnnnnnnnnnnnnnnnnnnnnnnnnnnnnnnnnnnnnnnnnnnnnnnnnnnnggtcgacgagcctcaagagttacaacctcatttatcctacatggggggtcctcaatcctttcaactaggggcggctgcccagatcgttcgatgttaatttacagcctcaggaaagggcaaacccctcccatattctacccaaacctccattcccggaattccctttttcacctccgggcctggaaaaaccctggctttacccattttaattccctatgcagtacaacccccttttgcaaaatgggatcttcccgagaatgccccacacaatcccccttccgaaaa

SEQ ID NO: 4547 - DNA, 382 bp, Diabrotica virgifera
catctctctcggctccccgctccgagtcgcgtcgcgtgaggagaaaggaagggaagccggaaagggttctcgccgacgcggaaggaggagatggccgggaagggaggcaagggcctgctcgcggccaagacgacggccgccaagaccgccgagaaggacaaggggaagaaggcccccatctcccgctcgtcccgcgcggggctccagttccctgtgggccgtatccatcgtcagctgaagcaaaggactcaggccaatggccgtgttggtgctactgcggcggtctactctgctgctatcctggagtacctgacagctgaggtcctggagcttgctggcaacgccagcaaggatctcaaggtgaaacgtatcacccctcgtc

SEQ ID NO: 4548 - DNA, 364 bp, Diabrotica virgifera
  misc_feature (54)..(68): n is a, c, g, or t
  misc_feature (106)..(106): n is a, c, g, or t
tggtgatacgttatgtgatgaaattggagcatgatttatttattgattgtattnnnnnnnnnnnnnnntcggggacgagcaatggtcttttcctaccaatctatcncctagtatcatgcacatagtacttcggttcaataactaataaatttttgcaataagtatgtgagttctttatgactaatgttgagtccatggattatacgcactctcaccattccaccattgctagcctctctagtaccgcacaactttcgctggtaccatacacccaccatataccttccttaaaaaaacccatacctaactattacggcatttcgatagccactccgagatatattgccacgcaacttttcaccgt

SEQ ID NO: 4549 - DNA, 318 bp, Diabrotica virgifera
  misc_feature (173)..(173): n is a, c, g, or t
gatgcagagtatggctacaaaggggccaagctttccagtgaagatggtaagtatggtggaaacagtggtcgaaattatagtaagattctaagtggccaggatatgcttgagagcctttctactgctacgagtttggacttgttaagtgatgctggagaggtggttctgagtanggaattgaaaaggtgtccaacttttagcaacctgaagaccctgtcccttggtgaatggtgtatggccgctgattttgatgcattaattttcctgctacagcattcacctaatataaagaggctttttctccaacttaaattgaac

SEQ ID NO: 4550 - DNA, 394 bp, Diabrotica virgifera
  misc_feature (144)..(144): n is a, c, g, or t
  misc_feature (208)..(226): n is a, c, g, or t
actactcttgggccttgcccttttcgtctcagccggtgaagatcttggcaagggttatgaaattgtggaatgtgccatgtaggtgttgaaatcaggaatacccgaatggggataacaaaaaaacaactactacgtcgtactcgnggacccacagaggactggtaacgtcggtgttgccaaagcccatctcgatctccatgactataannnnnnnnnnnnnnnnnnncgggaaattcaagcataccgattcagtgctgacactgacaactaggctgtctctgactacaacacatcatggtcaaaaggatatcaactcactatgaactacattgcaaccattaatgaacatttcatttcacagtactactcatgaagcatcaggataaccatgaaa

SEQ ID NO: 4551 - DNA, 431 bp, Diabrotica virgifera
  misc_feature (320)..(345): n is a, c, g, or t
gggtcgacgcgcttttgtaaggaaatattgcctgtacatggagttccaaagacgatcgtctcggaccgcgacgtcaagttcctaagctacttttggaagaccctatgcgccaagctcaaaatcaagctactcttctccacggcgtatcatccacaaaccgatggccaaacggaggtgaccaaccacacactctccactctactccacgtgctcatcaagaagaacatcaaggagtgggaggagtgtctacctatcaccgagttcgcctacaaccgcgcaagacactcaacaaccggcaagtcccccttcgaggtcatccnnnnnnnnnnnnnnnnnnnnnnnnnngaaattcttcctctaccactacaagagcgcatcagtatcgaagcaagtgcatgtgtgaaccatctcaagaagttttatgaagatac

SEQ ID NO: 4552 - DNA, 396 bp, Diabrotica virgifera
  misc_feature (323)..(338): n is a, c, g, or t
gggtcggccagaaatattgatcagtggatgactccatgatatctactccagcttcgtcttcataatcatcatcactatcggggttggagtcggtgtcgtcaattatgatgttgtctttaggatggatgtcctcctcgggttcgggatctcccatgaatattcctagcttcttcttctggtcttcactcttctccacccgtactgctatttcctcttcatatccatcgcatgtagacttgagttcctctcctagctccatgttcctggtcatcactttcttcatgtctatcttgctggcatacatctggttctcctgacgaggnnnnnnnnnnnnnnnntcctggatgtaggttgcaatggatctaaccttcctggtgcaaatcatctcccaatgtt

SEQ ID NO: 4553 - DNA, 341 bp, Diabrotica virgifera
ggcacactaactaaactcctactaccgccgccgtccgctctaccccaggtaaggaacggaggagcggcgatgtctcaccgcaagttcgagcacccgaggcacggttccctcggcttcctcgccaggaagcgctgctctcgccaccgcggaaaggtgaaggccttccccaaggatgaccaacagaagccttgccacctcactgccttcctgggctacaaggctggaatgacccacattgttcgtgaggtcgagaagcctggatctaagctccacaagaaggaaacctgtgaggctgttaccatcattgagacccctcctctggtcattgttggtcctgtggc

SEQ ID NO: 4554 - DNA, 166 bp, Diabrotica virgifera
cccacgcaaccaaacacacgtcctactaactcgtgctcggacaccttggccgacacctcggttttgttgttctttatgaaccatccaaatcaaaccagtttgccccttcccacccagccaggtttcccttaattccttttcaccaagggtctattggaaaacctta

SEQ ID NO: 4555 - DNA, 361 bp, Diabrotica virgifera
agctggagtgccccttctgcggggaggagttcgatggcgtcggcctgtgcttgcacatcgaggacgagcacgcggcggagaccaaggccggggtgtgccctatatgcacagatagagttgggatggacttggttgggcacatgacctcagagcatcccagtttcttcaagggcaggtggaggaaccagcgagtttcatctggatcaccttcttcaatgtattccgcattgaaaaaggatgcggcgcacatacaataccgctacggtggatcctctcgtgccacctcgctcaatacagtgcctgatcctctactctcctcctttgttggtagcttcattgatgatgatgcacattctccaaa

SEQ ID NO: 4556 - DNA, 371 bp, Diabrotica virgifera
  misc_feature (255)..(277): n is a, c, g, or t
agcaggatcctacgcatcctcaaggcccatgggctggcaccagagatcccggaggagctctactttctgatcaagaaggcggtggcgatcaggaagcacctggagatgaacaggaaggacaaggactctaagttcaggctcatccttgtggagagcatgatccaccgcctcgctcgctactacaagcgcaccatgaagctcccgcccacctgcaagtacgagtctaccaccgccagcactctggtggcttaaggnnnnnnnnnnnnnnnnnnnnnnntagctgattaaagcttgattgttctggaaaccattcttatgttatgccttatgatagtttggagccaaacagatgctgcaaattttctatgttt

SEQ ID NO: 4557 - DNA, 347 bp, Diabrotica virgifera
cgggtcgagccgtacgtatagatcagtacattctgttcttcgtactaaagagtgtgtgtgtgtgtgtgtgtatgtatgtatcaaatgttcagagtcgagcagtaaacattttgcaccttgcttgtccatgcaaagtgtcggtggtacgcaggctcaagggaagggaagggaagggaccaaatcaattagagaaaaggggacgggacgggaccaaataattgtaatcgccagatgctcgcactgttgtgccctgccgcccctgctccaacttgccttgctgctgctgttttccctgtaccgtacccgccaattccctctcagacatttggcggtacagattgacagat

SEQ ID NO: 4558 - DNA, 353 bp, Diabrotica virgifera
aacgagagcaaatggcccctgcagaagaacggagtcttcaacctgctcctttctttcaccgtggagagcaacgtgtcaacgaagtccattactttcgacgacgagccagctgctacacgggtgagcaccgtcccgacggtgctgcgcggcggcctatacctcttctttgtctcggccatgatcctcatgttgagtttcaaagtagggtcctgcatctacagcaggtaagttaagagcctgcccttggggccgttcttattttggtttagcggaactatacatggcgccccctcgacgacggcgtgggagcaaacgactcggaagacagttttacatttacgcacttagtttgt

SEQ ID NO: 4559 - DNA, 351 bp, Diabrotica virgifera
ggacgagataccgcgcccaagtctagggttccccctttcttcttctccacgcgaatcagatactagcaccagcatcgatggcggcggcagcgccggcggacgcgaaggcggaggccgccaagatggacctcctcgaggacgacgacgagttcgaggagttcgagatcgaccaagaatgggatgacaaggaagatggcaacgaagctgtccagcaatgggaggatgactgggatgatgacgacgtgaacgatgatttctcactgcagctgaggaaagagctggagggaggcaacactcagaagagctgaactatttccccatccatatcaaagctgtagtaaactttatcct

SEQ ID NO: 4560 - DNA, 261 bp, Diabrotica virgifera
agcgtgtcatgcaagaatggtggggtgatctcggatatcgagttcccacatgtcggtggcaggcaaaagaggggcaatgtgcaccgatagttcagactcaaggcaaaacaagtgtgcatctcatacagcatgcattcattcgttcacgggcgtcgtctcgaggttataccttcaaagcatacaaacggaacgattctcgttcggtgccaagtagaggaagtatacgttctcgggacattgtggaagtagggggtacacgac

SEQ ID NO: 4561 - DNA, 109 bp, Diabrotica virgifera
  misc_feature (9)..(52): n is a, c, g, or t
ctctatagnnnnnnnnnnnnnnnnnnnnnnnnnnnnnnnnnnnnnnnnnnnnattgtacactaaaagactaaaaacttaggtaagcataatcttggcggtcatcactac

SEQ ID NO: 4562 - DNA, 304 bp, Diabrotica virgifera
actctagagtgattcgtattatgcctgctcacgtgttcatggattgcaggctcttgcacttcgatatcgcacataccccattggttaaggggccaaatctatcaacgttgggattaggactaagcacctctaaagcagtgaccgtgccattcaacggtggcagcaatatctattggagttcagagagtaggagggcgcataggattgtaagattactaggcaaccagatttcgctacgaatgtcgctcgaaccataagttccattgacattagtcatttacagtgggatcggtcacttcgactt

SEQ ID NO: 4563 - DNA, 313 bp, Diabrotica virgifera
  misc_feature (76)..(76): n is a, c, g, or t
aggggatctaatcatttggtatgttgagcagcagaatgcccaaggcgcatatagttctacagaagaggtgaaggangaagtaaagtgcatcaaggccattatagagaggctgatacagagggaatgccatcttgtagtcatagatgaaggaacagcggcagcagaaggtgctacggcaagggcatcggagcacagaatcctggctgttaacccaaactacgtcattgattgattaaccagctgaggtcacacagctaactagatccatcatatgtggttgaccaatatagcagacattcaaacggaagacatc

SEQ ID NO: 4564 - DNA, 381 bp, Diabrotica virgifera
cgggtcgaccgggctgcagattgaagaaggctccatgccgcacctccgaaggcttctcattgacttccagtcatcggaggatgatacagatcactttgtgcttggtatccagcatttctcttgtctcgtgcaggtccgtgccaccatctactgtgagcctacttcaacaacagtcgtttctgccgcagagacccacatcagagatcaagtgtctcagaaccccaacaatcccctactggaattcaacagaaaacgtcgaggccgtttggtgaggcgtctaaggccgctctctaatgtgaaggagcagccatcggcggtgattaagatccgcagcctggatgactggactatgatgatctagcacaaggggaagaaactgct

SEQ ID NO: 4565 - DNA, 380 bp, Diabrotica virgifera
acaaaaagtcataataattacctacagtgaaaatctccgataactacatttttgtacattggacataaaataatttcggggtacagcagaatttgcccaatttgacagtgggtaggaacatttagaaaaataataatgtcatcatgctcgaaacccaaaaacccattcctcggtaatggaaataattgacaaatatctctacaatctatactaaatttgcaatcagggtgcagtggaggtaaacgagccaagacacgttaaagtgctccctgtaaatattctctttactctgtcactggataaaaaagaaaatttttgactgtttggtatctttcttgtcggatagtaaaatattattgtaattagttttaggtaattgt

SEQ ID NO: 4566 - DNA, 368 bp, Diabrotica virgifera
cgggtcggccggacaccacaggtcacttactctcccaaggcaaagggagacgatgaggtgctctcccaaaggaccttcccaggccagggagaggtttaggaacccgccatggcggtgccggagggcgacacctcggccgccgggcacatgggggaacagtcccccatggagattaccgacgggggtcgtgctcaattcggcccccatatgagcacggatctggagacccatacggccccgaagcccgacaagcagcttccttcaagagaagggggcgtgcccgtcccttcggcgacctctgtccaactagaggcgccggacaatctattggaagcgctacgaggcgcttccattgtggaagaacaccg

SEQ ID NO: 4567 - DNA, 369 bp, Diabrotica virgifera
aattggcctcattgtcgcatgtagctctggatcacagagccgaggacagatcctcgcacgggcaactgccgtccaaggagagattccttttttttgtgtctttattccctgttttaattcggcacctaggccatcgctggacgctagtagtatttttgctatggaaggcctagaccaaaatactaatgcgatggactcctagtattttgcacgatagcctagatttgatcggtggattgtagtaattcaagtactactacttcacgtatggatcagaaactagtctcttcttggtactagcttgtactagttggtacagaccgcttccttttatatgcttcggtctactatggtcatcgcttgttaaac

SEQ ID NO: 4568 - DNA, 315 bp, Diabrotica virgifera
  misc_feature (69)..(69): n is a, c, g, or t
agccgccaaggaaacacggacggttgctgccgctggttcgtatctcccacacgtgtctcctcgatgtanagcattgtttcacacttttcgatccactcgcatctattcaacgtggcaagtaaaccctgttggcaattaaagtggcatatcgatcgacgcgactcgtttgaacgtagcaaatccgaagcgcgaccggtgccactccccttcccttcccctttccctatttaaaccaccacccctccacctattctccacacatccatttgcgccgcccccttctcttcttcacccaaacccagagcactctcaaag

SEQ ID NO: 4569 - DNA, 288 bp, Diabrotica virgifera
cgtattatgttcataatcgtgcacaagcacaatggctcccactccaagggccgtcaaacttaggaggtcattgagttttgtattgactttattcctgaccttaggggatggaaaaggcacgctaggaggggaacaaataatatgtatggacggacattctctcactgaagcacactacacagttctacagaattccgccttggtggctccgtatatggatgaacactagaatttgctacgctccaaacacccagaacggtctgatgactggattgcacgtgaacaaac

SEQ ID NO: 4570 - DNA, 409 bp, Diabrotica virgifera
  misc_feature (72)..(72): n is a, c, g, or t
  misc_feature (91)..(123): n is a, c, g, or t
  misc_feature (373)..(396): n is a, c, g, or t
agataaatttaagagaaatattacaaaagatcttttttgttcgcaatggtccaaacagcctaaagtggtgtntgcccgggccaaaaattgnnnnnnnnnnnnnnnnnnnnnnnnnnnnnnnnntaaataatcataaaaaaatcagtatttcttggggacttcagggcgcaaagggtatacagtgtgttccatttgaaatgagagggttcattggatttccagaggaacggaaaatatgacaacgatgtgatttgcactataatattggccgcattggaaaacccctacctaccaaaaaatataagaatcgtccaagccgttttcgagataattgagtgtttccatacatagaactcactctgcatacataaannnnnnnnnnnnnnnnnnnnnnnnctaatacacgaac

SEQ ID NO: 4571 - DNA, 319 bp, Diabrotica virgifera
  misc_feature (17)..(104): n is a, c, g, or t
gacccacgcatccagtnnnnnnnnnnnnnnnnnnnnnnnnnnnnnnnnnnnnnnnnnnnnnnnnnnnnnnnnnnnnnnnnnnnnnnnnnnnnnnnnnnnnnnnntataagtttcaacacttgttcgggaatacaatcaaatttggttcttttccaagggtttcaactttaattattcctttgggggaattttttgccttttctaaacttccgtctattttttatttatcggcctttctttttttactttttatctgggtttccccgggttttttgccaatttaaccgctttcacaaattcccctttttaactattgggc

SEQ ID NO: 4572 - DNA, 342 bp, Diabrotica virgifera
ggagcgaaggcatctctctccatcccgacctctcgtggccgccgcgaagaaaaggagcttatcatggcttcaaaacgtatcctgaaggaactgaaggacttgcagaaagatcctccgagatcatgcagtgcaggtccttctggcgaggatatgttccattggcaggcaacaattatgggtcctcctgatagtccctatgctggaggtgttttcttagtgaatatccatttccccccggactaccccttcaagcctccgaaggtatcgttcaagacaaaggtcttccatccgaacatcaatagcaatggaggcatatgcctcgacattctgaaggagcaatgg

SEQ ID NO: 4573 - DNA, 359 bp, Diabrotica virgifera
  misc_feature (289)..(289): n is a, c, g, or t
  misc_feature (330)..(330): n is a, c, g, or t
cccacgagtccatttagttgtatggtagtagctgattcttaaatcacacatacagatctcagtgcttaaggtcggcttcaatgaaacaacccaccatgtactcctacatggcctctcagcgatacctttaccaaatcgtgttcaacacaccactctcattaccgacattaacatttcactctagcccatcacccagatgaaccagacctgacacgactctaagcatagcaggcatagcaaggtaggaacaacacatacatatggctcaatcaactcctacacatgctantgggtttcatctagttactgtggcaatgacaggtcatgcanaggaaatgggttcaactaccgtagcacac

SEQ ID NO: 4574 - DNA, 408 bp, Diabrotica virgifera
aattttgtttattttgaagtctatttcaagatgagggttgtgtctgcaattgtggtattcctctgcgtcgtccttttgataattcaaactatatccgcggcacctgcgcccattcctgggggtggcggtggcggaggctgtggtggcggtggcgggggtggcagtggtggtggcggtggcggcggcggctgtggcggtggaggtggcggtggccgctaacgtataattaaaatacctaattttacatgtggaaactataaaattgtatattttatctatctttattgtatattgtaaaattgtatagttattgtatattgtaaaatgttttgcaattagagtatttattcctattttttgatattatgaataatactctattacagtagtacctatgtgataaattta

SEQ ID NO: 4575 - DNA, 376 bp, Diabrotica virgifera
  misc_feature (282)..(296): n is a, c, g, or t
gggatgacacggaaggcgggcataagggaagataacatctctccttcgctgaatccagattccaccaagtcccagactgggtctatttgagtactcgttctggcggttcaaataaaattagtctctaagcaactccacactgggatcctcttgaaggtacacctcacagaaacttggaaattgcatatgtttgacacggaattgggtccgatgtcttgaggatgaagattaaaaaggtgcagagcatcccagaagaatttagagccaagcggtgagaagccnnnnnnnnnnnnnnnagtaaagacaatgacttcttcctcttttggctgaggtttctcctcttccggcttatgggcgcggtaatacatgacaattt

SEQ ID NO: 4576 - DNA, 391 bp, Diabrotica virgifera
  misc_feature (363)..(386): n is a, c, g, or t
gatatgcccactaactattgcttcgatggacactctggtagcttaagagatgttgtcagcatagccacaaaagattatatgtgtatcatatctctgtggatattgtgcaccgcgtatatgaaggaatatcaatttcaaattagaaattttattacatttccagtttacaagaactttaatatttgaattcatattgcatgatgtacattacacatctatttcttgaaaggacatattattcgttatataatgtatctacttttttaagaattaaatttgctttatttaacatcattatagttacaattatctaatctgagatcactaacaatgtttctttttaagagatagcttattacatgnnnnnnnnnnnnnnnnnnnnnnnncgttt

SEQ ID NO: 4577 - DNA, 418 bp, Diabrotica virgifera
agttcataccatcttcctttcatcagtttttatggttttcatgctcctactccacttagtgttcacatcgactttttagttctctccaccatgcattatcctttcaaaaagtattacctcataaaatactcctagatattacatccaattaatagcagcagttcaatttttgtcaaatctttttggaaattactcagttccattttgcaatagatccttgcaccatagcatgcttaattcttagaattttgggcctaactgatcgtttaatattttaaagtcattagtgtataatccttgttatggtatctggttttacctttagtttatttatgcttacgtttattaaatgtagacggctcacaaatcgagtatcacaatgaactagattttgaatagtttacattcagttttgttt

SEQ ID NO: 4578 - DNA, 398 bp, Diabrotica virgifera
cccacgcaaccgttgacatactctaatttagcaaaacttacaaaatcatttaaagtttcttatttaccatatgtacaaaaccccatcaaggctttaaaacatctggatgttacagttactgaagttcctctagacaagtttggtaaaaacttcgaaattccagagactgatatacttattgttaaccttaacgatgctaaggattctgaaagccgaacagatatgttgaaaaggcatgatgctgctatatctaaaatttacgaagatcttgcaaacactaacgacaatgtattgggaatgtacactgctcaccacacatcgtgggttgtatctgaagaagttattaaatctagacaagcaagatcattaatggtggcagaaaatgctgaagctgctaa

SEQ ID NO: 4579 - DNA, 408 bp, Diabrotica virgifera
  misc_feature (365)..(390): n is a, c, g, or t
gggatggtacaatatttacaaagctcaatcaggtcgttgcctacgcagatgatatagacataatcagctggacattaaacgacctagaaaaaacttatacatattttaaagaagccgcacagactatgggtctagaagttaatgtctcaaagacaaagtacatgataacaactcgggaaaaggtacaaacgaaaggcaacatatctctgagcgggcaaatatttgaaagagtggaccgtttcaaatatttaggatcaacaataacagaaggaaataaaaacagtgatgaggtaacagcaagaatttcgcttggaaacaaatgcttctacagcctacaaaatatcataaagtcaaaatcagtatcnnnnnnnnnnnnnnnnnnnnnnnnnncaacagttatgagaactg

SEQ ID NO: 4580 - DNA, 366 bp, Diabrotica virgifera
aacagactaactctaacgcgtgggcgggcgctgtgggtgacgcgagggattgccgacgattccgtaaattctgctgatctagatttaatcgtcaacaaaaaatcattgtgtccagattgtatcattattatcaatatataggtctaccctgcgaattccacagtatttattgcacctgtatacttaaaccatgtgcctttggggtaagcatcgggtctcgcgtgtacagggataaggttcattagctgcggtcatatgacagttgaatggtagcgtaatcatgtacattcatgattcaatgctggtacgtcgggttggatgagtatcgaactggccgtatgtactttagactcaagttaagcttta

SEQ ID NO: 4581 - DNA, 422 bp, Diabrotica virgifera
  misc_feature (118)..(138): n is a, c, g, or t
acccacgcgtccggttatgtggaagtaatgtatatctagaaaggaacttacaataattagtcagctgtacacaaacaataattagcttatgcttatgcgattagaaaattctttaccnnnnnnnnnnnnnnnnnnnnnacaacttgtatggtattagttcctgaaaatttaatagaggcaaagaccagtaaattacatttgacaacagtgcgctacacgtcatttatgtcaatattgtcatgtcaatacagggcagtatttattatggtagagaagtttattttgttagacgtcaaaattatgtgattttctaagttattttctataaattgttaatataacttaaaacctttaagttattacaacaacatggcttctagaagtttaacagacgtgtttttattaatgcggaataatgcaat

SEQ ID NO: 4582 - DNA, 430 bp, Diabrotica virgifera
aaagcagttgttttatttctacgtttagaatagttcctgcgttctctttcagggttcatttgataatgtaagaaaatgctttggcttggttcttttcagaaccagccaaagtctctagaagcagcgttttatttttaggtacaattattaatgtaagaaacgacactgagttcttgttagaactcagtgtcccctttgcacaggcctttatcaaggcctggtgcattttccttcccattgccttagccctggagggctgaggcgtagcagatgacctgcgattccgtccatactttgaaaatggacgaggatacggataggccgggggtgaattgagtagctccttgtatggaataagttagagacccagacttttgcctaacttattccccctatccgtaacatggcgcccgactcgtggaggaaccct

SEQ ID NO: 4583 - DNA, 427 bp, Diabrotica virgifera
gacgatgaatgcaaataggtgaaatctattttgcatgtaaaaaaggtatttgcatgcaagggcggatccaggacagattttcgggaggggccatgaacttttttttgagaggggtaccggagggtctggggaaaatttttaaaaatgagggttgtaatagtgagttttaaggcacttttcacagacttttgagtgccataaagacattccaaacttatagttattaaagtattattaaagtcaggacacatttcttcggatctaagttctttcaacaagtttaatactatttttccagtgcttcacctgtcaggccttgttcttcccctctttctgattttcactaattatttttatgttctcataagcgtcaatgaacttgacaaagtcttcacgaatgttgttaatgtgtatgtatctcacattt

SEQ ID NO: 4584 - DNA, 389 bp, Diabrotica virgifera
accacgcgtccgaaaatatgaagactgaaaaccacaagcaaatgcattcggccagtaaacttgtcaattataatggtggaaaattaattgattttaaagaaactaaaaattaatttttggtacctggggtaccagggataataattcaaaattaattgattaataatttccgaatttaaatcaccaaataacttaaaattttaatgggaaagtaattaattttaagttaattttttggtaaggaaaggtaatcctttttaaacaaaaccaaatttttaaagaattaaattaagttaattaataacgatggaattaatcactgaataagttcaaaataatgataattgataattttaaggaagtacctgataagcaaacttttataaaat

SEQ ID NO: 4585 - DNA, 401 bp, Diabrotica virgifera
  misc_feature (360)..(360): n is a, c, g, or t
gttttgtacttgtgtgccaaataaaagaataaatatgttcaaaaaacagaaaaaaccttcaaaactaaatagtgtacaaagtgacaaacgcattgatcctgtgccaagacctccagtatctccagtttcaccagttacaagaagtacactacagttttattgtcagctagcacatggtagtccaacggcatttgtgtcaggtttttccaatataaaagaactttacgaacgaattggtgaatgcttcaaccttcctgcctcagatatactattttgcactctaaacacttacaaaattgatatgactaaattattaggagggcaaataggactggaagattttatttttgcacattgtanaggcaggccgaaagaagttgaactaacaaaatccgaaagtg

SEQ ID NO: 4586 - DNA, 360 bp, Diabrotica virgifera
acaacacccaggactgagtcatattatatttttacagttattttgattgggattctcataaggatcaagtttagagaaaaaaagaaaactcaacatgagcctactgccccaacagcccaccaacaagatgatatttataacatcagtggcagagttcaaaaccaggaacagtggcccacacacgatgctcatttatcaatagaccacataagtgtcttgaaccaaatgaacaaaccggtatatgatgatgcacctccctcttatgaggaagttatgaaaacatcaattcaagttgtcggagagacctccacaccaccatactcaccacctcaaccagcaagccaggttgtaatagttgtg

SEQ ID NO: 4587 - DNA, 389 bp, Diabrotica virgifera
cacccgcccgtccgaacacataaaaaagcgacctgtccaaaacgccgcctagactaggcggcgttggccgtggcacattcactgaactcaatcaaactggtggaaactgtccaactgttgatggcacaaatccagtacaacctcgcgatctggaacctgctcaacaatctaataaatgccaaatggacaaccacatcggtccacactatgctcatggtacaccatttcgacaccatagcaaaaaattgtgacattcacccaacctcaactcaggtagtactgcgcgattactaccagcaaattaaacttatatattattgcaataagcacagcatcttcgtctgatcatacagctcactatgatcacctggattatacgtatttatgaa

SEQ ID NO: 4588 - DNA, 422 bp, Diabrotica virgifera
  misc_feature (75)..(92): n is a, c, g, or t
  misc_feature (145)..(183): n is a, c, g, or t
  misc_feature (185)..(314): n is a, c, g, or t
cacacgcctctacacacacgttctgatatttataattacgtatttttttatgggaaataagccacaattttactnnnnnnnnnnnnnnnnnnctatttactggatgtaagaaaaattgtagaaatttatgtttacatttacacannnnnnnnnnnnnnnnnnnnnnnnnnnnnnnnnnnnnnntnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaggttcaagcctaacttacccttgaatgcaacttcaaacccctccaaaagggcccccaaattcaaattcaagggccgtccttttaaaaatttctgaccgggaaaa

SEQ ID NO: 4589 - DNA, 130 bp, Diabrotica virgifera
acgcacgcgtccaccgagttgcacataaaattacaaattatccaaaaacggccttacatatacgttgtccagcaactcatttcactacatgccgccatttttgagttagatggacattttggtgcttttt

SEQ ID NO: 4590 - DNA, 284 bp, Diabrotica virgifera
  misc_feature (101)..(118): n is a, c, g, or t
  misc_feature (241)..(263): n is a, c, g, or t
actaccgacgataatacaccactgatgataacggcaatgaaactaccgtagatgatattactaccactagcctagaacccgaaccgtcggctgaaacgacnnnnnnnnnnnnnnnnnnaactgctacggagcgctctgtagattttgtgtgtgttaacgcaagaaaatttgctcaccctgtagattgcaataaatattatctgtgtgtagatacagttttcagtacagtgaagtatttgtnnnnnnnnnnnnnnnnnnnnnnntatgacgcagacaatgaaatt

SEQ ID NO: 4591 - DNA, 312 bp, Diabrotica virgifera
  misc_feature (20)..(42): n is a, c, g, or t
  misc_feature (47)..(65): n is a, c, g, or t
tccacccacgcatctgccannnnnnnnnnnnnnnnnnnnnnngacannnnnnnnnnnnnnnnnnngaatgtttagttcgacgtgagtatcttccagagctttttgtgtaggaaattttatgcgtttctacatatcccgaattttttctcagttaacctaaaattatttaacaacattacagttaatatgagataattttatattagtcacattcagtatttttaaggatgagcttatacatacagttttagatacgatttaatttttatatacaattacgactactagttttcagactttaaaatctgttaa

SEQ ID NO: 4592 - DNA, 335 bp, Diabrotica virgifera
  misc_feature (12)..(43): n is a, c, g, or t
  misc_feature (49)..(74): n is a, c, g, or t
  misc_feature (178)..(196): n is a, c, g, or t
  misc_feature (216)..(244): n is a, c, g, or t
  misc_feature (286)..(311): n is a, c, g, or t
aattataaaccnnnnnnnnnnnnnnnnnnnnnnnnnnnnnnnnaatccnnnnnnnnnnnnnnnnnnnnnnnnnncctcctttcgaccctacatctaatttaaatttacaaataaactgattaagaacagtattaggtctattaattattcatctagattttgattaatcccctctcgnnnnnnnnnnnnnnnnnnnaagattattataacattacnnnnnnnnnnnnnnnnnnnnnnnnnnnnntataaatcccaaggaagaacattaatttttatctcactattnnnnnnnnnnnnnnnnnnnnnnnnnnttggattattcccgtatattttta

SEQ ID NO: 4593 - DNA, 210 bp, Diabrotica virgifera
  misc_feature (13)..(32): n is a, c, g, or t
  misc_feature (109)..(123): n is a, c, g, or t
atgataaaattannnnnnnnnnnnnnnnnnnngggtgaaaaaataatcatcatggtaaaaatactaataaaatttcagatcatggcggggacagtactgggaggcagcnnnnnnnnnnnnnnnttaagctacaggtgaaggcacattcattacttcttaaattcgtatcaacagactaagtcagagcaagtcgatattatacacacgaca

SEQ ID NO: 4594 - DNA, 432 bp, Diabrotica virgifera
  misc_feature (33)..(68): n is a, c, g, or t
ggtcgacgacgcgtctacacacgacatctgctnnnnnnnnnnnnnnnnnnnnnnnnnnnnnnnnnnnnggctatggcaactaactttgtaaccgtggagcagctggtagtagaagcgaattacattttcaaagaacaatttggcgaagaagcagacatagctgtgtatgctccaggtagagtgaacttgatcggtgaacataccgactataacgatggatttgttatgcctatggcacttcctttggtgactgtaatggttggcaaaaaagttgagggatctgtagtaaccgtatatacaactagtacattttgcgaccaagaaacatcatttgacatgcctagtccatgtgcgccaattagagccataactccagtgggacccagatgggtaatgtacataaaaagggtgattgtaaactatataggcgat

SEQ ID NO: 4595 - DNA, 209 bp, Diabrotica virgifera
  misc_feature (11)..(30): n is a, c, g, or t
ttgcaacatcnnnnnnnnnnnnnnnnnnnnatggtggaactaagggtggtactgacggtggtacgaagcgatgatacggtcatcaatctcaatctacccatgacgtctattacgaggtgagtggctcaatggtcacatgattgtctcggttaggcatctgacgattgggacctacattggtacgattcttgggttctgttcactacgtt

SEQ ID NO: 4596 - DNA, 351 bp, Diabrotica virgifera
  misc_feature (317)..(346): n is a, c, g, or t
cgggtcgacacaagcgtccagcatacgtcagcataatattgatatttttgactttagtttaacagatgaagaaatggctgttattgatgagttcaactgtaatgttagagtctgccatgctgaagaattaaaagataatcctgagtatccatttacattgcaggagtaaatcttcttctttctaattttttatcataactgtataatttattcaacacgcttttatttatataattacaagactagtatctatatgaaattaatatcagtatattgtttttcaaaagtaaacggtacgtaatatacgaattattatnnnnnnnnnnnnnnnnnnnnnnnnnnnnnnttaat

SEQ ID NO: 4597 - DNA, 423 bp, Diabrotica virgifera
  misc_feature (144)..(167): n is a, c, g, or t
acaccactctaaagtgagtcgtaataatcacagatttatgaacagaaaaggaaagcatgcttctagatcgactgtaaatatttctgctgagagggagatgatccacctgatgcaaatgcagaaggctggaataccttgcccaannnnnnnnnnnnnnnnnnnnnnnntattggtgatggagtttatcggcgaaaaccaaatacccgctcctacattgaaggatataatggcagatgttcattgcacaaatgcttatgagcaggttattgaatatatgaggatactctataccaaggcagatttggtacatgcagatctaacggaagataatattttgtggcaccacgataaatgctatttcattgatgtcagtgaagcactagagcctagccatgaacaagcattcttctatctatacaagga

SEQ ID NO: 4598 - DNA, 115 bp, Diabrotica virgifera
aaactattgaattaggaatactttgaattcccttaggaggtcaaagtattcctaattcaatagttggtgctactgaattaggaatactttgacaacctaggggcctgcaggcgtt

SEQ ID NO: 4599 - DNA, 287 bp, Diabrotica virgifera
ttatcctgcacctgatcctttagtatttaagagatgggaagattctgatgaagaccaagcatagatacattttctagagggtagccattattagaggttactgaagtctcccattccctattggaatgtatcctacgatgataagttggaaatgatacaaactaatatcataaacttgttgatgtgattggggaatgctcttgcatatatttgtccagatctctaattctggttttagatacatctaatcatttgtacaatggtctaccttgttagtttaagcgata

SEQ ID NO: 4600 - DNA, 415 bp, Diabrotica virgifera
  misc_feature (23)..(67): n is a, c, g, or t
  misc_feature (255)..(281): n is a, c, g, or t
gacgcacccgtctacccacgcannnnnnnnnnnnnnnnnnnnnnnnnnnnnnnnnnnnnnnnnnnnngacttaagaccttttggaatccacctcttcaattgtatattgtgatttctaaaaataatttcagtttcagttgaaaatattacattgagattatttcaaacaagctttacctcataagatatgtacttttttgaagttaatataaagtagcgcttatttgtgactttccgtaagtcttggccctagannnnnnnnnnnnnnnnnnnnnnnnnnntaaaaaaaaactcgcaactaaaaattacatgttacttatttatactgtgctgtttgtgtaaaaaatagtggtattcgctcaccacggacttttgtgataagaatagttaaagtcatgttctagaattcaaaatg

SEQ ID NO: 4601 - DNA, 193 bp, Diabrotica virgifera
  misc_feature (12)..(175): n is a, c, g, or t
  misc_feature (177)..(192): n is a, c, g, or t
cccacgcgtccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnt

SEQ ID NO: 4602 - DNA, 395 bp, Diabrotica virgifera
aaaaacagcttcagtagatggttcattagacttatgttcctatagtcttcacaaacttttgctcctggttttttagtcaacggcatgactcagatttgagccacatttttcctgccttgtatatgtcattaaatagttcagctattatttttatttgttctatagctaatagcttcaacagttctgcaggaatttcatcaagtcccagtgcctttccatcctttatttgtctgatggctgccgttacttcttctggtaggatttcaggaccttaattctcttcaatggtgggttcttgtcctattctaagctcgtggaaaagtttcgtttctcaagtattctccccatgctttctttttatcttctttggttatggcaagattgccttcatcatc

SEQ ID NO: 4603 - DNA, 307 bp, Diabrotica virgifera
cgcgtccgaacgaatctctcgccatctgcagctttcgcgttatctgttacgactgtattcggatttgcacttatgggtctggttctcgctacctgctgcgactcccacgttttgaaccaactgcatcgaccctctcagatccttgcccacaccagtcgtggccaagtctaccgattgttcgggcaatcttccctgccagttctcatgtgcacgtcatcgacacttcgccagcaattgcactccagatggattcatgtgcatgctgtgctgtcattgcagtctatgcttcgtttatagaccgtttgga

SEQ ID NO: 4604 - DNA, 404 bp, Diabrotica virgifera
  misc_feature (256)..(273): n is a, c, g, or t
atgaaattcgcagaaagatgcattaaagaaagcttaagattatatccaagcgccgtcagtatttcacgattgtcaggagaagaaataaaaaccaaaactggatatactattcctaaaggatgtacagtagctgtcttgatttacgacctacatcgtaatccagagatctgggaaaatcctttaaaattcgaccctgatagatttttacctgaaaatatgtcaggaagacatccatatgcttatattccttttagtnnnnnnnnnnnnnnnnnnataggacaaaaatatgccatgttggaactgaaaactgcagtttgtggactgataaacaattttaagctggaacctgtaacaagacctgcagacatgagatttaaagctgacatcgttcttagaccagctaa

SEQ ID NO: 4605 - DNA, 124 bp, Diabrotica virgifera
  misc_feature (2)..(59): n is a, c, g, or t
  misc_feature (104)..(122): n is a, c, g, or t
tnnnnnnnnnnnnnnnnnnnnnnnnnnnnnnnnnnnnnnnnnnnnnnnnnnnnnnnnnnctgaaaggttatccttttttaattataccaaattttttagacctnnnnnnnnnnnnnnnnnnncc

SEQ ID NO: 4606 - DNA, 304 bp, Diabrotica virgifera
  misc_feature (244)..(258): n is a, c, g, or t
  misc_feature (260)..(275): n is a, c, g, or t
cgggtcggccacgcgtccgcacacacttccgcccacgcagtccggtaatgctccagaaaatggatggggtgaccgatatagtggtattcattcagtacagtaatacaatcatttaccatgacaactacaggcatgatgttaagttacatgcgaatccaggcatagaatttcgaatctatacatatcttactatcaagttaaatgtccactcaaagttggtgtctatcacaggctgtggagatcnnnnnnnnnnnnnnngnnnnnnnnnnnnnnnngcgtggaattaatatctaattttatatgc

SEQ ID NO: 4607 - DNA, 400 bp, Diabrotica virgifera
  misc_feature (19)..(39): n is a, c, g, or t
  misc_feature (56)..(82): n is a, c, g, or t
  misc_feature (87)..(108): n is a, c, g, or t
  misc_feature (198)..(219): n is a, c, g, or t
  misc_feature (267)..(298): n is a, c, g, or t
  misc_feature (300)..(313): n is a, c, g, or t
  misc_feature (315)..(331): n is a, c, g, or t
  misc_feature (353)..(390): n is a, c, g, or t
attatttcattaatctccnnnnnnnnnnnnnnnnnnnnnctaatatctgatattcnnnnnnnnnnnnnnnnnnnnnnnnnnngttcnnnnnnnnnnnnnnnnnnnnnncaccctttaacttgtggtttaatattattaatacaaacaattttcacatcagttattacaggattaataaattataattactgattttcnnnnnnnnnnnnnnnnnnnnnngtaggaggaatattaattctttttatttatataaccagaattgcttcnnnnnnnnnnnnnnnnnnnnnnnnnnnnnnnncnnnnnnnnnnnnnngnnnnnnnnnnnnnnnnnctatattaagatttattttagnnnnnnnnnnnnnnnnnnnnnnnnnnnnnnnnnnnnnnatgaataacc

SEQ ID NO: 4608 - DNA, 386 bp, Diabrotica virgifera
caaactttagactcagtttttgtaggaccaatacctgaaggcaaacacatgttcgtctttcaagcggaccctccaaatgtctcacgtattccagaaaatgatgctcttggtgttacagttgtactattaacgtgttcttatagaagtcaggagttcattcgtgtaggatattttattaataatgaatatactgatccagaacttaaagaaaatttacctagtcctccacaatttgataaggtaacccgaaatattctagcatccgaaccaagagttacccgctttaaaatcaactgggaagaaaccaaccccacagaaaataacacaaactctgaccaaagtggagcatcagcacccacgacatcagaagctggaccctctgctcc

SEQ ID NO: 4609 - DNA, 424 bp, Diabrotica virgifera
  misc_feature (161)..(183): n is a, c, g, or t
  misc_feature (398)..(418): n is a, c, g, or t
acaaaatgcatatttttggagatatttgcaaaaaaactgttgaaaatcgtgagaaaatttcgaattttcaattgccaataccttgaacagtattgggtttttgaaaaaactttatgcaacattttttgcttaaaattaggtcttctatcgatatctgagannnnnnnnnnnnnnnnnnnnnnnaccaccgaaaaggggtggcaaccacccccagggtgaaaacggagttcgggtcaatatcacttttgaagttaagggtgggataagcctagttccaggatttcatgtaaatcggttcatagtaaaaaatttctgagctaaaaagcttcaatgactgcactaccaataattttaagtttttgaataaacaataggactactatttgggaatctggccnnnnnnnnnnnnnnnnnnnnncggttt

SEQ ID NO: 4610 - DNA, 295 bp, Diabrotica virgifera
  misc_feature (12)..(36): n is a, c, g, or t
  misc_feature (145)..(175): n is a, c, g, or t
  misc_feature (184)..(206): n is a, c, g, or t
cgggaatgaaannnnnnnnnnnnnnnnnnnnnnnnnagaataatttaagaagaattttatttttggagtgaaaagcataaaggtttttaaaagtttagtattaccaaatgagttttaaaatattggtaccagggttttagggaannnnnnnnnnnnnnnnnnnnnnnnnnnnnnncgggggtgnnnnnnnnnnnnnnnnnnnnnnnttatatggaaatatataggttaagaaatttttgtgccaagatatgtgattcgcttttaaatatacctaagggattaagacgtaaattaa

SEQ ID NO: 4611 - DNA, 356 bp, Diabrotica virgifera
  misc_feature (20)..(38): n is a, c, g, or t
  misc_feature (61)..(83): n is a, c, g, or t
cgaaggatcacccaaaaaannnnnnnnnnnnnnnnnnngtttaagaactccttcgttcctnnnnnnnnnnnnnnnnnnnnnnntccgtgaagcatatgaactgcctctgccagaataatacaaacgcctccatcgagactgccagcaattaattcattttagtttagtaaaaaaaaactggtgcggctaaaatttttgcactatatctgtgacattggactgcatttgtcaaattcgataaaaaaatactacaataaattatattttagctttatctgtacaggaaaaccataaagatttttaatattaactttcaaagtgcgacatagtagtggattaatatattatattccaaa

SEQ ID NO: 4612 - DNA, 427 bp, Diabrotica virgifera
acaattctgaagaatctttggctttcctaggactaattggagaacaaaatatcgaagaaagggccaaattactagatgaaaatccagcaaatgtagcagaagccctcaatgtagctgaagaagacaaagaaaacgttggtaaacaattaaaagcattatatacttcttcttcttttacggatgatagagatgcattgataacgtttacaagtgacgcagtttttgtacgatcaataatacgtcaagccgaaagcatatctaggcacgtacctgtgtatctgtatgacctaacatatttgccagaggatagtactgctcaaggagtcgcgcatggagtagacatgcggtatttgtttggtggagattctcatggcctagtatttaatgaaaatctccgaaaatctttattaaagttttggactaaatt

SEQ ID NO: 4613 - DNA, 349 bp, Diabrotica virgifera
attggttacactttcaccatccaatgcacataattattacaactgtccacataccagccaggtccgacaccaaatttaccagaatacattacaggggaaagttatccatgtacgcattccataaacgggtttctttcacgcaccactcacttgtcttcagggacccgtcattgatgatagttgtactacaccacttatagatgaatgtggttatagagcggactcagtagttttacgaattgacccacttcaatcaagttaacaactgcactacgatgttcagatctatgtggcaccatagacacgttatctataaataaactttttggactgttgtagaatttgattc

SEQ ID NO: 4614 - DNA, 283 bp, Diabrotica virgifera
atggacatgccattttattgtatacctatatatcttgttgttaatgctcatgtaggataagcaggaagattgcagagattttataaatcatgagacatgattcgctatagcttttggtgggatgtttgatatctgggagggctattggagctaaatctgcatatttttatattagatgatagttttagaatgaggcttcaattttgcaggttgtttttgccgatggatgacacactggatttttaggtaagataccatgtggtttctggctagggttttgagt

SEQ ID NO: 4615 - DNA, 415 bp, Diabrotica virgifera
  misc_feature (155)..(174): n is a, c, g, or t
tgtcgaacaaattaattaaacatgaaacatcacgacgtcttgaaatttacactggttttaattgcagatcagggatcgagcttattgcattgaaagcgcatatgttccgaaaaaagattttcatacctgtatagtcgatatgattcaattttacnnnnnnnnnnnnnnnnnnnnttcaattgattataacaattagttgatcgtaactgaaatttttgataaattttgcatgagtatggcgccataaggcagaatatggaactatttaacagtctcaattgtttatagtgtgtcaaaataacattatcgctttgacagccatactgacgcttagtgtgtatagaatagtgagattgttaaataggatttctgcgattaacagcaagtgcaacatttgtgacataaccatcatcac

SEQ ID NO: 4616 - DNA, 288 bp, Diabrotica virgifera
  misc_feature (17)..(49): n is a, c, g, or t
  misc_feature (113)..(137): n is a, c, g, or t
  misc_feature (181)..(198): n is a, c, g, or t
  misc_feature (204)..(217): n is a, c, g, or t
  misc_feature (219)..(236): n is a, c, g, or t
tagttttataggttagnnnnnnnnnnnnnnnnnnnnnnnnnnnnnnnnnggcgtgctttgtgattatttatgtttagtagatgatgaagattttattatgagtggcattgtgnnnnnnnnnnnnnnnnnnnnnnnnnttatctgaattcggcaccatttttttcatctgtttagtaatagnnnnnnnnnnnnnnnnnngtatgnnnnnnnnnnnnnngnnnnnnnnnnnnnnnnnngcgctgtattttgagtgtggtaaggtatcataatcattactttttttattga

SEQ ID NO: 4617 - DNA, 307 bp, Diabrotica virgifera
  misc_feature (8)..(48): n is a, c, g, or t
  misc_feature (84)..(97): n is a, c, g, or t
  misc_feature (99)..(113): n is a, c, g, or t
  misc_feature (115)..(147): n is a, c, g, or t
  misc_feature (204)..(222): n is a, c, g, or t
  misc_feature (266)..(279): n is a, c, g, or t
  misc_feature (282)..(294): n is a, c, g, or t
cgcgtccnnnnnnnnnnnnnnnnnnnnnnnnnnnnnnnnnnnnnnnnncagtttcgactaattttattaattgatctattttannnnnnnnnnnnnncnnnnnnnnnnnnnnncnnnnnnnnnnnnnnnnnnnnnnnnnnnnnnnnnaggattagtttataataatcatacctttataaatttccattttaatagaggctaaannnnnnnnnnnnnnnnnnngtctatataatttacctaactttattgtaatgaacagttactcnnnnnnnnnnnnnncannnnnnnnnnnnnttacattaaattt

SEQ ID NO: 4618 - DNA, 89 bp, Diabrotica virgifera
  misc_feature (16)..(16): n is a, c, g, or t
acctacacgtccgctnttagataatatatatgttaggcaattaaaagggcacttttaaataacgggtggttgaatattaagggtgaaat

SEQ ID NO: 4619 - DNA, 103 bp, Diabrotica virgifera
atggaggaaaaaataattccaaaaaaaagaatgtgtgtgtactttgtacgcacgtaagaagttatacttctactacatattatgtgatttttaagacaatacc

SEQ ID NO: 4620 - DNA, 180 bp, Diabrotica virgifera
cccacgaatccgaccacgcgcccgttactttacttgtgacctggatagcacccaatttattatatcaacatcgtgtagttatctactgttacaatagctatacagatatagtaaatatgtacgacaaaggttggtgctgcaccacatcccgctcagtgaagggaaacgtcaagacaccta

SEQ ID NO: 4621 - DNA, 399 bp, Diabrotica virgifera
  misc_feature (142)..(166): n is a, c, g, or t
  misc_feature (218)..(235): n is a, c, g, or t
cccacgcgtccggtcgagtcggaggccagcagggtcaggggggtattcaagtgccccagcaagtgcagatggccgtaggaagagcagtcaccaatgccgctatcaacgaactatccaacgccttcaaattccataagtaaannnnnnnnnnnnnnnnnnnnnnnnnagtttatacattctctttcgttcttcttagcgcgtctagtagaaaaccaggnnnnnnnnnnnnnnnnnnttaaagctgataaatgagatattttgtagtttagactgaatatgggctttctattggacctaaggagatcttactaacactaacctttcaatgccagtatactaactgttctttttgttgttaagattgttattattactattaaagaagcaatgttaacacag

SEQ ID NO: 4622 - DNA, 397 bp, Diabrotica virgifera
  misc_feature (369)..(390): n is a, c, g, or t
caaaaaaatacattagttaatattattgttactctgctttaaaataactttttaaacaccaagaatattacaatgcttcaaaacttttaccacttcaaatacacgtcaaactttaccacttcaaataccatgtcaaatacagctgatctattaaatgtcaactttccatgttagtgggcagtttctatacattttctgagaggcgagggggactagacataaaaagaaaagtgcggcaggtgaaggatccgggactgtaatagctcaatgttcctatgtgtctagtagggcggctgttactgtatacagatacatttataaatactgtaataacagatatatttttacattgtgtacatagattgttgnnnnnnnnnnnnnnnnnnnnnnctggttt

SEQ ID NO: 4623 - DNA, 168 bp, Diabrotica virgifera
tggactccaagatcagtgtacatgtatatgacgccaattaccggaacacccgcttagcgcatcatggtcttttacgttcaagttgtagtccatggactactagaggctgaaccacgtgatctacagatcaagacagcaatgttcaggaaaacttcaggtgggattcct

SEQ ID NO: 4624 - DNA, 380 bp, Diabrotica virgifera
  misc_feature (191)..(191): n is a, c, g, or t
  misc_feature (196)..(196): n is a, c, g, or t
  misc_feature (218)..(218): n is a, c, g, or t
  misc_feature (230)..(230): n is a, c, g, or t
  misc_feature (302)..(320): n is a, c, g, or t
gaaagactcggttaaaatcccaattgccacactaaaagccggaggcccaaataaccaagtattgttagatctgtcattcccagacccaccagtcacattttcacttatacaaggtaatggaccagttcacattgtaggccatcatttaattggtagtccgatggaagaattcgatcggatggagcgcgtanaacangaggggtgggcggggggacaangggaagaatganccgggacgatgggaaaacggaaatcgaatggaaaagtaaaggtgtgacttgagccccaatccctctagaacnnnnnnnnnnnnnnnnnnnaggaggaagatgaggatgaagatgagcccaaagccaaaagagcagaatcagcgactaacg

SEQ ID NO: 4625 - DNA, 372 bp, Diabrotica virgifera
  misc_feature (154)..(171): n is a, c, g, or t
  misc_feature (214)..(214): n is a, c, g, or t
acataatcttcatcctacttcccccaaatagcactggacttactcagccgttagatgtcgcatttttccgcccacttaaaattaagtggcgtgaaactttagattcttggaaaacaaaaaatcgtggaactgtgccaaaagatacatttcctcnnnnnnnnnnnnnnnnnngggagcgaatgggagagaaaaatctttggcggaggggaggggnttgatttaaaggtgcaggggtagttcgaggaaatcgaggagaggtcttgaagaggcttccaagtaaagacgcagtagaggatggcaaagaaagtgagaataccgttgcctgggtaactacatttcaggaatatttagaagaatgtagaacgaaaggga

SEQ ID NO: 4626 - DNA, 156 bp, Diabrotica virgifera
  misc_feature (21)..(50): n is a, c, g, or t
  misc_feature (68)..(86): n is a, c, g, or t
  misc_feature (88)..(107): n is a, c, g, or t
  misc_feature (109)..(125): n is a, c, g, or t
  misc_feature (127)..(144): n is a, c, g, or t
gcgaatatggtgatattattnnnnnnnnnnnnnnnnnnnnnnnnnnnnnntggtaaggtggaaggggnnnnnnnnnnnnnnnnnnngnnnnnnnnnnnnnnnnnnnngnnnnnnnnnnnnnnnnngnnnnnnnnnnnnnnnnnngtagttttagtt

SEQ ID NO: 4627 - DNA, 181 bp, Diabrotica virgifera
  misc_feature (53)..(70): n is a, c, g, or t
ataaaaactgtctttatctaatttataacgaactttacttataagttaaaacnnnnnnnnnnnnnnnnnngatcagaaaaccctacagagttttatcaaagtaacaataagttttttcacaattaactttatttaaaaaatcaatttatttagttggggtgattactgcatcaatttaact

SEQ ID NO: 4628 - DNA, 343 bp, Diabrotica virgifera
ccgcaaaaatgtgtccacttagatcaaaaatcgacctatttcgtcatttccttaaaatctaataaatactgccaaatatcaaggtggattattttctttggctcacactgtatatattttaatattctacacagaaaaaagtcaggaacaaatttgtaatgctaatgcgagtagaggggggtattttttttttacaaaaagtctgttgtcgcaatttttacttatcacatctacagaaaaaagaataaagtgaaaaactgtttataacaaattgacgaatatttttattgttaaaagtgtcatttactgttaagtgccagttactatttttataagctagcat

SEQ ID NO: 4629 - DNA, 80 bp, Diabrotica virgifera
ttcactcgtccggtttgacatacatgatactaaacctaaacataaattatacaaaattaaattttcttactattgtaaac

SEQ ID NO: 4630 - DNA, 157 bp, Diabrotica virgifera
  misc_feature (7)..(20): n is a, c, g, or t
  misc_feature (22)..(49): n is a, c, g, or t
caacacnnnnnnnnnnnnnntnnnnnnnnnnnnnnnnnnnnnnnnnnnnctactaatgtgagagaataattgatttttaccagagagaaatttaatttttgtaccctgtgtatcacggactattacttaataagtacatatttagtaatttccaatt

SEQ ID NO: 4631 - DNA, 170 bp, Diabrotica virgifera
gttgctggttccatgaaactggaattggaccactaccgtgaagtaactgcttttgcccaattcagttcagatcttgatgctgctacgcaccaattgttgagcatatgtgtacgtcttactgacttgttgagacagggtcaatacatacccatggctattgaataacaagt

SEQ ID NO: 4632 - DNA, 341 bp, Diabrotica virgifera
tggggtttctgggactgctccatttggaagtgttcactcaaagattgacacaggaatatgacgccgaacccataatcacggccccatctgttacttacaaaatcaaattaaaacctaccaagcaaaatataaaagatggatcagatgtgatctttatgaacaatccagccaattttcgcgaccatgttagaatagaggaggggggtggggggaggattattggaacaatggtaacgcctggacaagtacttgggacccgtcatatcactgtgtatggaacgtagggggatccagagatctgcaaataatatagacaatgaaagagttatattacaatatga

SEQ ID NO: 4633 - DNA, 310 bp, Diabrotica virgifera
  misc_feature (11)..(28): n is a, c, g, or t
  misc_feature (34)..(52): n is a, c, g, or t
  misc_feature (97)..(121): n is a, c, g, or t
  misc_feature (148)..(173): n is a, c, g, or t
tcccggggccnnnnnnnnnnnnnnnnnnagggtnnnnnnnnnnnnnnnnnnncttaattaaatgtaaaaagaaatttactcttacgtttaaaggccnnnnnnnnnnnnnnnnnnnnnnnnngacccacagaggtttagaacattattnnnnnnnnnnnnnnnnnnnnnnnnnncttacataatagggggagtcaacctgggggggctaaaaattaaacgccacctttttggtaaatcagtacactaaataaagacctctgggatccaactagtttgacgatattaagaaactaccttagggaaaaccccg

SEQ ID NO: 4634 - DNA, 192 bp, Diabrotica virgifera
tccgggaaaacagcgtccaaatctaacttccaggtagggaaaatggcaatgacaggcttaatgaattaaatattattcaagtttgaactttcagtttaaaagagattatcccaagcagataattcaataaacaaacttctgggggtccattcctaaagaactggccttactaaagtgggaaaataccaactc

SEQ ID NO: 4635 - DNA, 446 bp, Diabrotica virgifera
cccacgcgtccgtccagacctagtaggttaactcagacctcttgagggaaagtggacgtatattatttattttgccaatcttttgcttgtacctaccactgtgcgtctaggtacctagtactagcaacatttgtattgtctaccatcaactttatatgcacacatgtttatttcttcactgcttaaaactaaataaagtcgttcaagtacttctgtaactaaaaactacacaaaatttacaacaaaatgttcggaaaatacaactaaaaaaaccgttaacggtaaaaaaacttaagaaacatggcaatatggttcaaataatataaaacaaacacaattgtttgacagtttgcctcccaaacgtcaaagtcttgccccattataatcttgacgtatgttaaaagcgccatctattgacaatttgtaaaaacttaggaagtaggtct

SEQ ID NO: 4636 - DNA, 237 bp, Diabrotica virgifera
  misc_feature (29)..(50): n is a, c, g, or t
  misc_feature (202)..(218): n is a, c, g, or t
  misc_feature (220)..(233): n is a, c, g, or t
cttttactaaaatttaatttttaactacnnnnnnnnnnnnnnnnnnnnnncattttacaccatgttatcacctatttttacacactaccacttttaacctttacaaattttttaccaacatatacatttaaacttacttaaattcagtcacgacgaccatattacccctaaacaaattgtctctttactaaaaatatctacnnnnnnnnnnnnnnnnncnnnnnnnnnnnnnncccc

SEQ ID NO: 4637 - DNA, 414 bp, Diabrotica virgifera
  misc_feature (48)..(71): n is a, c, g, or t
  misc_feature (116)..(145): n is a, c, g, or t
  misc_feature (209)..(260): n is a, c, g, or t
  misc_feature (285)..(403): n is a, c, g, or t
acggtcggaatccggtcaccagcgtccgccagcgtcgccagcgtccgnnnnnnnnnnnnnnnnnnnnnnnngtaaagtaagaaaaatttactaatgtagtaattagtatgtggagnnnnnnnnnnnnnnnnnnnnnnnnnnnnnntacctgtgtatcacggattattaattaacaattacacatttactactttcgaatttaaaagacnnnnnnnnnnnnnnnnnnnnnnnnnnnnnnnnnnnnnnnnnnnnnnnnnnnngaagaaatgttaatcccttttaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctaaaatttaa

SEQ ID NO: 4638 - DNA, 453 bp, Diabrotica virgifera
gtttttcttaaaaactatcaggtaataaacatattatataattgaatataatctgcttggcaaccctggtagaataattctaaattacaccatttcttgagaaatctaacacttgactgaattgtctttttaaatttaggatggatgttttgtgttcctaaagtagtaaattgtctttggtgaatgtcttaatacattttcttccattatggcaaataattcaataacataagttttagcacacaactgccgttttataggcctatatttacctttacctaatgtcaattaacgttagtctgtatgcgtattttctgaaaggattcaaaaactattttacgtaaacacgttatcccttattttttgctcaatgcgcatggcaagtatagccttttacgtttaacgtacgtcaaaaaggtacagggtctaaaatctctctaatatggacccaag

SEQ ID NO: 4639 - DNA, 445 bp, Diabrotica virgifera
  misc_feature (15)..(32): n is a, c, g, or t
  misc_feature (84)..(107): n is a, c, g, or t
attaaaacgtacgcnnnnnnnnnnnnnnnnnngaaattagttaacagaatagtttataaaggaatttcgggaataaagctaagnnnnnnnnnnnnnnnnnnnnnnnncaatttcgttttattagaattcaaatataacaagctaaaaatgcgagcattattataacgaaaactttgtttatttatgtatttaaattcctaatatggaaaattgctatcatgaaaagttgtttagaattaaacattttgtttttatgtgtaatttaaacatgttttaatgtgaaattcatatttttttacataactcgactaaaatcgattcaattttatatatgatgattgcatcgtcgattttataccatgcagatctttttatgaagactataactttatctcgtaaaattacaaataaaaaagtgtcccgtaatataagtgtccaacttaag

SEQ ID NO: 4640 - DNA, 328 bp, Diabrotica virgifera
  misc_feature (237)..(290): n is a, c, g, or t
acgcgtccgatatgatatgaactgtcaatgtaataattaggaaatggctattatcagtggatgtattttataaagttatattgtacatttaaatttatctatgttccaatatatttaacacaatataactttataaaagaaacacaataaagttataaattccaataaaaacaataaatgcactaatatcactgtcactgaaaataatgtagattaaaattcatagtaaacaatgtnnnnnnnnnnnnnnnnnnnnnnnnnnnnnnnnnnnnnnnnnnnnnnnnnnnnnncatacactaagcgaaaaagggagcaacgggagtgaaag

SEQ ID NO: 4641 - DNA, 194 bp, Diabrotica virgifera
  misc_feature (2)..(19): n is a, c, g, or t
gnnnnnnnnnnnnnnnnnncgtgcgtgataacccacgcgagaatctcgtaattgcgaacgacgatcttcggccgtcaacttttataaaaactcaaatatttacataaaaattaggagttaacacttttcatttatcaaaatatcttcactaccttacttccacatacaattacttttactttatacacattttt

SEQ ID NO: 4642 - DNA, 425 bp, Diabrotica virgifera
  misc_feature (3)..(16): n is a, c, g, or t
ccnnnnnnnnnnnnnngacgatttgattgggcaatcgttactttaacgaagggggaagtcatgacatcttaactactttttttctgtctcctctagttttcggtatacactgcgaaacataccaatttgtgacaccctgtacattgtaccttgaggggtgtaaaatcaaagtcggcaatctcccatttccataattttgggaaaccgcgaaaatctgtagaaactaacaaaattaaattaaaacaataaaactgatgaagaatcaaataaaatttggtttgtgatcggatgtacagaaaggggagcttaagaacacacagtagcgatcaacaggtagcaacaaacgcggtgattgcgacaggccgttggcctaggtcgctacaatttctttatggttatatccgtttcttgggtgtgaatccgtc

SEQ ID NO: 4643 - DNA, 370 bp, Diabrotica virgifera
  misc_feature (16)..(38): n is a, c, g, or t
gtcgaccacgcgtccnnnnnnnnnnnnnnnnnnnnnnnccgatgtgttacgcgatatgatttaagcatacatacgcgtcggtaacatatgttgcaacctccaacttggtaagtgccgattctgaatcactagcttctacggtccgaaagaaagacaatggcaacaacgatggcgcatgttcctcctccacaatactagtcacgatgatgtcacggcctaggatgcacatcatacaggtgtccacttatcaactggtaattttgatctcgtttaaaaatcacaatgagttgacatatgaagagatccataatgagtctgagatatcataaatggatccaattagggggttacagtcgctggcaatgggtaa

SEQ ID NO: 4644 - DNA, 453 bp, Diabrotica virgifera
  misc_feature (2)..(19): n is a, c, g, or t
  misc_feature (52)..(72): n is a, c, g, or t
  misc_feature (93)..(111): n is a, c, g, or t
  misc_feature (142)..(159): n is a, c, g, or t
  misc_feature (274)..(295): n is a, c, g, or t
cnnnnnnnnnnnnnnnnnnctgacaactgtaattcaagacttatatgcaagnnnnnnnnnnnnnnnnnnnnnaactcctaaaaagacagtttnnnnnnnnnnnnnnnnnnncttgcatataagtcttgaattacagttgtcnnnnnnnnnnnnnnnnnnctgaaaaatacattatttcgcattaatacctcatcctgttcgatagtttcttaagatagataacaaactgccagttcgataagttttcttttaactaacacaattgtttattagnnnnnnnnnnnnnnnnnnnnnnactgtactgttgtccccaaaacattaaagtgttctgcatttatttaaagaataataaactttttatattaatggtagttcttttgtttttgaggtttttcactcagctgtttacgcttgttttagttagataggtgttgcaaaaactatagggataaa

SEQ ID NO: 4645 - DNA, 407 bp, Diabrotica virgifera
  misc_feature (27)..(52): n is a, c, g, or t
  misc_feature (95)..(122): n is a, c, g, or t
  misc_feature (155)..(189): n is a, c, g, or t
tggaaaaattagatatatttcgtaagnnnnnnnnnnnnnnnnnnnnnnnnnnttaaattcaagtaccaaaattttgttaataaacaaatttaccnnnnnnnnnnnnnnnnnnnnnnnnnnnngatacttttagggatgagcttataaataaaacnnnnnnnnnnnnnnnnnnnnnnnnnnnnnnnnnnngtcaaaatttacataatttaagacatgtcaagatttatgttcaaatattattaattatagttattagccattttatagaccaaaacatatttaaattagttaaatttaatcgagaagatacatttcgatctccaaatatgtatatcgagtacaaatcgagtagtttaacggatgaactcggcaacatatttttcacctgtttaatgatcccatgtcaa

SEQ ID NO: 4646 - DNA, 124 bp, Diabrotica virgifera
cacgcgtccgcatcatctttattcagccattaaacctcgttctttctaccacacttgtcatctccccttttaaaacaacctcactactggcgttaccttctgttctatctccactactctccgg

SEQ ID NO: 4647 - DNA, 383 bp, Diabrotica virgifera
cccacgcgtccggagttatttctaaggagattgaggcttattaaactgtatatttattcattaattaattgtgactacaattacaatgtctgcatatattttatgtggtacttccagtggaggacttccaatattatccagaaaaaaaggaaattctgagccgcttccattttctataacaggatcattaaacggaatccacatgttcggaaaaccatttggcatagaagttttagaaaccttaactgatgattatgctgttagttggaaggaatttgaagacagcataattataattggagcagcaagtggatgttcaatagacattttaaacagactattggaagatgtttttaatacaactagttatgataatttggaat

SEQ ID NO: 4648 - DNA, 414 bp, Diabrotica virgifera
taaggcgcttacattacataacacacttcaaaaactaaagttataacaatctgttagatgttgatagaaaaatcaaattctaataatctaaaagtctacacctacagtactacgaatgaatgcagttccaactaaaagtttactggggctttttaaaacaggatggaatgaaattccagaaatcatgggcagttcaccttttgggttaactgggattggattaacagcttattcactgtagttatactatcaaaatgacggcgacaacagaaagtataacgatcagtacaccgtttatagacatgatgatccaagggtagcaaaattaaaaccataatacatttataaaataattagtcctgtaacaactttatttcatgtaacattcttaagataaatacattattaaagtaa

SEQ ID NO: 4649 - DNA, 385 bp, Diabrotica virgifera
  misc_feature (2)..(24): n is a, c, g, or t
  misc_feature (116)..(137): n is a, c, g, or t
tnnnnnnnnnnnnnnnnnnnnnnncttcacatattagtcaaaattgtaattattaactttatttaacttgaacttattaactttacttaactttaacttattaactttatttaacnnnnnnnnnnnnnnnnnnnnnncatatgaacttctggattccaatccctcagattagtttttggtttcacttgttattattactattataaaccacgagttaggaaaaggatctgtgtatccactcgtaggtttatttattcaataaggcttgtgcctgtcccactcacagtgaggtatttatatgttatatatagtatcaggtagtatttaattaaggcgtacgtattataaacgtacaattattatttggtgagggttctactaacct

SEQ ID NO: 4650 - DNA, 364 bp, Diabrotica virgifera
  misc_feature (46)..(72): n is a, c, g, or t
ggcagtcgacagggtctaacagtgttaggcgaacgatggcatagannnnnnnnnnnnnnnnnnnnnnnnnnntgccatgccaccaaataagagcacttcagctcaaatacactttgcagggatctacacgttgacagttcacggaataatgtgtgacggtatcgccattttgacagatggagacaaattgccgaagagtggaggggtagaccttccaagaacatccttagggaaaacgtctcttaggaaaatgtcgatagcagaacattcttcactcgagatatagagggtacacgcaacatgaccgctttacttgccatagccctacagatcggtcataacgcattcttcacttcctttctcg

SEQ ID NO: 4651 - DNA, 245 bp, Diabrotica virgifera
  misc_feature (25)..(42): n is a, c, g, or t
  misc_feature (152)..(173): n is a, c, g, or t
attttagttttcgtttatattattnnnnnnnnnnnnnnnnnntttgtgagccaatgtttcttgggttgaattctttattagtggaagtatttatacatataaaatagataaacagtgagatattaggtgatgtagttttgttatttattacnnnnnnnnnnnnnnnnnnnnnntaattttaggaggtatttgttattgttaaaataattaaacgaatatgttaatatatttttactttcatcctt

SEQ ID NO: 4652 - DNA, 392 bp, Diabrotica virgifera
ttgtgaattataatcaaattttaataaaaatcagactgatacgaggtcaattacctaaataccgaagtgaaacttatccacaggtccctaaaacctacatcgcacaaacttatttatagacaaactatttcaaagaaaacaaaatggataagctgaaaagagttttaactgggaatgagtctccagatgaagagagtggaataatgtcacaattagacgatgctaccaccttaagttggtccacaagactaaaaggctttttggcatgtttcataataggcatattactgtcgtttttgggttcgtttgctttatttttaaatagaggtttgccagtttttgcagtattttacaccttaggaaacgtcacgtccctcctcagcacatgcttc

SEQ ID NO: 4653 - DNA, 213 bp, Diabrotica virgifera
tggtaacaattaataacaaagatgctacgcagtgcgctcgttccttaatatatttggattcgtgagggcagctttgcacggcaacatcgaagtgcattgcagcttggctaggtattgtgaatgtccttatcatgccttcatcaagaatacttgttaagtttttacctgtcatgattgcccacaggtatcttggagaatttgcgattgtacgca

SEQ ID NO: 4654 - DNA, 429 bp, Diabrotica virgifera
gcagatacatgatgcaaaccaaaaacaaattgtaggtgctgaggttaaaaaggtttatacaaatggacaattccaagatcatctcggagatgccgttgaatttttcagcgatacttcatttggaagacctattattcaacatgccaagctacaatcccagtttagtgacgtatatttttaccacttttcctaccaaggaactatcccaggggttcgtccatactacgaaggagcatataaggtagctcatggtgatgaacttcaatacgaatgggcaattggtaataacacgaatttgaatacctttccaccaggagatgttttaacaagccaaagataccgaattctacttagtaattttgccaaaaacttgaacccaacatctgaatctactgacattttgggaataaactactgggcaacccttaa

SEQ ID NO: 4655 - DNA, 265 bp, Diabrotica virgifera
  misc_feature (13)..(30): n is a, c, g, or t
  misc_feature (43)..(57): n is a, c, g, or t
  misc_feature (59)..(71): n is a, c, g, or t
  misc_feature (81)..(117): n is a, c, g, or t
  misc_feature (185)..(203): n is a, c, g, or t
  misc_feature (207)..(239): n is a, c, g, or t
gattaatttaaannnnnnnnnnnnnnnnnngcaaaagtaaggnnnnnnnnnnnnnnngnnnnnnnnnnnnnaattgtgaannnnnnnnnnnnnnnnnnnnnnnnnnnnnnnnnnnnngtaccctgtggttccagggagtattaattaaaattaaagaattactaatttccgacattaaaaaagcnnnnnnnnnnnnnnnnnnntggnnnnnnnnnnnnnnnnnnnnnnnnnnnnnnnnngaaatgttaatccgtttttaaatata

SEQ ID NO: 4656 - DNA, 277 bp, Diabrotica virgifera
gttaaaagttggttttacagaacaattcgtggtactctacggtattccgagccccatcagatgagtatttaaaacggtatgcctttttaagagattgtgccataacattattttttagtactttacaaaagtgtttgtctgcaaaaattctgttttggaataagcagcattgtgagctgctgatattcatggtttggaatctactcttgaaggtgattactaattaattcgtttatactatatcattgcacatcaaaaattgcctgtaaatcaaatc

SEQ ID NO: 4657 - DNA, 334 bp, Diabrotica virgifera
  misc_feature (2)..(15): n is a, c, g, or t
  misc_feature (78)..(104): n is a, c, g, or t
  misc_feature (120)..(139): n is a, c, g, or t
gnnnnnnnnnnnnnncagatcttaaatttaattaatagcaatagatgtacaagtaagtatttttatattattagtagnnnnnnnnnnnnnnnnnnnnnnnnnnngtaaaattttagtacnnnnnnnnnnnnnnnnnnnngttacgatgaaaaattttcacattttacaatatgttactacttatttttagacctcagtatatagactttttacaaattttttagtaatgacagaaattacattatttagagttagcagtgatgataacattagtatgaaaaacatgtatatttagtactgatatatcagtttaagagagggaatctgcaacatt

SEQ ID NO: 4658 - DNA, 380 bp, Diabrotica virgifera
  misc_feature (342)..(360): n is a, c, g, or t
cactttcatactcttgccagttatcattgaaataatgttgccgaagaaacacaattttgtgaaattccaaaaagcagctccagcgttggctcttttgtttttaagttacacgattttatacttttcgctgtacttccgtcatggtgtgtggctatatccagtgtacaaagtcttaacatggccacagagacttctctttagcgcggctcaactttgtggggccttgggataccaaaaattaggaatagtattacaaaattccaaaaggtcgcaaaacaaacaaaaagttaaataacgttagctgtttgttgaattttatctaaaaaattatttatatcatcnnnnnnnnnnnnnnnnnnngaataaaatgttttattatc

SEQ ID NO: 4659 - DNA, 183 bp, Diabrotica virgifera
  misc_feature (17)..(79): n is a, c, g, or t
  misc_feature (89)..(172): n is a, c, g, or t
ctttttaaatacatccnnnnnnnnnnnnnnnnnnnnnnnnnnnnnnnnnnnnnnnnnnnnnnnnnnnnnnnnnnnnnnnattactaagnnnnnnnnnnnnnnnnnnnnnnnnnnnnnnnnnnnnnnnnnnnnnnnnnnnnnnnnnnnnnnnnnnnnnnnnnnnnnnnnnnnncaatttaaaat

SEQ ID NO: 4660 - DNA, 151 bp, Diabrotica virgifera
  misc_feature (120)..(138): n is a, c, g, or t
attgaaagcgggaatgaagggtgggatgaaaaaaaaaggccttaatttaattataaggaatttaattttaaggtaaaaagcgctaaatttttttaaagaggcgaaaagcccctagagggnnnnnnnnnnnnnnnnnnnggtttttagagta

SEQ ID NO: 4661 - DNA, 304 bp, Diabrotica virgifera
  misc_feature (72)..(90): n is a, c, g, or t
  misc_feature (133)..(151): n is a, c, g, or t
  misc_feature (161)..(195): n is a, c, g, or t
  misc_feature (254)..(272): n is a, c, g, or t
tattttaaataagttttgcgtaatgaaaaggttagacgtttttacatacaacaagttttttaagacccagcnnnnnnnnnnnnnnnnnnnggacatctatgattaagtatttttatatgatgagtatctaagnnnnnnnnnnnnnnnnnnnggataaaagnnnnnnnnnnnnnnnnnnnnnnnnnnnnnnnnnnngtaaaaattttcacattttaaaatatgttactagttagttttatatatcattacttttnnnnnnnnnnnnnnnnnnnctagaatataaatttacattaggtaaatttag

SEQ ID NO: 4662 - DNA, 263 bp, Diabrotica virgifera
gcccgaattttttcaggcgataaaaatgggtctttctagcacaatttacaattccatttttaaaagaacctcaacaatggctttagctgttgttgtttctgcatttttcttcgagagaactttcgatttagcaacagacaccttttttgaaagatataatgaagggaaattatggaaacacatcaaggacaaatatgagcaggaataagtgataattattttgtgttagtataatttattgtaaataaaagaaacttctgccc

SEQ ID NO: 4663 - DNA, 445 bp, Diabrotica virgifera
cccacgcgtccgaaactattcaagggttgcctatagactttttggagatgatgttaagttttggatcacgataaatgaacctctgacaatatgttattatggttatggtacaggagccgtcccaccttttattcagtcagaaggtattttggagtatcagtgtttacgcaaccttcttaaagctcatgctagagcttaccatgtctacgctgaagagtttagaaataaacaacaaggaaaactatctatgtcctttaatacaaacgcctttctacctggaagtgacaatcccaaagatatccaagccacggagagagttcagcaatttaatcttggagtctatgctcacccaattttcgttggagactggccagaaatagtaaaaacccgagtagccatccgcagtaaattagaaggaagaaatgaatcccgtcttccagcattc

SEQ ID NO: 4664 - DNA, 425 bp, Diabrotica virgifera
gacaaaagttgaacaaaaagaagctataaatacagaaggaaaacaagatacagaaaaggaaactcttgataagcagaaagctgatccagatactgaaaatatatccgaagatgagcttcctgttgttcaagctgtaaaagtaccagaagctgaggaagtttcagatgaagaacttccagggcccaaaagagctgagcttcctgcagatactgaagtcgtctccgaagatgagctccccaccgttaaaaatgattccaaaaaagaaagtaacaagagaaagcttgccactgattacgatcctggatccccaacatctgaaaatgaggcaccttctaaaaaaccatctcttgatagttcggctgaaaaggacaaagaagaaaaacctaaaccgaagaaattaccagaacttgataaatactggaaag

SEQ ID NO: 4665 - DNA, 440 bp, Diabrotica virgifera
ctctctattattcctctactttcaccttgctgcattgcacagtgtcggtctagcagcctttgaagatggaggtcccgatcacggttacgtgaaattcgttctttgattcattttttaaatgcaacatggattatataaagttctttattgaataatgtagttatttggtttttattattttgtacgtctaatcgaatttgattttcatcattggtaactaactttaaagaaaataatgttgatttcatattagctggtcattcaaatgtggctttgtggcttttgagatatttaaacaattattaggtatccaaaaagcctttcttgaagacctgctttaatttgccgtcttgaacattttgtttgttagttaatgtcgaaagttttttttgatggaatattattaaaaagagaaatgtactctgggcttgcacatattt

SEQ ID NO: 4666 - DNA, 91 bp, Diabrotica virgifera
aaaaaaaaggggtggccgcccaaaaggtataaacctaacatacccgtaaaggaaatttaaaacccccccaaaagttcccccaatttaaatt

SEQ ID NO: 4667 - DNA, 51 bp, Diabrotica virgifera
  misc_feature (25)..(46): n is a, c, g, or t
aagacgcatgggaaatattacaacnnnnnnnnnnnnnnnnnnnnnntcgta

SEQ ID NO: 4668 - DNA, 112 bp, Diabrotica virgifera
  misc_feature (2)..(105): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataaaaa

SEQ ID NO: 4669 - DNA, 100 bp, Diabrotica virgifera
agcgacgatcttttgtgtccctcctaaagaagagcccatgttgttatatatgtttgtactgatttagaatgcatgaattaataaatacatattttcctat

SEQ ID NO: 4670 - DNA, 317 bp, Diabrotica virgifera
  misc_feature (187)..(199): n is a, c, g, or t
  misc_feature (202)..(223): n is a, c, g, or t
cttttagaattgaattatttgttctacggtcttgtccaaggaattcgtaacattcgtctccaacagaacatttcaatgttgtctatatttctttccgcagggcccccgctaccatatgtgcaaagtgtgcaatgcacacgggcgccatcctttaggggcgccaaaaccctgggtcaaaaattgcaannnnnnnnnnnnnccnnnnnnnnnnnnnnnnnnnnnngttgagaaattaaataggattgagtataaacacatacgagattttattagtataataatataagttactgctgattcccatttgcgagaacatg

SEQ ID NO: 4671 - DNA, 175 bp, Diabrotica virgifera
  misc_feature (12)..(26): n is a, c, g, or t
aattgatttggnnnnnnnnnnnnnnncattcacaacagtaaacaccagtttccgtcatacgcccgggattgcacaagttgtcgacgttattcatacttgtggtggacatattagatattgtaccatctgatagtaaggatgattattacccaaatagtggtatgatacattaccc

SEQ ID NO: 4672 - DNA, 148 bp, Diabrotica virgifera
  misc_feature (93)..(107): n is a, c, g, or t
  misc_feature (110)..(131): n is a, c, g, or t
  misc_feature (133)..(145): n is a, c, g, or t
gtactttgatatatatatatgtacactgtgaacttaccatttattaatgacaatattacgtaacaataaaggacagttcacagtgtactttgnnnnnnnnnnnnnnncannnnnnnnnnnnnnnnnnnnnngnnnnnnnnnnnnncct

SEQ ID NO: 4673 - DNA, 345 bp, Diabrotica virgifera
aaaaaaagtgccagttataattggatttaattcagaagaatggctttatctcgctttgatgaataacgaagaagtgcttaaagcttatgatgcaaatccaagttcgttagtttccggactaatgacaatgactcctgaaaatcgaaccattgcaggaaatctcttgaaagatctatacaccaataatggtagtttcgtcgatgatctaggtggttagataaggtcaacaagtgacaacctctttacaacatgaggctgtaaacaagtcgagcttgcttctgaggtggttccatattttttctatcaattttcttacaagggagagttgggaaaagggatgggatt

SEQ ID NO: 4674 - DNA, 302 bp, Diabrotica virgifera
aacctagaggatctaggcttatcttggcgtgtatgcgacgttggatcacttctaacttgtcaggtaccttcaatttactgaccggtggttcgataacgtctgttttgggaaatctctcgtcgtgacgcaatttatgcgccttgcacatccacgcccattcgttggctggctttgcaccaatccggtccgcactgatagacccacgcaaaagttttggtcactccatggcaagtgctatgtggcctgtcacgccacatgatccattgtcaatgtagtggggatccgcagtgggatcgtttcac

SEQ ID NO: 4675 - DNA, 309 bp, Diabrotica virgifera
aaattggagtaaaacttattgatctctattttgttagataacgaggagggaagagagagataaggcttttaaatattttgctttatgttaaatccactttgtggaaggctttatttggaaaagaatcacacacattagaacactccaatgatgatcaaaacacttactatttaatggaaaaagaacctttagtaaatctttatatttctgtacctagagacaaaagtagtttgaactgtgctgtgatgatagcgggaattgtagaggcagtactcatagggacaggctttccagcgaaagttactgctc

SEQ ID NO: 4676 - DNA, 250 bp, Diabrotica virgifera
aaaattgttttcttaacagtacttagtgtggtctactgcagaactattagacgtaaataaaaacatagacaaagagattctccgtcaaaataactgtgggatatattaaaacataatttaatacagcccaaaatggccaaaagggctacagtaaaacctggcttacacaacgtgattatggtatgcagtggaggagtaggcaaatcagccctaaaactccagttcatgtatgacgaattcggttaagact

SEQ ID NO: 4677 - DNA, 271 bp, Diabrotica virgifera
  misc_feature (21)..(50): n is a, c, g, or t
  misc_feature (52)..(64): n is a, c, g, or t
  misc_feature (66)..(89): n is a, c, g, or t
  misc_feature (141)..(172): n is a, c, g, or t
  misc_feature (182)..(201): n is a, c, g, or t
  misc_feature (212)..(226): n is a, c, g, or t
  misc_feature (228)..(244): n is a, c, g, or t
cccacgcgtccgaatttaacnnnnnnnnnnnnnnnnnnnnnnnnnnnnnncnnnnnnnnnnnnncnnnnnnnnnnnnnnnnnnnnnnnnctcgtttttacatataacgaattttttaagaactcaattaaatttagttagnnnnnnnnnnnnnnnnnnnnnnnnnnnnnnnnttagtaatannnnnnnnnnnnnnnnnnnnccttaaacagnnnnnnnnnnnnnnngnnnnnnnnnnnnnnnnncgtaagcataaaaattttcagatttta

SEQ ID NO: 4678 - DNA, 407 bp, Diabrotica virgifera
tggttgtagtcggaaattaataaagaatcttcgaatttagtgtaatcggtagctttactaattacatatccaaaatgtctggtattgcgggagcccgtttaactgaagagagaaaagcctggagaaaagatcatccatttggttttgtagcccgaccttccaaaaatcaagatggcacacttaacctaatgaattgggagtgctccattcctggaaaaaaagggacaccatgggaagaaggacattacaaattgagaatgctgttcaaggaagatttacctactagcccaaccaaatgcaaatttgaaccaccattgtttcatcccaatgtatatccatcgggtactgtttgtctgtcgctattggatgaagacaggactggagaccggctattacaattaaacaga

SEQ ID NO: 4679 - DNA, 349 bp, Diabrotica virgifera
  misc_feature (50)..(63): n is a, c, g, or t
  misc_feature (65)..(77): n is a, c, g, or t
gtatgtattacagtctatagtatttggtttagtacatcgtaagaacgtannnnnnnnnnnnnngnnnnnnnnnnnnnctctttgtagctgatcgatttcctgctcaaaaactcggtacaccgacgattttttagactatttgtttttaactaaacggcaactcaagatttgtaatatgtgtagaagaatttttggtacaggattttttcatgtttgtgattatcgatttttttgtcatattggcgaaaacacacccagagattttcatatatggccaatatatttcaaatgtcgtttacttttataccaatatattttattagattaattaaattgatatttaatacct

SEQ ID NO: 4680 - DNA, 399 bp, Diabrotica virgifera
  misc_feature (56)..(76): n is a, c, g, or t
  misc_feature (154)..(178): n is a, c, g, or t
  misc_feature (346)..(367): n is a, c, g, or t
aggattgaaaactacttcgtctagtcaatttagtttaaataattaataaaactgcnnnnnnnnnnnnnnnnnnnnncgtccgtgtttgctacactttacttcctcattacgttcgtatttgatttagagatttttaaatgagagtttaagtcannnnnnnnnnnnnnnnnnnnnnnnnaaacgtcagtgtttggttgaatatatacacgtgtttgaacattacgtcgtaaactcaccattatcacaatattaaaactttttctttgacttctcaaaaacaaaccatgtggcgcttacaacgttattcggcggacctattcaattattgtgtatttctaaaaccatnnnnnnnnnnnnnnnnnnnnnngcgacccaaaatcgacgtaaaactaagttttt

SEQ ID NO: 4681 - DNA, 406 bp, Diabrotica virgifera
  misc_feature (160)..(194): n is a, c, g, or t
  misc_feature (226)..(243): n is a, c, g, or t
  misc_feature (344)..(365): n is a, c, g, or t
aaaaagcattggatttcaatgaatagaattgcattaagttgtcttaatgggaggttacttgctaaactttcgatcctatgggttaatcttaatcttcctgtgagttattgaaatgtaatcagattaaccaaaattctgattaaattcagcacttcattannnnnnnnnnnnnnnnnnnnnnnnnnnnnnnnnnnaaattttgttggttttgttgattttttaacgnnnnnnnnnnnnnnnnnngtctaaggagagttcttcgagcaatggttgccggaaacaagtaccaaaaattacaaaaaccgaaccatacctacaaagttgaaaaaatccttcgggaaacnnnnnnnnnnnnnnnnnnnnnncttgctagcagaaaaattattacaaatatattttatgtacg

SEQ ID NO: 4682 - DNA, 178 bp, Diabrotica virgifera
  misc_feature (17)..(42): n is a, c, g, or t
  misc_feature (72)..(89): n is a, c, g, or t
  misc_feature (91)..(177): n is a, c, g, or t
ataaaacatgtccttcnnnnnnnnnnnnnnnnnnnnnnnnnngcaatgattaaattgaatgggcgcggtagnnnnnnnnnnnnnnnnnnannnnnnnnnnnnnnnnnnnnnnnnnnnnnnnnnnnnnnnnnnnnnnnnnnnnnnnnnnnnnnnnnnnnnnnnnnnnnnnnnnnnnnnc

SEQ ID NO: 4683 - DNA, 343 bp, Diabrotica virgifera
cacacactgaagaaaagccatatcaatgtcaaatttgttttaggtcgttttcccttaatggatatttaaaagcacatctcagaaatcacactggagaacaaccacatcaatgtgaaatatgttcaaagtcgttttccaatgtgagtgttttaaacacacataaaagaatacacactggagaaaaaccgtttcagtgtgaaatatgctttaaatcgttctctcaatcaagtgctaagaataagcatatgatgtcacacactggaaagaaaccttatcaatgtgaaatatgtttgaagtcgttttcacgaacacatgatctaaaagacttaaaaactggacacgg

SEQ ID NO: 4684 - DNA, 424 bp, Diabrotica virgifera
  misc_feature (231)..(250): n is a, c, g, or t
atcatttagtgcatattaatccatgattcttaatgaggagcttttatagcaataatattcatttagtagtgaatatgttatatcatttcaaattaatatcataattattttaacgaaattatatggaattattaatttacaaggattaattattaaacattgatgactaaatattagtagaaaaggatattatcagggacgacatactttagtagttactattggtttacnnnnnnnnnnnnnnnnnnnngatacttcataagctataatttattatatgatattattgaggattttttcatagaatatttacatcatatatagatttaagaataatttgacctcctattagaattcatgcctttagaccattatattactcttaattaattgcataaatactataaacatcgggattaactgt

SEQ ID NO: 4685 - DNA, 387 bp, Diabrotica virgifera
catcatttaaagtgaaaacttaatggtgaacgaatctaaataaaagttatagaattttatgcatcgagcgtactttgctacataaggaattgaagaagaaaagtgctaaagcataatgccttatcgggctggagtgcgtattatctaaaaaagattatgagtcgtacgagaaataatatgacaatcaagataccgagatggaattatctttaatccttgggatagtctatatcatactacctcattttacgtcagctgcaagcaatttttcaacagagcaaataaatagtatagaagatacaacccagactcctttgaaagcatacttaactaatggagagatcattttacttccaaaaacagaatttccaccgaaaaatgaaatat

SEQ ID NO: 4686 - DNA, 116 bp, Diabrotica virgifera
  misc_feature (3)..(40): n is a, c, g, or t
  misc_feature (45)..(110): n is a, c, g, or t
cannnnnnnnnnnnnnnnnnnnnnnnnnnnnnnnnnnnnnaatannnnnnnnnnnnnnnnnnnnnnnnnnnnnnnnnnnnnnnnnnnnnnnnnnnnnnnnnnnnnnnnnntcaaaa

SEQ ID NO: 4687 - DNA, 314 bp, Diabrotica virgifera
tcaaaatgttactttggttagtagtattcctgttaatacaattcatttatggcttcattgtgtataatgtgcgatacaacttcatctttaaatcatgttcaatcatttttcgtaccatgggtctcaaggattacaatgttgagactctctaaatcatgattttggattataaaagacctaactgtattcaaatttttactgtaaactaaatcccttatgatatcttttttgtcatgagatgtcatgcgtcattagcccaacctaacttttttccacatccttcaaattcagtcaggaacgctgtgtttgtgatt

SEQ ID NO: 4688 - DNA, 442 bp, Diabrotica virgifera
cccgcccgtccgaccacgcatccgcaaacatgcgaaatacaaagaagattaactcttgcttgggcagcctacggagctctgagagacatatttaggagcagtataccgatcggtttaaaaagacaagtgtttgaacaatgtgtgctaccggtaatgacatatggagcagagacactgactctaaccaaggcaacagcgtcgaaaatgcgggttgctcaaaggcgcatggaaagatccatgctgggcgtaactctacgggataaaataagaaatgaagatctcagacaaacaaccggtatcgcagatgttgtagaacgtatcaccaggctcaaatggaactgggcaggacacgtcgccaggctgaaagattcaagatgggcacgaaggctgatggagtggagaccaagagaagataaacgaagtagaggaaggccgcctacac

SEQ ID NO: 4689 - DNA, 323 bp, Diabrotica virgifera
cacccacccgtccgaccacgcgtccgactggacagtaggactacaagttacgactctaaattacagatactacgcagagttgttaatacaaaagcccaaattaggtgtgaacaacaagaaaaccagtataacgaactacgaaagagagatgaaatactaatgcatgatacaacgaaaattttggaaaccattcaagagatggatactcaaaagaagaattctttaagattaccatacgaccaactttccaatgactttggatcgatcttttcaacgcttcttcctggcgcaaacgctagactggtactgccgccaggaaagac

SEQ ID NO: 4690 - DNA, 89 bp, Diabrotica virgifera
  misc_feature (37)..(80): n is a, c, g, or t
gtagtaatagtgtacacatttttaagaataaacatgnnnnnnnnnnnnnnnnnnnnnnnnnnnnnnnnnnnnnnnnnnnncagaaaaag

SEQ ID NO: 4691 - DNA, 415 bp, Diabrotica virgifera
  misc_feature (374)..(412): n is a, c, g, or t
tgagatttaagtcaatgttatgagtttatgtgcaaaggtactacgacaagcagaaagaagatagacgtcactgaaatggtctgttgtagaagaatgtttcgaattctgtgaggcgaccacaggacaaataaatgttaaatgagtaaaaaatagttcaagtattaccaagactgccctagagtgaaatccccaggaaaaagaaaaagatgtcacccagctaaacttagagaagatccatcatggacgagataagaagtcaaggaaagtcttggagtgagatgaaggcctaagcgcgaaataaaacccgatggcgcattttcactgaagcttcggagttcaagatcattatgagtcaaaggtcagcaaatggctcnnnnnnnnnnnnnnnnnnnnnnnnnnnnnnnnnnnnnnncat

SEQ ID NO: 4692 - DNA, 309 bp, Diabrotica virgifera
  misc_feature (30)..(45): n is a, c, g, or t
taaggcatttgctaatccagaagatgctannnnnnnnnnnnnnnngccaaaagtaagtgaacatgtggaaagagttcgaagagctcacttgaacgacattgagaagattccactattctttgtgactggtttgatttataccttaaccaatcctgcagtgtatctcgcaaaaactttctttttggcatatacactggcaagaatcagtcacactgttgtgtaggctgttgttccgattcctcaaccagcaggaggactgtgttggatggttggatacggaataactggatatatggccgttgtcagttt

SEQ ID NO: 4693 - DNA, 322 bp, Diabrotica virgifera
  misc_feature (145)..(195): n is a, c, g, or t
accacgcgtccgggcgatcatacctatgaagtccacagggaccaagacatcgaccggctgattcatattgacgacatcagacctgcaacagccctagaaatcaacggcgaccaagccgttaacgaggacgatgaagcagtgtttnnnnnnnnnnnnnnnnnnnnnnnnnnnnnnnnnnnnnnnnnnnnnnnnnnnacattttttttctttagctttaggtttttcgaattgtaaaaccgtgttttattttcaataagatttttttttgcacacaggaaggtctccagagcggaggggctgtcaccaatggcggcgttcgtta

SEQ ID NO: 4694 - DNA, 424 bp, Diabrotica virgifera
agacgtatttggattttacgtaattgatagtcaaccaaataccctattgggatgggttgttggcaaaatggcggcagaagtagaatatatgagtgacgatgatgttattgctttgtgtatgttcctactgcggaagtttttgggtaaactttataatatctgcgatgcagatgaaattttaaggtcaaaatggagcagtaattctcatttttgtggttcttatgtcttcaaaagtatagatcaagaaaaacacattgcaacggctgaagatttagctagaccagttacctccaacaaggataataaacctgttttattttttgctggataagctacaagtccagaccacttctcaaccgtccatggagctattgaaacaggtttcagagaaggagatcgattagcgcaactattaaagaagaca

SEQ ID NO: 4695 - DNA, 338 bp, Diabrotica virgifera
aacatgcgtccgcggattcttggggtcagcatgtctccacacagggaagaaattcacgtaactacgaggccatgtataccactgtcaacgacgtttcgggaaacaccgtaagcatcctacaggtcctggtaatgctggtggtatgcatcaccggaaaatcaccgtcgacgtgtagcatccaggatagctcggagagttgggtataacgaactagcacgtaaggaaaaactccaatcggtgcccagctattaacctatacaagttatggacactacttgttgaacaacctaggttagcatacttggaatatccttcgggaaacgacccattcattgaca

SEQ ID NO: 4696 - DNA, 269 bp, Diabrotica virgifera
cccacgcgtccgatttagtttacaagaatagactcttttttagtacgagtaaggaacaggtttatttagtgatagttaactagtattgtgagagactactttacttttacaagcgagcgatttatttggcgtaccttgtgtcgcacggattatcacctagcgcgtagagatttactagtttccaatttaaaccagctaaacaattgagatttttagtgggcaataaatattttacagaacttttttgtaatgaactgttattcgttttt

SEQ ID NO: 4697 - DNA, 466 bp, Diabrotica virgifera
  misc_feature (243)..(266): n is a, c, g, or t
ggcgacccaagccttcggaaaaaattggccataatttccaaaaggaaaacctccgtaattttttaaccgggttaaattaagttcacaatttcggcctcctgggaattggtaagttgggggtaaaaaaaattgaaccaaatttgacttttaaaataaatccacaacgactttaacaactttgtatataccgcagaaatataggttagttatgctcttttgtgtaatatatggaataataatagnnnnnnnnnnnnnnnnnnnnnnnnggattctattctgtatctaatttttgtataaattttgtaacttttcagatttcaatgattctaaatttctggatatcttcttaaacactgataacgatacagcgaaactactagacatattctaaagaaatcgaaaaaaaaatgttaacgacaccgaagttgatgttaaaaaaaaagttacaaaattattagatttaata

SEQ ID NO: 4698 - DNA, 349 bp, Diabrotica virgifera
  misc_feature (38)..(65): n is a, c, g, or t
  misc_feature (101)..(123): n is a, c, g, or t
  misc_feature (177)..(196): n is a, c, g, or t
atagtagaatggtgaaactattattatacaagttcagnnnnnnnnnnnnnnnnnnnnnnnnnnnngaaatgtaaatcgatgttttaaatataactaagtgnnnnnnnnnnnnnnnnnnnnnnngtttattaagaatatatttaggagggggctattttggtttgattaatatgaagnnnnnnnnnnnnnnnnnnnncctgtaagattttaatagaatttaatttttaggtagtaattttgattaaaaatttgcagaatttaccagatgttattacgtatatttatatagcagtaattcgatttttgataacttgtttatgggcatagggagttacattgtttacgttta

SEQ ID NO: 4699 - DNA, 430 bp, Diabrotica virgifera
  misc_feature (10)..(41): n is a, c, g, or t
  misc_feature (44)..(72): n is a, c, g, or t
  misc_feature (80)..(120): n is a, c, g, or t
  misc_feature (128)..(141): n is a, c, g, or t
  misc_feature (143)..(173): n is a, c, g, or t
  misc_feature (211)..(229): n is a, c, g, or t
  misc_feature (257)..(308): n is a, c, g, or t
  misc_feature (318)..(357): n is a, c, g, or t
tcattatgannnnnnnnnnnnnnnnnnnnnnnnnnnnnnnnccnnnnnnnnnnnnnnnnnnnnnnnnnnnnnttcaatgnnnnnnnnnnnnnnnnnnnnnnnnnnnnnnnnnnnnnnnnngtagaggnnnnnnnnnnnnnncnnnnnnnnnnnnnnnnnnnnnnnnnnnnnnntcttatagtttaattttactaagattttgagtttgtannnnnnnnnnnnnnnnnnnaggaaaattatataaatatggaatttannnnnnnnnnnnnnnnnnnnnnnnnnnnnnnnnnnnnnnnnnnnnnnnnnnngtattttctnnnnnnnnnnnnnnnnnnnnnnnnnnnnnnnnnnnnnnnngattagtaccagttttattattaattattggttgaggttatcaaccagaacgtttagaggctggaatttattt

SEQ ID NO: 4700 - DNA, 174 bp, Diabrotica virgifera
aggcctccgcgacagcgtacgcccatgcgtccggtttgatccgtttcactaattcactctgaatgattttctagttctggcagcagtttttgcagttgctgacgcattccaagttgattatctccgttgggtcagcttatacggaactctgcctgacaacggattaccacctgg

SEQ ID NO: 4701 - DNA, 358 bp, Diabrotica virgifera
  misc_feature (102)..(115): n is a, c, g, or t
  misc_feature (117)..(130): n is a, c, g, or t
  misc_feature (295)..(314): n is a, c, g, or t
  misc_feature (337)..(354): n is a, c, g, or t
cccacgcgaccgtaaatatatatgtattatttattactttatttgttacctaatacaacataaactatacgagggttgatccaattatgtaccaaataaagnnnnnnnnnnnnnngnnnnnnnnnnnnnngactaaaagtacaaacattgaagctaataatttataaagtttttatactatatttttaaattgctgattaaaattacgataatcatacgaatcaagcaagtatgaaaattttccagtgtttgtatgattcatacatctcaggctgtgatataatattgaaaatannnnnnnnnnnnnnnnnnnncagtgaaaaatgatgtacttacnnnnnnnnnnnnnnnnnngtag

SEQ ID NO: 4702 - DNA, 102 bp, Diabrotica virgifera
  misc_feature (35)..(93): n is a, c, g, or t
ttccgggggcccccacgcgtccgccatcgcgtccnnnnnnnnnnnnnnnnnnnnnnnnnnnnnnnnnnnnnnnnnnnnnnnnnnnnnnnnnnncagcatttg

SEQ ID NO: 4703 - DNA, 112 bp, Diabrotica virgifera
  misc_feature (10)..(46): n is a, c, g, or t
  misc_feature (66)..(111): n is a, c, g, or t
atgtgagagnnnnnnnnnnnnnnnnnnnnnnnnnnnnnnnnnnnnngaccttggggttacaaggannnnnnnnnnnnnnnnnnnnnnnnnnnnnnnnnnnnnnnnnnnnnnc

SEQ ID NO: 4704 - DNA, 367 bp, Diabrotica virgifera
  misc_feature (309)..(336): n is a, c, g, or t
tccggggccgtcaggcaactaaaagatctgcagctcatagaaaagcaagatgagctgagaacacaagcgaaacgggccgtgaatgaaaaactatccaaagaaaaggaactgctcaaaactaaacgagattttaaagaagacaagactgtaccagaacctgttggtgaaagagacccaagtacagagtgtgccattcaacattgtaatgagagttgtcgagacaatagtaaattaataggaaaattacagaaggaaaactcagagctaagtaggaagaaccaaaattgtttagaggaaataaacgactgnnnnnnnnnnnnnnnnnnnnnnnnnnnngacttttccatgttccacactaaaataagtt

SEQ ID NO: 4705 - DNA, 392 bp, Diabrotica virgifera
  misc_feature (15)..(66): n is a, c, g, or t
  misc_feature (105)..(144): n is a, c, g, or t
tccgccaacgcgtannnnnnnnnnnnnnnnnnnnnnnnnnnnnnnnnnnnnnnnnnnnnnnnnnnncaaaactttattttttttacaagaagacactaccctagnnnnnnnnnnnnnnnnnnnnnnnnnnnnnnnnnnnnnnnnggtttacctcccaaatggatttaatctaagttgcgtgataatgaaatttaataacctttctaaaggttaccctaattcaaattaattggctgccttttaaaattttgatacagggaaaacccctggtttaccccaatttaatccctttgaagaaaatccccttttcccaataggggttaataccaaaagggccccaaactttcccccttccaaaaattttccaaccttaaatgggaattggaaccccc

SEQ ID NO: 4706 - DNA, 444 bp, Diabrotica virgifera
  misc_feature (119)..(137): n is a, c, g, or t
cccacgcgtacgccattctaatatagtaggttgttttgtataaataagttgagtatgcatttaattatgacaaaatgtcatattgacattttagactagaaatataccagaaatatacnnnnnnnnnnnnnnnnnnngatttaatttagtttatacatatcattttaaactttagacattttatgtaaccaaagcaaaacagcatctaatgacacatccgataagatgtatgaatgagaatattttgaattttgtttaaattacaaatcatagttgatggattaacaagttgtttatatttttattcgtaataactaaatactgtaattgccttttaccatcttaggactctaaactgtcacctagagagtacatgctaactttttttagtcaaatattgaacaaatgttttgcttttcagagatctattgatatggataaata

SEQ ID NO: 4707 - DNA, 311 bp, Diabrotica virgifera
  misc_feature (55)..(193): n is a, c, g, or t
atacacagttttagacttatgtgagacaaattaatatgaaagtcagaataaactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccaaaagaatcaaacctaactaacccttaaaggaaaattaaaacccctccaaaagggccaccaaaatcaaatcaacgggccgcctttaaaaaactccgaaacggaaaaaacccggg

SEQ ID NO: 4708 - DNA, 174 bp, Diabrotica virgifera
gaaataaagttaaaataattacattagttttttatttacgaattactttttccagtataactattataataggggaaatttatagaatatctaggaaaattaacaataatttgactaggttttctgaaggcatttactttaataagatcaactttatgtacagaaattttcaga

SEQ ID NO: 4709 - DNA, 255 bp, Diabrotica virgifera
  misc_feature (13)..(39): n is a, c, g, or t
  misc_feature (61)..(98): n is a, c, g, or t
  misc_feature (109)..(135): n is a, c, g, or t
  misc_feature (139)..(159): n is a, c, g, or t
  misc_feature (174)..(204): n is a, c, g, or t
ccaacgcgtccgnnnnnnnnnnnnnnnnnnnnnnnnnnnctatattaagatttattttagnnnnnnnnnnnnnnnnnnnnnnnnnnnnnnnnnnnnnnatgaataaccnnnnnnnnnnnnnnnnnnnnnnnnnnncttnnnnnnnnnnnnnnnnnnnnncaaataatttaatcnnnnnnnnnnnnnnnnnnnnnnnnnnnnnnnctttaattgcagtagtgaaaattacaaaatttttatatggcccattacgac

SEQ ID NO: 4710 - DNA, 451 bp, Diabrotica virgifera
ccacgcctccgtaaaactctatcaccgtctgcaccattgtcgtgaaacagatataaatctcatgatacatgtatcacaacttgtcgcgatacatgtgtcgatacctatctcaacgtgaatgggggccttaacatgcaagcaactatgctctgtttttaaacaaggaggagtaatttaaatataccgcgccgtaatgcttgtttgtaattggtcttctctcaggcaagtttagtccactcttatgaaattttggcactattgacacttatgaaattttgacagtattggcatttcatacgttaacctttaactatccgcgcatcaagtgataacataagtaaagcgtggcgtatttttatacacacaagaaaattcactttaaaacaaccgttttggccaatggttttaaataaccttaattggttggtaaaaaccttaatcggcatcaacc

SEQ ID NO: 4711 - DNA, 162 bp, Diabrotica virgifera
  misc_feature (27)..(39): n is a, c, g, or t
  misc_feature (41)..(53): n is a, c, g, or t
  misc_feature (67)..(85): n is a, c, g, or t
tccggaaggtggtcatttggactgtcnnnnnnnnnnnnncnnnnnnnnnnnnngttatgttaaaagnnnnnnnnnnnnnnnnnnnacgagaagatgctatatagtttgaaagggttagtaggttgtgttttttgaagaaatctttgttatgtgatatatttg

SEQ ID NO: 4712 - DNA, 253 bp, Diabrotica virgifera
  misc_feature (71)..(107): n is a, c, g, or t
cacgcgtccgttactttacattctgattatgataatgtgattataaaatatttttaacaaaacaatttccnnnnnnnnnnnnnnnnnnnnnnnnnnnnnnnnnnnnnccaaacacaaaaggaaccggcccataagcgatcaggaacgccatagcccaaaatcgcccgtacactcaccgtccattggagccacgaggcccggttctatggccccgcccatcagataccccggccgagaggcgactgggaccccc

SEQ ID NO: 4713 - DNA, 268 bp, Diabrotica virgifera
  misc_feature (25)..(43): n is a, c, g, or t
acgctatccgccagcgcgtccgtcnnnnnnnnnnnnnnnnnnncagtttcttgtttcgcttaattttctttaatgatctttaattactattgtgccctactatgttatttttacccactaagagtttattttatgtcccttcgtgtatcatggattagtcgtttctaattagatgtgtattattttcgattttaccttaccctatctatttatcttttttccgctctttttgatcctcatcttctgtttttgtgatgaaatgtccttc

SEQ ID NO: 4714 - DNA, 407 bp, Diabrotica virgifera
  misc_feature (52)..(80): n is a, c, g, or t
  misc_feature (82)..(109): n is a, c, g, or t
  misc_feature (112)..(217): n is a, c, g, or t
  misc_feature (219)..(255): n is a, c, g, or t
  misc_feature (257)..(280): n is a, c, g, or t
accacgcgtacgatttttagggatgagcgtatggataaaattttattagtcnnnnnnnnnnnnnnnnnnnnnnnnnnnnncnnnnnnnnnnnnnnnnnnnnnnnnnnnngtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnntnnnnnnnnnnnnnnnnnnnnnnnngtaaaaacatgtccttttgtacgtaaattaaagtcccccctgcccactgaataattttaatggccccggtaatttgaaccgtgctaaagtatcataatcattactttttttattgatcgctggaatg

SEQ ID NO: 4715 - DNA, 359 bp, Diabrotica virgifera
  misc_feature (101)..(119): n is a, c, g, or t
  misc_feature (132)..(155): n is a, c, g, or t
  misc_feature (342)..(356): n is a, c, g, or t
accacgcgtgcggcaaagaaggctgacaagaaggaaaccaatgccatgtcaaatggagtgagcaagcgtggtaagaggaaagaggaagagaaggaggaatnnnnnnnnnnnnnnnnnnntgacaaaggcagnnnnnnnnnnnnnnnnnnnnnnnntgatcaataaattgttcgaagacatttcctttgcttttaaactattttttatacttaaagcttaaaatttacgtatttactttcagtatcgatacttttaagtttacttaacagtacacacttaaattacttaatttttgactgatttgaatttggtattagtacgaatccaattccaggaaaatgnnnnnnnnnnnnnnnaat

SEQ ID NO: 4716 - DNA, 372 bp, Diabrotica virgifera
  misc_feature (18)..(47): n is a, c, g, or t
ggcacgtacctagccacnnnnnnnnnnnnnnnnnnnnnnnnnnnnnnacgaaataagtagttttacgtcgtttaattattgatattgtaatttttttaagttgtcaggaattaacatttaggagacaggatgaatcggagcattcgttaaatcaagttaattatagagaacaaataaaattgtttaacaaatacgatctggaattttctaatttactttttgactcgaagacatttaacggcgtacctaaaacagcacagaatgaaagaatcaattagtagttacattttgatctttttcggtagaagtagacgaatctactgatagaggtaacatgtcattcacaattatcaattgttcttaatatttatg

SEQ ID NO: 4717 - DNA, 410 bp, Diabrotica virgifera
  misc_feature (299)..(313): n is a, c, g, or t
  misc_feature (315)..(327): n is a, c, g, or t
agtgttttataaatgctggaatgttccacagggtgacccgtactttggggggagatcacagtttgattggtgcacccggtgtgcaatgacaagttgcctgtctagcaacaatattgttacaccggtattgttggggaatagggctacaacatgttaaagaaatgacttggatcggacaggtttgggaaattcgaggcatcggaggtgaccaatttttaaggcagtgcgttaatttcttggagaagtggatttattaattcctacatattcttttagaacaatatccatgttcaaactannnnnnnnnnnnnnngnnnnnnnnnnnnnacttttacgttattgttaaaaattgaatgtttaaattctatatgattaatttttatctgtgatctttagtagtctaagtgtat

SEQ ID NO: 4718 - DNA, 251 bp, Diabrotica virgifera
  misc_feature (13)..(34): n is a, c, g, or t
aattgaattacgnnnnnnnnnnnnnnnnnnnnnnattcttacattatttaagaacttaagctaatttacctttaattatcaaccaagagaggttatgactacaacaacaaatttaacattgaattgaaaatgacacgacagtgagtttcttctttcgaccctacatcaaacttgaagttaccaataaactgagtaagaacagtattaggtctacaaaatattccagctagattttgactaaaggcctctcg

SEQ ID NO: 4719 - DNA, 394 bp, Diabrotica virgifera
atgaaaagtccgatatttacagtcttggcattttaacatgcgaattagctaacggatcagaaccattctcagggatgtcaaaaacattaatgttaacggagaaagtgcgaggttgtgttccaccccttttagataaaactacaattcctcgaggtgaaaatttagattgtggagatacggaaattagttcgagcattttaaacagaagatttagccataatttacaccaatttgtttctctctgctttatgtgggatgtgaccgatagaccttccgctacgcagttgatcaaccatcctatttttaagactgtcaaaagagctctacctctaccagaactactgaagccagcattgccattaagtgaccgtgtgggatttgatacagatgaaat

SEQ ID NO: 4720 - DNA, 291 bp, Diabrotica virgifera
  misc_feature (26)..(51): n is a, c, g, or t
  misc_feature (68)..(88): n is a, c, g, or t
  misc_feature (90)..(118): n is a, c, g, or t
  misc_feature (135)..(184): n is a, c, g, or t
  misc_feature (188)..(236): n is a, c, g, or t
  misc_feature (245)..(265): n is a, c, g, or t
  misc_feature (267)..(290): n is a, c, g, or t
ggtacctggggtttcagggataattnnnnnnnnnnnnnnnnnnnnnnnnnncgaaatttaaagaaccnnnnnnnnnnnnnnnnnnnnngnnnnnnnnnnnnnnnnnnnnnnnnnnnnntaagaaaaggtaatccnnnnnnnnnnnnnnnnnnnnnnnnnnnnnnnnnnnnnnnnnnnnnnnnnnccannnnnnnnnnnnnnnnnnnnnnnnnnnnnnnnnnnnnnnnnnnnnnnnngggataacnnnnnnnnnnnnnnnnnnnnncnnnnnnnnnnnnnnnnnnnnnnnng

SEQ ID NO: 4721 - DNA, 286 bp, Diabrotica virgifera
  misc_feature (62)..(83): n is a, c, g, or t
  misc_feature (100)..(136): n is a, c, g, or t
gaatgggagttagggcccaaaaaagtcaccgaaatggggaaacaccaacaacatgtaaaagnnnnnnnnnnnnnnnnnnnnnntcacaacaaaggccccnnnnnnnnnnnnnnnnnnnnnnnnnnnnnnnnnnnnnaaaagggaccaagccgacccaaccctccagcgaagaccaacgcccccccaaagggacccccaagttaacttcacggggcagcgtatcacaaggcccggcagggaaacccccgggggggaccaagagtaaccccctggagcaaaacccccc

SEQ ID NO: 4722 - DNA, 420 bp, Diabrotica virgifera
  misc_feature (45)..(63): n is a, c, g, or t
ttttaagccagtaaaactgtggtattttttttcaatgcatcatcnnnnnnnnnnnnnnnnnnnttggttaatggggcattacatcgcaaaaccgtaatttctaaataatatcgtcttaatttatttatctaacagtgtactgtctaaataacattcgtaaaccctgtacatttttttaatagtcaatttttatttgttcccatcctcatcagttttgcttacctttttttctctctcaaaaatatgatttcaaaataatctatgttccattaccttccaaaaataatataaaacggttttattatatcagcattgttgtaaatatgacaacttatgtgtatcgatggtttttttgatgtccatagctgtacgtgttagcctaaagtgtagtcatagctttggcaaaaaacatccccgttt

SEQ ID NO: 4723 - DNA, 274 bp, Diabrotica virgifera
  misc_feature (162)..(182): n is a, c, g, or t
acccacgcgtccgttcaagcgtatgttcatttgtatcgctagtcgattcagatcgctgagacagtatgaggaatgtgtttgtggtagtaaaaggtttagttcgtggtgggggcgtggtcaataggtatgtttttaggggtgggatttagtattttgttgacnnnnnnnnnnnnnnnnnnnnnagtattattatggttgatatgttttagtatagttatacttatagatttttctaagttatttataaggttgatatcttgatgtttttaatgta

SEQ ID NO: 4724 - DNA, 245 bp, Diabrotica virgifera
  misc_feature (14)..(50): n is a, c, g, or t
  misc_feature (67)..(87): n is a, c, g, or t
  misc_feature (90)..(117): n is a, c, g, or t
  misc_feature (135)..(147): n is a, c, g, or t
  misc_feature (150)..(214): n is a, c, g, or t
  misc_feature (216)..(228): n is a, c, g, or t
gtaccttgtgtacnnnnnnnnnnnnnnnnnnnnnnnnnnnnnnnnnnnnnccgaatttaaaggagcnnnnnnnnnnnnnnnnnnnnngtnnnnnnnnnnnnnnnnnnnnnnnnnnnntaatgaaaggtaatccgnnnnnnnnnnnnnccnnnnnnnnnnnnnnnnnnnnnnnnnnnnnnnnnnnnnnnnnnnnnnnnnnnnnnnnnnnnnnnnncnnnnnnnnnnnnncatattttaggggatgc

SEQ ID NO: 4725 - DNA, 280 bp, Diabrotica virgifera
aaagcccttcttaagtccaataatagctgagagaactaaagaaacttttgggtaacggaggcggcggcaagcacgtcacatacgaagtggttccacatgcatcccattcatcagctcacgtttctacacacgaaaccgcctatgctggtggttccggacacggaggccgctatggaggagaaatccggcggcggcgctaatgccggcggtggtcccggcggatggggtaggtctctcaatgccaaacctttaccatacaggggacatcaacaagccaaac

SEQ ID NO: 4726 - DNA, 172 bp, Diabrotica virgifera
  misc_feature (12)..(38): n is a, c, g, or t
  misc_feature (41)..(88): n is a, c, g, or t
  misc_feature (94)..(121): n is a, c, g, or t
attaaaatatannnnnnnnnnnnnnnnnnnnnnnnnnntgnnnnnnnnnnnnnnnnnnnnnnnnnnnnnnnnnnnnnnnnnnnnnnnnggttannnnnnnnnnnnnnnnnnnnnnnnnnnnaaccgtttattaaaaacaagtctttttgtataaaatataaagtcccccctg

SEQ ID NO: 4727 - DNA, 77 bp, Diabrotica virgifera
  misc_feature (3)..(19): n is a, c, g, or t
ttnnnnnnnnnnnnnnnnncgtacaagttaacaaatacgggtccgaattaagtccaaaaccattccaaaacgcccct

SEQ ID NO: 4728 - DNA, 133 bp, Diabrotica virgifera
  misc_feature (13)..(121): n is a, c, g, or t
ccgacccgtccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaatttatttt

SEQ ID NO: 4729 - DNA, 343 bp, Diabrotica virgifera
  misc_feature (6)..(34): n is a, c, g, or t
  misc_feature (78)..(121): n is a, c, g, or t
  misc_feature (141)..(172): n is a, c, g, or t
  misc_feature (175)..(253): n is a, c, g, or t
  misc_feature (256)..(338): n is a, c, g, or t
tggggnnnnnnnnnnnnnnnnnnnnnnnnnnnnngaaaaggtaagaaaaaatttaattaaaggaaagtaaataagaannnnnnnnnnnnnnnnnnnnnnnnnnnnnnnnnnnnnnnnnnnnggaacctggggtaccagggnnnnnnnnnnnnnnnnnnnnnnnnnnnnnnnnccnnnnnnnnnnnnnnnnnnnnnnnnnnnnnnnnnnnnnnnnnnnnnnnnnnnnnnnnnnnnnnnnnnnnnnnnnnnnnnnccnnnnnnnnnnnnnnnnnnnnnnnnnnnnnnnnnnnnnnnnnnnnnnnnnnnnnnnnnnnnnnnnnnnnnnnnnnnnnnnnnnngtaag

SEQ ID NO: 4730 - DNA, 319 bp, Diabrotica virgifera
  misc_feature (2)..(44): n is a, c, g, or t
  misc_feature (46)..(66): n is a, c, g, or t
  misc_feature (68)..(106): n is a, c, g, or t
  misc_feature (165)..(177): n is a, c, g, or t
  misc_feature (179)..(192): n is a, c, g, or t
annnnnnnnnnnnnnnnnnnnnnnnnnnnnnnnnnnnnnnnnnncnnnnnnnnnnnnnnnnnnnnngnnnnnnnnnnnnnnnnnnnnnnnnnnnnnnnnnnnnnnnaatggagtttaagaaactaataatcaagttttttaagaataaaattgattaacctacgnnnnnnnnnnnnngnnnnnnnnnnnnnnggaaattaaccttttttaatataatcacatgagttaagatttttgggatcaaattttttggaatacaagaataagttacctgagggaaaacagcgtaattatagtggagagtacatcgcgagaaaaa

SEQ ID NO: 4731 - DNA, 387 bp, Diabrotica virgifera
  misc_feature (74)..(92): n is a, c, g, or t
atttgaatttaaaatcaaagtagaggacaatagagatgactacggcaatggtccatttgaaagtgaagctgatnnnnnnnnnnnnnnnnnnnctaaagacaacaccgttgattttcaattttacaacgatattgaggatgttcaggacagagaaacaccgatgttaaaaataatatccgatatagtgggatatgatgcatatcgtcaaaatatagatacagtaacaaatagcggtctcgttaggaccagagcaaggctttatttcattgacagtaaaagcagccgtcggttgcaactcactaaaagtcccgcagacagtggattcgaactggttaatagtgaaacaatattaaacatagtgaccaatgtgaacaccttccaaaatct

SEQ ID NO: 4732 - DNA, 383 bp, Diabrotica virgifera
  misc_feature (42)..(42): n is a, c, g, or t
  misc_feature (62)..(62): n is a, c, g, or t
  misc_feature (112)..(112): n is a, c, g, or t
gacccaggcctccgcagacaataattttaacaagagcaaganactatccagaacacgaacangcaacagaaagatgaaaacaaaattgatcagctttttaaaaatgatgcanaatttaacagatcagacacaaagtttaacatcggaggtaaaaggaataaaagaagaacaacgagaatatagaaatgacctccgagaattaagaaaagaaataaatgaattcaaacaaagtaaccaacaactacaaaaagaaaatgatgaaatgaaacaggaactaaagatagtgaaaatgaaggtagaaaagttcgagaaagagagaaaagctaacaatgttattgtccagggtctaccgatggatacaaataacccaaatgtagtcaatg

SEQ ID NO: 4733 - DNA, 411 bp, Diabrotica virgifera
  misc_feature (67)..(87): n is a, c, g, or t
  misc_feature (371)..(394): n is a, c, g, or t
agtttatggtaaacatggaaatagtgagaggtcacattctagtgttttgacagttctcttacgtcannnnnnnnnnnnnnnnnnnnntcgcttttgtagtaaaaatactatatgtacctattatgcaaagttgatcaaatcaaaacaacctacttctttgcctaaaaacatgcgggatatattttactttcacctgtgagagactacgacgtattctttgcgcaattttgttcaaactgtgactatagagcataataattatatgttccctcgtggctatataactgatattttgtcaaaattttaaagtttaaaattgctgcaggcagcaatagtttagtaattcaacgttttgagctatacagccatgnnnnnnnnnnnnnnnnnnnnnnnngttgctgtagtaggatg

SEQ ID NO: 4734 - DNA, 403 bp, Diabrotica virgifera
acaatttgtcgttattgattgtatcaggaggtaaatttccaacttatcctccttttcacgtgattgtaatattatcttgtaccccgtatcgcgctttgacactatcatttttttcatattcttttctagttttgtctactagctttccgctatcttagcatactttgtttttattagtatcttctgtagtttctattccgtttatgaaaataagtgtacccgcaagtgttgtatattctaactttactatcctgctcttatgtacgagctttggtattgaccactagtttgtaactttttgactaatctgatacgatcatgcagtttgcttgttagattacgaacattgatttttagaagattacaacgcttcaaaaacattggatatctcatatatttaaaa

SEQ ID NO: 4735 - DNA, 378 bp, Diabrotica virgifera
  misc_feature (50)..(72): n is a, c, g, or t
ttgacaagggcatggaaattgtgaaatgcgcccagcgagcaataagcgtnnnnnnnnnnnnnnnnnnnnnnncatcacataatcccttcgtcgttattagaaacgtatcatggactggatcaatcggtgttgcaagcacccatatcgaactcaataccaataaatggtatggtcttgcggattgggatatctcagctaagcaaatcaatgacgacgaagatttcgaggctgtctttgactataccacatactggcccagttttagaatcgtaggcaactacgaagcaaccgttaaagagcttttccttacacagcactacaaaggaacctacaacataaccatgattaaaccaaaatggactggaagaatcagcgcac

SEQ ID NO: 4736 - DNA, 333 bp, Diabrotica virgifera
  misc_feature (170)..(184): n is a, c, g, or t
aaccacgcgtccgtttcaacgcactattctaataagggtccgaagccagtgcagaatccagtgcgatcaaccagttgatgtctcagttaatgtggccatccaccagggaatacgatcatgatacggatgtacatccaatgatataacatatgctattaacaacgtttggnnnnnnnnnnnnnnnatcagattgtgaagacaatcatgcaggcagtcattacggcgaacttcacgaaccgattcacaaaacaccacgctttagaccagggattccttccaggaatgcatcaagaaatagttgtcgtttaatgtgtagtcacgtgtcgattccca

SEQ ID NO: 4737 - DNA, 370 bp, Diabrotica virgifera
atgtggtctttgggctgtatgctagcatctatgattttccgaaaggaacccttttttcatggtcatgataattatgatcaattagtccgcatagccaaagtcctaggtactgaagagctttttgaatatcttgataaatatcatatagagctagaccctagattcaacgatattttaggaagacattcgaggaaaagatgggaaagatttgttcatagcgagaatcagcatttagtatcacccgaagctttagattttttggataaactgttacgttatgatcatttagaacgccttacagcacgtgatgcgatggatcattcatatttctatcccgtggtaaaagagcagtgcaggatgctgtctacgg

SEQ ID NO: 4738 - DNA, 338 bp, Diabrotica virgifera
accacgcgtccggagattaaacgagtttaatattagtgtgtttgctcttcatcctggaatgatagctactgacataatcactagacatctttcgcctgttgtctacagaggtgttgcgccattatccaaatttttgtttaaaactcctgaagaaggtgcgcaaacaacaatctatgtagctaccgaaccaggtatagagcatctaacgggaggatttttctcagaatgtcattatcaagaacattacaaaactgctagagacccagaattagcgcgacagctttgggatgaaacgattaaattgttaaattataatgattgattaaagtattgagaac

SEQ ID NO: 4739 - DNA, 295 bp, Diabrotica virgifera
  misc_feature (9)..(29): n is a, c, g, or t
  misc_feature (259)..(271): n is a, c, g, or t
  misc_feature (273)..(285): n is a, c, g, or t
aggattacnnnnnnnnnnnnnnnnnnnnncgtagtttcgcaatttactaggagctatgaaaattgacatttttattgtagaatcaatattttacatactgtttttgttctgaaatgtcacacgattttagatacatcgaaatttttagatcgaacagtacatctaattattagcaatatacttataagtgacacagttttacatcaataatattaagtacctgtaaggacaagcttaaaaataccccttgattataatnnnnnnnnnnnnncnnnnnnnnnnnnnccaattttca

SEQ ID NO: 4740 - DNA, 367 bp, Diabrotica virgifera
  misc_feature (8)..(27): n is a, c, g, or t
  misc_feature (30)..(44): n is a, c, g, or t
  misc_feature (52)..(87): n is a, c, g, or t
  misc_feature (106)..(120): n is a, c, g, or t
  misc_feature (122)..(138): n is a, c, g, or t
  misc_feature (148)..(175): n is a, c, g, or t
  misc_feature (178)..(205): n is a, c, g, or t
  misc_feature (222)..(267): n is a, c, g, or t
  misc_feature (269)..(365): n is a, c, g, or t
gaaaagtnnnnnnnnnnnnnnnnnnnnggnnnnnnnnnnnnnnngggagagnnnnnnnnnnnnnnnnnnnnnnnnnnnnnnnnnnnnggaacttggggatcaaggnnnnnnnnnnnnnnngnnnnnnnnnnnnnnnnnccaaatttannnnnnnnnnnnnnnnnnnnnnnnnnnngtnnnnnnnnnnnnnnnnnnnnnnnnnnnntaatgaaaggtaatccnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnac

SEQ ID NO: 4741 - DNA, 178 bp, Diabrotica virgifera
  misc_feature (24)..(24): n is a, c, g, or t
accacgcgtacgaaaattcagtanaatgagaggaaagaatttaataataatacatttgatctaaggaaaccaaatctacccattttttgaataattcaaaattaatcaaaatcatgaaatatttattataactataaataatttggtaaaattattttttacctatagcaataaatag

SEQ ID NO: 4742 - DNA, 379 bp, Diabrotica virgifera
acacgtctgcaattttgggatcgtagagattaaatttgacataaattttttaaatcagtttttgtttaaacagcttccggacgtgtcattcctaacggacagaactttgctaactaatcgcaaacgcatacagggcggtttacgtcgaaagcgatccatgtataacgttacttaaatggagtgacagacgatacacgccaggcagtccctaccttttcgtagaatcgacggtctcacgatccaggcttcaatccatgtgtcactagtcggttttacatcataggacggcatatatcatgaattggcaaatcctgcttcatcacagacaattgaaccgctctctggcgatttttgttatgagtgttgccacattttgttt

SEQ ID NO: 4743 - DNA, 263 bp, Diabrotica virgifera
cgcgtccgaccacgcgtccgacttcgcgtccgaacagacttttgggaactgttccgttaaaacacttgtcacaattagcttcgtttggcaagggttccgcgctcttaaagctctgcaatctgccagccctggcagtctattgggaagcaccttaagatcgtacgatctcaactcattgctttcgtacactctttggggtagactgtgtggtaactcagtggcactgggttacctgtcacgttcacttttcaactcatagactt

SEQ ID NO: 4744 - DNA, 462 bp, Diabrotica virgifera
  misc_feature (4)..(50): n is a, c, g, or t
  misc_feature (438)..(438): n is a, c, g, or t
tacnnnnnnnnnnnnnnnnnnnnnnnnnnnnnnnnnnnnnnnnnnnnnnngattcttcgatttgttaaaattatattttcctaccatatatgatgtaaagtaccttatgaaatcatgcaaaaatcttaaagggggattacaagaagtggcagaacagctagaacttgaaaggattggaccacaacatcaagcaggttctgattctcttctgacaggaatggcatttttcaagatgaaagagatgttcttcgaagacaccatagacgactccaaattctcgggccatctctacggtctcggcacctctttcgcagtgaacggaactgccaacaactactcgaacgacaacggagataccacaaactcttcatgaaacttactggtcttctgtctcctcatcaaattactaaagctaaagtggaaaacactaatgtgacncgtttcttcaacaaaatatatgaa

SEQ ID NO: 4745 - DNA, 114 bp, Diabrotica virgifera
atataatttacttagttcttttctctgtattttagtaattaaatttcatcatacattttaagaaaacatgtattttgtgttcacttaatacaagttttcttacaatgtaagaag

SEQ ID NO: 4746 - DNA, 134 bp, Diabrotica virgifera
  misc_feature (40)..(59): n is a, c, g, or t
ataagtggtgtagcaactatactagtagatctgttcgacnnnnnnnnnnnnnnnnnnnncgagtttaaaccggtgtgaaccaagttggttgctaacattaattgattgcgatacttaactccaaatggaccatt

SEQ ID NO: 4747 - DNA, 212 bp, Diabrotica virgifera
acaacaacccaacgttaatcaaggaaatgttcaacattaagaactgaaacattaaattgtagactttcatcgtttgaatataaatgtcttgtaaaggaattctgcaatctgggtgaaaagatgaaggatgataaatgagggaatgagtataagttgagcaatcagttggataattacgttaggtagtttatgcagagcagaaattcagggtt

SEQ ID NO: 4748 - DNA, 314 bp, Diabrotica virgifera
  misc_feature (17)..(77): n is a, c, g, or t
  misc_feature (108)..(160): n is a, c, g, or t
  misc_feature (162)..(313): n is a, c, g, or t
aaagaataataagaatnnnnnnnnnnnnnnnnnnnnnnnnnnnnnnnnnnnnnnnnnnnnnnnnnnnnnnnnnnnnncaagtaaaatgagaaataagaacggggaagnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 4749 - DNA, 423 bp, Diabrotica virgifera
gaaccagataccgaaatacaatactcgtctcctaatcagtacattattactgctacagatgacaaccaactgattagtgaacctaagccgattgaaactaatgaagtatcagacacagaacccgaaacaccagtgtttgataacagcagaatagccctctatttcagtaataaccaaagactaaaaaaagaaacacaagaagcaagtgtaggtgaactaaaggaagaatcaaaagaaagtgaaacggttcaaatttaaaatatagtttttattttggataattgctcaaaaatattgatgtgtcaatgtgactgaaaaaaatggcgtagttgttgaaaaatagtattgtacgatcttaaaaagtagtaatttattgtacgaatatttagttattttaatttagattgtttaaattaagatata

SEQ ID NO: 4750 - DNA, 324 bp, Diabrotica virgifera
gtccaaagaaatccacaggaaaacgaggcagaaagcgtaaggacgacgatgactccgatggaagctacagacccattttgatgcactcatagttgattgatcctgtggctgagaaggattattgttatagttcgaaactttagttcatgtttgttgcgtatgctggattattacttacgatgtagatagtgactgttgtcgacttcaaatggcctgtggggatgaaatttataatggatatagtggttttctcataatttttttgtcacgggctcttattcatctcgtggtcgatctaattccttgagtagatcattaagtgga

SEQ ID NO: 4751 - DNA, 383 bp, Diabrotica virgifera
  misc_feature (116)..(133): n is a, c, g, or t
cataagcgtccgcaaaaagtcccgccagcctactgaataattagtatggcctctgtatagtgaccgtttcaattaattaagcaaacttatcacggtcaggtgattatttaataaannnnnnnnnnnnnnnnnngttaaaaaattaactgtctttatgatccaaatatttagattaaaatataagtttacctgctggatattatcgatattacaataagacactacaaaacttataataaataatgcgaccgctatgttagtataaagtttataaatggtgtaacatcaataatatgaagtcagtacgacttttattaatctacatgatcagaattaaaaccggtgtgagccatgtgagccactatctttgatttattaatata

SEQ ID NO: 4752 - DNA, 143 bp, Diabrotica virgifera
actagattgactttgatcaacgttttgaattaccaaatcatcaacatttgctataaggaagaaaaactcagtttcaaatactgatgatttggtaattcaaacggtcgagcaatgtcggacgagtaaaaagaaataaggcaaat

SEQ ID NO: 4753 - DNA, 432 bp, Diabrotica virgifera
taccggtctatcacttccgggcgcctgcaatcttctcaaaaattttactatcttatctcaggacatacttcgtgcttgcacgtggtccacttacattctccgccgtttcgagccacacagtgtctcccactactgcggatattgaacctatcataggatcgttaagtgtttcacctattggaccaacactaaattccatcccaagttagctcatcagatggtcagtaggccaactcattcctccatggcataacacgttgaccatcatactatctagtctgtataccacatcgactgccgacagtgtcccgtcttcggagtcagctatcaaggacagtgatggatgatactaggcattcagtaccagctgattccgcatcagtcaactcgcaaatcagctttgccatcgtgtaccacacactgtacatgtat

SEQ ID NO: 4754 - DNA, 309 bp, Diabrotica virgifera
atctagtgacagtgagtcggatgatgacgaaaagaacatacaggataccttgagaaaccaacggaggaaatgaatcaataaaattgggggaaaaactggacacgggcacaaagggatcagaagaatttgttcttgatcatcatccaacggtttagcatgatcctgactgagcatttggtaagatgcgacacagacggtaaagattacggtacgcactggtacaagtggactattggaagactgcaacaaatctttttggcgcaccacgatcaagtgcagaaatacagctcgacgttggagacgctatta

SEQ ID NO: 4755 - DNA, 266 bp, Diabrotica virgifera
cagtgcaagttcagaggcagagtatctgttcgagtcttattaatcctaccgaaagctatttccagatgtagaacaatttatgggctatctaccgcaaacatatcttcataggtggttaaggcgaccgccgatgaacctcatcagcgatttcttcaatagttcgtgattcactaagacaacttttcattagcagaactatgtacaaacattcactaacacgttagctgtgcgataggcttattgtttattaacccacgttcggcgtg

SEQ ID NO: 4756 - DNA, 237 bp, Diabrotica virgifera
  misc_feature (82)..(236): n is a, c, g, or t
acccacgcagatccgaccacgcgtccgatatttttgtatctatgcacgattgtaaataaatatggctgtaaagtgcattcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnna

SEQ ID NO: 4757 - DNA, 244 bp, Diabrotica virgifera
ccgcactaaaggaaaaagggggcccttctaagggtttcatacttcttctcccttctacgcggtctccaaattccttttcattggcccccctttttaaatcccggggctgcgatttccccgctctttcccgggaaaacccccttgtttcccaactctcttcccctaccaggcttcccccttttcacgactgcccctttccccaatcggcccacttctttagccccttccgaaatttttccccccc

SEQ ID NO: 4758 - DNA, 73 bp, Diabrotica virgifera
  misc_feature (12)..(33): n is a, c, g, or t
gtttaataaaannnnnnnnnnnnnnnnnnnnnnaccgtttaataaaaaacattccttttggaataaataaaaa

SEQ ID NO: 4759 - DNA, 297 bp, Diabrotica virgifera
  misc_feature (120)..(138): n is a, c, g, or t
cccacgcatccgagaatttaaagttttaattcgttatgtaatgttataatgatcattattcataaataattataacgagaggggattgttcataatcgatatgggaggatcacgccccgnnnnnnnnnnnnnnnnnnnacgattattatgagattacatataggatttaacgttttaattgggaattataaatgccagggaagaacattaattttgatcacaccatttagattaattttattcaatgaatttcctggattatacgcgtatatgtatactgtattaagacatttagct

SEQ ID NO: 4760 - DNA, 399 bp, Diabrotica virgifera
  misc_feature (392)..(392): n is a, c, g, or t
accacgcgtccggtgtctcaacatacacttgaggataatttccacccaaaatacggaattttggccaattgacatacccattcaaccaaaattgaccttcatcaaaattcgcttataaaaatcgggatcaacggcaatctcgttttgggccctttcgccttatctacgccttgctaggtaatcgtgtagcttcaattcttgcacgagttggattttgtatcttccataaagtggatggacacataatcaactgctgtgcacgatgacggatataatgattcgggtcttcctctatgttacgctatacaatagcaacaacttcttctgtacgacgtctctgtggatgcgtattatcaaatcttgacatttcccattaattttgaggaaacaanaaaaata

SEQ ID NO: 4761 - DNA, 355 bp, Diabrotica virgifera
  misc_feature (25)..(120): n is a, c, g, or t
  misc_feature (122)..(314): n is a, c, g, or t
  misc_feature (316)..(331): n is a, c, g, or t
tcccggctcgacaaacgcgtacgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnaaattttttagtaagatataaatt

SEQ ID NO: 4762 - DNA, 195 bp, Diabrotica virgifera
gacgcacgcgtaagcacgtatcacttgatatctgctcgcctatagcaacacagctgttgaaatacgtgacactttcaaaaacaagtgtaccaccggtgtcatggcgtacctgttgggtgcgtcagacagtttcattagtacaatatcggttcgtaggtgttatgtaatccatatgtgtctcatcgcggttgactc

SEQ ID NO: 4763 - DNA, 197 bp, Diabrotica virgifera
agcgtatacatccggatcgaactttttgtcccatatgttaaatttaatgagcctgagcatgtctatgaggtgcaatatcttgaatgcgaaaatgtagatatttggaaggatgtgctaccaacacaagttttaccacaattcactttttcatggccagccaagtcagattcctatcacacatttcagaaggttgaccc

SEQ ID NO: 4764 - DNA, 382 bp, Diabrotica virgifera
  misc_feature (362)..(379): n is a, c, g, or t
gtgcaaaggatattcattatacacagtatattgatatagaggtagcatttttggagtacgcatacacaaatgatcgtgatgcgttcaaattagaagctaccgagttgatgaaacgagcatgtgatggcatccgcttatggaattataaacgggattttgaaaattctaagttgaaatatgaactctttctagaattagtgtcagtgtttcttaaagaggtaccatcaagatctgactgttacaaagatgttcaagcttgtttaataattgaattggttgatttgtccaaagaatatccccaaaaatgtattaatatatcagactatccagaatttatgtctgtcattgaaaccatgttgacnnnnnnnnnnnnnnnnnnggt

SEQ ID NO: 4765 - DNA, 374 bp, Diabrotica virgifera
gtcagtcttgtataaaaatggtgttatttaacttgaaggattgccaggattatgtttataaacacataggcttttataaaagttgtcctattgtgtgactactttttattatgaatttttgcattatttatcccctttatttcccccatattttttcctgactcgaacattaatctgtatcatttacattttttattatcaaactgatttcatttatatacatgatatttcaatcatttgaaataaatacctacgtaatatatgtaagtattacgaaatctaatatttgtttgtactgatagtttaatttctgagatttatgtgattaatccttgtaattaatattattattagcattagtatcagttttcgtg

SEQ ID NO: 4766 - DNA, 327 bp, Diabrotica virgifera
cggacgcgtgggagaacccctcagttatcaagtacttctggattgatccgtatcatacggaattggggattgccatgaaggtggacttatgaaccttgcttttggtttcgtctacgatcacagaatcgtatcggaagcaagttatccctacaacactatctaccgacattgaagtccacccaatgttagttcagtatttcatatgcaccgttactgtgacttatagctagctgatcaaactttgtgacatgccgtcagtactgttagtcccatttctgcagctatttgggtctgatcaaatccacttctatgcaagctgtatatatc

SEQ ID NO: 4767 - DNA, 405 bp, Diabrotica virgifera
agggacagcccctgcttacagactcgctcgatctaacatctccgtcaattctttcaaagattcggcgaaaagcgttgtgccttttatctgtgtacctactttaagtagatacttacgattaagcaatacgtagttattagaatacctaaatgtttacatttatatttttgatctaactttaaccctctaatctacagaaacctaaaatgaaacagttgaattgttttacaaatgaaaaatatctattttaactatagtagggacataaaaatgctgttaaccgatttcaaatggggtaaatttagtaaatcttagcctttgtgtatttaaaacttacactagagatatatgttaactgcgctacccttgatgggatcaaaagatataagtttggaaaaaataaac

SEQ ID NO: 4768 - DNA, 81 bp, Diabrotica virgifera
  misc_feature (3)..(66): n is a, c, g, or t
agnnnnnnnnnnnnnnnnnnnnnnnnnnnnnnnnnnnnnnnnnnnnnnnnnnnnnnnnnnnnnnnnttcaattattttaag

SEQ ID NO: 4769 - DNA, 281 bp, Diabrotica virgifera
  misc_feature (58)..(115): n is a, c, g, or t
cgacccaagcgtcaacctacgcctccgttaaaatccccaacacagcttcagcccatgnnnnnnnnnnnnnnnnnnnnnnnnnnnnnnnnnnnnnnnnnnnnnnnnnnnnnnnnnngggtccaaaagcagatggaacaactactcgggagttgggattctgccagtcggccctacgcagggattactacggaccaccaacacacccgagtattacttgccgcatcacttatatattagataaactgggttgatccaattgccacctcaggttctcatggtcg

SEQ ID NO: 4770 - DNA, 371 bp, Diabrotica virgifera
aggaaatcttctattcacggttgattattttccaaggaggctatatatgaatttttaagaaatttgtcttaaggtaaaggcacttactgctcctgtaaagggccaacagcttctataaatatttaaaatcgtaccttgggatggcattgatggtgtgcttccatatgaagaggatattgatctctccgatgtagatttagatgagatagcatagttgtaaatgtcataattttatatttatgtatcaattcctgctgttaaagtttgggttaaatcaatttccagaatgtaaattttttaatcataaccaattgatttgctaaatttgtaattctgatctcaaatgctttatcttatttaaaattggtgta

SEQ ID NO: 4771 - DNA, 52 bp, Diabrotica virgifera
tgtgagatgttttaaaatttatgtttagtaataaatgttactcacctctctg

SEQ ID NO: 4772 - DNA, 416 bp, Diabrotica virgifera
agaaatttcaccggccatccatctcaccctgttcagttaccaccacctcattttgcgaatatgcccaataatttgacaccaaacaatcaccaacttccccaaatgcagatgggcaacaacgggatagacgatactttgaggtcacctgaagaaacgcttcagattggcaaagacggaggagcaccaccaaacagaggtccaccaaggcctaacaacaaccagtcttactaccaaaacaacggttacaataggccacgacagcaaaaccagaataggaacgctagtggacctaggcctactgctactagacatgcataatactaaagcaacattattcggtttaaccctaaacaaggatattaagtaacaccctgtaaggtattttttttaataaaagttaaatcatagtacgaacg

SEQ ID NO: 4773 - DNA, 355 bp, Diabrotica virgifera
aggttatgcctacgtttatgcgatacttcacacacgtcttggcgatcaacgagtttggtaccaggttccctgagtgtttaacaataagaaaacatgtgctggaagatattcacattattgctgaggatgccgtcattgttacctgaaatctaagactcaatggttataacattagctagaggttcaaaggatacgatttccatactgacctgtttattctgatgcatattgccaagttacatgccagtacttcatctcagacattaatcgatcctaatacatttgacgaccaggtcaaaaagtactgccatgtgtataaatttccaaaggatcataataccaataatggattttt

SEQ ID NO: 4774 - DNA, 343 bp, Diabrotica virgifera
  misc_feature (74)..(99): n is a, c, g, or t
  misc_feature (281)..(324): n is a, c, g, or t
gtatatgttaagagtaattttatttattgattgatgattagtaatgtgagaggtgatattatatttaaatttgnnnnnnnnnnnnnnnnnnnnnnnnnnctcatggatcatggattagtaattacatatttaatatttacgaatttcgaatagctaagagcttaacatttatattgtaaaatgtatagtttaaataatatttaagttatgagttgtgaaacgttattcgatatatctaatatcttatgaattaagttatatttaattattaactatatacnnnnnnnnnnnnnnnnnnnnnnnnnnnnnnnnnnnnnnnnnnnnggatgagcgtagagcttaa

SEQ ID NO: 4775 - DNA, 365 bp, Diabrotica virgifera
ttcatctccgctgtttcgagcaatctttttgatctgtctgtgtcaggtcgtatttctgccgcatatgtcattattggtctgatgactgttttgtaaattctgcctttcatttctttttcgatatttctatttctctatatccaggccatctgcggctctatttggtctattcacttgatcttccacttctgtttcgagctttccgtagctagatagtgtgatgcctagatatataaattccatcacttgttttattatctgtccctccaggtctaatttatatctattggatttgctgttggaaccatgcattttggcatttttgggaaaattaacatgttaaattttttggcggttatattaaa

SEQ ID NO: 4776 - DNA, 395 bp, Diabrotica virgifera
  misc_feature (15)..(59): n is a, c, g, or t
  misc_feature (78)..(110): n is a, c, g, or t
  misc_feature (120)..(147): n is a, c, g, or t
  misc_feature (149)..(177): n is a, c, g, or t
  misc_feature (194)..(212): n is a, c, g, or t
  misc_feature (221)..(244): n is a, c, g, or t
  misc_feature (246)..(295): n is a, c, g, or t
  misc_feature (303)..(376): n is a, c, g, or t
  misc_feature (379)..(392): n is a, c, g, or t
tgatagataattaannnnnnnnnnnnnnnnnnnnnnnnnnnnnnnnnnnnnnnnnnnnnggaacctggggaacaaggnnnnnnnnnnnnnnnnnnnnnnnnnnnnnnnnnccaaattaannnnnnnnnnnnnnnnnnnnnnnnnnnngnnnnnnnnnnnnnnnnnnnnnnnnnnnnntaagaaaaggtaatccnnnnnnnnnnnnnnnnnnnttttaaggnnnnnnnnnnnnnnnnnnnnnnnncnnnnnnnnnnnnnnnnnnnnnnnnnnnnnnnnnnnnnnnnnnnnnnnnnnggatgagnnnnnnnnnnnnnnnnnnnnnnnnnnnnnnnnnnnnnnnnnnnnnnnnnnnnnnnnnnnnnnnnnnnnnnnnnnggnnnnnnnnnnnnnncac

SEQ ID NO: 4777 - DNA, 217 bp, Diabrotica virgifera
  misc_feature (16)..(16): n is a, c, g, or t
  misc_feature (23)..(23): n is a, c, g, or t
  misc_feature (75)..(75): n is a, c, g, or t
  misc_feature (87)..(87): n is a, c, g, or t
  misc_feature (112)..(148): n is a, c, g, or t
  misc_feature (171)..(172): n is a, c, g, or t
  misc_feature (197)..(198): n is a, c, g, or t
  misc_feature (206)..(207): n is a, c, g, or t
tatcacaacttagtanacaatanatataatagaataaagaatcttgccgaattaagtgacgaaaatggatcacanatgttacagtanaagaattatacatacataatatagnnnnnnnnnnnnnnnnnnnnnnnnnnnnnnnnnnnnnttcagaatttatatcactatgannacgtatgtgatatattacaattacnnatatatannaaaatatatt

SEQ ID NO: 4778 - DNA, 361 bp, Diabrotica virgifera
gcgtccgcaaactggcactctgatagatcatcgtctttcacacttgacctattcttcttccacccatatatcagttcaattcttcacatttctctttcatatttgattttccgtgtttcgattacccttttgacctccgtatttcagtttgcatattttttctatccttaagcccacttgactgtagatatctgttgtatatgcatatttttatagataatcgaaccttagtccgacgcctaaaaggtccttacgaacaaaaggaataatatatgattgtattaatgttgatatattttgtaatctaataaaagttgtttagttccatctagtcggtgtttatctgaaatcaaagtgtatg

SEQ ID NO: 4779 - DNA, 252 bp, Diabrotica virgifera
  misc_feature (35)..(92): n is a, c, g, or t
  misc_feature (94)..(107): n is a, c, g, or t
  misc_feature (190)..(208): n is a, c, g, or t
  misc_feature (224)..(245): n is a, c, g, or t
cacgcctccgcgcacgcgtccgcacacgcgtacgnnnnnnnnnnnnnnnnnnnnnnnnnnnnnnnnnnnnnnnnnnnnnnnnnnnnnnnnnncnnnnnnnnnnnnnnctagtaatgtgagagaaatatttacttttattaaacgaaaaattaatttttggtacctgtggaacaggaataatcaattaccnnnnnnnnnnnnnnnnnnnccaaatttaaacgaannnnnnnnnnnnnnnnnnnnnnggaaaaa

SEQ ID NO: 4780 - DNA, 95 bp, Diabrotica virgifera
  misc_feature (8)..(88): n is a, c, g, or t
gaaaagtnnnnnnnnnnnnnnnnnnnnnnnnnnnnnnnnnnnnnnnnnnnnnnnnnnnnnnnnnnnnnnnnnnnnnnnnnnnnnnnnngaccctg

SEQ ID NO: 4781 - DNA, 79 bp, Diabrotica virgifera
gaattaatgctccatcgaatgactttataggacgactacaaacgtgtagaggaacctctacaagacatggaatttgata

SEQ ID NO: 4782 - DNA, 257 bp, Diabrotica virgifera
  misc_feature (222)..(246): n is a, c, g, or t
atcatggattttaaactccgaagaaggaaccaaaagttccttaattgccgcgttaaacaccgatctttaaggaaaatatatctggaaagaatgcactttaattgaatgggacagttacccaatgccgaatccaccctactaacgccattgttaccaaaatgcctaccgatggttccaaaatgaagtttaaccataaatttataataaaagccaatttgattnnnnnnnnnnnnnnnnnnnnnnnnngcgccccaaaa

SEQ ID NO: 4783 - DNA, 423 bp, Diabrotica virgifera
  misc_feature (12)..(12): n is a, c, g, or t
  misc_feature (327)..(327): n is a, c, g, or t
  misc_feature (401)..(418): n is a, c, g, or t
cacgcgtccggngccgcgtggggtacctataatatttgacagacaatatttgtatcatactatttctgcattgtatcatttagattcagaatttacacagaattgccaaaaatgtggcagccctgtactactcagactgaaagtaaaccccctcttaatattttatctactacagttgagatgtatttttctattggcttttaagtgcacatagagctatattggtgtatctatataatatatctataaatataaatgttatagatctatacatattgatgttatagaagttgtattcatatatttggtggtaaatgcgaaatgtcncaatttgaatatgttctccactattttgttaagtaaattataaatttttagaatgtgaagttagttttgtaagnnnnnnnnnnnnnnnnnngtaac

SEQ ID NO: 4784 - DNA, 101 bp, Diabrotica virgifera
  misc_feature (25)..(25): n is a, c, g, or t
cacagtaagtctgaacatggtacangatcccaccaatatgatgtattggtaatgcctaatctgtatggtgatatcctgtctgaaatgtgcgcaagtcctgt

SEQ ID NO: 4785 - DNA, 53 bp, Diabrotica virgifera
  misc_feature (35)..(52): n is a, c, g, or t
tatgaaagtatccgtttaatatactaattttaagnnnnnnnnnnnnnnnnnnc

SEQ ID NO: 4786 - DNA, 109 bp, Diabrotica virgifera
  misc_feature (18)..(79): n is a, c, g, or t
ttctaatttctattatcnnnnnnnnnnnnnnnnnnnnnnnnnnnnnnnnnnnnnnnnnnnnnnnnnnnnnnnnnnnnnngatttaataagaatttaaattaataaataa

SEQ ID NO: 4787 - DNA, 295 bp, Diabrotica virgifera
  misc_feature (19)..(48): n is a, c, g, or t
  misc_feature (64)..(114): n is a, c, g, or t
  misc_feature (146)..(263): n is a, c, g, or t
  misc_feature (265)..(287): n is a, c, g, or t
gaacttgtgtaacaaggannnnnnnnnnnnnnnnnnnnnnnnnnnnnncgaaatttaaaagaannnnnnnnnnnnnnnnnnnnnnnnnnnnnnnnnnnnnnnnnnnnnnnnnnngtaatgaaatgtaatccgtttttaaataaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnncgattaaa

SEQ ID NO: 4788 - DNA, 73 bp, Diabrotica virgifera
  misc_feature (18)..(56): n is a, c, g, or t
  misc_feature (58)..(72): n is a, c, g, or t
aatttatttattaccacnnnnnnnnnnnnnnnnnnnnnnnnnnnnnnnnnnnnnnncnnnnnnnnnnnnnnnc

SEQ ID NO: 4789 - DNA, 221 bp, Diabrotica virgifera
  misc_feature (85)..(85): n is a, c, g, or t
  misc_feature (149)..(149): n is a, c, g, or t
ccgctaagtctactcttatgtcaaaatataaacacggaatggttgtatcacactctgataaataaagaacttacagtatgtccanatgagggggatattgataatacctacaactttgtcaaaattctttgttcaagtaaattgccgtntggtatcacagatgtcaacaagcaaaagaaatcttttacaactgatgaaattgttgagtattacaaaaatgc

SEQ ID NO: 4790 - DNA, 318 bp, Diabrotica virgifera
  misc_feature (36)..(54): n is a, c, g, or t
gattaataaaaagcaaaaatactttataactcgtcnnnnnnnnnnnnnnnnnnnctgtattaaaataatatgactgaaacgacgagtatctatcatgaaaaacaaataagggaactatgtgccctacatgctttaaataatttatttcaagccaaaggtacattttccaaagctgaattagatttaatatgtacttctctatcaccaaatcattggataaatccgcacaaatctatgctgggacttggaaattatgatattaatgtgattatgaaggctttacaagatagaggctatgaagtaatctggtttgataaa

SEQ ID NO: 4791 - DNA, 230 bp, Diabrotica virgifera
gttgggcttggtactccccgtggtgccgtccacgtctgctcttggagtccagggacctggcacttgacggtccggacttggcttcgggtgggaaccctcttgtggcggttgaggcagcggagcacctcccaatccttggtagccctgcttttgcatcggatgcatgctgcactgctggagcacggtgggcgtattccacatgtcctgaccgctgcggtgccttcatgctg

SEQ ID NO: 4792 - DNA, 447 bp, Diabrotica virgifera
  misc_feature (12)..(12): n is a, c, g, or t
  misc_feature (26)..(409): n is a, c, g, or t
aattccggagcngacccaggcgtcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatagtattaaaaaaatgtatatttaagtaaaaatat

SEQ ID NO: 4793 - DNA, 451 bp, Diabrotica virgifera
  misc_feature (18)..(18): n is a, c, g, or t
aattccgtagccaccagnctcagattttcaaattcgttgcaaaacgaaaacacagccaaaccatattctagtccaatcagagagtgctgcaagcacgcctaccggtttcgaaacttattagtctctcatcgggaggcacatatgctgctctccctgatccaaccaaaacaaaccccagcgtgcagtcccggattgcaacgaacgaaatggcatagatgccctagcggcaactgctagcaaaaatactaagttttcactctaatggcatataaaacaacataatgctattctacatcccaccagaatgaaaacaatgggaaccttttctggttacacctccgaggcttctacaatttgcaatccatacggatgctgagactaggaagatgatttttttcattttatccttgcccatacgtcatgattcattttttaaacaagttaaatcaaa

SEQ ID NO: 4794 - DNA, 71 bp, Diabrotica virgifera
  misc_feature (13)..(30): n is a, c, g, or t
  misc_feature (34)..(51): n is a, c, g, or t
aattataacttannnnnnnnnnnnnnnnnnccannnnnnnnnnnnnnnnnnttaatttaccttagggataa

SEQ ID NO: 4795 - DNA, 318 bp, Diabrotica virgifera
  misc_feature (4)..(18): n is a, c, g, or t
  misc_feature (101)..(179): n is a, c, g, or t
  misc_feature (244)..(261): n is a, c, g, or t
gcgnnnnnnnnnnnnnnnaaccagctacaaacacattcaacagacgttcgtaattttttttataatgtaattgacatttaaaataaatacaaagtatttgnnnnnnnnnnnnnnnnnnnnnnnnnnnnnnnnnnnnnnnnnnnnnnnnnnnnnnnnnnnnnnnnnnnnnnnnnnnnnnnacaagaggggaaaagaaaaaagagcggaagcagagaacaacgagacgaaggggaaaaaaaacacnnnnnnnnnnnnnnnnnncccaaaagggtaaaaagcccggcgggggaggaaggggggggaaaccccccacaaagg

SEQ ID NO: 4796 - DNA, 352 bp, Diabrotica virgifera
  misc_feature (324)..(324): n is a, c, g, or t
gtccggcacctacagattccaccaaacctgctattgccacattaacacatcgatttctgactaccacgcaggaaacacctacctcagtaaatacctcattttcaacgctagatgtgtagatagcggcacctatctttgtttagcactcacgcagttcggtaaagacgaccaaaaagtgactatcaatgtgccgtgtaaaaaatcggatagtgaattatattccttgttgtttttaataccgtttggactgttgttgatacctttagttgtatggctatgttattataggacgaaaaagcatctactatcataatcgtcgaacancagaaaaagcttctcaggactataactc

SEQ ID NO: 4797 - DNA, 392 bp, Diabrotica virgifera
ttcaactgctggaaagattctacgatcctagttatggaaaagtggaaattagtaataaaaatattcgatatgttgatttgaagtcgttaagatctcagttgggaatagtctcacaagagccaaatctattcgacaaaactatagctgagaatatagcatacggtgcaaattacaaacaagtggaaatggatgctattattgatgctgctaaatctgcaaatattcatgaatttattttaaatcttccaaagggttacgaaacaaaagtaggtagtaaaggaactcagctctctggaggacaaaaacaacgtattgccatagcacgagctttgctacgaaatccaaaaatacttttattagatgaggcaacatcagcattagataatgaaagt

SEQ ID NO: 4798 - DNA, 193 bp, Diabrotica virgifera
  misc_feature (21)..(21): n is a, c, g, or t
cacgacgtccgaaagtttttntttattaatctttttaacttagctggtactttaacttacatgtttccgtcttatgtcctgtattacagaatgtgacatcggctttagagaattacattctattgacgatttatcgcgccctaggtgaaatcgtcataataatatcttttcccggctggagagccactcttaa

SEQ ID NO: 4799 - DNA, 377 bp, Diabrotica virgifera
  misc_feature (8)..(159): n is a, c, g, or t
  misc_feature (161)..(216): n is a, c, g, or t
  misc_feature (218)..(249): n is a, c, g, or t
  misc_feature (282)..(299): n is a, c, g, or t
  misc_feature (303)..(335): n is a, c, g, or t
ccgtccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnncnnnnnnnnnnnnnnnnnnnnnnnnnnnnnnnnctattagtagtaaaaaattgtatacttagtatnnnnnnnnnnnnnnnnnncacnnnnnnnnnnnnnnnnnnnnnnnnnnnnnnnnncaaacatctctttttgtattaactatcattctcgcctgctca

SEQ ID NO: 4800 - DNA, 75 bp, Diabrotica virgifera
  misc_feature (3)..(66): n is a, c, g, or t
ccnnnnnnnnnnnnnnnnnnnnnnnnnnnnnnnnnnnnnnnnnnnnnnnnnnnnnnnnnnnnnnnnccaaacaaa

SEQ ID NO: 4801 - DNA, 265 bp, Diabrotica virgifera
  misc_feature (51)..(73): n is a, c, g, or t
  misc_feature (75)..(92): n is a, c, g, or t
  misc_feature (94)..(108): n is a, c, g, or t
  misc_feature (131)..(149): n is a, c, g, or t
ccgaattttataaattttagactaatagaatattttttagtcaaagtatcnnnnnnnnnnnnnnnnnnnnnnncnnnnnnnnnnnnnnnnnncnnnnnnnnnnnnnnncaacacaggttcatggtttgtcnnnnnnnnnnnnnnnnnnnggaagggatcattatatacttattgctgtcgaatttgcgcgagctgcatctttcgcatttttattgtcgactccatctttcaactactttttttgtacgtcaactgttattcgtct

SEQ ID NO: 4802 - DNA, 119 bp, Diabrotica virgifera
  misc_feature (14)..(52): n is a, c, g, or t
  misc_feature (97)..(115): n is a, c, g, or t
cacgagtccgcaannnnnnnnnnnnnnnnnnnnnnnnnnnnnnnnnnnnnnngaatgaaataagtgtttcgtttaaatacatgttttcgtaatatgnnnnnnnnnnnnnnnnnnntgtg

SEQ ID NO: 4803 - DNA, 224 bp, Diabrotica virgifera
  misc_feature (94)..(114): n is a, c, g, or t
acgagtccgtaggaaaatacatacacaaattaattctttggcaaggttgtcaaaaccaaagtttcagcataattggttagcatgacgacaaacnnnnnnnnnnnnnnnnnnnnncaagggacagaagaatatgaaacaagattacaaaaaaaattgagtatacaaaagaatttagagaagaaaaatcactaagaggatttaaaccttcaaggggttgaaccggg

SEQ ID NO: 4804 - DNA, 133 bp, Diabrotica virgifera
tccggagcgatagatgtggagtaaacagggttgatgctaatggagaattaggttgtgagggtggtggcagtggttatatgtggaagagttaatatttatgggcagtatatagggtttggggatattgttttgg

SEQ ID NO: 4805 - DNA, 328 bp, Diabrotica virgifera
tccgtacagttcccatattctaatgtttgtaacttaaatatatgacttttattttgctgtttaatatactattgtcaagcataaaatgggatgtgtatgtaaactttattcgaaagctaaagtactgtgccaattatattttaagtcttgctatccacttaaatttttaaattataaggttaaaaatacctacctacaggcctcctgttaaagtctaaatgatcatttttagacaatatagaagtagagtagattgaaattagagtttttgagatatctcacgtgtgtcagatagatgttacattcgtgtatgcagctctggttttag

SEQ ID NO: 4806 - DNA, 94 bp, Diabrotica virgifera
  misc_feature (22)..(22): n is a, c, g, or t
attttaaaatgaataaaatatntttttaaagtaaaagtaagagaaaagattttgatttaagtgagtagttgaattaggtatgtgtttgagagaa

SEQ ID NO: 4807 - DNA, 335 bp, Diabrotica virgifera
  misc_feature (178)..(200): n is a, c, g, or t
  misc_feature (232)..(267): n is a, c, g, or t
  misc_feature (291)..(316): n is a, c, g, or t
tgaactacaatgcaaccattaaggaacttttcctttcacagcactactcaggaaccatcaagataaccatgaaacaaccagtatggactggaagaatcagcgcacaaaaaacccccactgacttaaaacctaacaccactgtagacagttttaccgtcgactggcacgttgcagatgnnnnnnnnnnnnnnnnnnnnnnnggattacttggagacacttatgctctcgctannnnnnnnnnnnnnnnnnnnnnnnnnnnnnnnnnnnttatcggaaataccgttggagacnnnnnnnnnnnnnnnnnnnnnnnnnnctggtatcccactggcaaa

SEQ ID NO: 4808 - DNA, 341 bp, Diabrotica virgifera
  misc_feature (14)..(45): n is a, c, g, or t
  misc_feature (278)..(278): n is a, c, g, or t
  misc_feature (306)..(306): n is a, c, g, or t
tccgcacacgcgannnnnnnnnnnnnnnnnnnnnnnnnnnnnnnntttcaaacaaatgtcattgactgatagcgaccgacgactcgtactggacgctcacaattatttgagaaataaagtagctacaggacaggaacccataggacctcaaccacaagcgtcaaatatgaaagctctgagttatagcaaggaactggaatatatagctcaatgccacacaaactcctgcaagtggggccacgacgcatgtagaagaactcctgaatggggatgggtangacaaaaccttttcttaagatcttacanaggaggttccataactacaagagatatgttaaatt

SEQ ID NO: 4809 - DNA, 415 bp, Diabrotica virgifera
  misc_feature (237)..(254): n is a, c, g, or t
ccgcagacgcgagggcttttattatcttctatttaatatatctctttcatttaaatcatcatactgaacatacctcgtatattcatactctccaaatatctgtattttcaatacggaacatgccgctacttcatagtacttggttgtcattttaaatgtcgttttcaatgacagtgtcacttcatcgacttgacatacactggaaggaaaaaattaatccttaaaagggcatgtttnnnnnnnnnnnnnnnnnnccattatctaaacacctcttggggggttgagaacattatattgtgatgatatttctccgtctaacaatttttatattgtgtttttttatctaacctaccttcctatgtcagaccatgtgttctgataatttagtttcaaatataattatcctttaatttac

SEQ ID NO: 4810 - DNA, 184 bp, Diabrotica virgifera
  misc_feature (14)..(41): n is a, c, g, or t
cacgcgtaagcaannnnnnnnnnnnnnnnnnnnnnnnnnnngatcgattcggttactgttatgcttttgactatgcactggcgtgctgtttgcgatcactgactccgaatatttgacattaggatgacgtgtagtatttgatatgttagattggcgagagaccgtcgatatcatttagcggcct

SEQ ID NO: 4811 - DNA, 341 bp, Diabrotica virgifera
  misc_feature (14)..(36): n is a, c, g, or t
  misc_feature (47)..(108): n is a, c, g, or t
  misc_feature (129)..(165): n is a, c, g, or t
  misc_feature (167)..(247): n is a, c, g, or t
  misc_feature (250)..(318): n is a, c, g, or t
gcgtccgcgagacnnnnnnnnnnnnnnnnnnnnnnnaagctcatccnnnnnnnnnnnnnnnnnnnnnnnnnnnnnnnnnnnnnnnnnnnnnnnnnnnnnnnnnnnnnnctcatccctaaaaatattggnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnctnnnnnnnnnnnnnnnnnnnnnnnnnnnnnnnnnnnnnnnnnnnnnnnnnnnnnnnnnnnnnnnnnnnnnctaatgaggataatattagtatt

SEQ ID NO: 4812 - DNA, 151 bp, Diabrotica virgifera
  misc_feature (55)..(77): n is a, c, g, or t
gtccgcgaacgaatgggatttactccaaatacacacgtttaatacacgaattccnnnnnnnnnnnnnnnnnnnnnnnctaaaaacatgtccttttgtactacacaccacatctcgcccgcccagggattaccttgaagggccgcggtactt

SEQ ID NO: 4813 - DNA, 236 bp, Diabrotica virgifera
atttaaaaactgctaatacatgtttaacagaacatatggatcctattctgatggatttagggtcttgcgctccaccgaaagttcaagtttgtggagctcaagatgcacaaaaattgcaagatttggctgccgaaacatgttctatcacatacacaactcctgaactattccatggttgagagctactgtgtaattgatcagacactttatattttgagtttgggttgtgtcttgta

SEQ ID NO: 4814 - DNA, 233 bp, Diabrotica virgifera
cacgcgtacgaaaaacgaatcattttctaatattcctttgtagtacagtgaatgtagataacaactaactaggtactacatttatatttaaaaggtaatttcaagggctatgacgtattaaattgagtattagcacacacaatgtgtgtactttgtgcgcacataagacgttgtacttctattatacgatttcaaccacatccacatactttaaacacgtttatttatcccta

SEQ ID NO: 4815 - DNA, 304 bp, Diabrotica virgifera
caatagatcacgagaactgatttttacatgcctaccattgaaaattgcatttaattgatcattttttcacaagatcctcgtttattgaagttatttactcgttgagtcagacattaccattaaaatacgtgaaaacgaatagattttccataactttttttcactgagctgtttcttttgccgcctcgcacattttttctctctttcacgtttttccctcactttgttcttgtagtccaagtgaaaatatcctgtgatttttgttcagacattttttgtgttttcagatagttttactgtttta

SEQ ID NO: 4816 - DNA, 354 bp, Diabrotica virgifera
acgcgtcagccagcgcgtccggataatttcaagctttatttaatcatttgactatctcaagatactttcggaagaattgcgacgcctaaaaatgttgctggttagagaactcttttcatcagtcatcactatccggggattgaatcgaatcataaattcgattctcacttcactctttaagttcataggcaaaaatcccctataataagactgtaggataatcttgaggattttgctctaatattgaaatggcttacgatgatgatttaaaagtgacttgcttccattagaagatctaacctagaatgtactggaacatagaactactagaataatttctaactaagtagcgga

SEQ ID NO: 4817 - DNA, 333 bp, Diabrotica virgifera
  misc_feature (9)..(209): n is a, c, g, or t
  misc_feature (211)..(233): n is a, c, g, or t
  misc_feature (240)..(257): n is a, c, g, or t
  misc_feature (259)..(273): n is a, c, g, or t
gtccgatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnncatttcnnnnnnnnnnnnnnnnnncnnnnnnnnnnnnnnngttttaccttttataaattttttactacaatatacacttaaactatttaaatttagtaac

SEQ ID NO: 4818 - DNA, 118 bp, Diabrotica virgifera
ccttcattgccaacacagtactcgatcccaatgtccacgctgtagaccacgttgattggagagaacgtgctgttttgggagtccaccatcggggacactctggatcacgctgggcttt

SEQ ID NO: 4819 - DNA, 142 bp, Diabrotica virgifera
acgcgtcagatattgctgggctttcagtatcatgggatccctcgaaggttaactcgtcatcgataggtatcaacgctgtttctctcagtgagcaagaattggttgactgtgattgggtgagggagggttgtgacggaggttt

SEQ ID NO: 4820 - DNA, 343 bp, Diabrotica virgifera
  misc_feature (12)..(38): n is a, c, g, or t
ttcccgagtgcnnnnnnnnnnnnnnnnnnnnnnnnnnnttagtttagtacgaggtctatttgtcccgttacgcagctaaggtgttaacttacactgctgctgttcataacccatcagaaaaattgagaatgtgcaatgtggttgatcaattccccattaattctcaaccaacaactactaaaaacagttacatgatttacgaaggtgcaagataactgtcaggccaatttttcagcgtccaacactcatttctcttgtacaaaaattaaaaatacgtgggcgttaattaaaattatcacatatttacctttcgcgcccgtcttagtaattttttgacaatttt

SEQ ID NO: 4821 - DNA, 66 bp, Diabrotica virgifera
tccggggtcaccacgcgtccgaaagccgactataaccaagaaaatcttctcagtttttgttatttt

SEQ ID NO: 4822 - DNA, 255 bp, Diabrotica virgifera
  misc_feature (29)..(29): n is a, c, g, or t
tccggaaactactgctttgtgtgttttcnggctatctttgttttcgctggctgttcttctttttcttgttgtgttggtgcgcttttggtggctgtcggtctggttggccctgttgccgtgtgtgtccgtgctgttgtctgctggcggctgtggctcgggggtctccttgttgtccggggttgcccgggtggcgctggttttgtccgtgctgttttcgctgttgtgttctggttcgtgtcttggttttgctttttg

SEQ ID NO: 4823 - DNA, 306 bp, Diabrotica virgifera
caggcgtccgcaaacgcgtccggaacttttcctttcaccgcactatgcaggaaccagcgagatgaccaggacgcaggcagtctggactggaagagtcagcgcacaggagagccccactgacgtaaagcctagcaccactgtagacagttttaccgtcgactggcacgttgcagatgtggcaggtccaatcagtggtgtcggattacttggagacacttatgctctcgctattcacgaaggtattgaatgtgccctcaaccatggtcgtatcgcaaataccgttggagagttccttaagatgagatt

SEQ ID NO: 4824 - DNA, 257 bp, Diabrotica virgifera
ccacgcgtccgacaatgcgtgggtttaaagttaataaacagttttcgagtagaatgtagggaaaaattgtagttgagggacagttagtaagtgttgtgagagaagattttagttttatgcgagaagagttcagtttttgtacgctgtgtatcagggattagtagttaacaattagatgtgaattatttccgagtgtgggggagctaacaaagtcagatttttattgtaaaggagcgaggttaaagagtttttttgta

SEQ ID NO: 4825 - DNA, 297 bp, Diabrotica virgifera
  misc_feature (32)..(146): n is a, c, g, or t
  misc_feature (148)..(205): n is a, c, g, or t
  misc_feature (221)..(255): n is a, c, g, or t
  misc_feature (257)..(290): n is a, c, g, or t
gtcccagatccccggggccacccaaacgtccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnncagcttaaaaatacannnnnnnnnnnnnnnnnnnnnnnnnnnnnnnnnnngnnnnnnnnnnnnnnnnnnnnnnnnnnnnnnnnnnctcactt

SEQ ID NO: 4826 - DNA, 371 bp, Diabrotica virgifera
  misc_feature (100)..(119): n is a, c, g, or t
ccggggtcacccacacgtccgcacacgcgtccggaataacattatgttgttttataagccattacagtgaaaacttaatcatttatttgtttgttgttcnnnnnnnnnnnnnnnnnnnncattatcaaacggtaggttttgttgtttgtgacttcagaatcataaaaatttcatgctagaattgtcaaaagcacaatacttaattttttaaggaagtaggtgcaaaatcttggtccaattctattgaaatgcattaacttttttcgagtactgacaatactaacgaacattttcacgggttttacacatatttgataatctttttagaatttatcatattacattatgcctgagggcctaaagtcccttac

SEQ ID NO: 4827 - DNA, 221 bp, Diabrotica virgifera
gtccgcaaagattattcagtaacattaccagtgttaactgattttgtgtgagtagttacatgtgagtgtgactctcttgtagagttgttactctcttgtgatttttacagaggttagaaagtagtgtattacaggtatgaaagttgattaatttttgctgtatttactaggggacgtaggtgtgatcggcgtatctcacgcaactttagtgcacgactatc

SEQ ID NO: 4828 - DNA, 457 bp, Diabrotica virgifera
  misc_feature (23)..(61): n is a, c, g, or t
  misc_feature (226)..(269): n is a, c, g, or t
ccggggtcacccacgacgtccgnnnnnnnnnnnnnnnnnnnnnnnnnnnnnnnnnnnnnnnggtgggtgtcaaagcacatcaagaaacctatcagatctacagtgacttgcttggattggcatcctaacaatgtgctacttgctgccggatcttctgatttcaaagtcagagttttttctgcttacattaaggatatcgaaaagactcccgaaccgactgcgtggnnnnnnnnnnnnnnnnnnnnnnnnnnnnnnnnnnnnnnnnnnnnttccaacgttggagggggttgggttcacagccttagtttttctccagatggaaacaaaatttgttgggtttcccacgattcttcgataaacgtggcagatgcaagtaaagggaatgctgtccataaacttcgtaccgagtttttaccatttcttagttgcacttggatcggcaataaatcagtagtgg

SEQ ID NO: 4829 - DNA, 161 bp, Diabrotica virgifera
ggggaaaggttattcgtgtttaaatataggtaatttttgaagaaataaattaggttgatttagtagcagtagatttataggtaaatatttttagattattaagatgaaatattttgagggatgagcttaggaataaaatgtggttaaaagtgaggttggag

SEQ ID NO: 4830 - DNA, 86 bp, Diabrotica virgifera
  misc_feature (14)..(38): n is a, c, g, or t
ccacgcatccgcannnnnnnnnnnnnnnnnnnnnnnnncggcgtgggacgagaagagtttagtttttgtggcgtgtgtatcaggga

SEQ ID NO: 4831 - DNA, 159 bp, Diabrotica virgifera
gtccgtaaataccagtgctggtaatattagtcacaaattaaataattgtcgcgatattcgtgatatacgaggtttaattacagcctttaccattgacttgtatttacttaaatacttgtaatctttctttatgtggttttccttttagatccggatttt

SEQ ID NO: 4832 - DNA, 87 bp, Diabrotica virgifera
gtccgaaaatttgtattgtggaataagtattcgaaatctgttttttgtcctgaactgtcacgcgtgttgaggtatatctacgttttt

SEQ ID NO: 4833 - DNA, 353 bp, Diabrotica virgifera
  misc_feature (151)..(168): n is a, c, g, or t
ggggccccccacgcatccgcagacgcgtgggctgttgttctgtatggtttgagccaggatccagaggcttcttgggaaagtggtgcacttgcgattatcttcctagtgttcttcgtcggtaataccatcacaacgttacgtgttattccannnnnnnnnnnnnnnnnnatgtacatacagtagaagatattgtcgaacaggttttatgagacaatcagcgattctgtaagaaaagagagttccaaggatagtacaaaaaaagaaagtgaggtacagcagcaatgaatttggttgtaagggatatttttaggctaatattcattttgtttaagagagtgtcatatgagttttat

SEQ ID NO: 4834 - DNA, 434 bp, Diabrotica virgifera
  misc_feature (96)..(116): n is a, c, g, or t
ggtccgacgttcccggggccacccacacgtccgaaaggttggatgaacacaaaactgtccttatttgacttatagagaattttattttctaagtgnnnnnnnnnnnnnnnnnnnnnaacacgagaacacccgacagagttggagaaaattatcaataagtttttgtagtagtaacttcatctatggagcaaactcattcaactggggtgattaaggtggagctttagctttggtcatattatactattacttaacaatgtttgtgatccaagtttttcgatgacaagaataactcacctcatggacaacagcctaatctaattggagagtgcaaatcgataccaaacattgcgacctcgacgtcggaccatacttgataaatggtgtaccagctatatgagtacgtctgtacgacctttaaaatctcacaggat

SEQ ID NO: 4835 - DNA, 252 bp, Diabrotica virgifera
  misc_feature (17)..(45): n is a, c, g, or t
gcgtccgccaacgcgannnnnnnnnnnnnnnnnnnnnnnnnnnnncttaccctcattgtaacagtatcaggcgggaggtacaattttgaccgtgtctttccactgttcaggtatccagtgctgacactttttacatgaagacaatcttgttttcgtcagtgcttttgtaagcaggtgctgctttgcagcaggtcgaattgacactggtagatctttctgaatctgatgacgaagctgtcttgttaaaacttt

SEQ ID NO: 4836 - DNA, 221 bp, Diabrotica virgifera
ccacgcgtccgtatgaggcgagtgtcctgttacgaggcatgcattgactcgcagatcattcggatgcacagcgagtacatatttggacgttttcttcagaagttcatctattcgagtagttacgactcagttgttcgtaccaatagttgcgtgtcgtcggttccgccgagtgcgggaaccttctctcggcgtggcttctcccctggcaaggaagaaccttc

SEQ ID NO: 4837 - DNA, 254 bp, Diabrotica virgifera
tccgcaaacgcgaccgagagggaacttatcaaggccttcagactttagtagttacgaaaggtgtacgttgacgaataattttatttacgacttcagaggtattaggtttttagagcatttttttgaggattttttcacagatcattatgaccaactgttgaattaggaatacgttgacctccgagaggaaggcaagcctttaacccattagaaatccctttattaaatacttgagctcttttaacttcgggatt

SEQ ID NO: 4838 - DNA, 162 bp, Diabrotica virgifera
gtagccgtccgacattcgaggctgcccccacgcgtccgatataaatgctggactgaacggttggacgagcgatcgactgtcttcgagtacgttacgacgcacttgagtttcacttcaacacgcttagacttttgtacgcgactagatcaccctatgtagttt

SEQ ID NO: 4839 - DNA, 163 bp, Diabrotica virgifera
  misc_feature (7)..(27): n is a, c, g, or t
cacgcannnnnnnnnnnnnnnnnnnnntatctattttagaataataccctcttttttagtcacagtgccgaccgattttatccactgatagtcaattactattgtgagagaagctcttatttcttacaaaagaaccatttatttcttgtaccttctgtagcag

SEQ ID NO: 4840 - DNA, 117 bp, Diabrotica virgifera
  misc_feature (14)..(67): n is a, c, g, or t
ctcacgcatccgcnnnnnnnnnnnnnnnnnnnnnnnnnnnnnnnnnnnnnnnnnnnnnnnnnnnnnncaagttataatgattacacacacaaatggaatgtgttgcaataatttttt

SEQ ID NO: 4841 - DNA, 67 bp, Diabrotica virgifera
acagggaataaacggataaggtaaatataagagataaaaaactaactaaaataagaaataggggggc

SEQ ID NO: 4842 - DNA, 70 bp, Diabrotica virgifera
acgcatccgaagatcgtagacactggtatcagtttgatcgctggacctagcgctcaagtcgataagtcac

SEQ ID NO: 4843 - DNA, 373 bp, Diabrotica virgifera
cacgcatccggaaggctacagtggacttggccattacggagtcttgccagccgctaccagttatagttccagtgttgttcaccatacacctgtggtcgctaaaacctacgttgcaccagtggtcgctaaagcctacgttgcaccagtggtcagctacagtgccccattagttacctcctatggattgggtcacggatacggaggattgagtcacggatacggaggattgagccatggatacggacatggtttaggatatggtcatggtctaggacatggttatggtttaggacacggttatagtctaggacacagctacgcaggtctgggtcatggttactctttaggagggtctggacctgggtggtacctg

SEQ ID NO: 4844 - DNA, 64 bp, Diabrotica virgifera
tccggaattacctaattttgttatgtgttgacatggacattggaaataataaagattgccatac

SEQ ID NO: 4845 - DNA, 362 bp, Diabrotica virgifera
ccacgcatccgcattatcggcattcccacagcagtctcgaactcgtgatattcaaaagtcataaaaataatttactgaacaatgttttactaagaagaaactcattttctgctaaaaaggtttcaagagatagaaatagtgaaaaccgaagttttctgtcttagttgcctttcttagtttttgtttaaaacgatcacgaaactcaaactgtttgttggttcaaaaaactggtttccaactatatcataataacaaaacacaaggattgcagttctggagaatatgtgattaaaagtattaggggtcagcgtactagtgaccagtactatgctgcgtaccctagcacattcgcggtcatgact

SEQ ID NO: 4846 - DNA, 137 bp, Diabrotica virgifera
tccgaaatttcaagggatgagcttaaggataagattttattaaaatttaccttttaactaaattttaggattaacaatttgcacacttcaaaatacgtcatcatgtatctttatatctgatcgggttcattcgtcat

SEQ ID NO: 4847 - DNA, 114 bp, Diabrotica virgifera
  misc_feature (38)..(76): n is a, c, g, or t
tgggaatttaatttttaaagtgatgattaggattgggnnnnnnnnnnnnnnnnnnnnnnnnnnnnnnnnnnnnnnngatattgagtagttttatggttttattagattgtttat

SEQ ID NO: 4848 - DNA, 356 bp, Diabrotica virgifera
  misc_feature (2)..(30): n is a, c, g, or t
  misc_feature (40)..(69): n is a, c, g, or t
  misc_feature (119)..(153): n is a, c, g, or t
  misc_feature (165)..(220): n is a, c, g, or t
  misc_feature (245)..(314): n is a, c, g, or t
  misc_feature (318)..(351): n is a, c, g, or t
gnnnnnnnnnnnnnnnnnnnnnnnnnnnnnttatttggtnnnnnnnnnnnnnnnnnnnnnnnnnnnnnntgatttatgttttggttgttttttttttgttgattgtatttattagtgtnnnnnnnnnnnnnnnnnnnnnnnnnnnnnnnnnnngttggattgtgnnnnnnnnnnnnnnnnnnnnnnnnnnnnnnnnnnnnnnnnnnnnnnnnnnnnnnnngggtgtgtttgtttatgtttgtttnnnnnnnnnnnnnnnnnnnnnnnnnnnnnnnnnnnnnnnnnnnnnnnnnnnnnnnnnnnnnnnnnnnnnngttnnnnnnnnnnnnnnnnnnnnnnnnnnnnnnnnnnggttg

SEQ ID NO: 4849 - DNA, 86 bp, Diabrotica virgifera
  misc_feature (11)..(85): n is a, c, g, or t
cacgcatccgnnnnnnnnnnnnnnnnnnnnnnnnnnnnnnnnnnnnnnnnnnnnnnnnnnnnnnnnnnnnnnnnnnnnnnnnnnnt

SEQ ID NO: 4850 - DNA, 94 bp, Diabrotica virgifera
  misc_feature (14)..(37): n is a, c, g, or t
ccacgcatccgcannnnnnnnnnnnnnnnnnnnnnnnggagttttcaacaataaaaattgccatgtatcagcttcgacagctattgacactgga

SEQ ID NO: 4851 - DNA, 339 bp, Diabrotica virgifera
cccacgcatccgcacacgcgtccgaccgtggacacgtgcaaatggggcggatatttttagtttttgttttagtgggggctgcttttggaaacccagcgccaaacttgggacaggaaaatgagtgggagcagcttctaaaagttggttcgaacgttgatatcaaaagcaacgccattgacactggaagaagtgctgctggcagcattgaggaccacatctaaagatatatcaaaagccatgaagcaacgtttgatttgccttttactggatcaacggtgacgttagatggaaaaaatctggactattacgagatgagcattacgtcgacttttggcacac

SEQ ID NO: 4852 - DNA, 224 bp, Diabrotica virgifera
gtccggagctttaaacatttgttcagaggtacaaagctgatatatcatcagagcaaaaagaagctttattggagttattaaagaagcaaaatcaccatactcttactcctgaaattagaggagagttgcagcatgccaagtgtagagacttggaagatgttatgcccacaatggagtttgattaaatactaaataagtagttgttaacagttatgttttgaagt

SEQ ID NO: 4853 - DNA, 228 bp, Diabrotica virgifera
  misc_feature (42)..(68): n is a, c, g, or t
ccacgcatccgaaaagatggagtgacgaatagagagaagggnnnnnnnnnnnnnnnnnnnnnnnnnnncaaaaaacatttattggacgacgagtcgattgttaattttaaggcaatacctttgacggctgttgtgtaagataatattccatgtggagtatagactacatatattttagttttttactgttctccagattttatcgaatatacttttatagtttacata

SEQ ID NO: 4854 - DNA, 122 bp, Diabrotica virgifera
ccgcacacgcgtccgtgacttcacagtatattgatttcactttgtgcacacttcttcgctaaccagttgtgcattgctgtcaattcttttacttgtccatggcatatccttgggcaggagct

SEQ ID NO: 4855 - DNA, 336 bp, Diabrotica virgifera
ccacgcgatccgcaaacgcgtccgatgaaactaatgttattcttttttgtcgctttaaccgtagtggcatctcaagcagaagaatttaacgttttcgagaaatatgtagaatttgtaccacaatgtaattctactctatctaatcaggcttttaaagattttatgactaaaaaaaatgcgaatttgggtctagaagaactaggaaactttttattttgcatgaatacgaaatttctcactcagaatgaaaacggagacgttaatgttcaacaattcaacaaaattgttggtacgctagtacctcaaaatgacttagaacacttaacaacagtgtgt

SEQ ID NO: 4856 - DNA, 419 bp, Diabrotica virgifera
cccacacttccgcccttgcttcggacttcattcatctgcgccatcatagtcatcggcctgaccgtacctgttctgacaggtttaggtcttcgctttctctgtcatagaatgtgagtgtgagaatctggtgacaggctaactagacctgctagagtagtggatcagggtagttgaccatattgctgataatctcaagctgcaagtataacacgtcaggtcatcctggtaaccgtcgtaatggcgtacatgctctcaactgtgatgtacccgggacgctcaaatctgattgctgttttatacattaggctgaagtttgacacaatatcatttgagacgtgttgacttctctgcatcgaggacctttggatttggatgtcaagattacatcgatcgtggtatctaatatgatccaagtatag

SEQ ID NO: 4857 - DNA, 422 bp, Diabrotica virgifera
  misc_feature (204)..(224): n is a, c, g, or t
agttcatgacaagacacgataattcatcattcttcagtgcattttcgcagtgataaaaccaatttttgtgaaatgggaaatggttttttaagtttaatacacactttatattgcgtgttcttcgagtatctttaagactttaaaaggaatagtattattaattcttagttcctaactgaaccggtgccgatagcaagactgtgnnnnnnnnnnnnnnnnnnnnnccaaagatgtcaacggaggtgaagacgatttctgcgagagccattacgatactaagaatggaagaaacacagccaagactgaccagatcatcgtcgttagataaaataaagaaattcaacacattcatctgctcccaacagtactacgtgttgccagctctacttaattggctaaaatcttcacaaaccaatctacaa

SEQ ID NO: 4858 - DNA, 402 bp, Diabrotica virgifera
  misc_feature (91)..(110): n is a, c, g, or t
  misc_feature (138)..(138): n is a, c, g, or t
  misc_feature (296)..(319): n is a, c, g, or t
ccaacgcgtccgagcaatttgaaaaagtcagtcatgaaactgaaaatctttaggcaatgaggtattttgagcttttcttcacttcatacannnnnnnnnnnnnnnnnnnngacatttgtcaaacgggttaagtcgtanacgaaaagtggctcaaaccttctttttgcaaaaaaatggccggtttgccccgcaccaatcaaatgccccctttgttggtgaacttttcgcaaaaaatccttgtttgtaaaacttaattaatttgttgggaaattattttgaggaacttttggtaaacnnnnnnnnnnnnnnnnnnnnnnnngaataaatatcacccccaatagcatcgataatttataaaccatgggaaaaatacaattcacatttaactcatatcgatttatt

SEQ ID NO: 4859 - DNA, 418 bp, Diabrotica virgifera
  misc_feature (8)..(146): n is a, c, g, or t
  misc_feature (246)..(264): n is a, c, g, or t
  misc_feature (284)..(312): n is a, c, g, or t
  misc_feature (354)..(379): n is a, c, g, or t
aattactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttcgaccctacatctaattttaatttaccaataaactgattaagaacagtattaggtctattaattattccatctagattttgattaatcccctctcgnnnnnnnnnnnnnnnnnnnaagattattataacattacnnnnnnnnnnnnnnnnnnnnnnnnnnnnntataaatcccaaggaagaacattaatttttatctcactattnnnnnnnnnnnnnnnnnnnnnnnnnnttggattattcccgtatatttttactagaacaagacata

SEQ ID NO: 4860 - DNA, 416 bp, Diabrotica virgifera
  misc_feature (62)..(188): n is a, c, g, or t
agagcatattgttacgagatgaggttatgtaagataattgatataataaaacttttatatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagggttcaaacctaatttacccttcaaggcaatttcaaacccctccaaaattgcccccaaattcaattccaggggccttcttttaaaaagttcttaacgggaaaaacccgggcttaccccaattaaacccctttgaacaaaaccccctttccccaagcggggttaaaaccaaaaaggcccgcaccagttccctttccaaaagtttccccacccgaaagggcaaagg

SEQ ID NO: 4861 - DNA, 151 bp, Diabrotica virgifera
cagcgtccgcacaagcgtctgaccacgcgtacgaaaccacttgggcagaactagcaaaaatctcttacgtgacacgtgtctttgacgaagtacccaggggaagtcctgttgtgccccacaagacacatggatgaaccaattccttaagacc

SEQ ID NO: 4862 - DNA, 122 bp, Diabrotica virgifera
acccacgcgtccgcacatgcttcgacttaaaactggtgtgacccatgttggattccatccttaatttagtaataaagtttagtaccatgggaacatatatatatgaggggtgttatatttag

SEQ ID NO: 4863 - DNA, 420 bp, Diabrotica virgifera
attaggtattacttctacttatactaatttatatagatcattctaactaaatttaattaatggctttaacaaaaccaaagtcggagatgtcctccgaggagctccaagctcgcgaggaggaagaattcaacactggaccactgtccgtcttgacacaatcagtaaaaaacaacactcaggtactcataaactgccggaacaacaaaaaactactcggtagagttaaagccttcgacagacattgcaacatggtgctggaaaatgttaaggaaatgtggacggagctacccagggctggtaagggtcgcaagaaggcgaaaccggtcaacaaggatagatttatttcgaagatgtttttaaggggcgatgccgtgatactaattgttagaaatccacttgctaccgtgaatgcatgagata

SEQ ID NO: 4864 - DNA, 411 bp, Diabrotica virgifera
agggaatatcctgagagtctgggtgcttgataagattacggacttccttttcttcctcagtaaagttttgctgacgctgggagttggagcagcatcatatgtgttcttcgcctcggggttgcttcctacaaaagttatcgacaactctgatctccattacggaatcgtgccggttgcagtaattatgatttgcacttacttcatatcatcgttgttcttcaatgtttattcgatggccgtggacacgctatttttgtgctttttggaagattgtgaaagaaacgatggatctccagaaaaaccttactacatgtccaagagtctaatgaaaatatttggaaagaagaacaaaatagattaaattaattgtaaggcagtatttacaattttacccgtaagaatatctgtgat

SEQ ID NO: 4865 - DNA, 341 bp, Diabrotica virgifera
  misc_feature (10)..(68): n is a, c, g, or t
  misc_feature (71)..(97): n is a, c, g, or t
  misc_feature (116)..(145): n is a, c, g, or t
  misc_feature (164)..(184): n is a, c, g, or t
  misc_feature (186)..(213): n is a, c, g, or t
  misc_feature (257)..(333): n is a, c, g, or t
taagtaatgnnnnnnnnnnnnnnnnnnnnnnnnnnnnnnnnnnnnnnnnnnnnnnnnnnnnnnnnnnnggnnnnnnnnnnnnnnnnnnnnnnnnnnngcagggagtattacttggnnnnnnnnnnnnnnnnnnnnnnnnnnnnnntagagctattaaattagcnnnnnnnnnnnnnnnnnnnnngnnnnnnnnnnnnnnnnnnnnnnnnnnnngattcgttttgaaatacatctaaatttttaacaaatttattaannnnnnnnnnnnnnnnnnnnnnnnnnnnnnnnnnnnnnnnnnnnnnnnnnnnnnnnnnnnnnnnnnnnnnnnnnnnnggataagc

SEQ ID NO: 4866 - DNA, 394 bp, Diabrotica virgifera
aatgaagaaagaagagtccaaaatactgcaaaaattcagaatggtcagatcgcctacataaaaaatgaaaacagttctcttgtgtataatattatgtatattagattcgttctcggaaattaatatagtttgttgtattgctcataatatgcctatttatactaaaaatctgtttgtgtcaaatccaaattccaagcggaagtgttaagtttttatttttcataattacgggataatattcccttgtctttaaaaagtttctatacctaatgtgccttttattaaatctgtttaacaattattattcttctatggagtgtatgaggttattgttataaaactgaaattagtttttagttagtactgtatttattagcttttaggttataataaa

SEQ ID NO: 4867 - DNA, 388 bp, Diabrotica virgifera
gtcaaatactcatcaaaagatagatccaggattgtgttaaagaaaactgactcatttgctacatatattttgttttgaatgcaatgtttaagagaaattctgctaaagtggagttggaaagcattgcagcattccttagtaaatgtttacagactaaaatttatataaacaaaactaacattgatcatttccttgaagttatatcaatttgtctgggtgagcattgcacagtatggaaaaaatcaaatgtagatgcacgcaagcttttagaaaatgtgatcaattttacacacagcatagaagttgctgaaactagtaggatcaaaatgattagtatattagcagactttgatgacagtccgtatcttacaaaagccatcgggtatca

SEQ ID NO: 4868 - DNA, 411 bp, Diabrotica virgifera
  misc_feature (82)..(106): n is a, c, g, or t
ctcaaaatatcgttttcaataaaataaaacacagtacatagttattaggattaattatagtgataaacgtgaaaacttattnnnnnnnnnnnnnnnnnnnnnnnnngatctcttggcatctatttcaggttcaggcaaattttgacaagatttagcaaaagttaaagcataatcctaataccataatattattcttacatgatttgtatgcacgtgcagtatgaaggattctacattgtatcattcttaaatgatgcgaattaaacgcacgacactaatattaggattattgataataatatggtcatcaatattttatttaacatattattaccatcctgttcacatatatagtgaaatacctagtaaattgagccagcatattgtgatcttagaacaaggcatatcaag

SEQ ID NO: 4869 - DNA, 360 bp, Diabrotica virgifera
caagcgtccgaccaaaccttaacaataaaattttggtccaccaccattgtaacaattattttttaaaagattcaaaatgagtactatgccaatgacttcttcatcacttctaccattggaattggtatataactgtattggctcagaacttcaaataatcatgataaatgaaatggaaattgatggcacattatcaaggtttgatgattttgtaaagaagttgctggatgatgttacagagtatgaaaatacaccataagggaggcgtataacaacactggatgaaattttgctcaatggaattaacaaatcactgcatgtacctgaaggagatatgccagaataacataatgaacacat

SEQ ID NO: 4870 - DNA, 416 bp, Diabrotica virgifera
  misc_feature (350)..(367): n is a, c, g, or t
attttggcagcgttgatttgaaaaaattctagagcaattcagttgtaataattgtagtaaattgcacaaatctattttaacttatatttaatttatcagtatattgctgatgtagcgaaatatttttaaagggatttttaatttggaaataattcgacctgtatatatgactaattaagttgttaacaaaaataataaaatgacaaccaataataaaaaatgttcttgttaatatacaggaagctcagttgagaagagttccttgacacctcaaattgcaagaacgtcttcgttgagcttcaagggattcttccgcaattatttggttgacagatttctacgtccactcnnnnnnnnnnnnnnnnnngtatgtatcccgaatctttattaaaatttcttagtagttcttttaaaaa

SEQ ID NO: 4871 - DNA, 110 bp, Diabrotica virgifera
gagggccaccaactttgcaaattttgaaatttttaggtgcaaacaagttatgtcggaaattttagattgtaaatagataatcatcaatagacaactggaactccgttaaa

SEQ ID NO: 4872 - DNA, 367 bp, Diabrotica virgifera
  misc_feature (315)..(354): n is a, c, g, or t
aggagaaaacatcaccgcctctactaatgttaccgccaatgttgttggcaaggtaaatcccttcctttttggcaaactcacaggtaaggctatccatgtacatgtaccaattgtaacctttgttgactagacagttcatttgggcaatcccgccatctacgaggaggtttatagccaaggttaatgaacccgcataaagtcactcataaaggaatctagggatatgatgcagattatttggtcacaagcgacttcgatggaaaggcacacaccgcagtcttagatgcaaagtcaggtaccaaactaaacgatgcnnnnnnnnnnnnnnnnnnnnnnnnnnnnnnnnnnnnnnnncaatccaacaaag

SEQ ID NO: 4873 - DNA, 195 bp, Diabrotica virgifera
gacccacgagtcagattcttctttatatttttcttatactccacttttaataacttgttacaaactattttatattttgatatttacttttgttacatacgtgcgttcccaacttcgggggggaatcttatactacttccacttacttgtacctacacctctttttcctctttatttctacatatttatcttctc

SEQ ID NO: 4874 - DNA, 274 bp, Diabrotica virgifera
ggggccagccacgcttcgggaaaaattcacttttaatttcacttgaaaataacgatgattgtaaaaactatattttatatgttatttcttatataaatcaggaatgtgtaaggaaaaaatttatgttaaaaacggagactccttttgaatttacatcaattccaggaaacctaaaagttttttcaggtctcaacgatgtcaaagaactagttaatttagatcttttaataatctgggtggatagaaaatatagtctatctgcaaaagatatttg

SEQ ID NO: 4875 - DNA, 383 bp, Diabrotica virgifera
  misc_feature (14)..(67): n is a, c, g, or t
  misc_feature (69)..(119): n is a, c, g, or t
  misc_feature (124)..(235): n is a, c, g, or t
  misc_feature (237)..(281): n is a, c, g, or t
  misc_feature (283)..(308): n is a, c, g, or t
cgacccacgcgtcnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnntgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnncnnnnnnnnnnnnnnnnnnnnnnnnnncatctagttttatctagtattactttaagtttttacaaatttttcattacaatataaatttaaattagttaaatt

SEQ ID NO: 4876 - DNA, 102 bp, Diabrotica virgifera
cggggccagcacgcgtccgaatttataagcttaggttttattcctcctattgttcttctttcaaatgttggataacatcataacttttggatttcgtcttag

SEQ ID NO: 4877 - DNA, 268 bp, Diabrotica virgifera
  misc_feature (15)..(72): n is a, c, g, or t
  misc_feature (105)..(133): n is a, c, g, or t
  misc_feature (135)..(162): n is a, c, g, or t
  misc_feature (176)..(216): n is a, c, g, or t
  misc_feature (221)..(257): n is a, c, g, or t
gttcggatttaaagnnnnnnnnnnnnnnnnnnnnnnnnnnnnnnnnnnnnnnnnnnnnnnnnnnnnnnnnnnggaaatgttatgcgtttttaaatatatcgaagnnnnnnnnnnnnnnnnnnnnnnnnnnnnngnnnnnnnnnnnnnnnnnnnnnnnnnnnnagattagtaatatnnnnnnnnnnnnnnnnnnnnnnnnnnnnnnnnnnnnnnnnnggagnnnnnnnnnnnnnnnnnnnnnnnnnnnnnnnnnnnnngagttgaaaat

SEQ ID NO: 4878 - DNA, 388 bp, Diabrotica virgifera
agaaaatggcggagatattgagcaaaaacggttctcgtttaaaatcaagatggcggctaacgcaatagcgcggttcggtcgagattttaaatttgcactactattgacccccctaaagattggaaaactaaaatttggggcagctcctaatgcaaggttaggcctgttattcgtctaacccgactgaactattattatacttaaggacgatactttcttctcaatttacttaagtttactttttctacgatctctagataacaaaaccgtctttagataacaaaaaaccgaagaaaattaatttcacagttttttgttttgttggcagaaaatacaaattatatgcaaggacgcctacaaaaaccacttaatattctgaatcagattg

SEQ ID NO: 4879 - DNA, 95 bp, Diabrotica virgifera
  misc_feature (14)..(66): n is a, c, g, or t
gtaaatttatttannnnnnnnnnnnnnnnnnnnnnnnnnnnnnnnnnnnnnnnnnnnnnnnnnnnngattattaaatgaattaataagtttgtga

SEQ ID NO: 4880 - DNA, 373 bp, Diabrotica virgifera
  misc_feature (72)..(97): n is a, c, g, or t
cgcgggggcacccacgcgtccgcataaatcgaagatgtaatatatccaatgctttatagactgggtaatgtnnnnnnnnnnnnnnnnnnnnnnnnnncaaatatatggatagtgtcttcagttattacgctcaaaatatttttaaggtatcattactttgatttagaaaattgtatcaagcaattggttatatgagtatcgaactctgttttaaatagactatattgttacgcttcatcgaaaaatcaatgtattgaactccaagagaagttacaatactttgaactcgtaacacagtgacaacttgaaacatcaaagttagaagtacaagtgagctagaaaggtcaacaccatagaggtttttatatatttt

SEQ ID NO: 4881 - DNA, 322 bp, Diabrotica virgifera
aggtaactattacatgaaatacaaaagtagtaagtaagataaacattaatagcttttttacaaatcttttcgaaaattagatttgcacctgtagttgaaattaaacttgggacaggtctgacgctctataagatgcatacttatgtatccgtttatgacaattatttgtactttaatgtcgttacttaagcactcttaagtgtatttcctttaggtgatcatgtatagtataaatttttcgtactcaagcataattgatttgtgtcacatcccctttaagacgatttgactaaaattaacaatgcctatatctttctccctt

SEQ ID NO: 4882 - DNA, 335 bp, Diabrotica virgifera
cccactcatcagttgtcatttcactgccacaatgggttttttagtgaaatcaggaaaagtctttatggaccgcgggggccgtaacactggcagaaaatcctttatcttcaaaacctacgattttagtttatgtaccttgctgtaccagggatccttaattactggttatgaaatgaacactttgaaattccacagacccatgggcttaggctttttactcgtgaggtccatatttcagccatttatcatggtatggaacgtcaaccatctcaagcccactacatattctgtagatttggcatcagacttagttattgtacccatagtcctcatta

SEQ ID NO: 4883 - DNA, 412 bp, Diabrotica virgifera
  misc_feature (69)..(91): n is a, c, g, or t
  misc_feature (344)..(364): n is a, c, g, or t
  misc_feature (366)..(396): n is a, c, g, or t
aacttcagaaaaaaaacgttaacgaaatttgatgacagcttatctttttatgtcccataaacacactgnnnnnnnnnnnnnnnnnnnnnnnctttctcctcttttaggctattgattatgtagtttagaaaggaactacaacgttaacggggttttattgtttcatatactcaatggacgtctaaatatgaaaaaacccgcggagtgctaccatttaaagctgtgcgtttttgagaagggggtgcattagtcccagggctcccgctaccatatgtgccaagtgtgcaatgcacacgggcgccttcctttaggggcgccaaaacccagggtaaaaaattgcaagnnnnnnnnnnnnnnnnnnnnncnnnnnnnnnnnnnnnnnnnnnnnnnnnnnnngttgagaaattaaata

SEQ ID NO: 4884 - DNA, 266 bp, Diabrotica virgifera
  misc_feature (25)..(59): n is a, c, g, or t
  misc_feature (68)..(88): n is a, c, g, or t
  misc_feature (91)..(103): n is a, c, g, or t
  misc_feature (117)..(151): n is a, c, g, or t
acccacgcgtccgacaataataacnnnnnnnnnnnnnnnnnnnnnnnnnnnnnnnnnnncctgatacnnnnnnnnnnnnnnnnnnnnnccnnnnnnnnnnnnnaccgactggcttcnnnnnnnnnnnnnnnnnnnnnnnnnnnnnnnnnnncatccttatatctctattattttcgaattgaaaccagctattcaattcaaatttttatcgtcacatacatattttaaatcacttctctgtaccgagatgtcatccgtctccatct

SEQ ID NO: 4885 - DNA, 87 bp, Diabrotica virgifera
  misc_feature (37)..(54): n is a, c, g, or t
acccacgcatccacccacgcgtccgacatttatttcnnnnnnnnnnnnnnnnnnctgcgcgcgctccgccatacctctcggtttttt

SEQ ID NO: 4886 - DNA, 101 bp, Diabrotica virgifera
  misc_feature (45)..(63): n is a, c, g, or t
tttttcgagcttatttttttactattttatttgccaaaatgttgnnnnnnnnnnnnnnnnnnnaagatatgttcttcatttttagatatatcttgtttttt

SEQ ID NO: 4887 - DNA, 423 bp, Diabrotica virgifera
aacgttgttgacgcttcagcagctgcaatttattgatccgataccgggaatcgtttttacgttgaattgtttgcatgcttttgatgattcttgtttgatacatttgataattttattgggaatattagtgagtttattttgtagttttttatcacattctacattttaaatgatattctattttttaaatgataccaaaatactgtgatgatatatttgcttagttatcgtgaattattatcgtctgttttttattcaaattttacaacaaaaatctattattacttatccttatctactaaattaacagtaacattgattccagacattattcttaagaaatatcatattttaccaattttttggtattaacttcgtaaatacgtcgtaatagtagttaggacacttaagatgtattttttt

SEQ ID NO: 4888 - DNA, 399 bp, Diabrotica virgifera
aaagcgatcccgcgcatgtgacagacaaagatggctagaccactcaagcctaaacacggtgtagttgaggttctcaaaacgttcaatgtcaaaactgtaatttatatgattgcagaatcttgggaacaagtgactacaatcagcttgataatgttagaaaaaaactatggaagcatgtatgtgacttgccagaaaattcaattcaaccagtggagaactgttacctggaaaatgactcgccagactaggtccagccccaagaacttttggatatgttccaaaatattgacggttgctctgaagtcgatgaaagtaacattaatctgtggttagaggcagataacggagattatgcgccacttactgacgaggcagtgatcgcattgtgtttacctgatg

SEQ ID NO: 4889 - DNA, 190 bp, Diabrotica virgifera
tcttgtttaagacctacttcatttcgtaattttccaatataacttgctaaacttccattatcagggggcctaattctagaatcgataacaaacccacgatctagccttcactcaatttgccgattggtctaatgattaatttaaagctttgttcaattctcagtttatcttcataccaaaactatccttt

SEQ ID NO: 4890 - DNA, 325 bp, Diabrotica virgifera
  misc_feature (9)..(48): n is a, c, g, or t
  misc_feature (241)..(258): n is a, c, g, or t
ctaaaaggnnnnnnnnnnnnnnnnnnnnnnnnnnnnnnnnnnnnnnnngcccaaaaggttctcagcctttcgtatcactgaatcgttatttatcaacccttccaacttgaaccctactgttcgatttcagggggggggctctttccagggcaatgactgttacaccctttgggttaaccaccataagccccttgcaaattttcccccttttcagttagggcgccttttttgaaaaggcccnnnnnnnnnnnnnnnnnncactattcgcctacccaattgtggaaacgcaccccctcttcgcctgggctttaacctccgcggggcc

SEQ ID NO: 4891 - DNA, 389 bp, Diabrotica virgifera
  misc_feature (11)..(61): n is a, c, g, or t
ccacgcgtcgnnnnnnnnnnnnnnnnnnnnnnnnnnnnnnnnnnnnnnnnnnnnnnnnnnngtacaagaaatgaaatcaattttcattattacattcttcgcttgtattggtcttgcagtagcagttgcaattccaatgaacataaagggtccagctccagatttagatgatccaaactgtgtagtctgcttttccgctggaaattttattcaaggatttaagaactcaggtgattccaaggaagaagcaaaacaacaaaggaattttatctgtaacctgtttaacactgacgagctaatgcaaatctgtatgagcacttatgaagatgacgtctaatatatttatggagtaactgacctcagaacagttactgaaatgtgcatacaca

SEQ ID NO: 4892 - DNA, 311 bp, Diabrotica virgifera
  misc_feature (280)..(300): n is a, c, g, or t
gattgcaggtgcaggtcacttttatcttttcttttcctagaacatcagtgatataattgcaacatgcgcaacaaggccggaaaagtgaaagaaacctccaaagagaagaaacagaggaaaaaggattttcaagaaacccaaaaacaagtaaaaaccattgtattaccaggactgatagttattgctatattcattatcatttatgtttatatgaaaacaagaccaaaaaatggttacattgattgatacagaaaatcaataaaacatgtaaatattacgnnnnnnnnnnnnnnnnnnnnngtttataacat

SEQ ID NO: 4893 - DNA, 363 bp, Diabrotica virgifera
ggtcagatatccgggtcgaccacgcgtcaggaaatcccagtctaacattgtgcccgttcagtcagatatacgcatatccatcagatcagatttgtttgttacagtatccttcatgatcatgagctcccattactaatctggggtttttctcagatgtgttttgaatatgctttattactgcatcactcacgaactttttcctgaaatttgggagcccattagattacatatgattacgagatttaaacgtcccttgaacgtgttacttaaaatcatgtactggatctagtcacctagcagatttagtaaaatgcatcatcgaagtcgaaaccagatatgtacttacagttatagctgaatgca

SEQ ID NO: 4894 - DNA, 391 bp, Diabrotica virgifera
atgatattctttgcaaatcatctaagccaactgcaaaaccaactgcatcgtcggcatacataatgttgtttagacgcactcgattgactactccttcctgtagttcttccagtgcttgctggaagatatgttcacagtacatattaaataccaccggggacagaatgcatccttgtctcactcgtataaccactttatgcatctgctattaagcacatctataatagttgattgtaatacattcgttttggtcatttaactcctcttgtatgaatgaattcacagcatgtcctcacacaaaagacaaaaattgccaaagaacacaaattcaaacacaaaatagctaaaaagtacaaattataaagaattcgttaagctttcactgggaatg

SEQ ID NO: 4895 - DNA, 427 bp, Diabrotica virgifera
cccacgcgtccgcaaatagaatgatgggaagcgcagattaaagattagaaaccaccattgtacagtgtactatgagagttgggataaattgagggtagttaagaagaacaaacaattgaccattagcgatgagttggctgattataatctaccaacactaaaaaggactaaattagatgcgcagaaatctgaaggacctgttgagctgttccctagcgactctgaagaagattacgatgatgaatgtggtaaacgaaagcgaggtaaaagaggaggaaagaagattaaataggcagctccatctggtcctgtcgagccggatgatgatggagaataggatatagtggaagatattgaagtacacgattggtgattgatttaactgcataaattttggaattgttgaaatgattaaaggtaatccttt

SEQ ID NO: 4896 - DNA, 371 bp, Diabrotica virgifera
  misc_feature (55)..(69): n is a, c, g, or t
  misc_feature (72)..(84): n is a, c, g, or t
  misc_feature (149)..(181): n is a, c, g, or t
  misc_feature (325)..(365): n is a, c, g, or t
tcgacgacgcgtccatgctctattaaataatatgtaactatttgctctatatttnnnnnnnnnnnnnnnccnnnnnnnnnnnnngcagtaagaattaccctaggtactgtaaaaacatggtctgcacatatttagtaaaattcgggagnnnnnnnnnnnnnnnnnnnnnnnnnnnnnnnnnaagagaccttatataatcttgttaatactcaattttagacttgttaaattgtttaaagatagacaatcagaatcagaaatattcaagagtgtaaatagtgtacagaaaagatctacagcaccaaaaggggtattatcatatccnnnnnnnnnnnnnnnnnnnnnnnnnnnnnnnnnnnnnnnnngacact

SEQ ID NO: 4897 - DNA, 136 bp, Diabrotica virgifera
ccttcaggctaattgtagcacttccccgtatttgcctaatttccacctattcggtttgtggttatctaacattaggaaaaaacactggaattgtaattttgtggcttctgaaggcggggctacaggtgaaacattc

SEQ ID NO: 4898 - DNA, 105 bp, Diabrotica virgifera
acgtccatctcagatttagtctgttctactttcaaatttttacatcatgtgacgttaaaccggtgtgagccaagttagttcctaccttgaaacaagaattaaatt

SEQ ID NO: 4899 - DNA, 348 bp, Diabrotica virgifera
  misc_feature (323)..(341): n is a, c, g, or t
aaaaaacaagaactaaagatttaagttcgacttttccatacgcttcgatagatatgtcacatgtactatttttgcaactatcatatggcacttccggtcagaactttttaggtggaaacgatattaaaaccaaaattaggtatacatatttgttctcatcttgctaaggcttaactgaaactaaggcaatactttgaatttcattcgacacctcgaggagttgtgtttacggacgggcggacaaactgacgtggataattcaacgttttcacatttttccaaaattgggtgaaaacaaaaattcgtatattaccttctgatgnnnnnnnnnnnnnnnnnnnaccctag

SEQ ID NO: 4900 - DNA, 71 bp, Diabrotica virgifera
acgacgcgtcgagttaaatattaatatagaaacaacctggctcaaagcggtttaaacacatatcatattaa

SEQ ID NO: 4901 - DNA, 316 bp, Diabrotica virgifera
  misc_feature (189)..(201): n is a, c, g, or t
  misc_feature (203)..(225): n is a, c, g, or t
aaaattttatatgatgaaccaacctgtattctatattgtctaatattttgttcagttttggatgttaacatgtgtgatatgatgttgcacttttttgtaaatgttttgcagttttcttttaagtgcattttttgtattgtaagcttacgagtttattaatcagttccacgttgaactcttctttgtacnnnnnnnnnnnnngnnnnnnnnnnnnnnnnnnnnnnntagatatagtttttattgaggcaactaccaaattgaatgtatttcactttccaaaaatatatagccgtttaatttaaaaaaaacaccacgc

SEQ ID NO: 4902 - DNA, 411 bp, Diabrotica virgifera
acgcgtcagcccaagcgtccggccgtatctctgactgacttctgtgattctgttcattaactcttggagggcttcagaactgtcagcgaataccactgtgtcgtctgcgtatcggatgttattaaactatttatatggaaatagcatccacatcactttaatgtaaaccttttctgcacaaccaatttgttaatttaaagttaaatgaatcgtccagttttataaccagactcaggagctgacttagaagaccgcaattgaatacttatttttttaaaactgatcagcataacagtgttaagatttttttatacaaataattgttacttcaattcagctcctgatttggtaaataacctgagacagcctatcaactagtttaacttgaaatgctgtttgacctttatgttc

SEQ ID NO: 4903 - DNA, 341 bp, Diabrotica virgifera
  misc_feature (8)..(30): n is a, c, g, or t
  misc_feature (33)..(45): n is a, c, g, or t
  misc_feature (64)..(88): n is a, c, g, or t
  misc_feature (149)..(170): n is a, c, g, or t
  misc_feature (177)..(196): n is a, c, g, or t
  misc_feature (198)..(210): n is a, c, g, or t
  misc_feature (234)..(246): n is a, c, g, or t
  misc_feature (248)..(260): n is a, c, g, or t
acccttcnnnnnnnnnnnnnnnnnnnnnnnccnnnnnnnnnnnnnctaacaattaggattaacnnnnnnnnnnnnnnnnnnnnnnnnnctatttacttctatatattacgacttttacgggttacaacttttttatcaaaatataaacnnnnnnnnnnnnnnnnnnnnnncatgacnnnnnnnnnnnnnnnnnnnncnnnnnnnnnnnnnccaaacatataggtttactacccnnnnnnnnnnnnnannnnnnnnnnnnngtattaaaaacacgtccttttgttgtaactacaaagtcccgcccgcccactgattcatttgaatggcccccgtattttgac

SEQ ID NO: 4904 - DNA, 85 bp, Diabrotica virgifera
gtccaaaatttatttatactacacatttaattacttggggtgattaataaacaaatttaactgttttattacacttttactatca

SEQ ID NO: 4905 - DNA, 177 bp, Diabrotica virgifera
  misc_feature (60)..(87): n is a, c, g, or t
cgtcggttggatcagcgccgatctgtcggtatcttagtttacgatgacacttacttttcnnnnnnnnnnnnnnnnnnnnnnnnnnnntacagaacaccctggggagttttatacaattattaatcaatttttttactaacaactttattgatagaccacagttagttacgtggggtg

SEQ ID NO: 4906 - DNA, 336 bp, Diabrotica virgifera
  misc_feature (19)..(19): n is a, c, g, or t
  misc_feature (25)..(25): n is a, c, g, or t
  misc_feature (73)..(95): n is a, c, g, or t
ttttattgttttctgacancagtanaacgtattttgaaatagataaattacatagattcttcgttttgtctcnnnnnnnnnnnnnnnnnnnnnnngtttaacaccctggacgccgtcactagtatggcgtatatgccaagaattcgtaatttaaaaatacaaatcgacctgtttcgggaatttctaataatgctgtttatttggctgataatgaattgatgcgttgctttgtggacgcactgtatattaaagatatagcggaaaaccgtattacaattatatttatacaagtatggtcattaacatgattaagtctaatggctggtttccaaaata

SEQ ID NO: 4907 - DNA, 363 bp, Diabrotica virgifera
agccattctccattactaatttgcagttggataacctggatcattagctattgcactaccctgatgggattcaataacgataacgggttcgaatattcgaaggatgaagagcctactgcattcttgcaagttaagcacaggcaagcagctcctggcctttcacctgctgttgaggtccccctcttcaagatcaatcaggtctatcacttcctgatattcacaaagtcaaatcaccgcgctaccatatccatactcacgtatccctacaactaccatatcacgtgcacttctgccatcaagaggttggttgaattcaccgactgtccccacctatgtaatcccggattacacccatttgtgaaa

SEQ ID NO: 4908 - DNA, 192 bp, Diabrotica virgifera
ccacgcgtacggaatccacccacgcgttcgatgaacacaatcagtgtcttcatctcttttatctggaatttaaggtttacgtcaaacaccccaacttttttcacgttccaacatcactctatgggggggtaaacacttacaaacctcctttttatggggacacaaccactttcactttcatctcattcctcc

SEQ ID NO: 4909 - DNA, 415 bp, Diabrotica virgifera
  misc_feature (46)..(63): n is a, c, g, or t
acgcgtccgcaaatattagctgagtcaggccaaatagctgagatgnnnnnnnnnnnnnnnnnngttaggaataaacataagcaaaactctcacatgtggattgaggttgccaaaatttattatatgttggataaattcaaagaagctaggaatttaaaggatgctgccttaaaatctataacgataaagaaaatgcaattggatataatcgttcagtttgctcttatggaattcaattatggagaaccacattatggttcacatatatttgaagcaattctaagttcggatccaaaaaaagtgacgatttggacgatgtacgttgaccaattagttaaaaaagggaagatcgatgaagctaggcaagttttggatcgctcagtttctcaacatttgcccgtgaagagtttgaaat

SEQ ID NO: 4910 - DNA, 395 bp, Diabrotica virgifera
  misc_feature (313)..(344): n is a, c, g, or t
cacgcgtccgtatcttatattatgttggcgtttgggtatagttcttcgagctctttgttagttattatcctatattgtcctgctgcttcatcaagcatggtcccaaatatcttccttgggatttttctttcccaacaaaacaaggctacaatttcaattaaaaactagcatggacttatctcacctaataaaatgacaaatattaataggaatttccacatagtttctgacgtactatggtttatagtgcataaagtagccggttccacaaagccatgttaactcactttactgaaccgataaagttaatacnnnnnnnnnnnnnnnnnnnnnnnnnnnnnnnngggccttatcaggtgtcaatttcgaaaaaaaaaactatgtattgtgtgaca

SEQ ID NO: 4911 - DNA, 178 bp, Diabrotica virgifera
  misc_feature (49)..(122): n is a, c, g, or t
ttgtcgaagggaactgatgttttatattatacattttatatattacttnnnnnnnnnnnnnnnnnnnnnnnnnnnnnnnnnnnnnnnnnnnnnnnnnnnnnnnnnnnnnnnnnnnnnnnnnnaggaaggagcttcaagggcccgaagtgaaaatttaccaagtacaatgtcccaggga

SEQ ID NO: 4912 - DNA, 443 bp, Diabrotica virgifera
  misc_feature (210)..(286): n is a, c, g, or t
ggggtccactacgaagcgctgatgcccagacagtgtaagatttattggtcgtcagctctaccccaaatgggaccaaattaaggactatatcgacgagttggaatttgtaccctttggcaaagccatatacgtgcaccacgatgctgatattgtaaagcaaacacctgagcgttactcattcagttgccaacatggtcgtagagaatgccnnnnnnnnnnnnnnnnnnnnnnnnnnnnnnnnnnnnnnnnnnnnnnnnnnnnnnnnnnnnnnnnnnnnnnnnnnnnnatgaaaagtatagatccttcttctttcgatactgttgaagaatgtgctaggagatttggattagatattccgaagctgaaatcctgttccgacagcatagaaggagacaaacttctagctaccaaaggagaccgcacgtttcagctggatccaaata

SEQ ID NO: 4913 - DNA, 413 bp, Diabrotica virgifera
  misc_feature (157)..(195): n is a, c, g, or t
ggggccacccacgcgtacgacaaaacagaacagtattaaactgcaacctatgaaaggagtctacaatatgtgagaccaagtccagtatgccaagtactgtggatttgtcctttctaaaaccgaactgagagtctgagaaatagttattatttttggnnnnnnnnnnnnnnnnnnnnnnnnnnnnnnnnnnnnnnnggaatctatctggttaaactgttccatgttttgcaaaatgtcagttttatagtagagtagatttgttaaagttgagatttattttggcaaaaaccatgttgttggtcggatattaaacctttgcatagccaactcaactgcctgctgacttgggaatcaaacagtttcggtattgaagaatgtatacaaacactacaatacttttctacttgattttt

SEQ ID NO: 4914 - DNA, 387 bp, Diabrotica virgifera
  misc_feature (59)..(76): n is a, c, g, or t
gaacgaaagtaacaaaatggtttagtactctaaaaattttgtatctttggatgactggnnnnnnnnnnnnnnnnnnctgggtcaaagagcatgacgtcaataaatttgtaacgtaaatatactgtagaactgtgaaatcgttcaatattacaagaaattagataaatattgatacaaaaatgtacttggcacaaatgtacaaaggtttacttggcagtaaattactcatggtaactctggttaaaacagttcccatcatttgtaacgggtagctttgttagataccaaactcaaatagcattataaaattgaatcatggagaatgcatctatcgagaacgctaagattcactgctgattcgaacaaaagatatggttaattgacacg

SEQ ID NO: 4915 - DNA, 341 bp, Diabrotica virgifera
  misc_feature (108)..(126): n is a, c, g, or t
aaataaattttaaatgtaacaatttctacatttacctaaattgtacataacaaaattttgtgaataaaatgattctcgttatttcgataatgaactgtgaatataatnnnnnnnnnnnnnnnnnnncaatgaatattggatatgaacatgtgagcacgttgtataataacttccagttgatgtcaagattgaccaacatatcagaaattaatttgtcacagtgattagagaatctttcattttattcttttttaaatatccactagatgcctttatctatacaaaatataagttgatataagacatcgagtaatatgacgaaaattatgccgtgcattttg

SEQ ID NO: 4916 - DNA, 339 bp, Diabrotica virgifera
  misc_feature (161)..(191): n is a, c, g, or t
  misc_feature (200)..(264): n is a, c, g, or t
  misc_feature (272)..(337): n is a, c, g, or t
ccacgcgtacgcagacgcgtgggaattaactctacagctacttaaccatttgcgaatgcataaccacaaactgatctaaaatgtaatgaatcttttttcaaaccgttcaccgagtcacgtaaatattaatatgtacataattaatacgtacgaaaaactgnnnnnnnnnnnnnnnnnnnnnnnnnnnnnnnttctcttgnnnnnnnnnnnnnnnnnnnnnnnnnnnnnnnnnnnnnnnnnnnnnnnnnnnnnnnnnnnnnnnnnaatagatnnnnnnnnnnnnnnnnnnnnnnnnnnnnnnnnnnnnnnnnnnnnnnnnnnnnnnnnnnnnnnnnnnaa

SEQ ID NO: 4917 - DNA, 181 bp, Diabrotica virgifera
  misc_feature (37)..(49): n is a, c, g, or t
  misc_feature (51)..(69): n is a, c, g, or t
  misc_feature (71)..(98): n is a, c, g, or t
  misc_feature (133)..(150): n is a, c, g, or t
agagtttaaaatatgttaatatttatgtttatatagnnnnnnnnnnnnngnnnnnnnnnnnnnnnnnnncnnnnnnnnnnnnnnnnnnnnnnnnnnnnatgtgatgatgtattaagtataaagtcattgtagnnnnnnnnnnnnnnnnnnggtttaccaaatgaattcagtatcatttttt

SEQ ID NO: 4918 - DNA, 288 bp, Diabrotica virgifera
  misc_feature (47)..(70): n is a, c, g, or t
  misc_feature (72)..(85): n is a, c, g, or t
acgcatccggagcttcttttgttgttatctcatttatatttaacgtnnnnnnnnnnnnnnnnnnnnnnnngnnnnnnnnnnnnnnatcattttcatatatggtaagtttgattttttcatcgactttttagtaatctatcttttgaggctagttccatttagtaatgaggatgatatgagtactaacaatgtgtcagagtatgcgtatcagcaacgggtattaatggaagtcggcaacatgtgtgtcaccggtttattaaaatcatgtccttttgtattaaatcttga

SEQ ID NO: 4919 - DNA, 416 bp, Diabrotica virgifera
ttccgggtgcccccacgcgtcagcatccacgtaagtaagattagaaacctacccagcagcctcagccagctgttgatccatccaaacgtgcgcctgactgggaattgcatcaaacgatacgttcgaaaactagcacgagatttcgcaggtttcgatggcgataacatggttgataattgtgttgatttgggacttttcgccaacagggttctttctatacgtgacacgtggagcttggagcgactggtggagcattttctagacttacaactaagcatagacatgaacgtgaggcatagtcggtggcatataattcctctgtcgaaagaacagcaactatatgctgcaaccgattcatatgcaagtcttttactctataatgttttgaaaagtcgtgaaaatgagttaaaggcttt

SEQ ID NO: 4920 - DNA, 282 bp, Diabrotica virgifera
  misc_feature (163)..(243): n is a, c, g, or t
catagtcacaaatttacactctcttccattcaattaggacagtagctagaattcctttaatagttatcaatctactagttattgtgttgaagctaatactcggatgatatatttaattttaatgttaggaattagaatttgtgaatcctttatgtatttgtannnnnnnnnnnnnnnnnnnnnnnnnnnnnnnnnnnnnnnnnnnnnnnnnnnnnnnnnnnnnnnnnnnnnnnnnnnnnnnnngtagtaaaaaaaagggcggaggttcaaaaggaataaagg

SEQ ID NO: 4921 - DNA, 389 bp, Diabrotica virgifera
  misc_feature (71)..(196): n is a, c, g, or t
  misc_feature (205)..(242): n is a, c, g, or t
attcgcgcgtccacccacgcgtacgagatgtatcacttttaaatgtttatttagaacagtttaaataaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgtgcatnnnnnnnnnnnnnnnnnnnnnnnnnnnnnnnnnnnnnntgggggtccatcttttataaccgccgggcggggaataaacctccctctaagggcccccgtagttttaaccccagggccgcgttttaaaaactggcctcctgggaaaaaccggggttaaaagggcgacgccccctgggtgcaaagccc

SEQ ID NO: 4922 - DNA, 174 bp, Diabrotica virgifera
actatggcttaattgactgttacatatcttttgacaacagcttcttgttcaaacagatgatcaaaatttattttacaaggttccagtctacaaattcatggaagatgtaagactttcaaatccaaaggaaatagatttacaagatcattggattattcaaatttcacttgtcgt

SEQ ID NO: 4923 - DNA, 544 bp, Diabrotica virgifera
  misc_feature (33)..(33): n is a, c, g, or t
  misc_feature (41)..(86): n is a, c, g, or t
  misc_feature (110)..(127): n is a, c, g, or t
  misc_feature (237)..(238): n is a, c, g, or t
  misc_feature (254)..(255): n is a, c, g, or t
  misc_feature (261)..(262): n is a, c, g, or t
  misc_feature (285)..(286): n is a, c, g, or t
  misc_feature (333)..(334): n is a, c, g, or t
  misc_feature (380)..(380): n is a, c, g, or t
  misc_feature (382)..(383): n is a, c, g, or t
  misc_feature (399)..(400): n is a, c, g, or t
  misc_feature (409)..(411): n is a, c, g, or t
  misc_feature (424)..(425): n is a, c, g, or t
  misc_feature (438)..(438): n is a, c, g, or t
  misc_feature (440)..(441): n is a, c, g, or t
  misc_feature (448)..(449): n is a, c, g, or t
  misc_feature (466)..(512): n is a, c, g, or t
  misc_feature (514)..(536): n is a, c, g, or t
cgcgtgcggttaaaagattttcagtattttaanaatatggnnnnnnnnnnnnnnnnnnnnnnnnnnnnnnnnnnnnnnnnnnnnnngaattttttaattcaaaatatagnnnnnnnnnnnnnnnnnngatttaaagtaatggatgactaatattaagtaattacacaaaattgggtatatttacgtaagaaactataataaggggtttcaataaaggggaattccgggcaacaattnntttttcaaccctggtnnttattnnaaaaacaatggtccctttttggnntattaaataaaataaagttctccgccctgggcccactgggattaatnnttgaatggggccgcgggggtattttgggaccgtttgctaagggtangnncataatcaattaagtnnttttttatnnntgaaagcctggannatgaaggggttgngnnatgaaannaaaaaaactggtccttnnnnnnnnnnnnnnnnnnnnnnnnnnnnnnnnnnnnnnnnnnnnnnncnnnnnnnnnnnnnnnnnnnnnnnagaagacc

SEQ ID NO: 4924 - DNA, 370 bp, Diabrotica virgifera
aggaaataagaatggtctgttagtcccaagttccacattcgatacagaacttcagcacatcagaaatgctctaccagatacagtaaaagtacacagagtagaagaaaggttgtctgctcttggaaatgtgatagcttgtaatgattatgtagctctggttcatccagatttagacagagaaacagaagaacttatagctgatacattaaaagttgaagtattcagacagaccattgccagtaatgtattagtgggatcatattgtgtcctcagtaaccaaggaggtctgttgcatcctaatacaaccatagttgatcaggaagaattgtcatcattgttgcaagtacctctcgttgctggaactgtaaat

SEQ ID NO: 4925 - DNA, 220 bp, Diabrotica virgifera
atgagtttaaggtaacgtgtaaatagatttgtaatctactacgttgctggtagatggatctctattcgaaattgggattacattacgaattacctgaatattttattttggtatagatattatatctcaaggtagataactacaaatttgctggggtgcataaattagaagatccggattgggaattgttgctccttttttttgggtgccttagaaaaga

SEQ ID NO: 4926 - DNA, 400 bp, Diabrotica virgifera
  misc_feature (318)..(343): n is a, c, g, or t
acgaaaagcgcatatcggcatagggtagactttgaattaggagataagtagaactattttcaaaatttcattaaaatccatgcagtaggatagaatttggaggtaatagcctgaccttgctctcattgactggtgtaaataatagcatactattctttttaattctttattataatttattgttctatttcttgtaaatgattttaaatagtttatattgtaaagaaatttttgtaactctgtaagtgtaaataatctttgtaatctttgtaaagacataataaataaatacagatcataatattctttattaattcnnnnnnnnnnnnnnnnnnnnnnnnnnttgtaaatgattttaagtagtctatattgtaaggaaatttttgtaatctttgtaaag

SEQ ID NO: 4927 - DNA, 287 bp, Diabrotica virgifera
  misc_feature (96)..(245): n is a, c, g, or t
  misc_feature (247)..(269): n is a, c, g, or t
agatatttttattttggaaaaccacgaatttaaggaacattttttgtacgtatgcttctaaaatattatatagtacgattattttgaaacatgtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnntggggtttcacaccatag

SEQ ID NO: 4928 - DNA, 405 bp, Diabrotica virgifera
agagttggtgcaactggatattaatattgaattgattaaaacaatttacaacacgcagtattcaggttaacaactgaactctaaagcccgtacaatttgacttatatactacgagcctatgttctccactattctagaccgggcctggaacaaaaagaataataccgaatgaatagaactaaatgtatctagacattctggcgccggcgaataaaaggagtgaaaggggtcgaaacttgttctcggctcgttcgacaccttgaagattcggtagtcggtggacgggtcaggaccggcctacgtaatattgggaactgtaacaatattaatatctaactttggtttgcaggtgcagaagctcctcgtgctgctggacttggagcagactgcgaatgtaacgcatgc

SEQ ID NO: 4929 - DNA, 405 bp, Diabrotica virgifera
  misc_feature (323)..(349): n is a, c, g, or t
agatcacaccttcctgctcatggaggtgaaacctacatacacctagcggactaccacttgcctcatgcaatatatctggagtgaacagggttgatgacaacgcataatcaggttgtgagggtgacggcactgcttacatgtgcaacagtcaccatccatgggcactacctatcactttggcatatggttttggtgccgcgtctttcaataacggaattgatgtatccctaagttgcacttgttacttacataccttcagtgatcacatttcaaacacgacaattattgtacaaattaccaatactggttctgatttgactcannnnnnnnnnnnnnnnnnnnnnnnnnnatgtggtgttggcattttcacacaaggttgtcatgaccactggcatgccccatgga

SEQ ID NO: 4930 - DNA, 422 bp, Diabrotica virgifera
  misc_feature (401)..(401): n is a, c, g, or t
aatgtttcataaaatgtataaacattttgtgatcttcaagccaatctttcgagaaaaaatggcttgaagatcacaaaatgtttcataaaatgtataaacagttcgaaccgaagggttgcaaggtttgctctcgcgaatttacaactaccaagcaattgctcgtccacatacaagaaagccatagcgacaactctctcattccattcaaaaaatataaatgtacgacgtgtaatttgactttaccttataaaaaaaatctggatcaacacatggaacatatgcattccagcgaggagaaaaagtctttcctttgcactgactgtggacattcatttgcttctatatcacggttaacggatcatatgaaaatccattaaagaaggacagtatgtaagttcctntttgcgacaaaaaatttaaaa

SEQ ID NO: 4931 - DNA, 177 bp, Diabrotica virgifera
aggacgcgtgggcaaaaatttacaaagccgtcacgcagaggtggttatttttattttggatgtaattttacattatatttttattcatgtgatattcagtatcccatgtgagactgaatgatatttttattgtatataattttataacattggttacaataaatacggtgtttatat

SEQ ID NO: 4932 - DNA, 210 bp, Diabrotica virgifera
  misc_feature (94)..(114): n is a, c, g, or t
agccattattaatttttacctgatgtaaaaatagttaacatggtttatgtgtgctgaaatgttagccgtttttcaagagagccaggtttttacnnnnnnnnnnnnnnnnnnnnnccaacaatatctgtagcataacaaatttctatataaataatggtcaatatttatagggatgaactgaatgtggaaagtttagcagaatttaatttt

SEQ ID NO: 4933 - DNA, 304 bp, Diabrotica virgifera
aacacgatcaatccaattaggatgtttaactggaagattaatctcgcgattcctcaatactatccgaaatatttatctgtctaccattttgtacaataaaggaggagggaagacatccatgagtgacggccattgcatacgatttgcatatcctaatcatcgaatgtcataggacgtatttgggtcagaatgtcagtcaacgagaaaaaggctttgttgcacgtcagtgtacacctttgaaactcaagtttttgaagcttccacaacaccctttggtgcggaataccccgtgttccggtttgtg

SEQ ID NO: 4934 - DNA, 348 bp, Diabrotica virgifera
  misc_feature (41)..(70): n is a, c, g, or t
  misc_feature (154)..(325): n is a, c, g, or t
gataaacacctatttaacgaaaaatcaataaaacaactatnnnnnnnnnnnnnnnnnnnnnnnnnnnnnntaaaggttccaaccttaattacccgttaatgcaacttcaaacccctccaaaattgcccccaaatttaaatccattggcctcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccgcggttttgtggtttaccc

SEQ ID NO: 4935 - DNA, 193 bp, Diabrotica virgifera
cacgcgtcaagtagagttgtgttgctaatttcgttggacatgctgacatgggtgattggttcgaccatgcaagatagccaattttactggcacatcatggccgttgtgtttttaccataattggagttggcgctgttggtgttacaggatctcttggcagatatactattacattggcgtgcttcgaccatgt

SEQ ID NO: 4936 - DNA, 466 bp, Diabrotica virgifera
  misc_feature (11)..(29): n is a, c, g, or t
  misc_feature (36)..(70): n is a, c, g, or t
ttcgcgcgggnnnnnnnnnnnnnnnnnnnattgttnnnnnnnnnnnnnnnnnnnnnnnnnnnnnnnnnnnaagcttgtcaacaactagtataagatatggtaaaagaaattttaggaagttccccatatataataaaagaggaactaggatattcaaacaacaacaaatgcagaatccggacccagaagttcctgttcacaaaagaggcgtgcgggaggttggttatgaggaaagagacaaatttattacaattccagaaagaataccagaattaatagtcccagatttgaggaactgtcagttgaaaccatatgtctcctaacagaccccaagaagtctttcaatcggaattcacaagctgaggacttacttaatgtagtatatgctccaaaaatagtcaaagatttcaatgaggggaagcttgcagatgatggccagcctttagaaccttcaagggaagaaaaa

SEQ ID NO: 4937 - DNA, 368 bp, Diabrotica virgifera
  misc_feature (15)..(108): n is a, c, g, or t
  misc_feature (110)..(130): n is a, c, g, or t
  misc_feature (277)..(295): n is a, c, g, or t
ccacgcgtcagaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnntgaagtgtgaataggatgaaattggacaaattgtagtggaggtgaattaagaaaatgctggggggggcgctttttggggggttcagtctgtttttggtgtgttggggatgtttagttttttttcggggggtcactcattttgttttnnnnnnnnnnnnnnnnnnngtggtgatgggggaaaactgtgtggtttgcctatcacattcggtggggacaattttctttttctgtagtgggg

SEQ ID NO: 4938 - DNA, 262 bp, Diabrotica virgifera
ccacgcgtcagctattttggttactaagttctttaacgatctcaatttggcgcttgggataggtggtaccttttggttgttcgcctgcttttgtattgctgccttagtgttcgttattttctttgttcctgagactaagggtaaaagttttcaagaaattcaaatttttttggataggtgatattagttgctagataaacagtacttataccttttttattaatgttttatattcaaattttaataaagttgttgtacctgg

SEQ ID NO: 4939 - DNA, 420 bp, Diabrotica virgifera
  misc_feature (129)..(146): n is a, c, g, or t
gcgtccgaaaaaaatcattttcatcagatattaaatacgttgatatacctatacctgctggatgtgaggaagtgtttgtaagattttcaaattcggagtgtgctaaagaattttgtaataaagaatatnnnnnnnnnnnnnnnnnnctggaaggagatgaagaacaaatgtattgggaaaagatacagaatgaccgaagcataaagttttcaaaaaatgttaaaaaacaaagaggaagagacaagttactgaagaaagcagagaaggaaagagcgaagcatattaaatttgatgaaggggaatgatgatttggcaatttttttgcatttctatagatgtaacagataaaagattcaatagatgtaaaaaatatttaacttgtttactctaatggtaattaataaatcaagatttacctgt

SEQ ID NO: 4940 - DNA, 400 bp, Diabrotica virgifera
ccacgcgtcagcgaacgcgtgggggctaggagtgcattcaataacatggccaaactctttaaaagccacaaccttaatctgaagataaaaataaggctcctacgatgttatatcttcttaatattgtattacggagttgaatcctggacactcactgaagcaatggagaaaaaacttggaagtcttcgagatgtggctatacaggcgaatcctaaggatatcatggacggacaagataaccaacgagaccgtattacgaagaattgggaaagaaagagaggtgatgtataccattaaaaggagaacattagaatatctcggacacacagaataagaaactgcactaaatacagattactgaaggtaatccttcaagataaagtattcggaaagcaaggaa

SEQ ID NO: 4941 - DNA, 455 bp, Diabrotica virgifera
ccacgcgtcagatattgcaaaatctattgaaccgattttaatgaaatttacagtgttgttttgccatataaagtttttctgtgttaaatatgaaggtcgtaggtgtaggataaatggttgaaaaacgtaaaatgcgaatacttgttttttgtggtttttttcgaaattattgctattttgcaacaagtgtgacaatttttggaattttcagttaatcgtatattgtaggaaatttaattacgcggcttttatgtcggtgcaacttttctcgaaaatgaatacttttaaggttataatcggaaaaccaagaaaaaaatcgaatttttccttcatttcttgagattttgattatttaaacaatgttccggacgtttttgagtgggaggataactcaaatattattatatgagttgttttcgggcaatttctgcaaaaaaatatgagtcacctctcaa

SEQ ID NO: 4942 - DNA, 215 bp, Diabrotica virgifera
  misc_feature (143)..(162): n is a, c, g, or t
  misc_feature (192)..(211): n is a, c, g, or t
ccacgcgtcaaccaacgcgtccgattaaaagatctaacctaaaatgtactggaacatagaactaatagaataatttctaaataagtagcggactatattttcatacatataaatagtgattctttatttgcacataatattannnnnnnnnnnnnnnnnnnnctttttatatccttaaataaattggaatgnnnnnnnnnnnnnnnnnnnncaat

SEQ ID NO: 4943 - DNA, 255 bp, Diabrotica virgifera
  misc_feature (14)..(66): n is a, c, g, or t
  misc_feature (68)..(170): n is a, c, g, or t
  misc_feature (172)..(187): n is a, c, g, or t
  misc_feature (193)..(205): n is a, c, g, or t
  misc_feature (207)..(219): n is a, c, g, or t
acgtacgcatccgnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnngatgannnnnnnnnnnnngnnnnnnnnnnnnngtagaataaatgtatacgttaacaatttgaactcgg

SEQ ID NO: 4944 - DNA, 360 bp, Diabrotica virgifera
  misc_feature (148)..(166): n is a, c, g, or t
  misc_feature (243)..(277): n is a, c, g, or t
  misc_feature (279)..(296): n is a, c, g, or t
  misc_feature (321)..(344): n is a, c, g, or t
aaattccggttttaactaatttatatgtgttgaaatgttattccattttaaatcaatctaagtttttatcagttaaattagatttatattatgtacatacatatggtataatttagatagtgtccataattatccaactattgagtcnnnnnnnnnnnnnnnnnnngcaatacaattttattagaatttgatttttaagtctcgattacgattaaaacttttcatagtttaaaaggtgttacnnnnnnnnnnnnnnnnnnnnnnnnnnnnnnnnnnncnnnnnnnnnnnnnnnnnngcaatttaaattacttcaatttacnnnnnnnnnnnnnnnnnnnnnnnncaaattgtatgcttag

SEQ ID NO: 4945 - DNA, 287 bp, Diabrotica virgifera
  misc_feature (246)..(261): n is a, c, g, or t
cgtccgggcagaaacagaagctggatatccacctttcaacacattacagccatctcattaggaatgaaacccgatttgatgtgggtagtaccgaatacattataggtgagtttctggcatttgctgatctgtacaattgtcctggcatactaatatcctcttttgaagtgactgccttgctacacggctactttggcaacccagcagatccagttgctcatcgagatatgtttttaccatttgttnnnnnnnnnnnnnnnnttagcgacggaagaggtagcttcatc

SEQ ID NO: 4946 - DNA, 422 bp, Diabrotica virgifera
  misc_feature (17)..(17): n is a, c, g, or t
  misc_feature (23)..(23): n is a, c, g, or t
  misc_feature (236)..(236): n is a, c, g, or t
cgtccgaattaatttancatcanattttaaaaaatacatgtttaaaaattaactaaaaaagaaactacatatatctcaaaattatacaaggaattcaataatgttttctcaaaataaataaacaaattctagtgggaatatagaataaaaaaagaaaagacagatttactatattaatttcaaaacatatatagtgaaaattacaataataaactaccagtagacaagtagataanaatagacaataacaaagcactgaaatcaggctaaatagcatctaacatagcaatacaaacagttcaatagcaattaaagttacaagggctcgataaaacaaccaagataagatattacaagaaaaactaaatgtcaattgcacaaaaccttaatacatccagtatttacatatgaatctgaaatct

SEQ ID NO: 4947 - DNA, 272 bp, Diabrotica virgifera
  misc_feature (178)..(206): n is a, c, g, or t
  misc_feature (209)..(231): n is a, c, g, or t
acgcgtccgtattaattgtgtgtgtattggttataatgcctttttaaccttaatttgaacttaaataataaggtaaaatcaaaatccgtaaagggccaataaaattggatttttggggttaaatcaaccctttaatggatccagtaaattaattaacaagagaacaaatttacccttnnnnnnnnnnnnnnnnnnnnnnnnnnnnnccnnnnnnnnnnnnnnnnnnnnnnncttaattttatgaaattgtatacctttgaatactataagat

SEQ ID NO: 4948 - DNA, 408 bp, Diabrotica virgifera
  misc_feature (57)..(87): n is a, c, g, or t
  misc_feature (291)..(318): n is a, c, g, or t
  misc_feature (380)..(404): n is a, c, g, or t
ggggccagccacgcgtccgcagacacgtgggatatttccaatcaacaagtaggtacnnnnnnnnnnnnnnnnnnnnnnnnnnnnnnncatttaatcaaaatcttgaataaagtgtatatttttgacacacccgcataaaattaaaaaattagttcaatagttaaattttaggtttcagaccatgcaaaactttcgatgaggtatcattcctcacataataaagaaattttctctatagttccaactctttgagacatgccgtatatatttgctttattaaatgaaaaccannnnnnnnnnnnnnnnnnnnnnnnnnnntgggtcatgattttgtacatattttggatataatattgtatatgttatgtagattttgtacnnnnnnnnnnnnnnnnnnnnnnnnntttt

SEQ ID NO: 4949 - DNA, 345 bp, Diabrotica virgifera
  misc_feature (292)..(309): n is a, c, g, or t
ccacgcgtacggaacccggtacaagaactatcgtccggtacaagctcccgtaaagtaagaataaaatcccattacttagtgttaatcccattatttagtagtacatcaatctatactacaaattaggtcccctttacttttaaagtgaaatgcaaatcaataattcctgcccaagaaaaatgacttcacatgtgactatatgcagtatttaaacaaatgcaaaagatacatgtgctctttttttaaatatttactgaatttagtaagccccacaaaaatgacatttagtatnnnnnnnnnnnnnnnnnntactacagttagtgtaggacaaagtctcctaagcta

SEQ ID NO: 4950 - DNA, 414 bp, Diabrotica virgifera
  misc_feature (32)..(84): n is a, c, g, or t
  misc_feature (87)..(111): n is a, c, g, or t
  misc_feature (138)..(413): n is a, c, g, or t
gggtccagccacgcgtccgcacacacgtccgnnnnnnnnnnnnnnnnnnnnnnnnnnnnnnnnnnnnnnnnnnnnnnnnnnnnnggnnnnnnnnnnnnnnnnnnnnnnnnngaaatggtatccgtttaaataaaaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnt

SEQ ID NO: 4951 - DNA, 371 bp, Diabrotica virgifera
  misc_feature (10)..(10): n is a, c, g, or t
cggggccagncacgcgtccggatggataaagcattaaagacactctataccaactcatcgtttgtggaagaccctcttggatatataaaatacaacagcgatgaagtttttggacgatcgacagcacgtcaagcagaagctgcatctcgatttgttcctgtgtacatgtatcaattttcttggtatgacaaaagtagtccccttccaggtgttaaacatgcagccgatttatattacatgtggaatgtatcattcggcaccactacccacaacgatgctcttcggaaacctatacttaaatggtggacaaatttcatcaagtatcaaaatcctactccagtaaaagatgaagatctacaaaatgtcatttg

SEQ ID NO: 4952 - DNA, 325 bp, Diabrotica virgifera
  misc_feature (2)..(32): n is a, c, g, or t
  misc_feature (70)..(88): n is a, c, g, or t
  misc_feature (116)..(167): n is a, c, g, or t
  misc_feature (177)..(216): n is a, c, g, or t
  misc_feature (280)..(293): n is a, c, g, or t
  misc_feature (295)..(307): n is a, c, g, or t
cnnnnnnnnnnnnnnnnnnnnnnnnnnnnnnntcttatagtttaattttactaagattttgagtttgtannnnnnnnnnnnnnnnnnnaggaaaattatataaatatggaatttannnnnnnnnnnnnnnnnnnnnnnnnnnnnnnnnnnnnnnnnnnnnnnnnnnngtattttctnnnnnnnnnnnnnnnnnnnnnnnnnnnnnnnnnnnnnnnngattagtaccagttttattagtaattattggttgaggttatcaaccagaacgtttagaggctgnnnnnnnnnnnnnngnnnnnnnnnnnnnaatatcattacctataat

SEQ ID NO: 4953 - DNA, 200 bp, Diabrotica virgifera
  misc_feature (34)..(63): n is a, c, g, or t
  misc_feature (66)..(83): n is a, c, g, or t
  misc_feature (86)..(112): n is a, c, g, or t
  misc_feature (125)..(169): n is a, c, g, or t
cacgcgtacggaacgcgtccgtatttatttgagnnnnnnnnnnnnnnnnnnnnnnnnnnnnnnggnnnnnnnnnnnnnnnnnnggnnnnnnnnnnnnnnnnnnnnnnnnnnngatttttatgagnnnnnnnnnnnnnnnnnnnnnnnnnnnnnnnnnnnnnnnnnnnnngataattatagatgttattattttcgaattt

SEQ ID NO: 4954 - DNA, 324 bp, Diabrotica virgifera
taaagaaataagaagtggacctgtggacgagtggtggatcgaatggatatcgtatcgatatctctatctcaaaaaatttgaagtttatcatacacataaaaaataaacaaatattgaatattttcgtaaatattgcatagaaaaacaaatacattatcaaaaatttatagaaccgtctgcaaagcagctgtagcctttcgtagtttggctcttatatcaaacaatccaaagatgtcaaatcccgagaactacaaagaagcctcctccatttacgatttcagtgcaaaagatatcaaaggtgaagtggtctctttagaaaaatac

SEQ ID NO: 4955 - DNA, 312 bp, Diabrotica virgifera
ttcgcggggccacccacgcgtacgcgaacgcgtgggcaacccccccagaacgagagttcgcaacggtacaccgtacagaagaaggaggccaaactatgctagactccaaaattcatcaacacagtgacgcacttgatgtgccatagatttctaatgtaacttgattgtaattaatgtacagtatataagataagaaaatagtagcttatataaagctttaaacgacttgtgattcctatatcgctgtatgtaagccgctgttgagagtatagatatatttaacaaattttttagttgtcatttcgcgagaaa

SEQ ID NO: 4956 - DNA, 191 bp, Diabrotica virgifera
aaccatctgctcatcgccttctcagttttcaacggcggctcattggctcaacaatatccataaccaattccaattgttaactatgaaaacgaaggcgtaaacgctgacgggtcttataattggcgcctccaaaccggaaacggtattatcgcgcaagaacaaaggcagatcaaaaacatcgccaatgaaaa

SEQ ID NO: 4957 - DNA, 120 bp, Diabrotica virgifera
  misc_feature (6)..(21): n is a, c, g, or t
actgtnnnnnnnnnnnnnnnnaaagtccatgaagaaatccaaagggacaaaaaacacagatttgcaattttccacatcaaaggtgggaaacaaattgatgtttaacacatatgagaaaaa

SEQ ID NO: 4958 - DNA, 393 bp, Diabrotica virgifera
gcagttcttgctattgaatcaatagggaaggaactccatttcagtagccgccgtttttgtgtaagggttatgtgttccatgaccaaataattttttatcgcttgattcagttttttaatgccattatattgtcgttgaatcgagttgattcactacattacttcgtgcacgaagtttgattagacacctgaatagtatttagaagttttcgtattttaccataaagtaatgatactcgatataaaatttcaagctaacgatttaaagagagatatttgattgtagtagtaacaaaagtagtgattttaagttcacaatatgtatgtgtcaaaatgttcgatatttttataaggttagtattagttttgtaaataattaataatgacactgaaa

SEQ ID NO: 4959 - DNA, 293 bp, Diabrotica virgifera
  misc_feature (179)..(198): n is a, c, g, or t
ccggctcgaccacacgtcacgctcaggaatgctggaatgatgggtaggatgagagtgtaactgtagtaacttaatttaggtataatacaggaattcggtaacatttttttcatttgtttaggagacgcaagtcccctagtgagatttaggaaatcacgcctgcccactgataaaattgnnnnnnnnnnnnnnnnnnnncgagctaaggtaggagaatcattaatatttttagtgacagctagattaataggttggttaaaaaatatacggtccatatttaatgtatagagaat

SEQ ID NO: 4960 - DNA, 379 bp, Diabrotica virgifera
  misc_feature (118)..(132): n is a, c, g, or t
  misc_feature (134)..(148): n is a, c, g, or t
cgatttctttctaacgcattaattgcatgtgacagaaaaaaacgcacgtcggtgattacatttcgtcggtgaaatttataacatttattctagttgtcaatagatggcgctataatcnnnnnnnnnnnnnnngnnnnnnnnnnnnnnnctacgaatataaccggtacaatttataggactatacaattcaaggaaaataccatttaataaatgcaataaacacaattgatttgattataggccaatttgcaaataatgtgtgagaagtgtcagatttatctaaagtgtcatgtcactaaagtgtatattatcagggatttaccttttgtactatcatttgtgacgcactgaaaaatgctcatgaaaagaattatagttg

SEQ ID NO: 4961 - DNA, 378 bp, Diabrotica virgifera
  misc_feature (264)..(283): n is a, c, g, or t
gtgacgtaaagtcaaaaatataagtctccccaccaccgttggacaagacaaccgtaataaagtctaataaccgtgggtctacaataattaaaaaagttgtcagatcactgtattatttaaagtccggaacagagccaattttttttggcttattttcctggagtaaatgtgtccaggtttacatacgtatttacgatagaaattattatttcgacatactttgtacaaaatattaagactttaaaatttgtttttatcgctagnnnnnnnnnnnnnnnnnnnntattattaataactattgatttgttattgataagttacttttacttttagtatatacactgttattttaataaaggatgatatattttcatttcg

SEQ ID NO: 4962 - DNA, 267 bp, Diabrotica virgifera
  misc_feature (56)..(75): n is a, c, g, or t
  misc_feature (150)..(169): n is a, c, g, or t
  misc_feature (172)..(184): n is a, c, g, or t
  misc_feature (192)..(221): n is a, c, g, or t
  misc_feature (223)..(266): n is a, c, g, or t
tcccgggcccacgaccgcattaatcggcggccgctctttttgatgtcaaacttacnnnnnnnnnnnnnnnnnnnncagttaattactaatgtgagagaaaattttatttttagaacagaaaaatttaatttttggaccctgtgtatcaannnnnnnnnnnnnnnnnnnncannnnnnnnnnnnnccaatttnnnnnnnnnnnnnnnnnnnnnnnnnnnnnntnnnnnnnnnnnnnnnnnnnnnnnnnnnnnnnnnnnnnnnnnnnnc

SEQ ID NO: 4963 - DNA, 242 bp, Diabrotica virgifera
  misc_feature (24)..(51): n is a, c, g, or t
  misc_feature (58)..(117): n is a, c, g, or t
  misc_feature (148)..(239): n is a, c, g, or t
accctgtgtatcacggagtattannnnnnnnnnnnnnnnnnnnnnnnnnnnaattttnnnnnnnnnnnnnnnnnnnnnnnnnnnnnnnnnnnnnnnnnnnnnnnnnnnnnnnnnnnngaagaaagtgttacccgttttaaaatatccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagc

SEQ ID NO: 4964 - DNA, 420 bp, Diabrotica virgifera
  misc_feature (340)..(358): n is a, c, g, or t
  misc_feature (374)..(401): n is a, c, g, or t
cacacatgcatcaacctgttacaagggtcaaatatgtgacagatgtgagttagataattgtgcttccattttaaaactaaccgatgaaacgttcgatccgcccttttgtatattcagaataaccaatgtgatattagatttaatctatcaatcctatttcattgcgtatatattgacttctacacaagtattgtatgttttgtttaatatcattgtgttttagaccaatttacagttgtaggtatctaaatagttttttacattgttcgattttactaaaaatacgctaggccgttattttttggctttagtatttatagtaaaaatgccaaccgagaannnnnnnnnnnnnnnnnnncttgtactactaagannnnnnnnnnnnnnnnnnnnnnnnnnnntatgtcaactaaaacctaa

SEQ ID NO: 4965 - DNA, 289 bp, Diabrotica virgifera
  misc_feature (27)..(43): n is a, c, g, or t
  misc_feature (45)..(58): n is a, c, g, or t
aaaaggggaagtcactaagaaagaggnnnnnnnnnnnnnnnnngnnnnnnnnnnnnnnaggttcagaaaacattaactttaagtaaacgaaacttttttgacacattttcttggcctcgataatggttttaaattggagaccacaatttttggaaagaattggaaaccgtaaatccaaaccaatccatttttggtgaaaactgggccaaaggtaaaggatattccataggaattacataattatccaaatatgtgatgtttaatttaaaataaagggaaatttttctgt

SEQ ID NO: 4966 - DNA, 157 bp, Diabrotica virgifera
  misc_feature (2)..(38): n is a, c, g, or t
  misc_feature (47)..(97): n is a, c, g, or t
  misc_feature (99)..(148): n is a, c, g, or t
gnnnnnnnnnnnnnnnnnnnnnnnnnnnnnnnnnnnnnggtaatccnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnngggatgacc

SEQ ID NO: 4967 - DNA, 420 bp, Diabrotica virgifera
ggaaaatcagaatactaacaaggttaacaagctaagtttgactggaaaccttctcggaagaatactgttgctgatcttaagaaacgacgatttcgaaaaggcctgcatcatcatggataaattggataaggatcatcaaaccatcgctggcgtaccggacattgaggctttagaatgctttgttgatagctgtattgagagaaaagcgccatctagagccatcgcatgcatccagtattgtgctgacagcgggttccaggaagctggtatatttgctgctaagcttaacgagaaactgacacttgatgaatcgcacctgaacagtctatcaaggatcgtaggtgatgtgaagctagcaaaagtctcagaccaaagttgaagatgtattttatatattgatcagttgattttctgactttg

SEQ ID NO: 4968 - DNA, 395 bp, Diabrotica virgifera
  misc_feature (344)..(366): n is a, c, g, or t
  misc_feature (368)..(380): n is a, c, g, or t
tccaagcgtccggaaggcattctatatgacaagtggacaaatctttaaccggttgaacccccaccacttctgtgacgatcaaacatatctttcaccaacggacaatcttatgcttctgtaccttgtgtatgagggattactggctgttaccactatcattcataatggccaccatggatgtttcaccctcatatgtgtgcaatcgcatccccggatgactcaaatttgtccatgtgtagcaaaatgttaatcctttcgcagcccaccgtgttatggagcacacaagagccatttacatacatatgcgcacaattgacaattacgccggcctatataccaaattnnnnnnnnnnnnnnnnnnnnnnngnnnnnnnnnnnnnaagatccaatcatat

SEQ ID NO: 4969 - DNA, 273 bp, Diabrotica virgifera
tttaaaattcagatttgaattctttagttcaagtaatgaagactttaataggatgaaagttcagtactattgtgagacaaaaattggtttacaaaaggaattcggtaacattttgtacatcggcttacaaggatcatgacttattgcctaaaaaataaatactcgccagctcacagattcaactgaatcaccactgtaattgtaccatgcgaatgtaacataatcattacgtcttgaactgatacccggaatgaacgacaccctgctccggag

SEQ ID NO: 4970 - DNA, 244 bp, Diabrotica virgifera
  misc_feature (77)..(96): n is a, c, g, or t
  misc_feature (110)..(185): n is a, c, g, or t
cacaaagcacatggtctcctactgattatgtcctaagcgtgcaccacatttaatacataaaataacgatagactcgnnnnnnnnnnnnnnnnnnnnaagtacgcgataannnnnnnnnnnnnnnnnnnnnnnnnnnnnnnnnnnnnnnnnnnnnnnnnnnnnnnnnnnnnnnnnnnnnnnnnnnngcagtcagcgtggtttgggtgtaaaaggtcctcccctcgctgactgccttccacagccg

SEQ ID NO: 4971 - DNA, 363 bp, Diabrotica virgifera
  misc_feature (14)..(36): n is a, c, g, or t
  misc_feature (298)..(332): n is a, c, g, or t
agggattcggcagnnnnnnnnnnnnnnnnnnnnnnncatcatgtctttttgcaccaaatattaagtcccgcctgcccactgattcattagaatggacgcggaatattgaccgtgccacagtaacataatcattactttgtttattgaaagctgggatgaaaggttggatgaccaaaacaactgtcattacataagctagaaaaaagtctatttatatagtcatatagcttaaatttgttttaaatgacgagaaaaaccctatcgaagttttataaattcaataataagtttatttagnnnnnnnnnnnnnnnnnnnnnnnnnnnnnnnnnnnggggtgataattcaataaatttatctttttt

SEQ ID NO: 4972 - DNA, 134 bp, Diabrotica virgifera
  misc_feature (2)..(128): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntataag

SEQ ID NO: 4973 - DNA, 328 bp, Diabrotica virgifera
  misc_feature (213)..(226): n is a, c, g, or t
  misc_feature (228)..(240): n is a, c, g, or t
  misc_feature (290)..(316): n is a, c, g, or t
ggtcaagaattaccgggattcattaaacggatcggtgcaggtcgaccttatattgtatcttagactattgcatattatttgtagatgtcctattagattttttaatataaaagtatttgtgctagtatcatctaacgtacgaaattttttatctttatattattcattccatatttattagatacattcttcagtagattatttttgcttgannnnnnnnnnnnnncnnnnnnnnnnnnngttaacaaagtcgtgtacttcatttttaatttaagaacgtgttaaagagnnnnnnnnnnnnnnnnnnnnnnnnnnnccatcgcaacat

SEQ ID NO: 4974 - DNA, 398 bp, Diabrotica virgifera
  misc_feature (322)..(335): n is a, c, g, or t
  misc_feature (338)..(350): n is a, c, g, or t
cgttgagttcggctttctatccaaacaaaaatcgtgagcaggcttttgaatttggaagaaaattaaatagttcctttgcttctagtaaatctagtgatttattgaaactgttacaagaagcaccattgtcagatatagtgactcagcaggcattgtcacccactgcatgtattccaactatggaagaagaatttaacgacaaagcttttgttagtggaccaatgcatagagccattctcaatggtgaattcaactttgttcctgtcttaataggcatcaattccgaggaatacctgttgtttgtggatgcagacagtgacgnnnnnnnnnnnnnntgnnnnnnnnnnnnngacaatccagaacaaatggtctctgcatctttcaatgtagctgaagaa

SEQ ID NO: 4975 - DNA, 231 bp, Diabrotica virgifera
cgggccgagccacgcgtccaggtagaatgacggtgcgaccgcagcacaatcactagttattttatgtgaccagctggcatgaagggttagatgacaaacgaactgtcttgatctaatttatacagaagtttactttgaagttaaaacgcttagagttttttaaaagaccagaagaccccacacagttttaccccagcattaaaaagtttttttagcaccaactttagttac

SEQ ID NO: 4976 - DNA, 407 bp, Diabrotica virgifera
atcagaaaaagaacacgatgctgacaaagaagaaaatcttactaagcaaaacaataaaaatgcaggagaaaatgaaaatggggaaagtaaaaaaaatagtgtagacgttgttgagagtctaagtaataactatgataatattaaatctatagatacagaagacaatgacaacgacttttcaggtttcgatctaaatactgaaaaagagaagaaaaatagtggaagtaacaattctgaccaaataattactaatgatattaatataaccaacgataataaaaatgtagaagaaaaagacaacggggagtgtcatataagtgaggaagaatgtattaatcataataatgtcaatgataataattattctttcagtacagaccaaaatattgaaagagatagtgagaata

SEQ ID NO: 4977 - DNA, 425 bp, Diabrotica virgifera
  misc_feature (48)..(65): n is a, c, g, or t
  misc_feature (241)..(320): n is a, c, g, or t
  misc_feature (340)..(365): n is a, c, g, or t
  misc_feature (367)..(421): n is a, c, g, or t
cccacgcgtctgcccacgcgtccggaacaatttgatattttctgaagnnnnnnnnnnnnnnnnnncaatttacaaacatatcaaaaactgtaaatatagattgtagcaataaaatttaccctctatttaagaaattttgttaaaacaaagcaggcatgtttgttaaaacaaaacaaacatgtttgttttgttgttattttgttttaaaccgtgtagatttaagtaattattgtatattatnnnnnnnnnnnnnnnnnnnnnnnnnnnnnnnnnnnnnnnnnnnnnnnnnnnnnnnnnnnnnnnnnnnnnnnnnnnnnnnngatgtaaacctccgcgaggnnnnnnnnnnnnnnnnnnnnnnnnnngnnnnnnnnnnnnnnnnnnnnnnnnnnnnnnnnnnnnnnnnnnnnnnnnnnnnnnnaaca

SEQ ID NO: 4978 - DNA, 317 bp, Diabrotica virgifera
cacaaacctctcattacacatcagttagactatcccaaggtctaagctgttgaaaaggttgattgcacataaattgctgttttggaagccaaagttcaaggacagtctggataatgcggggctttaattacaacggattccaccaaaggtcaatcctcaaccaacaaaatccacctgatccccccaattaaccagaaatggtatacacggagatagtgaaccatagttttgacagaggtttgataaaacataccttcttttaaattgagcaccacgggctttcaccacaagaacactacacctatacaggcgtatat

SEQ ID NO: 4979 - DNA, 423 bp, Diabrotica virgifera
caatgaattcatgacgcaccagtaatttccttttaactgacccaaacagccaatggcaatcaaggagaactactgattggtggatcagatccaagtaattacagaggagacttcaccaacacatgagtaccgtgtaacagggatggcaaactaagctacaaagtgttaccgtatgcaaacatagtttatctaagaatggatgtcgatcagtgatagatactggtacttctcacatctacggaccatacgatgaagtcgaagctaacaagacgcaattggtgccatctaagactacgatcttggaattcacaccaatgactgcgatgccgatttgacaaagcttccaaaagttacatttacggacggacgcaagaattttgacatatcaccatcagcctacgtcatcagagattcgagtaattg

SEQ ID NO: 4980 - DNA, 380 bp, Diabrotica virgifera
  misc_feature (74)..(88): n is a, c, g, or t
cccgcccagggggtagtaagttacactgcactttcaataaatgtaatgaacccatcgttggttttcagaatatnnnnnnnnnnnnnnnttactaatatactattgggacaaacgctgttaggttctggtctatatttatataaccgaccacatttaaaagctttacccacaaaagagaaaattctatacagctcatttggtgctgtcactttctctttaggatccgttttggtgtgggctatcttcagaagtgttgtcccccaaaatgtagctttaggaacagtatgcggtattggatccggtattgcactgattaaaattgcaagaagttatgtagaacatgtagactctcttgtagcagaaaaagcttaagtgatttt

SEQ ID NO: 4981 - DNA, 187 bp, Diabrotica virgifera
  misc_feature (4)..(28): n is a, c, g, or t
agtnnnnnnnnnnnnnnnnnnnnnnnnnactaatattcgtaattttcataacgggtttaatcaacactcttgttgactaacccacatttactaacgatgatgtgtattctagtaccagtttatcgagggaattcacccagaccagtttaatcacagaatcccggaaaattttttccaccagggtctt

SEQ ID NO: 4982 - DNA, 339 bp, Diabrotica virgifera
cggtcacttggagaagttgttcatggtatagttgttgtaacaaatttccacagtatgggtttatccactaacattgtgaggtccatggttaatatttggcagcccttaattaattcatcgtcccatgtctagcacggattatgacttcttctttgggtgttcagcatatgccatttcaacagagcccaactttcccaattgataacgtgctatgcacaacatacacaatttatatctatccatatgtaaatcgtatacattattaccagaaacttccaaggctcaaacttcatttacgtagtgactaaactccttcctgacaacatatccaaggctatt

SEQ ID NO: 4983 - DNA, 377 bp, Diabrotica virgifera
ccgacgcgtgcgatagtactccacggtatgacttaattactgtgtatcgacgacctgaatcgttccactaatatgttgatgtccaaggttaacaattagaagatctcagattcagcttcggactgaagtcaacgactggactgtgtatatacataagcgcgttcagcatactgaatcaccaacatcagaccattctttctcaagggaaaacatgctatgcacactcatacacaatttaaagctctccctcttaagatcatatacataattaccataaacctccatcgctcaaacatcaaagacctagtgactaacctccttcgtgacaccatatccaacgatattgataaggcctgccagagtatctaccccctaga

SEQ ID NO: 4984 - DNA, 418 bp, Diabrotica virgifera
  misc_feature (175)..(196): n is a, c, g, or t
caggaatgttttatacatcatatcttttaaataccaatatgtaacaaatttgatctttacgacatttaaggggtttttacccaaacattttggtgtctcgggcatgtgcagtactggaattgtacactgatgatggaattagtgttccgaaaatgttctgtaaccctttttgggnnnnnnnnnnnnnnnnnnnnnncaaaggaacatactatcgtttgtgatttatggtatacagccagctacaggaatttattttcctcgtggatttttttaaacaaacatttcgtgagctacaattcttattgataattattagtgaattttgttatattcaaagctcaggtatatttttgcagatttaaaccagagttgaaaccgatgtggactttctccttatttttatacttttttgtcatta

SEQ ID NO: 4985 - DNA, 204 bp, Diabrotica virgifera
acacaacgacatccccctatggacttttataaaactaggaatacgtttttttagtacgaactttagttatataataaatttacttaacctggggcgaaaaaacatcatttactttttaaaattatatacacatcgaagtttgtgctacaacttttttgattataacaataacttagcctagggataaccacgtaattttattgg

SEQ ID NO: 4986 - DNA, 277 bp, Diabrotica virgifera
cccacgcgtctgcccacccgtccggtttattttaaagtactatgctagtttttcacttaggtaatcaaaagttttagttactgacaggtgcatagtcttgtgagagaagagtttattttgatgtaggggggaatttatgtattgtaccttgtgtagcacggagtacttctttataagtagctatttattagtttcgacattaaagcagttaggactttacaatttttatggtaaagtaaatatttgaaataacttttgtgtcatgacatgtttttcg

SEQ ID NO: 4987 - DNA, 441 bp, Diabrotica virgifera
cccacgcgtccgattctttctcagcggtggcatttagtattggtgtcaagccacgcgctgagcatgtttacaaatattgagaacaaagaaatatatttgatcatcaaattaaataatgcaattgcccgaattattgtttacaatttacaattcgtgaactaaattagaaacccgtacatgtattataccataacaacttggctcatgtgatatacggggtgataaaaatatactgttcaatatcggatatgaataatgaatgtttgatattggacatgctgcggacggccaagtaagtactgcccgacgaaataagtaataacgaatgtagtcagtgttcaaagtttacaataatcatgatacattaggttaccaagataggttaataaaatgtgtgatgtaaagacactatatagtccttgaacaaataatacttttcca

SEQ ID NO: 4988 - DNA, 419 bp, Diabrotica virgifera
  misc_feature (154)..(194): n is a, c, g, or t
  misc_feature (213)..(231): n is a, c, g, or t
  misc_feature (258)..(294): n is a, c, g, or t
ggaacaacggaaaatagtaaaaaatatgataaaagatccaaagaagaaagttggaaacaattcggggaaaaacaaccaggaactcagataatagataacgaagataacagttttgttgcaagtatgacagcataatgttaaaatatagatgtannnnnnnnnnnnnnnnnnnnnnnnnnnnnnnnnnnnnnnnntgaacaaaaagctaaaagnnnnnnnnnnnnnnnnnnncaaaatcaaaaatcataaaacagtgtnnnnnnnnnnnnnnnnnnnnnnnnnnnnnnnnnnnnntaaaggatcgaagctaacttcggcgtgaagcaaactcaaaacccttccaaaagggccccctaactcaaattgccgggcgtccgtttaagaacgccgtcatggggaatacccggggtttcccaaac

SEQ ID NO: 4989 - DNA, 937 bp, Diabrotica virgifera
  misc_feature (13)..(34): n is a, c, g, or t
  misc_feature (114)..(133): n is a, c, g, or t
  misc_feature (227)..(245): n is a, c, g, or t
  misc_feature (425)..(447): n is a, c, g, or t
  misc_feature (810)..(811): n is a, c, g, or t
  misc_feature (874)..(875): n is a, c, g, or t
tgtggttatgttnnnnnnnnnnnnnnnnnnnnnncaaacacttatttttaaagatgtttgatatttcaccataatatttacatgcctattcaattcagtaacacaatggaagannnnnnnnnnnnnnnnnnnnccaataatcccattaatatatcgaccctaatatcaaaaattattagcaatgttaagaaaaaacatgaaaatgggacaaaagaatttccagaagnnnnnnnnnnnnnnnnnnngttaatgaatcctgatcctctaattagtgaggtagctggagttgcaataatacaactaattaaggatggtatattacctgttgattctgttttaacagattttattagtactatgaaatctattcaatgtcattctactctaattaatacattaggagaattattgtatctacaaataannnnnnnnnnnnnnnnnnnnnnnctacattctccacaacatccgtttataattttggaaaatgaaaatccacatttatctagccatattttgaataaaatatgtcaattgcaagagcttgatggatctattgtcaataaaatatttgaacctttttatctctactgtttatgttgtccatcaaaacatgaacatgatttactaagatatagactctggactttactcttaaattcaaactgtgttgattcaaacttctttgttaacatactaggatggttgcaggtacaaagaatcgaagatttaccactaataagtgatcagttaattgaagctttgaacaatcccaacataagtaaatttatcgaaattgaattgataatattnngtggttggtgaatgctctacgtaatttatcgataaacaaattagatgcgcaaatctgtctctnngtatttaaaaaagttattgaaacagaaccttagtgacatcgacagtattctggtaatttttt

SEQ ID NO: 4990 - DNA, 132 bp, Diabrotica virgifera
ggtctacccaggcctacgcaaaaattgaggcgaagccattgtaggtttgagtttagattaagatttctgaataccagccgtccaagaataaactcccactgtaatctggtttaaatgaaatttctgaaaacc

SEQ ID NO: 4991 - DNA, 437 bp, Diabrotica virgifera
aaagagtttgaaaattctcagcagtcccctttccgttcttgtcattagctctacatcgtccgcaaatcccagaacctggtttctgttatcaaagatcataccttttgttcgtattccactctcttgaaatattgcctccaacaagaaattgaagagtactgtggacagcggatctccctgcttttaactttcctattaatctttcttttaactttaaattttcctgttaggcttccttctatccttactctattgtcggtcttcactaaggtaatttttacgggtctgatcatcttttacggaattacaagtactcttaaggcctggtacaaacaccttcttgtcacaccttcttgtaagcttgtttaaaatctataaagaggaggtttaactttaactgtttctcatacgtactgctctgaatcattttcagcacg

SEQ ID NO: 4992 - DNA, 226 bp, Diabrotica virgifera
caataacagaagcaacatgaggattacatattttattgtatttgtactagcctttgtggcaactggaatataccaagtagaagcaggaaggtcatctaaaccagtcacccaagcaccaggaagaaaacacggccataaatagccttattttaatatgtataattaatttatattaatgcattttaatgttttattgtacaaatacaataaaaatgttatttgactg

SEQ ID NO: 4993 - DNA, 412 bp, Diabrotica virgifera
aggagttcctggtatttaaagatgaggaggactttgacggaaaactcgatgagatggacatggataactccaccgaacaagagatctcaaagatccttgaagatatgggtagaaagttcgagagtatccagccagagactaaagactctctgggcttcttcggcaagatcatggaatctgtcaaggggtacctctctaaggacaagaaggacatgtttggtgctgcggattatgggggattccagaagaagggttttatagagccggacatagatgattttacacacgcggaagaccctcctaagaagagaatgaggttggatccggatttagggccgctaaatgaaaatatagtcacgacgaccacgttgaatacgcgtgctctgaatacaaaggaaaaatgaagtttttg

SEQ ID NO: 4994 - DNA, 433 bp, Diabrotica virgifera
ccgggcgttagtatatgaacatcagcagcttgacagatgacaattggcatgaactgtcaacaggtcaaacaggaaatattaccgagttaaacaaaaaatgaccaggaaaatgttccaataaaaaaactgtaataaacgcaatattgaatagtttcactcatgaattactagaacttcctcctcagtatctagatttggaccatctaactatttatcgagaccaaattgtatacaagataccagcaattgtcagtgattaataaatacctgttgtatttttgaattctcgatattttgttgctgttaacgctgtgatatattcgcataacatattcccaattaattaagttttcatgacatattaaacagttttcatgaaatattttaaaccactaagaaagaatttaatagtggatataattatatatagtca

SEQ ID NO: 4995 - DNA, 246 bp, Diabrotica virgifera
  misc_feature (101)..(118): n is a, c, g, or t
gtacatttcccgaatgtatgcttgtttgtatgtttgttttcttagttattatcatgtatttgatcttttttatattcatttttggtccatattcttcacannnnnnnnnnnnnnnnnngtagtagttggagttgttcagcagagcttgccataatcacggtgtcatctgcatatcttatgttgttaatagatcttccgttaattattattccctcactttgagatagcattgcttcttcaaaaatg

SEQ ID NO: 4996 - DNA, 415 bp, Diabrotica virgifera
cccacgcgtccgcataacaaaagacgtatccatttggcataagggaaagtaataaaaatgctcaaatttactcaagtaaaatatatctaaagaaaaaagatcgatactatactatatacttcaaaaaatgatactctagaattcgaaaaggcagaaatgaaagtgtaaggtactacactgacatttaaatacaataagcggaaacaaacaaactaaaatgtgtcaaactattattatctattagcaaataataacacgaaaatatattgtcaataaaaatagctgcaaattagccaaacttgaacaaaaaaagaaaatcaggtctaataggaacatgataaaaaagaaaatcatgcttcacgcatagacaagaaaatatatatagcccgtgaaaaggcaattgacaaagctctac

SEQ ID NO: 4997 - DNA, 449 bp, Diabrotica virgifera
  misc_feature (28)..(50): n is a, c, g, or t
ggcgcataaatcgtttgaattttcaatnnnnnnnnnnnnnnnnnnnnnnnacgtacataattctttctctaataaatgacaattgacaaaaacaattggtatattactttttattttggaaattcccaaaaaagtgtatgattttcgtactttcacactaggatagccccttaatttcactgatttgttctatatattaatttttggacagttaggaaaattgataagatatacaatggtgtgttttgtacaaaaatgaaacccttgtttggtaagttcgggctcaatgcctagctaaatgagactgttatgtttttaagaaaaaccatcaatagtttagctcggattagaggaacttacctacgggacaatattttatttgttgataaatatttttgtttcgttgtgttagggaagtcatttctatgtaaaatacaagataatcgata

SEQ ID NO: 4998 - DNA, 406 bp, Diabrotica virgifera
aactgtgaaaggtctggctttggtggattcggggaatttttcagcgctgcctcttgaactaacatttgtctgaacttgagatccaactgcctgcgtttcatttggatgtgttcattccatgttagcctttggtcgatatgtaatgcaaggtatttcacttctgtgctgacggggatgtgtgtattgttaagtatgagtggatgacatgatatattaaaaccgaatgatataatgaaacctaaatttattgtatcatgaggggatgacagatttcccggcgggtgagggtggtaaatgttacttgtactgactttctttcattgattttaattctccattgattgtaccattctgcgagtaggtttaggtgggtttggagatgagaagagcatctactggattctca

SEQ ID NO: 4999 - DNA, 392 bp, Diabrotica virgifera
gtagaagtagttgtgctcgtttaatttttaattgttttttacgaaagttgtgacttgtgaccatgtgtaaatttaaattggcgatgaaacacgcattacggggttaagttgatatgaaaataatggatagtgatgtacaaaattgtgtccttttaaacacgtttcatacccgaaagaaaaaattgaggataatttttcatcaaggaaatctcgtctgggataacgaaaaaccgccgtcagataagactactgttcctatagaaaatgtaatatctgtccaacagaattacaggaaaacgcatcctagtgaaactagagagttgaatcctaatgcattcactaaccattatgcagaaagagaaaaaaggcccagaatgggtctataaaaacct

SEQ ID NO: 5000 - DNA, 391 bp, Diabrotica virgifera
  misc_feature (241)..(300): n is a, c, g, or t
atttaataagtagagcgatgtgttgtgataatggaaacagatgaagaaatttaaaagttggaaaaatgtttatcctggcaatatttatataccaaatgggatgatatccaaaaactaagtgttattcagtcactaacgtccctaatgcaaaaagatcgcaaagggactctcacaagaatcataccgaagattcaacaagaacttcctatcaatacatcctccgaatttcatttggccaccnnnnnnnnnnnnnnnnnnnnnnnnnnnnnnnnnnnnnnnnnnnnnnnnnnnnnnnnnnnntttcaaagtatagacagtaaagatctcgttgtggcaactgcctggagcgaaaacttaatccaagtcaacaaatgtgtatcccaaaatgaca

SEQ ID NO: 5001 - DNA, 409 bp, Diabrotica virgifera
  misc_feature (348)..(390): n is a, c, g, or t
ggctacgaaaaagaagactatgtccccaaatgtgataattgcaaaacacgtttgccaagttcccaatcagacggaacagaaaaccaagttaaagatgatgccatacgaaaaaaagtctctcgaatatctttaaacgaagacaatagccctcaaacgtggtgcacaaaatggcacaatttttgtagaaactgcggaacacagctacaacacacgccgagtaaagaagaagtacagttcgagaaggtagtggtaggagcccatggtgatataaattcgaacgaatccggcctctttatgtacattgatttgcacgggcacgcgtcgaagaaaggtatctttatgtatggnnnnnnnnnnnnnnnnnnnnnnnnnnnnnnnnnnnnnnnnnnnttacccaagttgatgagta

SEQ ID NO: 5002 - DNA, 239 bp, Diabrotica virgifera
agtaaattgaaatacgcgaagattttgtttgatgtgcatttcttagttagttaagaatttaacctattctgaagtttacttatttcccatggtagcttgcaccttgcagtgcgaagttacaattcagttgataatggtcacaaactttatattctccgtacgactctaaatctcattatacctgaacactgtccagcctagaagtaggcatacgtcgagcagcgagcccacctaaattc

SEQ ID NO: 5003 - DNA, 391 bp, Diabrotica virgifera
ccgggaaatggaacggaaatatgaaggtggttgtcttacacgcccgactggcgaggctcattaagttctcttttgttgtctttcgtcttatagattcattttcatttggtatagacgattataaactatgggcagcaaatcttaggttagaagattcattcacttttagttgagagatatttagggtactcttgtcggtgacagttattgtggcgtgttttatgggatatataggacacttattcgcaagatgtattcattaacatttaggagaattgtatgtataaagttatttgagctagggtttttagtagtagcaggagttagtttaagggatgtgcttaacaggaatagtttttttaaggtttatgttttaaataggtctttaggg

SEQ ID NO: 5004 - DNA, 158 bp, Diabrotica virgifera
cacaaacacatcccaactccggttcgttttggggtaaaactttttcgggtttaagcgatcacaagactcctgcaatgaggattttaggttaaagtacgcaccagtgtccaaggttttccttcctggattaccaaagaagaagatgttcgaaatctggg

SEQ ID NO: 5005 - DNA, 373 bp, Diabrotica virgifera
  misc_feature (9)..(26): n is a, c, g, or t
  misc_feature (29)..(42): n is a, c, g, or t
  misc_feature (44)..(56): n is a, c, g, or t
cccacgcannnnnnnnnnnnnnnnnncannnnnnnnnnnnnngnnnnnnnnnnnnnccatctcattcccttagacccggaagatttgctaaataaagtggataattttatcaaatttacacagccagatttgtctgcaaccgaaactttggcagtaaaggcgttcttttatttgcttattggtattttgggatccagcagtgttcaattgacatctcttctggttacagcgtctaccgaattaaatgcaggtgcaggattaggcagttcagcttcttttactgtatgcctttcagcagccctgctacagctaattaaatcaaaaataccagaggaatccttctcaattgaagggtagaaatcaatcagggggg

SEQ ID NO: 5006 - DNA, 281 bp, Diabrotica virgifera
  misc_feature (2)..(14): n is a, c, g, or t
  misc_feature (24)..(60): n is a, c, g, or t
  misc_feature (75)..(111): n is a, c, g, or t
  misc_feature (114)..(177): n is a, c, g, or t
  misc_feature (195)..(213): n is a, c, g, or t
  misc_feature (221)..(245): n is a, c, g, or t
  misc_feature (247)..(273): n is a, c, g, or t
gnnnnnnnnnnnnnaatggtgagnnnnnnnnnnnnnnnnnnnnnnnnnnnnnnnnnnnnnggtacctggggtacnnnnnnnnnnnnnnnnnnnnnnnnnnnnnnnnnnnnnccnnnnnnnnnnnnnnnnnnnnnnnnnnnnnnnnnnnnnnnnnnnnnnnnnnnnnnnnnnnnnnnngtaaggaaaggtaatccnnnnnnnnnnnnnnnnnnntttttagnnnnnnnnnnnnnnnnnnnnnnnnncnnnnnnnnnnnnnnnnnnnnnnnnnnnataattag

SEQ ID NO: 5007 - DNA, 354 bp, Diabrotica virgifera
  misc_feature (314)..(334): n is a, c, g, or t
catatttttcagtgaggtattacgagaatatctgctgaaatggctgctagaagaatcacgaaaagtgctgttaactgggctgccttaagcgaaaaggtccctgaacatcagcgtgcccagtttttagcgttcaaaactaagtccgacagctatcttaggcgtgtcttagcaaatcctgaacaagccccagccattgattgggcttactataaatccaaagtaccagttgctggaatggtagatgatttccaaaagcaatatggagctttatctattgcattccctgcagacactgtcaaacctcaactggatgnnnnnnnnnnnnnnnnnnnnngtgatatcgaaaaattcaaa

SEQ ID NO: 5008 - DNA, 410 bp, Diabrotica virgifera
  misc_feature (251)..(282): n is a, c, g, or t
  misc_feature (398)..(398): n is a, c, g, or t
atcacaatagacgtaggaaccaacaacgagactcatctgaaagatcctttgtatataggtttgagacaaaagagagtcacaggacaagagtacgatgaactcctcgatgaattcatggaagccgtagtacgccgatggggtcagaacactttgatccaattcgaagactttggtaactcaaacgcattcagattgttggagaagtacagaaatgaatattgtactttcaacgacgacattcagggtaccgnnnnnnnnnnnnnnnnnnnnnnnnnnnnnnnnttgaggatcacaaaaactagacgttccgatcatgtgatagtattccaaggagcaggagaagcgaatttgggtatcgctcaattgtgcaccatggcaatggtaaaggaaggtactantgagagtgacgc

SEQ ID NO: 5009 - DNA, 406 bp, Diabrotica virgifera
  misc_feature (33)..(52): n is a, c, g, or t
cccacgcgtccgttttttttcaaagttttcaannnnnnnnnnnnnnnnnnnnatatacaattttcaatttcaatactgtattatggataattgacttagttatacagaatgtctttaatgtcatctccatatttaataagattgcaagagttaaaattatggcaaggattatgacaatttattgcaaaaacaacaagaaaattcgcaagaatgtatagatttatcagatattgattccctggatggtgtaacaccaataaacgaatcaaaatctccaagagtttcgaaagatatgaattgtgttgatttggacagacaagttatattgcccactacaaaaccctttaatgaattgcttgaagataaacttgcagatgaccagccatatttaccaccagccaaacga

SEQ ID NO: 5010 - DNA, 401 bp, Diabrotica virgifera
  misc_feature (180)..(206): n is a, c, g, or t
ggtagctatccggtattagccgggcaatccaggcatcagccaacgcttcgggcacctggtgttacatcccaactagtgttccttttattctacgtttaatttcgagcacttgcatttacgttatttcgaaacacgcaatctgggtagcgtccagattcatatcaacatccttgtcattgnnnnnnnnnnnnnnnnnnnnnnnnnnnacactggtcatttaatttacaaactgtggtggcagcgacacacgtaccatcgttgcagttcgtgcaaagaagcccaagacatgggtacaggttcattcagatatgcctgagtactcgacaatcttaaagccgatagagaacgtggtattatcattgatactgctttgtggagattcgcaacagctaaatactatg

SEQ ID NO: 5011 - DNA, 325 bp, Diabrotica virgifera
  misc_feature (18)..(39): n is a, c, g, or t
  misc_feature (228)..(245): n is a, c, g, or t
tatttatttagttcagcnnnnnnnnnnnnnnnnnnnnnngtgtacaaagtaatttcatttacagagaggtaattagtactgtgagagaagatttcagttttaaaaaggaaaaatttaattctatgtaccctgtcgtatcaaggattataagttaagaattatatatttagtatttgcgaatttaaaacagctatcatgattaaggtttttagtgtaaatggaaatacnnnnnnnnnnnnnnnnnnctaggaaatgttcctcggttttaaatatatccaattttttcggagataaattaaccttagttattagcatataatttaga

SEQ ID NO: 5012 - DNA, 407 bp, Diabrotica virgifera
cccacgcgtccggactagacacccttgagctattaacaagttttcggcttgctattgatcgactttttttcatacgcggaatccagacctattccgtatttctccatcttctgatccgtcggcatatatttctacttccaggtatgtaaactttccaatgtaatcttcatgtataatgttttgtgggactatatttcttctcgtctgtatcattattttgtgtttttttctgtgctaatttccagacctagccttttcgtttgatttttaactctgtgtaagtttcctgtgctcctgtccagtgccaggttaaacaatgatcttactagatcttactgctttagtccctgcgagattttgaaaaagtctgtccgctggttttgtagtcgtacacattccggagtttc

SEQ ID NO: 5013 - DNA, 184 bp, Diabrotica virgifera
cactagcaattcgaattagggagttcacaatgcactagtaaaaccccctactcatgcacttcacatcggattaaccggcacaagaacactatattgtcgatactcacccatgttacctactgcagttaccatcgattggctaccgatgtcaccattggtgaaaaacctgttttcaatagaaagc

SEQ ID NO: 5014 - DNA, 364 bp, Diabrotica virgifera
ttacaaacttaatgatcattctatggaatttatggaagattttttagcggaatggaagcatgggcatggatttttatggtataatttcttaacatttagaaatagatccaatttaattggtatggatatgaaaatatcgagtactgcatcttttgctgatgaaaataatcatttggacgatttgaaggatacccattcggatgcatcgttgaaagttacttcagctctgctaaaagttatcacggaaatggttaatataactccagtaatgttgtatgatactggttccaataaatgcagaggaatgattgacgatttggaaaatggacgagctgagctaccaggtaactctctttttatctcg

SEQ ID NO: 5015 - DNA, 85 bp, Diabrotica virgifera
  misc_feature (35)..(53): n is a, c, g, or t
tcggtcaaggcaaaaaagaagactccagcagctcnnnnnnnnnnnnnnnnnnngaagtagcagaattattgagcaagaaattcaa

SEQ ID NO: 5016 - DNA, 202 bp, Diabrotica virgifera
acgcgaccgtgagttctatggcgggtaacgaaaataaggtcaggatgatgatgagggaagagggcgaagcaccagctgccgctcctgctcctgccggttccaggtccgcctcagagagttcctccaataaggccataaggtctggttctaatgtcttctccatgttttcgcagtctcaggtagctgaattcagagaagcttt

SEQ ID NO: 5017 - DNA, 301 bp, Diabrotica virgifera
  misc_feature (8)..(60): n is a, c, g, or t
  misc_feature (66)..(118): n is a, c, g, or t
  misc_feature (253)..(288): n is a, c, g, or t
tcgtgggnnnnnnnnnnnnnnnnnnnnnnnnnnnnnnnnnnnnnnnnnnnnnnnnnnnnngtaacnnnnnnnnnnnnnnnnnnnnnnnnnnnnnnnnnnnnnnnnnnnnnnnnnnnnngtaagcacatccctatagatatttaacattaggactattacatatttttaaggatgatcttaaatgtaatgatttattcaaatttaacttatatataacaattacgattaaatattttcatatttcaatatatgnnnnnnnnnnnnnnnnnnnnnnnnnnnnnnnnnnnnctagaaatttttt

SEQ ID NO: 5018 - DNA, 218 bp, Diabrotica virgifera
  misc_feature (17)..(37): n is a, c, g, or t
  misc_feature (40)..(67): n is a, c, g, or t
  misc_feature (84)..(134): n is a, c, g, or t
  misc_feature (137)..(185): n is a, c, g, or t
  misc_feature (195)..(217): n is a, c, g, or t
ccaaatttaaagagccnnnnnnnnnnnnnnnnnnnnnggnnnnnnnnnnnnnnnnnnnnnnnnnnnntaaggaaaggtaaaccnnnnnnnnnnnnnnnnnnnnnnnnnnnnnnnnnnnnnnnnnnnnnnnnnnncannnnnnnnnnnnnnnnnnnnnnnnnnnnnnnnnnnnnnnnnnnnnnnnnggaagaaccnnnnnnnnnnnnnnnnnnnnnnnt

SEQ ID NO: 5019 - DNA, 223 bp, Diabrotica virgifera
  misc_feature (163)..(181): n is a, c, g, or t
aaaatttggccacctcctggggaattttcaattttttaaaggaacaagaatcaaccccggggaattttcaatggcaccagaatcaaccccggggaattttcaatggaaccagaataagttacgtaataaaacttccgtaaaatgaaggtgaaaagaaaacccnnnnnnnnnnnnnnnnnnngggaaaatcccaaaacaaaccagaatcaaaatggtaaaaatt

SEQ ID NO: 5020 - DNA, 76 bp, Diabrotica virgifera
  misc_feature (41)..(71): n is a, c, g, or t
aaaacggcttattaataaaagaattattttagttaaaagcnnnnnnnnnnnnnnnnnnnnnnnnnnnnnnnaagag

SEQ ID NO: 5021 - DNA, 373 bp, Diabrotica virgifera
  misc_feature (10)..(36): n is a, c, g, or t
  misc_feature (52)..(69): n is a, c, g, or t
  misc_feature (146)..(169): n is a, c, g, or t
  misc_feature (192)..(212): n is a, c, g, or t
  misc_feature (310)..(362): n is a, c, g, or t
aagattaatnnnnnnnnnnnnnnnnnnnnnnnnnnncgtatttgtaagggcnnnnnnnnnnnnnnnnnnattgattagtattgagagagaataatttatttgtaaagaagtgttattcattttttgtaacatgtgtatcatggagnnnnnnnnnnnnnnnnnnnnnnnncaatatacgaatttataagaacnnnnnnnnnnnnnnnnnnnnngatttatagggatgaactaaaatttttttgttaagaaatgttaaacgtttatatatatatcaagattattaagttacatattatatttaatgattatnnnnnnnnnnnnnnnnnnnnnnnnnnnnnnnnnnnnnnnnnnnnnnnnnnnnngatgatcataa

SEQ ID NO: 5022 - DNA, 405 bp, Diabrotica virgifera
cccacgagtcaggtggtcaatgatattggcgaatgatgtgtaacagtatttcatgattttaacagactcataacatctggtgatgatgaagaatagctgttactgcagattgtcgacgctaatcgcaatcaagtccccactgagccaactaagaacgctgttctagaaagcatacagaattcatccatttccatcgtcaatatttagagacgtcatttttattatggtcttgtctagacaatgtacttaattttgagatggcttccaatgttaaataaacagatacattaagtttttgtatccgaacaggtgttgtgatttcttcaaatgtcgacaagcatattcacgtcttcagtcaatacacagttatgagcattgccatccaaataactttcggggttcata

SEQ ID NO: 5023 - DNA, 366 bp, Diabrotica virgifera
  misc_feature (43)..(109): n is a, c, g, or t
  misc_feature (111)..(126): n is a, c, g, or t
  misc_feature (161)..(187): n is a, c, g, or t
  misc_feature (195)..(250): n is a, c, g, or t
  misc_feature (254)..(283): n is a, c, g, or t
  misc_feature (304)..(336): n is a, c, g, or t
ccgggctttaccataatacaatattttttacgtaaaagtaacnnnnnnnnnnnnnnnnnnnnnnnnnnnnnnnnnnnnnnnnnnnnnnnnnnnnnnnnnnnnnnnnnnncnnnnnnnnnnnnnnnngtgctgtatcacggattattacttactcactatannnnnnnnnnnnnnnnnnnnnnnnnnnctacaaannnnnnnnnnnnnnnnnnnnnnnnnnnnnnnnnnnnnnnnnnnnnnnnnnnnnnnncacnnnnnnnnnnnnnnnnnnnnnnnnnnnnnncataaattaactttacttacnnnnnnnnnnnnnnnnnnnnnnnnnnnnnnnnntattaatattaactacttttagggatcagc

SEQ ID NO: 5024 - DNA, 385 bp, Diabrotica virgifera
aaacagagctccaaccggagacggaaggagcgcttttattagatcaaaaccaatcggaggcggtcacggaggcggaattggaggcggcatcggaggaggcggtatcggaggtggaatcggaggtggaatcggcggtggatccggcggtggtatttcatccagctacggcccacctggcaaatccggtccatactaattttcttactaagttacctctgcagtggttgccttccagtaactgctgcactacagtttgctgcaaaccacttcatccgctatttgtattttacccaacatagtattgtagattttaggacctaaactgagatgcgttcaattggaagattcgaggtaatcgttgtcgaaaggctgacatcaacccccc

SEQ ID NO: 5025 - DNA, 341 bp, Diabrotica virgifera
ggacaacgtagatgaccccataattgcgatcataagaagaatatggtgcatcttcagactgttaggatttatatgcggattatgaatacgccattgtctaacaggatgacactcgcgaatatgacgtagttgatagcgatgattcaataatagatgctgaagatgtccacgatgtagaggccgaagttgttgactcagctgaggatgatgccgcataattcagtgggtgccgtcaaaccctgtgaactttatttggccgactagctcagttcaaagtctcgagttaccttgcgtacatcagagctgcagtttcagttagtccttgttcactgtgccataca

SEQ ID NO: 5026 - DNA, 428 bp, Diabrotica virgifera
aacggagtcgtcggtcaaggcatgaggcgagagactctgaggtagatcaacgagaagagaggtgtaaaatcagttacagtatatattgaagtttccgattgaacaacatccttcatcgtgtgttacactatggtcgctcattgcttaagcataatggccacacatggaagtaaaccttgcagatatctctggtaaatttaagtcatgcgttgactacatcaaacttggctcaagacattactgcactctcgacagtaacgactgtggctagatgttccatagcaagcatcgatcgaattgcctcatgtgtactagcacgaatcgagtgaccatcctgtgttggcccacataatcatagttgccgtaataatacaagcatgcattaccactgatgagtcaattttagaattgttgaccccaagtgccca

SEQ ID NO: 5027 - DNA, 357 bp, Diabrotica virgifera
cgggccgacccaagcgtccaatcacgcctccgatcaaagcatccagtatagtctactgtgatttctattaaacattatataatacattttataggacatcgtgcaggacctcgttgacatctgcgctggccaatgtggtaccaaatttggggacatcatctgggaagtcaactctgacgaacacagcatcgactacaatggagactatgatggcgactctgacctccacattgtctactacaatgtcgactacagcgaagcctccgtaggccactacatcctcctcgacatcgtcgtcgatatgataccctcaatcatgtctgcactcttgtcagatctcttcagacaagtcatcat

SEQ ID NO: 5028 - DNA, 362 bp, Diabrotica virgifera
ttatgttaaaatcttaacataattcttagtccgtgtcaatccgtatattacttaccgagagtcaagtattattgcgtcagagtctttcatatgcatagaagtcaaatctatctttagtaccttgtgtctcagggcttactaattactaagtacctatttattactttcgaatttaattcagctaacaacttgatacttttattgtacgataaatcttttacgtaatttttttgtcatgacatgttacacgtgtttaaacatatcgaattttttatgaagtagctcatattcctcgagtaacaagatgttgaaaccaacgtacttgtcaaggagcattctgaaacatttttagggatgagctc

SEQ ID NO: 5029 - DNA, 321 bp, Diabrotica virgifera
aggacgcgtggggtggccgtcgaacctgttggtacattccaccaattgttcgttgtagtatgaattgatattccaccagttgaaaatgcggttatattcgaaaccatcaaacctgtgctcgtgaccaatgattgtagcatccttagtctcgattcagacaattcgagattcctcacggataaatgcaacattaacttcaacttcaggacggttgattgagccaacaacagtatttgccccatcagtacctatctagagaatcccttcttgaagatcagatgaccactaaccaaatcttgagccaaatcgacaagacaccaa

SEQ ID NO: 5030 - DNA, 272 bp, Diabrotica virgifera
gtacacgacatactgattacatgatctactgaggtactttctcagcacctgacaagtgcgatatatcagctgccgattctatgacagttgtgtgtaagcgggtagctacgacagaggttgtcaacgacgcgagagagttactgacgagtatcagcacttcagtcgtatggatgcagttttagtccactctcatccaggatgggaatatgtactcagtagcgatatgtgcatctaccagtatgctcggtggaaaaccagctattaccacagga

SEQ ID NO: 5031 - DNA, 210 bp, Diabrotica virgifera
  misc_feature (147)..(165): n is a, c, g, or t
cgggtcgaccaagcgtccaatttttacttagttgatgcgtgggagatattttttagtaaacgttgcgaaaaattttattaaatgatagtcagtcactatcgtgagagagtactttacttttagcgaggaacgatttactttttgtgnnnnnnnnnnnnnnnnnnngtaattagtaggtctacagttagtacttacgggctgagcagagct

SEQ ID NO: 5032 - DNA, 84 bp, Diabrotica virgifera
cgggtcgacgcaagcgtccagtggtcacctgtgatcactttagcttgggtcttttcagcgagatttttcagcactgtctctcga

SEQ ID NO: 5033 - DNA, 223 bp, Diabrotica virgifera
  misc_feature (8)..(128): n is a, c, g, or t
  misc_feature (130)..(222): n is a, c, g, or t
ctcatccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 5034 - DNA, 384 bp, Diabrotica virgifera
ttggtattcgtattacagcaaattgcttgttttctagtgtaatttgaattatcaaacttgaataattaacctgttatcttgacgttgttttatggttgttgatacatttcaattacctttggcattcatttataatacaaatgtcagtattaatataattagaagcattcagtattactataataacggatattttttcctttggaacgatcgcatcttttttttaatatccagcggataggaagttttggtatcaaaggcctcttatctttcttcggcagtacttcatcccttagtgcaccataataaatcctcagcggagtaagaaatattatgttctctagattctagatagtatgttacttgacttgtctgtaaaaatgt

SEQ ID NO: 5035 - DNA, 182 bp, Diabrotica virgifera
  misc_feature (11)..(29): n is a, c, g, or t
  misc_feature (37)..(56): n is a, c, g, or t
  misc_feature (90)..(118): n is a, c, g, or t
acccaagcgtnnnnnnnnnnnnnnnnnnnttcgtggnnnnnnnnnnnnnnnnnnnngttatggtgatattattagtattgtgagattgtnnnnnnnnnnnnnnnnnnnnnnnnnnnnnttgggattcgtgagtatttttgacacctgtttagtaattacatgtctattagtttcaaatttaa

SEQ ID NO: 5036 - DNA, 186 bp, Diabrotica virgifera
aatcgctcccccagaaaggaactactccgtctggatcggtggatccatcttggccacactctccaccttcgaacagatgtggatcaccaaacacgaataggacgactccggcccaggaattgtccaccgcatgtgcctctaagccatttaagcgtttcacacctagtaagctatttgtcatgttgt

SEQ ID NO: 5037 - DNA, 161 bp, Diabrotica virgifera
tacctatattcacatggaaaagcgcctttcgaatctactatactgcacgcagacgaaataaatatgttggtggcaacttttattacatttaaagccactaatttggctttggactctcaaattgcatcgatctatagctgtttaaacaatgaatatggggg

SEQ ID NO: 5038 - DNA, 80 bp, Diabrotica virgifera
cgggtcgaccaagcgtccacagtctggcacctcccactgtctagacttatggcacagtttctgtagtggttactttcaat

SEQ ID NO: 5039 - DNA, 215 bp, Diabrotica virgifera
gaaatcccaaagatgcctctatccccggtatgttacacaccggttatctttaattatgtgtgtcatttttgaccatgttgggtacagttctttgtagttttgaaacttgttgtttctaagaaaaacgtctaagacttctacgaaagaacttcatggttcagatagatcctggctcattgtattcttaaacattgtcaaacttggcaaaattcaaa

SEQ ID NO: 5040 - DNA, 376 bp, Diabrotica virgifera
  misc_feature (341)..(341): n is a, c, g, or t
acaacagcgtagtccacaaacttcaagtgactcagtgagctatggaacggagaatgctcaacattattgatggcaaatccaatgaagaaataagaaaaggcgatcaaaaataccagatgcgatccagaagattaccatgttaaattggaactgggcaggacacacaggaagactggaaaacaaccgttggatgaagcgaattcttgaatggcgaacaagggcaagtaagaaaagtagaggcagacctcaaaccagatggactgatgacatcaagctaatggctggccacgaatggcaacattttatttctgttcccaattcagattcaatgtcatctatanggcatcaacatcttcatagagttaagagaactgac

SEQ ID NO: 5041 - DNA, 102 bp, Diabrotica virgifera
tccacacaagcgtcgtccaacgcgtccgccacagccggtcagcaattgtgagcagccagctattcagcattgctttgtaaaattgctgagaagctaccggca

SEQ ID NO: 5042 - DNA, 53 bp, Diabrotica virgifera
tcatttgaaaacatggccaatctctttaacgttattgttgctcaagcgtccgg

SEQ ID NO: 5043 - DNA, 154 bp, Diabrotica virgifera
  misc_feature (19)..(50): n is a, c, g, or t
  misc_feature (58)..(86): n is a, c, g, or t
  misc_feature (89)..(117): n is a, c, g, or t
gaccctgggtatcaaggannnnnnnnnnnnnnnnnnnnnnnnnnnnnnnnccaatttnnnnnnnnnnnnnnnnnnnnnnnnnnnnnggnnnnnnnnnnnnnnnnnnnnnnnnnnnnnaatgaaatggtaatccgttttaaatataaccaaattt

SEQ ID NO: 5044 - DNA, 248 bp, Diabrotica virgifera
  misc_feature (13)..(60): n is a, c, g, or t
  misc_feature (69)..(129): n is a, c, g, or t
  misc_feature (133)..(240): n is a, c, g, or t
ttaataacaatannnnnnnnnnnnnnnnnnnnnnnnnnnnnnnnnnnnnnnnnnnnnnnngatgagctnnnnnnnnnnnnnnnnnnnnnnnnnnnnnnnnnnnnnnnnnnnnnnnnnnnnnnnnnnnnngagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatagtatt

SEQ ID NO: 5045 - DNA, 310 bp, Diabrotica virgifera
  misc_feature (9)..(309): n is a, c, g, or t
cgtccgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnc

SEQ ID NO: 5046 - DNA, 302 bp, Diabrotica virgifera
  misc_feature (13)..(87): n is a, c, g, or t
  misc_feature (93)..(121): n is a, c, g, or t
  misc_feature (123)..(143): n is a, c, g, or t
  misc_feature (145)..(184): n is a, c, g, or t
  misc_feature (207)..(249): n is a, c, g, or t
  misc_feature (286)..(301): n is a, c, g, or t
ttaataatttccnnnnnnnnnnnnnnnnnnnnnnnnnnnnnnnnnnnnnnnnnnnnnnnnnnnnnnnnnnnnnnnnnnnnnnnnnnngtatcnnnnnnnnnnnnnnnnnnnnnnnnnnnnngnnnnnnnnnnnnnnnnnnnnncnnnnnnnnnnnnnnnnnnnnnnnnnnnnnnnnnnnnnnnngataattttaaggatgagcttannnnnnnnnnnnnnnnnnnnnnnnnnnnnnnnnnnnnnnnnnnggatagaaattttcatattttaacatatgttattagnnnnnnnnnnnnnnnng

SEQ ID NO: 5047 - DNA, 168 bp, Diabrotica virgifera
tcaaaaatagcaaaaactccttggctcatatcgttgatgactggatacagagctataaactgaatctaaaagctggactgatatctcttatggagttctttataaaagcttctgggtgtaaaggtcgtattacccagcagatgcaaggctctatgggacatgctggga

SEQ ID NO: 5048 - DNA, 87 bp, Diabrotica virgifera
  misc_feature (56)..(73): n is a, c, g, or t
ataaaccaagttaggtggaatggttaagcacttggggttaaacactaatttaaaannnnnnnnnnnnnnnnnntttaatgaaaaatg

SEQ ID NO: 5049 - DNA, 397 bp, Diabrotica virgifera
  misc_feature (243)..(255): n is a, c, g, or t
  misc_feature (257)..(276): n is a, c, g, or t
cggggccaccacgcgtccggatctattcaataaatgtaaatataagaaattgtacttacaaattattctgcttgttttcttgactcactttctgtacaatttcactttgtcagtttatggtttctttggcgctttaaaagctttttaattatagctgtaataatcacaaaacttgataaaagttacgagcactcataaacacgtcttaccaattcaattagagatgggacatgatgtgataannnnnnnnnnnnncnnnnnnnnnnnnnnnnnnnngttggtcaaagctgtggtatatatttttaccttaaatatacttttttactgttccgtaatatgtaattataaattattctaataatcttagcgccatctacacgataattgtgaaagtatc

SEQ ID NO: 5050 - DNA, 292 bp, Diabrotica virgifera
tggatggcattggggcgtcctcttcatttgtcgattgatactaagaatgggccgtgcactgatttatccatcgcgccaaatcatactagctttctgagctcatctccatgaaaaaggaaactttgtcattgctcttagtggcaacgttttacgaaactgcgttacttggccattggtgatattggtcacaccatatttgggatggcattggggacattacctactgaatttggtaactgtacttttctgtgcagtattcttcctagtggtcacagatacacctgaagctcac

SEQ ID NO: 5051 - DNA, 413 bp, Diabrotica virgifera
aaaaatatggctacaatcttaggaaacgaatggcatatatcttccaaaggaaacgaaattttaacgggaaatgtatcgacgggggataaacaacagatttataactttgctttaaatacagatctaaaagaaatatgtagcccaattgttaactcttttccaattgatgcgacatcgaatgtagtgctccagattcacaagatccgaaacatttctgcacccaaagctaatgaagattcccaagcagctcctcggatgctcaagataactctaacagatggagaaaactatattcaagctttagaacttacaacaattagcacaataaattataaaacaactccacctggaacgaagctgttagttcaaggagctaaacttacatctggtttcctgttactaaatccacaaaa

SEQ ID NO: 5052 - DNA, 370 bp, Diabrotica virgifera
  misc_feature (39)..(53): n is a, c, g, or t
tcctcaatctgaatcggtggattcatcaaggtatcactnnnnnnnnnnnnnnncaggtggttgtacagaagaagacttactaaaaccgcacagccaagtgaccacagactttccatctaaactacatgcactaatgataacaattcctaaacgtgacaagtcgaatgtgacggatatagatcagtacatcgcacaactgaaatacaaccataggagtaacacagatcacaacttggaggatgtaatatatgctcagaacagctcaattataggacggacaatggtgctaatcaaagtgagatgacggaaaatcaaacagtacagaatggaattaatagtagacgtatatctccagcgcagaaaccacgaa

SEQ ID NO: 5053 - DNA, 375 bp, Diabrotica virgifera
cacgcgtcaggatgacacattgatcgtctatcacgtcgctcaggacccccatgggccaaaagctagtcaggagtcacgggacctccaagaatttccgggctaaccgggaacatcacttcaaggacctctaagtcgtccagggtcaacaggagacagttgagataagtgagactcaagatgatactgggcctgcaggacttataggacctccaactattgccggagacctcactggtatatctctgacactagaatgggatatgaaaggcgtacacaagagactcgaagtacaatatacggacatcgcgacagggaaacggtatgggacatttttctaccggagaattgcatatgggacctccatcagcacctgat

SEQ ID NO: 5054 - DNA, 277 bp, Diabrotica virgifera
  misc_feature (8)..(30): n is a, c, g, or t
  misc_feature (177)..(266): n is a, c, g, or t
gcgtccgnnnnnnnnnnnnnnnnnnnnnnngtggtactttaattacagtttccgcttatgcctgattaaacaatgtgaatcggtttatgaattaatttaatgagatctagccccctaatgaaatctcataataatatttttcccggcgaatgcactcttaaaaattttattactcannnnnnnnnnnnnnnnnnnnnnnnnnnnnnnnnnnnnnnnnnnnnnnnnnnnnnnnnnnnnnnnnnnnnnnnnnnnnnnnnnnnnnnnnntttaatcctaa

SEQ ID NO: 5055 - DNA, 412 bp, Diabrotica virgifera
agcggtattgcaccttcaaaggtttacaattatggaccaattccgaagggttgcgttcgagtaaaaatgtggattgataagagtatatccttctcagatccattgcatattctgaggcaactgtcacagcaaaattcatgtctaaggacgaaaagttggacggttttagatgttaagaacaatccaaagacgggctctatattcctcctacagttaagacaggagcatctcactgttttacggagcttcaacatggcaccctgtattcagaagaaaaaaactttatttaaagttctacaacctggagaggaattaaactatttttagaggaattgatgtccaacttcttcaaatagatgtctcgacttcaagataaaataatgatttttctttataagaattttattgtacg

SEQ ID NO: 5056 - DNA, 338 bp, Diabrotica virgifera
  misc_feature (86)..(101): n is a, c, g, or t
  misc_feature (103)..(121): n is a, c, g, or t
aaatgtacaaaattgttatcttcaatgatcagttaattagttaatcgatgatcacgaatattcttagttatttcatcattgaaagnnnnnnnnnnnnnnnncnnnnnnnnnnnnnnnnnnncttaataggtatacatttatgactttcgagtttaaaacatctacaagattacaatttttactgtaaaccattcatttcaactaatttttgatgaacgaaatgttaatgcctttttaatagatatcgaaattcttaagaaatacattagtatttaattattaacactctatctatcaatcaatatttttacaggatcaacatccaatatttttaggga

SEQ ID NO: 5057 - DNA, 379 bp, Diabrotica virgifera
  misc_feature (34)..(54): n is a, c, g, or t
  misc_feature (76)..(94): n is a, c, g, or t
  misc_feature (96)..(119): n is a, c, g, or t
  misc_feature (307)..(324): n is a, c, g, or t
  misc_feature (334)..(352): n is a, c, g, or t
ccgggcagacccacacgtccactttatcttccgnnnnnnnnnnnnnnnnnnnnntcagtaaagacaaattttatcnnnnnnnnnnnnnnnnnnngnnnnnnnnnnnnnnnnnnnnnnnnaaagtgacagatttagtttttgtaacctgtgtatcagggatgattacttagtgggtatacatatatgactttcgagtttaaaacatctacagcattacgatgtttactgtaaaccatacatttcagctaattattgatgacgcattggttattcgtctgtaatggattcgaaattcttaagaaatacnnnnnnnnnnnnnnnnnnccctctatcnnnnnnnnnnnnnnnnnnnagtatcaacatcaaatttgtttaggga

SEQ ID NO: 5058 - DNA, 431 bp, Diabrotica virgifera
  misc_feature (154)..(154): n is a, c, g, or t
gcacgcgtccacctaaatgtgctgtctatatttttaattttacaatcttcatatggtgatgattataccaaagaataccctaatgataccgaagatgtccaaggccctccagaagtcaccttgactacgcctaagcgggtactagtccatctangccagaatctgaatatcaactgcagcgccactggcgctcaacctatggaaatcggatggaaagcttggaaacgtgacatgcctagttcagtttacaccaataaaggatacattaagttcaacaatatccaatccgaacatgccggtatatattggtgcatggctaccaatccagctggtaccggaggtgctatagctgaggtcatcatagaaaataactaattgtcctcaaaaagtaaatgtgtataatatacaataaaatataaatttacctacat

SEQ ID NO: 5059 - DNA, 400 bp, Diabrotica virgifera
  misc_feature (236)..(309): n is a, c, g, or t
gacccacgcgtcagcaaatatcagccaatatcactcacagacacttgacgaaaattatgtcttagtttattggagtgcaacgtagtgggacacaacaatgctccagtgaatttgcacacatatccttaaatcctgatgtgtattacagacattcagttgatggcccttcgtcgtcaactcctagtaaggatgaggttccctgtgcagacagaactacaattactacacgtcgcgannnnnnnnnnnnnnnnnnnnnnnnnnnnnnnnnnnnnnnnnnnnnnnnnnnnnnnnnnnnnnnnnnnnnnnnnntaccttatcacatcaacgcatcatagacagtttacgcttatgacattacaagagattatccggtgtggaatattatcagagcatagatgac

SEQ ID NO: 5060 - DNA, 190 bp, Diabrotica virgifera
tcttagcttgcttcatccctctcttatattatcatactctgtagtgcttctaacaaggttggtcgttcgcggatgacgagtgtacacgtctccgtcgttaattactgctcacgggggtcgatcagtgacctttcctggctacagattatgttcgactttaactgctcgaggttaacgtgcgattacattt

SEQ ID NO: 5061 - DNA, 402 bp, Diabrotica virgifera
  misc_feature (82)..(129): n is a, c, g, or t
ttaagtttactaatggtatattttttatccgaaattggttcatttcttccaaaaattaattaaaatgagtttaaaaattacnnnnnnnnnnnnnnnnnnnnnnnnnnnnnnnnnnnnnnnnnnnnnnnncaactatcactgagaaattgatagtttttggccttttatatgttgcgatgatacatatatttaacaatttgaaatactaggatcttggagcttccacaattcgaacattttaacgttatttttggacctgtgaatctatggtgttgtaaagtctagaactaacattataccacgcataacaatttatgtactttatattaatttaccgaaatcacccctatgttaccaaaacatatttgcttattaaataaaaattgtaggttaacgaaaaat

SEQ ID NO: 5062 - DNA, 572 bp, Diabrotica virgifera
cccaagcgtccgctaatatttatttgggttttgaatgtaattattttatatttggagctcaacaggccctaaaggcccaaggcttgaaatttctccacgcttttcctccattttctcctgtccatggccgcagttctccaatttgttatcccgatgtccaggtctttcttacacgcttctagccactttcttcttggtcttcctcttctccctctaaattatatcttatacgtacacggctttaagaccaacgtcaaggtccacccctcggagacctgatttttctcagtgttatggaaatttatcggattctaaattttaaaactttttaaattcaataatattttggaacgttaggtccaacctcaatcttttaaaagacctattatcatttccattttttatgattttcactgtacaggttaaccatatgatattgtaaggataataattacagtatataaatatctactccttaattttttacactctccatgcactacggccactctttttttcagtagacacgactgtttgtagttgatacattgcttgtgattggtcaaaaattg

SEQ ID NO: 5063 - DNA, 359 bp, Diabrotica virgifera
accacgcgtacgctttagtgagtcagacatttcttctacatgtctagcattgattcatccatgaaacgcacagtagatgttgctttttgccgtatttttacggacaatttcgcagtttcttcggatactatcacggactcttgtgatgaccccaaggctcactacggctgtgaatcaccctgtatagcaacatgcaacgatcggcaaattgcaaaatgtgcatcacactgcatcaatggttggttttgtaactaacattatagtctaagttgatgacaatgaaaatgtgttttggtaaaacaatgttatcctcactaagagctattttatgagacacagtactgggaatctttttttcg

SEQ ID NO: 5064 - DNA, 352 bp, Diabrotica virgifera
accacgcgtacgtccaaccgttcaatctatgcttgagactgtgctcctgaattatttcttccactaaaaatggcgcaattgatggcattgttggcaattttggcggtatgtattgccgtaattacagctgtatgcgcaacttactgcgacaattgcagcgacgaagcctgcaaagaaaatgtaaaagttatgtatggtgttacctctgagaaacctgctgaatcagtttggcaaaccgtttgacaaaaaagtaaagtaggcagcgaagatagcaaagaacacagtgactaagcatgtagctatggtcacgatcactgtcacgcacactgtctcacatctaaagtcactgctg

SEQ ID NO: 5065 - DNA, 197 bp, Diabrotica virgifera
acaaagagagaggccaggacgcagactcccctttagtcgatcagtactgcacgctgcggaggatatcgcgtccgcgaaacacatgagcacccctctggcgtaacaaatccggtgcgagtgatcatcataatgatggcagcttatataagttacgccatggacataaactccttaagcgctgctcccagggggccgca

SEQ ID NO: 5066 - DNA, 354 bp, Diabrotica virgifera
acacacgcgtccaccagcttgccggagttgtggccgtcgaggtcaccggtgggcctgagatccccttccaccccggcagggaggacaagcctcagccgccacctgagggccgtcttcctgatgccaccaatggttctgaccacctgaggcaagtctttggcaaccagatgggtttgagtgatcaggacattgttgccctctctggtggccacaccttgggaaggtgccacacaaagcggtctggttttgagggggcctggactacgaaccctttggtctttgacaactcttacttcaaggaacttctgagtggcgacacggagggtcttcttcagctcccaagtgacaaagccc

SEQ ID NO: 5067 - DNA, 393 bp, Diabrotica virgifera
  misc_feature (97)..(115): n is a, c, g, or t
  misc_feature (262)..(294): n is a, c, g, or t
atattactgttttgtagtaccaagtatcaaaacaaaatcatttgtttaaattgtgtttttgtgttgaataatttccaaaacagaaagcgaaacatcnnnnnnnnnnnnnnnnnnnctgaaatgacacaagaaaggggtttcagaacaaaattatgataatcaatagtcttgtatcttcagcaaagggttgaagagattaacagaatcacatatttttatcagaatttagccaaaacgataaaatctctaggaacttgtctgnnnnnnnnnnnnnnnnnnnnnnnnnnnnnnnnnctgctgatctatacataataatttaattttcctttgttcgcctacatatccttgtgaaggataatgtaatattaaatttaaaggtgtaaggtgtaaaaa

SEQ ID NO: 5068 - DNA, 376 bp, Diabrotica virgifera
  misc_feature (3)..(29): n is a, c, g, or t
  misc_feature (181)..(211): n is a, c, g, or t
aannnnnnnnnnnnnnnnnnnnnnnnnnnatgccgtactgcatatatgcactaaaaaaaataaatggcaatttaaaacaaatatgctgaactgaaaaattgtgcatactgcagccgatctacagatacgtcaccaatataatcttttgcaacatttttttgcaataaaccgtcagcaaacnnnnnnnnnnnnnnnnnnnnnnnnnnnnnnnttgaatgaactgaaattaattctaaaaaaggctgacgtgactaatagttttgatctccaaatgacgtgaaatgataacaattatttgatactctttatgttttaataaaagttttaccaacattttgggcttaactaaaaaggtctagcctctttataattatag

SEQ ID NO: 5069 - DNA, 314 bp, Diabrotica virgifera
ccgggtcgactacgcgtccgctttatttgatgcattgcctgataaaggtgttttaaacagacctggtgctatagtaaccacacggatcccttggctcgccaaatctctagctaaaggcatactcataccagctatagctcccttactagcagaatatgctacctgacccatttgaccgtcatatgctgctacactagctgtatttacgatgactcttctacagccgtattgatctgggtcaatttgcccgagaggtcatacggacattccaaaaatcttgaatgtgccaatggtgtttacctgtaattatttgg

SEQ ID NO: 5070 - DNA, 655 bp, Diabrotica virgifera
  misc_feature (70)..(87): n is a, c, g, or t
  misc_feature (644)..(644): n is a, c, g, or t
gaaagtgctgaagtgacaagtgtcttcacatgtgcgacaacaaatgtgctaaattctgaagattttggannnnnnnnnnnnnnnnnnctccttaaggtccaccatgtactcgaagataaacaatggcgataaaagtaacatatttacaagaactaacagtatttgtcctcctcccgaagaagtacttctggatcgtgttctaacaaacgaaacagaccaattggagacgatagtcaacgagaaacttctaaaatatctatatcccgaccacagtaaacccatcctgttgatagcatgtacagcgaaggaagtggaggcaagaacagtcaagttgttaatagacttaggagcagatgtacggtaccaagacgaaaatcaatgggaggctcttcattatgccgctgaaagagctgactactttgtccttaaagttattatagacaaattaaaagagagaaaattccatttgaatgaagttttagcacaaggtagtaatgctttacatatacttattagacatggtaataaaaactccaaagattttgtcaaatgtgctaagcttttaatagatgaaggaataaatgtaaatttggcagataacaaaatgattactcctatcctttgggcagctaagaaagacttanacgatatcatc

SEQ ID NO: 5071 - DNA, 314 bp, Diabrotica virgifera
  misc_feature (60)..(60): n is a, c, g, or t
  misc_feature (83)..(83): n is a, c, g, or t
  misc_feature (145)..(145): n is a, c, g, or t
cgcgtaaggtcaactgttttgtctggcgtctccgcgttcgttttgcccgttcctgccttnctcgtcgtctgtggtggttctcncgctggtctgtcgctggctgtgctggcgttcctgctccgtccgtctgtggctgccttcttcnctgtcgccgtggacatgcgatgcgaggtctagtatcacctcatgaacgtcaacatggatcaattcggttttggcgctactggtggaagttattaaaggggttttgcctcgaagatcctcattaacaatgttgggctcgaactcatccagggtgccatctccaatgctgg

SEQ ID NO: 5072 - DNA, 398 bp, Diabrotica virgifera
  misc_feature (298)..(298): n is a, c, g, or t
acccacgcgtacgtcataattgaatactagtttgctgtagtgacacaaaatggattggctaaggatcagtttattatgtatatgtatattcaacatctatggtgcaccacatggagagaaagaagttagaattattagtcaaaccaacgaaatcgcccctgacgggggatatagctggagttttcaagctgataatggcataaaagctgaagaaacaggtaccttaatgaaaaccaacgatccagaaaatcctcaagttatcactgctcagggaaattattaatacactgacaatganggtaacaaaatatcactcacatatgttgctgatgatgacggcggtttccaaccacaacgagcccatttaccaacctctccccctattcctccaaatatac

SEQ ID NO: 5073 - DNA, 334 bp, Diabrotica virgifera
agacatgttatggataatcctgaggatttgattaggtggattgatgagaatgaataagctggtgttactcaaattctaacatatttacagagcgtgcatgtgaactcatgtgcagccgtcgctgctcttgatgtacgatcctaatgatgatactagttccgtgacatcttaacttcactgttagcaatcacagcccatctgatatagaaattgaggttgcatacactgacagtgatcagcgtgctaatgatcagtataaggtaatcctaccaaatgagactgtcaaacttgatcatgataccaatactggtgtaactactgttaatatattgag

SEQ ID NO: 5074 - DNA, 431 bp, Diabrotica virgifera
  misc_feature (27)..(27): n is a, c, g, or t
  misc_feature (104)..(124): n is a, c, g, or t
accacgcgtccgggttgccaacttggnaaatggaaaccgatgaatctcatttaaaaattgattatgtgaaggtgtgggcgctgtgaaaaaaacattttcttggnnnnnnnnnnnnnnnnnnnnnccacaaaacttcactatatcgttatggtaggggagcaaagtacgctaaatttgcagtcactcaaacgttatgggaaacaaatagggttgtaataataggtcctaaaatcaaaaacagttaagtaaaattttcgtaattttagggggcgctttccattttttaatttaactttccatttctaacaatcgttttttccaattatagcgccatctatccataattcgaaaaaatatctcgaataaaagtggcttatttttacgtcccatttaagattttaaagtaaccccccaacccaactccgtggggg

SEQ ID NO: 5075 - DNA, 424 bp, Diabrotica virgifera
  misc_feature (12)..(29): n is a, c, g, or t
aaattgtcaatnnnnnnnnnnnnnnnnnntaacctgtgatggagccccaggcactcacaggagatattcttacattcaatataaaggaggtagaacactgggccaaagaggcagctgtgctagacggaccgtggatagttggtggagatggttcgttcactgctcatactgcttatgttattgcgatgaaccaggtcttaactcggatagatactttagtttacgaccttctatagccgatgtaaacaataactgggtggtaactgggatgcgatttgtcaaacgaaatcgcatgattcatattcaaattcagcagggcgtgttattgccctacggatatattaaccaagacagcgtacattggaagccggtagatgacttttcgatacagtcttggggtgctgttgaaggtgaagattaccat

SEQ ID NO: 5076 - DNA, 146 bp, Diabrotica virgifera
gaccgacgcgtccaaggacgcatgggaagagcatgtgttgtaatatgttcaaatgacaatttctctcattccttatttacaaaaataaggaatgagagaaattgtcatttgaacatattacaacacatgctcttcccacgcgtccg

SEQ ID NO: 5077 - DNA, 441 bp, Diabrotica virgifera
  misc_feature (313)..(327): n is a, c, g, or t
attctagggtcgacgacgcgtccatcttcaaatcctatacaattgggacaatactctgtcgatgttgagggaggaattgttcagcgccgttaccaatctctacgagtacaatccggacagcattcataaaattgtcattgagaggtctttggtgaccaaggcaatgaactgtcatttgcgaccgcagaaaaaacgagaaaaatcgacgaagaagtgtccggtttgtgtctctaataattgtttgaagaggtatgagttaaaattgtttaatatgacacaaaggacggagacgttcgaagagatgtcgttgaannnnnnnnnnnnnnngacgtacccagaaatcgtcatgcaatcattacacaacatcctaaaactacaaaatgcaaatcaagaattcattaaagatggctggacacaaattaatatgaataacaccatgaa

SEQ ID NO: 5078 - DNA, 216 bp, Diabrotica virgifera
gtccatgcagtagctgcagtaatgaataccgttagcgtatttgcagctggatggcattgggggcgtcctcctccttttgtccgattactaactaggaaatgggcggggccactggtttaaccaacggtccaaatcctaataaccttccggggtccctcttcagaaaaaaggaaattttgtaattgccctaagggccacctttttaggaacttcctt

SEQ ID NO: 5079 - DNA, 200 bp, Diabrotica virgifera
taagttaatgataaatatattttatgtagagtaaaacacaaatttcaccatgcaagtggcccccgtaattaacgataagtccctggaagaccaggcccaagaactcaaggtgtaattaaaaagtcttggggctgaaatttctgaagaaaagttccccaaaggtataaaacacgatttacattaaattaatggggtaggtg

SEQ ID NO: 5080 - DNA, 141 bp, Diabrotica virgifera
cggttcaaaataattttgcctgtgcgcctcccctaagtctgttaaacacaagcgaatcccaaagggggttgccactaagaccaaaaaaggaactccccggaaaggcaaagcaaattccaagtttccctttttggaacaact

SEQ ID NO: 5081 - DNA, 280 bp, Diabrotica virgifera
  misc_feature (109)..(130): n is a, c, g, or t
  misc_feature (139)..(153): n is a, c, g, or t
  misc_feature (155)..(167): n is a, c, g, or t
atttgtactctattagcgatattctattatttttttagagcaatggccgccaaccaagaaagaacttttataatgatcaaacccgacggtgtccaaaggggccttgttnnnnnnnnnnnnnnnnnnnnnnaacagaaannnnnnnnnnnnnnngnnnnnnnnnnnnngtggccttctgaagaacttttgaagaaacactacgctgacttagctggcaaacctttcttcgcaggtctagtaaagtacatgagctctggcccagtagtgccaatggtatggg

SEQ ID NO: 5082 - DNA, 146 bp, Diabrotica virgifera
ccaaacgtccgaatgttgcgccttaagtgaatgtgaagttaaagtgccaccaagaaagtattttaaataggtacctacaaattaacgagtgttcaataaaattgaaaaaatgccaacggtttaacgtgactacagttacgaagaac

SEQ ID NO: 5083 - DNA, 199 bp, Diabrotica virgifera
  misc_feature (10)..(126): n is a, c, g, or t
  misc_feature (128)..(196): n is a, c, g, or t
ttaaaataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnngtg

SEQ ID NO: 5084 - DNA, 210 bp, Diabrotica virgifera
aaaatatcagctaatatcactcacagacatttgactattattatgtcatagattatgtgtgcaagtgtgggacataaaatgttccatagatttgccactttaccctaaaatcctgatgatgaatacagacgttcagttgatggaccttcgtcgtcaattcctggtaatgatgaggttcactgtgcagtcagaacttcaattactgcacgt

SEQ ID NO: 5085 - DNA, 160 bp, Diabrotica virgifera
cggggccacccacgcgtccggacatctgcagacgtaatagatggcttcattatctaccataaaggcactttattaaaggtaaagggcttagcattgcgacacacatatcttctcttatattcgaaggagttctatttggtgccttgtctctcatggatta

SEQ ID NO: 5086 - DNA, 359 bp, Diabrotica virgifera
tgtactttttgagtgaaaacttgttcccccaaaacctttgaggtgacacaagttacttcttactcgattaaatggagatggattccacagaaagaggtctcagccttgatcagaacctttcaatgggggcattgggtcctcaatcgccattggaaatcaaaccggacgcctctactctaaaccaattcagtccgcaaggaccaaacagtcctggatctttttctttaggtcatgcaaatttgctgagtccatcggctggatcgcaaaaaagcgaattctccttacccacccaatcatccacttaccgggtcgaaacatccttgctcgatatgtggtgataaggctactgggaaacatta

SEQ ID NO: 5087 - DNA, 242 bp, Diabrotica virgifera
  misc_feature (37)..(51): n is a, c, g, or t
actatattatcgttcaacggtgccgtgaattttgctnnnnnnnnnnnnnnngcatactgcagatctctcgatttcacatgctaacttatgcagccacttgaaatgtttcaacaaactccaagctgtaatagctacatacagccagaggtgtgccgatgcagcgatcctcactctgttgaggtcgtcagaaattgctacaaagtacatatctgcggtaacgtatgtcgcagatcgcacaattt

SEQ ID NO: 5088 - DNA, 268 bp, Diabrotica virgifera
ccacgcgaacaaaatatcgtcatcttgtgcgaaattgcctacaaaatcatccgttccagttatcaacccacaagggaaaaaacccccaatttgggggaaaagtctaaattttcagaatgttgcattgaacattgtgaatgactgtttccatcctaatgacaacaatcatccaaatgtttcaaactttgaaaattatttgaaagacatgattaagatttatggcacaacatgcaaacttggtgctggcaacagtggtcaacaatcagtt

SEQ ID NO: 5089 - DNA, 446 bp, Diabrotica virgifera
attcatctttactgttgtacttgttcgatagcttatggctgagttaaattaatgatatgggtagctactgtaagtgggcctttttatactgaaatattttataatgtaactactattcacttttttgaatggttgattttctttaaatacttttcataaatctttgacattattacattttgctggccccttttaaacaaaaaagtcaaagagtgtggattaaatgtgggaaccattgtatcattatacaagaaagacagtttttaatataataaaacgatttgcaagtaatgctaaaatactgattaagcgaattactcatttttggttaatagatatgaatgctttggttcattaattttattatagcatattaataaaccaaaattacattatatgatacatatggaatattttgatattggatatataaaaatatgaaatat

SEQ ID NO: 5090 - DNA, 333 bp, Diabrotica virgifera
  misc_feature (13)..(60): n is a, c, g, or t
  misc_feature (84)..(124): n is a, c, g, or t
  misc_feature (220)..(239): n is a, c, g, or t
acaagacttcggnnnnnnnnnnnnnnnnnnnnnnnnnnnnnnnnnnnnnnnnnnnnnnnnttagttaatgaaagattattgtgnnnnnnnnnnnnnnnnnnnnnnnnnnnnnnnnnnnnnnnnngttctggtgcctcagggaccaggaattattaattataacatttacattaacaatttccgaattaacaaaacctaaaaatttataatgttaaagggnnnnnnnnnnnnnnnnnnnngtttttggtagtgaaacgttatccgttataactaaatcccaatttttaagaaaacaattaaattttattaataaccatatcattaagaattaat

SEQ ID NO: 5091 - DNA, 345 bp, Diabrotica virgifera
aagcacttcggctcatattttggtttttggtgcggtaatactaagtgttttcaaattgcttgtttattgattgttattcatgactacgctgacgagatgccagggatcatcaatgctttcatcgtgccatcgatcttttgcgtcaccgcattggactcgcagtacagctgttatcatgactcatttaccgcaagtgatccagctgctgcaaggagtgttgactgattgaataagtgttatgcagtattcggtggtagatattcagcacaatccgatcatcaaaaattcttcaatcatatcttcaccagatcctttgtatacctgcttcaggctaccaggatcgac

SEQ ID NO: 5092 - DNA, 464 bp, Diabrotica virgifera
  misc_feature (214)..(246): n is a, c, g, or t
ggtcgacgcccgcgtccgaccacacgtccgccgaaggaaaactattgactgccaaacagaaggctgatagggctagggctcaagcattaatagatagtttgaaagcacaaggtgtacaattacctgatgtaggcgagaagaaaccaactagactgggaacgaggataaggccgaataagcagaagaaagagcaaactccagttcccaaacctgnnnnnnnnnnnnnnnnnnnnnnnnnnnnnnnnnctcccaaagaagaagttgttgtaccaccagtagaaacaaaagaaccagaaccagaagatgatgtcaaagacgcttgggatgcatcgtccgaagaggatgaggaatctcaagaaactgatgttaaaccacaggaatcaagaaaaacaatctgagtccaaaggaagcacatgacgaataggaaagcagctctgacgatgaagacgaatcagacagtgacg

SEQ ID NO: 5093 - DNA, 229 bp, Diabrotica virgifera
cgcacgcgtaggagtgtctacggtttgacgtatcggagaaggtcctaacagttgaggataatgaagtatcttgcagtttttgtgatttttgcgtacttatacacagctcatgttagtgtgtatttagaagagaagttcaggtgatgattcgtgggaaatgaattgggtatacagcatggacccagatgggcatgttggcaggtttgttaggacagcgtggaagttcttt

SEQ ID NO: 5094 - DNA, 418 bp, Diabrotica virgifera
  misc_feature (290)..(315): n is a, c, g, or t
accacgcgtccgggaacaaataatccgtcagttcaagaaaatttattaaattcttaaaatttaacgcttgaaacagcaatagagatatgcagaaactctgaaataacaaaaaggcaattcgaatctgtaagaaacaatgaaagtttggaagtaaatgcagtaaaaaataaacaaagtgagttgaaatttctgtgtaaaaattgcaaacgtaaacatgtagctgcccagtgcccagcgtctggaaaaaatttctttgtatatggtggagcaaatcactttagtaatgcttnnnnnnnnnnnnnnnnnnnnnnnnnnagatataaaaggcaaagtgttaaaaaaagttcaagaaattagaagacatgacaagaatattgatggagatggctattcaacagatgatgacgtacctgtgcat

SEQ ID NO: 5095 - DNA, 383 bp, Diabrotica virgifera
  misc_feature (82)..(108): n is a, c, g, or t
  misc_feature (366)..(366): n is a, c, g, or t
ccgttttggggactggggacaacgaacgacgacaaccatcccttttttccaattttttaggttaaattggggtaaataaacnnnnnnnnnnnnnnnnnnnnnnnnnnngtaaaaagacaagttcctgagaaaagctgtaaggtagaaacagataataatgaggtgaatctattagatacctttaaagttgaggataaagaagaaccaaaaacagaaattatatacatgtatgatacatttgattatttagacaaggaaatcctcataaaggctgaaatagaaaaagatgaccttagcttttctccatttgaggaaaaacaaagtcaaaaagaacttcaagaatacaattgctgtacaggaacgtcncaacaatacattggtga

SEQ ID NO: 5096 - DNA, 396 bp, Diabrotica virgifera
  misc_feature (216)..(216): n is a, c, g, or t
acattatagaaatttaaagcaggctttatccaacggattaattttaactaaaatacataaagttttgaaatttaatcaatctgcatggctgcgaccctatattgagttaaatactaacttacgggctgcatctaagagcagttttgagaaaaatctctataaaatgatgaacaatgctgtgttcggtaagaccatggagaatataaggaggcatanaactgtaaaaatatgtaaaaattggaatggaaggtatggagccaaaaacttgattgcaagtattcggtttcacagtcgtactatctttagtgaaaacctagtagccatcgaactaaccaaatcagtagtgtgctttaataaacctctgtatataggtgcagcaatcctagacatatcaaa

SEQ ID NO: 5097 - DNA, 415 bp, Diabrotica virgifera
  misc_feature (303)..(320): n is a, c, g, or t
atttaatattaagataatatacatacaaacaaaataaaagaactgtgccagatataaaatttactttttttcgtcaaataaatagaaatgtgtgacttttaacacaatttgttctatagtcttttcagccttttcaagtcgtgttctttgcacgttaaatatttccttctagatcaattttaaaaggaattaaagtttattcaacgtgagttctgaatagtataaaatcataaaactactaaaagccacagttacaatgcagtgcaggtagcatagagcaatgtatttcttacgggagaacgnnnnnnnnnnnnnnnnnnttgtcctgagcggcgcatcaggacaggtgatttctcagtctaccgccaaactaccacgcacctaccattgctgcgcgtcgtaagaacaacattgc

SEQ ID NO: 5098 - DNA, 326 bp, Diabrotica virgifera
  misc_feature (293)..(293): n is a, c, g, or t
aggacgcgtgggcgactgtacgacgtgttatgtgttagtagctcttaggctaagtatactattagttttttaacttatctgcacacaagcatttccaatggataacggtgacagatttttcataagatgtctcaacagatcatcaaaatggatcacgtgatgctccatccgatattgctactgcaaaaacgcccggccgtgacgatgatagacaattatttgttggtggcatgtcatgggaaaccactgatatggagttacgagaacattttgcgcaatatggcgatatcganagtatcaatgtaaacacagatcccaacactggt

SEQ ID NO: 5099 - DNA, 430 bp, Diabrotica virgifera
  misc_feature (155)..(174): n is a, c, g, or t
atcaaaaacagtcaaggtgatagtttttgagatttaatgtccctaagtaatgcagaacgaaagccacaaaagaatatcaaagactatcaccttgactgtttactacatataatcgaaaaagttattatggaattttgaaagaactgcgtcgtagnnnnnnnnnnnnnnnnnnnngaaggaaagctaaaagtttgtaaaaccatttttgatccaacgttgattgaaaaatcttgccgctatttttattttattagtaaagagaaatttttattgtattgttttataggtgttttacatcatttattaatatatagaagaaaaatgatagatgtaatccagtgtgattaaaagaaaattgagatattaactttttgaaaaatgtaaacgtaacagtatgcctcaatttccttgataccaacgtatcactatg

SEQ ID NO: 5100 - DNA, 295 bp, Diabrotica virgifera
  misc_feature (11)..(38): n is a, c, g, or t
  misc_feature (54)..(66): n is a, c, g, or t
  misc_feature (69)..(92): n is a, c, g, or t
  misc_feature (124)..(154): n is a, c, g, or t
  misc_feature (161)..(193): n is a, c, g, or t
  misc_feature (195)..(207): n is a, c, g, or t
  misc_feature (224)..(244): n is a, c, g, or t
tctgtggtgtnnnnnnnnnnnnnnnnnnnnnnnnnnnntcccttgaggatttannnnnnnnnnnnntcnnnnnnnnnnnnnnnnnnnnnnnnggaaagaaagtagctgcagctcctcttgcagnnnnnnnnnnnnnnnnnnnnnnnnnnnnnnncccactnnnnnnnnnnnnnnnnnnnnnnnnnnnnnnnnntnnnnnnnnnnnnnctccccgtgatttatcnnnnnnnnnnnnnnnnnnnnnatacatccgtattcaaagacaaaaggctgtacttcaaaagagattgaaagt

SEQ ID NO: 5101 - DNA, 64 bp, Diabrotica virgifera
aagaagttatcgacacttgagaaattccgtttaactccgaaaaccacgaacctaacaatgtccc

SEQ ID NO: 5102 - DNA, 291 bp, Diabrotica virgifera
  misc_feature (2)..(17): n is a, c, g, or t
  misc_feature (31)..(82): n is a, c, g, or t
  misc_feature (90)..(113): n is a, c, g, or t
  misc_feature (115)..(145): n is a, c, g, or t
  misc_feature (178)..(201): n is a, c, g, or t
  misc_feature (246)..(289): n is a, c, g, or t
cnnnnnnnnnnnnnnnngtaccttgggtacnnnnnnnnnnnnnnnnnnnnnnnnnnnnnnnnnnnnnnnnnnnnnnnnnnnnctacaacnnnnnnnnnnnnnnnnnnnnnnnngnnnnnnnnnnnnnnnnnnnnnnnnnnnnnnncatccgtttttaactataccaaattttttaggnnnnnnnnnnnnnnnnnnnnnnnncagtatatttacaattaaatatttttacattattaacattaagcnnnnnnnnnnnnnnnnnnnnnnnnnnnnnnnnnnnnnnnnnnnntt

SEQ ID NO: 5103 - DNA, 316 bp, Diabrotica virgifera
  misc_feature (3)..(315): n is a, c, g, or t
aannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnc

SEQ ID NO: 5104 - DNA, 125 bp, Diabrotica virgifera
  misc_feature (26)..(58): n is a, c, g, or t
cacgcgtccgcgacattttagtattnnnnnnnnnnnnnnnnnnnnnnnnnnnnnnnnnagatttgtacgactttttagtgtcatcgttttcctcgttcctgagactggacttctgtctaggggcg

SEQ ID NO: 5105 - DNA, 78 bp, Diabrotica virgifera
  misc_feature (2)..(43): n is a, c, g, or t
  misc_feature (54)..(73): n is a, c, g, or t
cnnnnnnnnnnnnnnnnnnnnnnnnnnnnnnnnnnnnnnnnnnctttattgttnnnnnnnnnnnnnnnnnnnnattgt

SEQ ID NO: 5106 - DNA, 261 bp, Diabrotica virgifera
  misc_feature (13)..(129): n is a, c, g, or t
  misc_feature (143)..(260): n is a, c, g, or t
ccaacgcgtcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtaccttgtgtacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnc

SEQ ID NO: 5107 - DNA, 123 bp, Diabrotica virgifera
  misc_feature (14)..(48): n is a, c, g, or t
agcgtccgaaaacnnnnnnnnnnnnnnnnnnnnnnnnnnnnnnnnnnntcaacttaggaaaagaaatgcttggttacattagttaaggaacctacggcagcaattccaatgttcaaagggggg

SEQ ID NO: 5108 - DNA, 442 bp, Diabrotica virgifera
  misc_feature (10)..(48): n is a, c, g, or t
tccgggtggnnnnnnnnnnnnnnnnnnnnnnnnnnnnnnnnnnnnnnncgttatcaatatcaacgtggttccaccatattgttagaaaaacctatctcgcgcaaaagaaaattaatttcgggatccagttctgatgctgtgccgttcccatgaccattgtcagttatgttagcatgaagttcagctatcactatacttggaacagggagattgtgttcaattcacaaaaacttgttaaaagacgctgaaaaccattggggaatacctccaaagccacccttcaagacgactgctcgattttttacacctagaactaataacttttttgtgtttgtttgttggtgaaccctagccctacgctgaatgatgtctatctgttacgaacccttccttctcgatgagaagatactaccagtcctggacgaagtggaacctccgcgtg

SEQ ID NO: 5109 - DNA, 414 bp, Diabrotica virgifera
  misc_feature (156)..(183): n is a, c, g, or t
ttccagggccccccacgcgtccggatttaatgattgttgtaatatcatgatagagatcccgtcaaattagtgcgttcccaaatgacgagatctttatcataattatgagagtaggttggtttaggacaactatctccaactaactaggtacatagnnnnnnnnnnnnnnnnnnnnnnnnnnnnttggtaaaattgtgatatcgactagatatgttggaagtttggtacaaccaggggcgggtattcatagccaatactaattgtaacttagaagtaaaaaattatccataagcagttttttaacattaactgaatcgattaaaacactaaaacaaaggtttaaatggttattttcaaaatgttatagttttttctacaatttttgtattctgagaacaattttcaaagtgaaaa

SEQ ID NO: 5110 - DNA, 409 bp, Diabrotica virgifera
gagagctcaatttatatttttctgacagcagattttccaaaacttactttttagaatgtgatcgacttatgtgagaaacttttaacacgtagaataatagctagaagaaacaaaacgatagataactaatgtgagatattatcgaatatagatgtatttttcgtgaaagccgttgtgaattcaaattttaactgttcatcttattcattaaatacattttagtatagctcattaacgggatgtttatttcggtttttttagaaagtttatccatttaaaacagaatggaaaattcttttaaaaaaatatcttaattgtatagcaatgtattagatggttaacgccaatagtgttaatagtaacattatagcaaatattttagaatttgtttcaaatccaaaaaaaataa

SEQ ID NO: 5111 - DNA, 417 bp, Diabrotica virgifera
  misc_feature (303)..(322): n is a, c, g, or t
tcccccacgcgtccgtgatcagctggtctgttgtctgcaaacaattctaggaagcatcttttcctaatttgcttttgcttttgtattgtggatatctcttcctgtgtctcttatgtggcttcatgtgcagtttcttgttctcttttctccagctgctcctccaaaaagtctctattgttcatccattgcattagtccatgctattttgtctttgctctagctgtttgtgccgttgtggataatagtgtatgttaaaaaaaatatgaagttattattttgaaacaacattcgtactttagggcnnnnnnnnnnnnnnnnnnnnttaaactaatgtccttaccaattttagcttttacttgtaagaaaaccttgtcccaaataccacgttgagaagaagaaagtttttgaatccaaaga

SEQ ID NO: 5112 - DNA, 459 bp, Diabrotica virgifera
  misc_feature (28)..(52): n is a, c, g, or t
  misc_feature (273)..(293): n is a, c, g, or t
ggcgaacaaagtgaatcttttggcggcnnnnnnnnnnnnnnnnnnnnnnnnncttgggggtagtggtatatttggatcaaatggtaccgcctaccaatcctacatttcaggaacaactgcttcaaaaattttaatagctaccgttgtcgatactgtcattaatgcttcagctactagacactttacaaataaattctttaagggtggtcttggaagctttgattttgatgatgataaaccagaaattctaaagtaccaaagtaatagattatnnnnnnnnnnnnnnnnnnnnntcaaaacactagatctttcccaacataatatcaaagaaaagatatgccatagatctttctgctgtcaatttaataccaatgtaacaacaaattccagcacggatgtatacaaattggttgcgtacagtggttcagtagatattttcggaacccaaaagaaaaccca

SEQ ID NO: 5113 - DNA, 89 bp, Diabrotica virgifera
  misc_feature (18)..(40): n is a, c, g, or t
  misc_feature (42)..(72): n is a, c, g, or t
ggccaacgcgtcggaaannnnnnnnnnnnnnnnnnnnnnngnnnnnnnnnnnnnnnnnnnnnnnnnnnnnnntaaggaaaggttattcg

SEQ ID NO: 5114 - DNA, 63 bp, Diabrotica virgifera
cccacgcgtccggcagtaacgaagccgttgaatacctttggtgtacaatttgatagttgggta

SEQ ID NO: 5115 - DNA, 392 bp, Diabrotica virgifera
atttcctcaaagcggttctcacttttgactgttaattggcaagaactcatctagaagtgtgttaataatgaagtttacggtttcttcgtggtttatttgtttgtttttagtttatttccggtgtggatttgcgagatttatgcttccccccgtgcccgatgttatctatccaccggtgcctgatattgttgccaagatgaatgaaacacttctagaagaggaacatatggacccggaattatcaccaggacttttccaaggagatatggcactcaccaacgagttctataactactggagggttggactgaaatttgaaatatttcctgataaattgtggaggaatggaaattgttcttatacaattagtccgttatatgagccatctgaac

SEQ ID NO: 5116 - DNA, 345 bp, Diabrotica virgifera
cagaaagttcagtgcaccacttcatggattcatgggatcctaccccaatgagagatcccagacactccgtggaacggtaaaggcttacccaatagatgatacctcaaaacctgtccacgtaaccgacatcataaggttccacatctggcacgacccacgttatccaagagggacacagacctgattcaaagataatcaacaacgatcttgaagaggctgatataaatttggaaacaccacccatagttattgttggagatgtcggttacatcaacaatctacatggtcacatggctttatccataatttgtgctgaacatccctctgaatattgccgcacgcgca

SEQ ID NO: 5117 - DNA, 156 bp, Diabrotica virgifera
aaagggttcaaagtttattaacccttgaatgcaagtccaagacccctccaagggtgtccccaaattcaatttcaggggccttctttttaaaactcttgatggggaaaaacctggggataccccaagttaccccctttaaaaaaattccccttttcc

SEQ ID NO: 5118 - DNA, 181 bp, Diabrotica virgifera
  misc_feature (16)..(179): n is a, c, g, or t
ccacccacgcgtgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncc

SEQ ID NO: 5119 - DNA, 190 bp, Diabrotica virgifera
acgcgtcagcgaagaagtcacgccggcttcaggatgaaacgatcccagcaggttacggtcactgaacccaggccaggagattcactggaaaagatgtattatggcgatgagagatatgggacctctttctagagttcgcagttgtcgaaactggagaagttcattggaccgccgagaactgggatcgtag

SEQ ID NO: 5120 - DNA, 87 bp, Diabrotica virgifera
acgcgtcagacaaaatacagatcatttagcactgtatcgtactttgtttaatttcaattgtttttcccgtgcattcagtaaatcatg

SEQ ID NO: 5121 - DNA, 305 bp, Diabrotica virgifera
  misc_feature (14)..(33): n is a, c, g, or t
  misc_feature (47)..(65): n is a, c, g, or t
  misc_feature (84)..(99): n is a, c, g, or t
agccaagcgtccgnnnnnnnnnnnnnnnnnnnnccagcttcagatannnnnnnnnnnnnnnnnnngtctgctaaaagtatcaannnnnnnnnnnnnnnntacagagaatgtaatactggctcaaattttgctcattgtaaccctgggatattctcaaaaagatggttttacacagaatataacagacattttatcaagaccattaatcggctgagagccaatcatgctcttacgccatattacatgcatagaatcggcttgtcagacactcccaattggtagtgtggcaaaattcgagatctatc

SEQ ID NO: 5122 - DNA, 232 bp, Diabrotica virgifera
  misc_feature (26)..(49): n is a, c, g, or t
cgaagttcaagtagcaatcggtcgcnnnnnnnnnnnnnnnnnnnnnnnnaccaaacaagagttgatcaatagggaggtgacagaactcaccgcgagaagacacccagtcacggtagaggtccatgagcaacagggagtggttgccgagcagttcgcacagctgattgtccagttagcgtagcagcacagactcactatacgtgaggttgcacaagagattgccacaggacag

SEQ ID NO: 5123 - DNA, 329 bp, Diabrotica virgifera
cacgcatccgaatttgacaatgatttccgaaatgcacatttaaccgtcaaataaacttattttacagtaaaattgtggttcattcccaacaaagatactaaaaagtaaattaggaatgtgatttccataatgtcatacaagttatgttagatttcctgattattgacttcatatcacccttactagccaaaattacttttgggttccgaattttcaaattcatttccgactagacatcgtcgaagttacgaaccgtatcactgtcatcggcatcatagcctgtgacagcacatgatacgaacaccaagtagttatgcggtacgtgtgtt

SEQ ID NO: 5124 - DNA, 424 bp, Diabrotica virgifera
cagggttatctgatgtttcagattcatcgtgtcctcgtaaggcgagctcaaaagccccacagaattttatacagtcaattatttttgacaaaacatacctgtttttcgtcacctcttcattgtgtttttgtatatttatccaataagcagagtcaagttgggcctgtatattaagtttcccaaataatgcaaatcgcatttcattgttcatatgagtttgcgtgttttcatgcttctttattttttcacttaaatgcactagatcccgcactcctgtctcgcgccacaatttttcctctttatctgcgccgaataatgcacacggaaaacagaaaaaagcatttttttcggaacatccacaaatccactgatttcgtagatacatgtctttattaaatttacgcgtatatgtttttccacggct

SEQ ID NO: 5125 - DNA, 351 bp, Diabrotica virgifera
aaaatgagcatggaaaacataaaaaactccacatccctgtaatagaatactcagaatggactgataatgtatgcgaaatgcattttgaagtagaaactaccaaggcttccaaaaatgcgtgtatatacattaaaaaatgacttggtatatatattggattttaaaaagagttgctgacatgaccaaactaatttataagtacttgtgaaatatggatttggtaaaagtcaagacaaggtgtttaggattattataaatgtcattaaatgacaaatgtgaaacattatcaaatatagggcgtttcattcacagtcatttctttcgaccttctgtcatatgtcgtacaatccc

SEQ ID NO: 5126 - DNA, 143 bp, Diabrotica virgifera
attatgcacatctcgtttgagttacatcggtatcagttcattcacaattggaattcgttcacagattggtcagaagcgctctagtgcagttagaaggatgtgattaatgaatgcaagcatcgaaatgggttcaagttcagata

SEQ ID NO: 5127 - DNA, 427 bp, Diabrotica virgifera
cgcaagtgattttaaagtgcagttattaaatcagtaccttattgtaaaaataaaatatgaccacaaatttcgatgaagaacaagcactgcgtgaatgtgaggcctatgttcaggcccacaacatccagcaggttctcaaggattgcatcgttcagttatgtatcaaccgtccgtcgaatcccattgcgtttctccgcgaacattttcaaaaattggaacgggaacaagctctggacgctaaacaacaagccatgtctcccgaggacactgaagacttgtctcctctaccagcccatgctcagcagcctgcccgacgtcgtggaggaatatcagcggagcccgtgagcgaggaagacgccaccagctatgtcaaaaaggtcgttccaaaagactacaaaacaatggctgctctctccaaagccattgc

SEQ ID NO: 5128 - DNA, 217 bp, Diabrotica virgifera
tacagccgacggacttgctgaagatcatgatgaaggataagttaacccacgtgaagacttcaaagtccgtgcccgttagcttacagagagataggactatgatatagactgaagcccgtaagatccggtgctttggacgtatgagtactggacccattcatccttgtagattgtacgaagggagtgcagcagcttaatgaaatcatatactctgtgg

SEQ ID NO: 5129 - DNA, 125 bp, Diabrotica virgifera
agcttctttagttagagcagccatagacaatttaatgctaggagacagatcttctgtacaggattttactgtttttttggaccagatggcatacaaccacggaaaggaaaggtttttccttctgg

SEQ ID NO: 5130 - DNA, 378 bp, Diabrotica virgifera
  misc_feature (240)..(254): n is a, c, g, or t
gtatatggtgaggtctattggatcatgggtttttcacacttgtcgcatcttcttatcgaactagttaaagttagattcataatataaggttatcattaagatatattactctgctttctacggtagcagttctttcaggacaagtctcacaatctctagttgcacattgcttaaaagctacagacacttcgatacgacaatacacaaatagctcaacactgatgagagacctgtcgaagnnnnnnnnnnnnnnnatgcaatacaagaaccaatacctgtacacatgggattcattccagaagagtggattcaggttatctacaatcaacctggtattacacgaccatacactttcacactcaccatgtctacatacct

SEQ ID NO: 5131 - DNA, 250 bp, Diabrotica virgifera
  misc_feature (11)..(62): n is a, c, g, or t
  misc_feature (64)..(81): n is a, c, g, or t
caacgcgtccnnnnnnnnnnnnnnnnnnnnnnnnnnnnnnnnnnnnnnnnnnnnnnnnnnnngnnnnnnnnnnnnnnnnnngttagtgtcacaataggattttaacttatttggttgtcatgaaatgtcattcgtcttcaaatatgtcaccttttttcagatcaatggtcgttttatttagtcgcagtatctgtaaaaaccctgtacttttatcatattaatcactttgtatttttacggattttctcaa

SEQ ID NO: 5132 - DNA, 326 bp, Diabrotica virgifera
gtcggacaagccaaagtcctttgtcatcgtgttgtgtatttttcaatgagtttaactgtttagtaagtacaaataaatccaaaatgtgtgaagcacgtttagttcaaagtgccaccttcaaaaaagtaatagacgcaatcaaagatcttctaaatgaagcatccttcgattgtcccgaatctgggatccaactccaggcgatggagaactctcaagtgtccttagtctccataacgctgaaatcagaaggagtcgacaagtacagagtgtgagagagaccttacaatgggcatgaacttgggaagcatgtcgaagatcttcaaatg

SEQ ID NO: 5133 - DNA, 125 bp, Diabrotica virgifera
ttacaatacaatctaaactgaccttctggctcttacttgtgttattgatgcagctgatgtaatgatccttcattactaacgcgagagcgtatctcatttccaatcgccaatccttgactcctggt

SEQ ID NO: 5134 - DNA, 411 bp, Diabrotica virgifera
gtttactcacgtagggtagatgtgtagccagacattcattatttttatatcatttaaatgtcagttaatatcattgtgtgtattcaagtatgagtgtaggcgtgtttcgacaacatatctctctttcaacaggtgtcccgtttggggtgtaacgatgagagcatatgaactgtacgatgttcaatcattgtggctttgtatatgagaatcgagggcatatacggctgtatcagtatttttatgcaacattgtgacatttgatgcaccaaatcatcatcatttccctagcctgcctatatgaaccctcaacacgtcggagcttaccagcatgagtccagaatctcctcagcagagtcagggcctacatattcagtaacctcgtgtttcgatgcagcacattagtagttttta

SEQ ID NO: 5135 - DNA, 278 bp, Diabrotica virgifera
  misc_feature (62)..(89): n is a, c, g, or t
  misc_feature (93)..(159): n is a, c, g, or t
  misc_feature (184)..(219): n is a, c, g, or t
  misc_feature (221)..(238): n is a, c, g, or t
tggtggtcgtggggggttgggggggggtgtgtggtgtggggggggcgagggggggggtggtnnnnnnnnnnnnnnnnnnnnnnnnnnnntgcnnnnnnnnnnnnnnnnnnnnnnnnnnnnnnnnnnnnnnnnnnnnnnnnnnnnnnnnnnnnnnnnnnntgggcgtggggggcgggggtgggtnnnnnnnnnnnnnnnnnnnnnnnnnnnnnnnnnnnncnnnnnnnnnnnnnnnnnnaggcgggggggcggtgggggggtggtggggggggggtggg

SEQ ID NO: 5136 - DNA, 306 bp, Diabrotica virgifera
gttacatcgcaagtatcgtgccttttattctaagtttagttgctgacagttgcacctacgttaattccacacttgcatcatgggtacacagcatagtcataggaacatcgttgtcattggacacgtctattctggtagatctactactactggacatttagtttaccaatgtggtggtcacggctcacatcacatctactgctgcggctgctcctcgtactgcatgggtagaggttcaatcagatatgccctgagtactcgacaaacttaaggccgacagagaatgtggtattaccattgatattg

SEQ ID NO: 5137 - DNA, 259 bp, Diabrotica virgifera
cccatgcgtccggcaagatgtgacataatgttaacatacgtgatagaaacaggcgtattcgtgataacagcttccacggtaattgtactgtccacgtgacactttgccaggagatccatcacggttgaacagcggtcagtttcggacaggtaagcttatgctgatgggtctgagatatacacgggacggaaaggagttgcagtggtacaggtaccgccatcaaatgcgaaatgtgtagcacatggcagaccatggtggg

SEQ ID NO: 5138 - DNA, 467 bp, Diabrotica virgifera
  misc_feature (379)..(396): n is a, c, g, or t
agttaagagattcgatttgggtattcgaaaaaaggtgtgtgcgctagttcagttcaaattacagttctttgtgtgacggttaaataataaattgtgtaaataactgaatatgagattaattattttggataaagctgaagaggttgcggaatgggcagccacgtatataatgaaaaggatacaagattttaaaccatccgcggaaaaatattttgttcttggactcccaacaggaagcacacctctgggaatgtacaaaaagctgatagaatttcagaagcaagggaaaatatcattcaaatatgtaaaaacctttaatatggacgaatacgttaatttaccaaaagaacacactgaaagctatcattactacatgtgnnnnnnnnnnnnnnnnnntatagatatacaaccaaataatgttcatttactggatggcaatgctgcagacctaaatggtgaatgtcaaa

SEQ ID NO: 5139 - DNA, 292 bp, Diabrotica virgifera
agcggtaacgatactccggctgacccacgcgtccgcgaaaacgtctgccatttgcgtattcgtccaatggtgtgtgcgctatctcagctcaaacgagagttcggtgtctcacggtgacatattacgttgtgtagaataactcaatatcagatcacatactttgggcacagctgaacacgttgcacaatgggcatccacgtccttcagtactaggatacgcgattttacgccatccgacggaggttattttgtgcatgggctcccaacaggaagcacacctctgggaatgttg

SEQ ID NO: 5140 - DNA, 445 bp, Diabrotica virgifera
aaaaaataaccagtccaaaattaaatggcaaatattacaatagaaaaaacaaaatatgaatgtgctccagtctcaaaacgttgccagagagatgatgttttacgtaagaccggtctgactgttggaaaggtagatttatattatggaagaggcgtccgaaatgatggatctcttgtacccccgattagacaaactgcaagtatttttaaacagcccgtaactgtctataagctacaagagagtaaagtaaaaaatgattataaaaacgggaatcaagagaaaccaaagcaactaatttgggagaaaagattggaaggtttaagggcttgtgatatggatggctttgagttcgaagctatggaactgccaaaaggtttaaaaccagtgggacctaatgtaactgaagacaccattatccagagtgttgctacagcactccatgttt

SEQ ID NO: 5141 - DNA, 428 bp, Diabrotica virgifera
  misc_feature (52)..(69): n is a, c, g, or t
  misc_feature (71)..(83): n is a, c, g, or t
  misc_feature (136)..(153): n is a, c, g, or t
  misc_feature (156)..(174): n is a, c, g, or t
  misc_feature (305)..(321): n is a, c, g, or t
  misc_feature (323)..(348): n is a, c, g, or t
cccacgcgtccgatttagtcaaaaaggtactttgaaaacacatttgagagtnnnnnnnnnnnnnnnnnncnnnnnnnnnnnnncttgtttaaaacagtttagggaagcatatactttaaaagcacatttggtagtnnnnnnnnnnnnnnnnnntcnnnnnnnnnnnnnnnnnnncaaagagtttagtacagtaggggatttgaaagcacatttgagaacacatactggaataaaaccgtataaatgtgaaatttgtgaaaaacagtttagtagaacaagtgatttgaaaagacatttgaaaatannnnnnnnnnnnnnnnncnnnnnnnnnnnnnnnnnnnnnnnnnnatttagtcaaaacagtattttgaaatcacatttgagagtacacactggagaaaaaccctacagtacaagtgtgaaacttg

SEQ ID NO: 5142 - DNA, 405 bp, Diabrotica virgifera
  misc_feature (42)..(42): n is a, c, g, or t
  misc_feature (374)..(374): n is a, c, g, or t
cgaaaacctcgacgccgtccctgtgcgtacatatcaccaganagaggataaggaataacacgatattgattagtgagtaggtaaccttttaacagcggcacagtgtgcgatgtttgagaaacaataattgacaacatgaacaacaatcggtcgaagctgctcccacaacaatcgtcgaaataaggtgaagcaatatttcggtgaaatatgcgaaaatacagcagtggggaggaaaagttgtacataaacagtttgtgtgttagtggaagcagtataaaacttttgaacccgacaaacaagtgttacatcaacaaaacgatcaagataacgttggatgccgacgtcgtggaccaggaagccaccgccgatagcanaaataaaatcgtggattttaaaaaaagtgac

SEQ ID NO: 5143 - DNA, 427 bp, Diabrotica virgifera
  misc_feature (113)..(134): n is a, c, g, or t
cggtcgcgtgagctgctccaagatgaatgttttcaagcatcagtccgtagttgccttaagcagcggcagatcagcagcaatgtgtcagaataatgtagatgtagactacaacnnnnnnnnnnnnnnnnnnnnnntcacatgcaggaggacttggtatcatacatacttatggactttcgacatggaaccagcgggtacattatggtgtctagagtcaacccgatatctacaggaggtattatgtgctgcgctgtaacccgtctgaaaatgtcgctatatcttggatatatcactcatgggaagtctaggatgtgcatatctaaactcccgtacatcgagatcagtatgcaacacatctatttcaggattcacttacaatggaacctttagactcatgaagtttctgcctatgaacgtcgacaaaata

SEQ ID NO: 5144 - DNA, 333 bp, Diabrotica virgifera
cggacacgtgggctttagcggcgaatcgattgagggtaaaattgtacatcaaccacgcgcctgcgcacactgacagtatgtagttctgacagtacatatgtagttcactgctaatctttcaagataggtatgtatgtatctgtaaccgtgcaaataagtcattaaaagaatatattagtggttttaggaaatgtattatgtattataattcttgtgtttttggatttgtaattccctgtagtaaaataatgaaatatgtacgcataacatttttacagtttgtccccgtgttgtgtaagtatatccgaaacttacacgtcaattcaagtggct

SEQ ID NO: 5145 - DNA, 439 bp, Diabrotica virgifera
  misc_feature (14)..(33): n is a, c, g, or t
  misc_feature (94)..(120): n is a, c, g, or t
  misc_feature (150)..(170): n is a, c, g, or t
  misc_feature (318)..(355): n is a, c, g, or t
  misc_feature (376)..(416): n is a, c, g, or t
actaagcttccgannnnnnnnnnnnnnnnnnnntaagttttagtaaattttaagtaatgattgatttatagtaatgtgagtagataatgtgagnnnnnnnnnnnnnnnnnnnnnnnnnnnaaccatgtgttgcaccgagtataacatggnnnnnnnnnnnnnnnnnnnnncgatattagtttcgcttttaaattagcttttttattgtaatttatatagtttaaaaaattttttagttaagttatgtgaaacgatatgaaatacatctaaatttatatcaaatttattaagtttaattattaacataataattatcannnnnnnnnnnnnnnnnnnnnnnnnnnnnnnnnnnnnnggataatcttaaggatgagcnnnnnnnnnnnnnnnnnnnnnnnnnnnnnnnnnnnnnnnnnattttgcatattttatttcatgt

SEQ ID NO: 5146 - DNA, 452 bp, Diabrotica virgifera
  misc_feature (97)..(124): n is a, c, g, or t
  misc_feature (127)..(144): n is a, c, g, or t
  misc_feature (419)..(419): n is a, c, g, or t
cggacgcgtgggccagtactgacttcggcacgatggatattctcctgtcgtatactctccgctgtcggcagggattgtattacgcccatagttgccnnnnnnnnnnnnnnnnnnnnnnnnnnnnacnnnnnnnnnnnnnnnnnncaggaattaaaaagttttgaagataaaaaatatgtttctgcatagttagcaaggtagtgccatggctctatggcactacctcacgggccgccactgcagtacctgtaaacaactcatagttttagtactattactactacaaaaggctattttgtcacaaaacgctttgatactagttattaaaactttttttaacgagatttttatccttaaatgtttatgttttataattgctaaatgttctgtcatttggaaccgtctgtggacagtcggangaattttacaatatttgtaaaatatatacattt

SEQ ID NO: 5147 - DNA, 430 bp, Diabrotica virgifera
ccaaatttgccaaaagaattgaacggttacaacctgtccgactaccccttttacgagagggttccagaaaatattacatttaagtgcgatggactgcacgacggattttatgccagcgtgatacacaaatgtcaggtgtaccaccactgtctgttcggaataagatacgattttctatgtgccaattatacagcgtttgatcaaacattatttaattgtaactttgtttctaatgtcgactgtcaaaattccaaaaagttttggaataggaatgatgaactgtataaaacaaaaagcaccactccaccgccgatcgtgtatagcttctacactcagtctcctcgcgtttatcctcctcctggctcaatacgaagagtaccgcaacgacgagggccagtcattccagacgtagcctctagtccagaagctc

SEQ ID NO: 5148 - DNA, 458 bp, Diabrotica virgifera
  misc_feature (90)..(108): n is a, c, g, or t
gtaaatttagtatagttgttctgaacatattataagaaaatcagacattagatgtaaaggcaatatttggtacaaacatttcttattggnnnnnnnnnnnnnnnnnnnctatttcaatggacatttggtctgaaagggtacggatattgaaatactttttatagaaatgtataaaacaattggtttattaagagaaaaatccaaacaaaaactttgtatccttacacgaagttatcaaaaataatatgaattgtttctatatacgtattcgtcatataggtactgaagtctattatacataggtaggtacatttaaaagaaaggtaaaatgattctaaaatcaatagaattacatttaaaaaaaatactgttgggatgatattgtaagaataaaatagagttgtacatgttttttttagtaagtattgtaaaagtcaaaagatgttttgatttcactt

SEQ ID NO: 5149 - DNA, 427 bp, Diabrotica virgifera
  misc_feature (201)..(220): n is a, c, g, or t
ataatttagtggactgcaaagcttaatataaacccatttcaaacagtccagaaatgcatggcgagatttttaagaaatgggcatatattgtattatttcactctcaggtgatacatttgtcaaaactattgtgatgcctatagccaaataaaccaaggcagtaataagtatgtttttatttttcgataactgcagaagagnnnnnnnnnnnnnnnnnnnncagtataggtacatgaaaactgttcttaatatagaacgtttccaaatgcgtttttctaggaacagtttacacgatatgatgaaaatcaataaaatattatctattatgcccttctaggaaaagtttaaataagacgataacttttgataccattttatatcctaccagattaaaacaatggaaaaccttctctggttacaccatccg

SEQ ID NO: 5150 - DNA, 450 bp, Diabrotica virgifera
  misc_feature (336)..(362): n is a, c, g, or t
atgagtttcattcctttaagccttgtagaacttataatttttgaaatagcgaactctcaaaataatcttttattatttgactgcataccgagacgtagtaaaatccctgggatttacccagcctggattaaattttgaaacctattataaagtatagtaatccatattaacagtatgacactacagtcataaattacatctatttgtggcaaataagtctaagttgtgtttattttgtcttatctaaaacagagtgacgatcttgtcatcgattataaatacgtatttacagtaaatatttgattagctaaagtaaatgtattatgttttattgcnnnnnnnnnnnnnnnnnnnnnnnnnnncgtgtttaatattatactgaacttgtgtaaaaaaagcattctattggaatcactaaagatttttagtttaattaaataatatgattga

SEQ ID NO: 5151 - DNA, 459 bp, Diabrotica virgifera
  misc_feature (121)..(155): n is a, c, g, or t
gtaataatttgttttatagactaaagcacattcctcgtccaaagatgcaggtatgcatcttgggagatcagcaacattgtgacgaagctaacgccaacaatgttccattcatggatgtagnnnnnnnnnnnnnnnnnnnnnnnnnnnnnnnnnnngttaagaaactagccaagaaatatgatgctttccttgcttctgaagccctcatcaaacagatccccaggttgttgggtccaggtttgaacaaggctggtaaattccctggtcttctctcccaccaggaatccatgacacagaaaattgatgaagtaaaagcaacaatcaaattccaaatgaagaaggtactctgcctttctgttgctgttggtcatgtaggcatgaatcaagatgaattggttcaaaatgtccatctttcaatcaacttcttggtctcactgttgaagaaacattggcagaacg

SEQ ID NO: 5152 - DNA, 329 bp, Diabrotica virgifera
gaaaaatttaggatttagcaggttttgattttgacgggctcaactgataagttctacctctaaatcaaacaccccatttgtaatatttcatcttagcaactgttcactacactggcttgcttgacagccattctttaagtagacagctacttatgggaatgaaaccatttctttgtgacatttctgtttattaatttaatcgttattaaccataattttcattgagaataaacgtatttccaattaaaagcgtggttaattcacattaaatatattaaatcatatcatcacggtgctatagcccttaaagggactcgaccttctcaagc

SEQ ID NO: 5153 - DNA, 352 bp, Diabrotica virgifera
  misc_feature (167)..(190): n is a, c, g, or t
ctacagagtctcacattaagcgacaacaatttagtttcggtaagttaatgaatgcggcaccagcaatatcatttgcgacaatatcaggaagatagttgttggagtaccaagattcataagaatgattgactggacggcattgtccaggaacggggaaaacagtaagnnnnnnnnnnnnnnnnnnnnnnnngaatttagtactggcaaatcaagtacattggtagcgactgatgtagctgccagagggtaagatgttgtgggtttaagatatgttgtaaattacgattagcgtcagtcctcagattattacagtcacagcttcggtacaactggtccatcagacagtgctggt

SEQ ID NO: 5154 - DNA, 183 bp, Diabrotica virgifera
gaatctgtcaggtgcgcagtaaatgtgccttcgttatgtataaacgttaggccataacaatcatgtgtacgggtatctcgatacgatgttccaatatcagcatgtctcatagatattgcgaagccagatgacgatcagtgcgtgatagaaaattaccaatcatcatggttggagtcacaaatt

SEQ ID NO: 5155 - DNA, 267 bp, Diabrotica virgifera
caaatgcgtacgtgtgaagttagttagtttatcgtgtcaaggatcttattgagacatattcaagcattttgcatccaggtcctcccagcatcatattgcggtccatacgccgggtttcgaagattctaatcttgagtctacatgctgctaactggtgtacctctcgatcagcatgagttctccgtgcatgtcactcacaatgtatgtcagattctagttggcactactcctaaatgttcaacatgtctagcatgtctcgcgtcaaag

SEQ ID NO: 5156 - DNA, 406 bp, Diabrotica virgifera
cccacgcgtccgggggctgtatacgctgaaccatctatcgtttaacgatttggaaccatggaatgagaggtataaatttggtagcagcattaccactattatgagattgaagtgtttgcgatttgcgttgatcaatttgctaaacatagtgcagcattacatattttcatttatttttaccacatgtttgcacaaattcgaacttgaatttgaatctgcgaatgatttgtcatccagtatatcgtcccatgctgagtttaataataacgcacaaattttgattggccaacttagagaacatgtgagcacaggatacgtcatttgataacgttgcgaagtgtataacagtattgatatacatgtgggagcacgtgtcctatgctacacctgaaagattacttgacat

SEQ ID NO: 5157 - DNA, 423 bp, Diabrotica virgifera
aacatcaataatagcgattgacagttggtctcatttctctttgtgcgtagtgagtaaccgttgttaaaagcaaaaatgaggaagttcatcgtacagtgtttgctggtggcactagtcgcggtgggagttgctgatacttggactacgatagataagagagattgcgaatcgaattgcatgagaaactgtaataaagccaattatcaaagctcagaatgcattagccatggaggacacttccccagatttgctgattgccactgctggcacaaaacctacgactacgataaatatgacaagatgagcaagtataataatctactaggttactatgagtaaagttttttgtgtgtagacaatgaactgtgcataatttcattaactgtgtgtaaacaagctgatctattataagttgtgtgatta

SEQ ID NO: 5158 - DNA, 428 bp, Diabrotica virgifera
ggtatgcctctatgctagtatagccaccgcagttttagttgcagccctctgttgtctagcgcgaagaatatctccttgtttttaaagaaaaatgtcgaagccaaagggatctgtatcttcagtaagtaaagcaggccagttgtctgttagtggaatcagtcgaaccagtagaataggtgctagagctccagcgccaccacccaaagtaggattggagaaaccaccaaaaggcttagaatggacattgcccccttttagcgtttgtccaagaccgaaaacaggaatcgattgggatgaactaaagaaacgaatgattagacgtcaagctccagaaggagaggatatcaagggaatacgattgattttgaaggagctccaaggcaagaatattccagtgcaagattttgtgaacttaatatctgcttata

SEQ ID NO: 5159 - DNA, 181 bp, Diabrotica virgifera
tcccggggtcatacacgcctctaaaatgacgtcgtattattcaatagttctctgcacaattgcctccaccagttcatcaaaatcatgtcttggttcattaattcgactatctctacggccttctgatactataggccgatctctatctattgattactgcccagttgcagaatcagcattt

SEQ ID NO: 5160 - DNA, 308 bp, Diabrotica virgifera
  misc_feature (34)..(93): n is a, c, g, or t
tagacagcgatatcgatacttcctggatgtttcnnnnnnnnnnnnnnnnnnnnnnnnnnnnnnnnnnnnnnnnnnnnnnnnnnnnnnnnnnnncattctttggttctaatatagatcagtagaacatcctagaatcttgtaagatgatactcttgccgacaatgtcatccttctgggtgttactacgatctacttttcagtactattaaatggtctctgtatcgactgtcatttcattttccacgggaacgtttgtcaaactgcagcctctgagcacttcataagtcagcagctccacatctcttgtg

SEQ ID NO: 5161 - DNA, 195 bp, Diabrotica virgifera
cccacgcgtccgggaaaagattcccgaatgtgatcaagctatcttaactcccagtttctgcatagctggtccgttcatcatgttcagaacttttcttatgccggccattagagtgctcacgtcatactcatcttctgcagaccttactatggcttcaatgttgaaatagtcgtccgacatccaagatcggaaggt

SEQ ID NO: 5162 - DNA, 440 bp, Diabrotica virgifera
  misc_feature (108)..(127): n is a, c, g, or t
cccacgcgtccgaaaagattcgattagattcaattacattgaatattaatttgttttgttgtaaatccacttaataattatgtgatatgtttgatttaacatgaattnnnnnnnnnnnnnnnnnnnnggcaccaatgtcaacttagatctctgacgtagataatgacatgcaacggtatttataatctaccgactgtagatctattgagaaattcacaccgagaatgcagtacggctaagatagggcaatacatttctaatggggaataaacgcacagggttgtcagtcttcaccagttgttgattgctctctcaagagcgtcgcacaggaactgtggcaacactgaatgcacattgctatcttaaccatactgaatttcacgttagtctagctttaatgtcactgttaataaaaactggtttctatatttgtgtacaga

SEQ ID NO: 5163 - DNA, 344 bp, Diabrotica virgifera
  misc_feature (8)..(26): n is a, c, g, or t
caagactnnnnnnnnnnnnnnnnnnnggacacatgctctgatatcaggtcttccagcatgtatataacgataagaacggaggaattactgacgatcattgagcggagtcctgctctgacttcgtttagatcagtatacacgtcatctagcatagatcgaaatgaactgtcatataaatatgattgtaaaatttccgaatattgtgaacgcatagtaattttgagtttgtgtactagaccttcatgctaaactttgtcgatggccttagcgacgtggaaggagattgttcaacagactttcttgtcatctattgatttagcagttacggtcatcattctgggtac

SEQ ID NO: 5164 - DNA, 284 bp, Diabrotica virgifera
  misc_feature (9)..(32): n is a, c, g, or t
  misc_feature (92)..(113): n is a, c, g, or t
  misc_feature (127)..(151): n is a, c, g, or t
  misc_feature (178)..(205): n is a, c, g, or t
  misc_feature (238)..(271): n is a, c, g, or t
acgactccnnnnnnnnnnnnnnnnnnnnnnnncataacaccatactttttagtaaaagtaaccagacgttttatttaaggatagctacttcnnnnnnnnnnnnnnnnnnnnnnctttataacagacnnnnnnnnnnnnnnnnnnnnnnnnnggcacggattattacttaataattacnnnnnnnnnnnnnnnnnnnnnnnnnnnnctaacggccttcaaatttttactgtgaaatacnnnnnnnnnnnnnnnnnnnnnnnnnnnnnnnnnnctcgtttttacat

SEQ ID NO: 5165 - DNA, 443 bp, Diabrotica virgifera
tcaaccaacccttcggaaaacctgggggaagatattagaaaacttgattatggcaagaaggtcgtaattggaaaacctggaaaagtttatgatatgataagaagaagagctctaagaacaagatctgtaaaaatgttggttttagatgaggctgatgaaatgttaaataaaggattcaaagaacaaatttatgatgtctacagattccttcccccatcaacacaagttgtactcatttcagctacactgcctcacgaaattttggaaattacttccaaatttatgacagatcctattaggattttggtaaaacgtgatgaattgacattggagggtataaaacagttctttgtggctgtggaaagggaagaatggaaatttgacaccctctgtgacctctacgatacattaaccattacacaagctgttattttctgcaacac

SEQ ID NO: 5166 - DNA, 428 bp, Diabrotica virgifera
ccacaatgcatctctgctaacagaatcgtaatcttgtttaaattccacgaagatttggtgtacatcgcggttgaattggttgatgtactcaaagtgaaatacttttcatcatctaaaataatcatttttttattggcaaagtttactcgcctcagttgacgatactatcttggtatacgaatggtatacgaatgacaatactacttggtatttggggcagttacgtctctttcgatattttaagaccattcctccccaaatccaaccatatcgtactcttagaagatctgcattgacgagggaatctcctagatgacattccaacctggtttcttgctcttctcaacaatctctatgacttctgtgcagtaaatgcacatggtcttcctctttttggttgatttagacacggtattcccagatcgcac

SEQ ID NO: 5167 - DNA, 81 bp, Diabrotica virgifera
  misc_feature (2)..(37): n is a, c, g, or t
annnnnnnnnnnnnnnnnnnnnnnnnnnnnnnnnnnngtaccaagtagataaaaactttagttaaagaatattaagggagg

SEQ ID NO: 5168 - DNA, 432 bp, Diabrotica virgifera
gttataataaaaacgtaagtcttctttggccacgggaatggaacaggttagtctgtaacaacagagaaaaagtttcgttaaatatttgtataattttcggcatatctcatttcttctgatcattgcttataatttaatctcgagtatttaaattcaaatgtattgtcagatacatatttaatgacgagacttacattattcaaaaccatgtatagaaataataccataaaaccccatgactataaccatgtcaccatccccacatatgactgacatgattttgaggaatgtaagccttcacggctggtgttctgtaatggtaaattctttttgggctttataattggtcgtgatgtggatctatttctttcttgtgcctttcaactgtgacagacatcgaagactatgcaacataggtcataactgtcgggt

SEQ ID NO: 5169 - DNA, 441 bp, Diabrotica virgifera
  misc_feature (43)..(43): n is a, c, g, or t
  misc_feature (108)..(126): n is a, c, g, or t
  misc_feature (315)..(315): n is a, c, g, or t
  misc_feature (334)..(357): n is a, c, g, or t
  misc_feature (374)..(392): n is a, c, g, or t
cacgcgtccggaactcgaaatgcaatgttctatttactaacanagaaaaaagcaattatccgtataaatatgcaatctattcgataatttcacgaaaagcaggttgcnnnnnnnnnnnnnnnnnnngatctttttgtatgtcattgataaagctcgaccgtcattttacatgacaatggctgcagatacgtgagcattcataaccttcttaatagaaggaagggattttttacactgtaaaacagtgccttctttattctgcttggccgagctcctggccacgctgctatagcagcctactgttataaatatatnaaaaaaaagtatcggatgnnnnnnnnnnnnnnnnnnnnnnnnggaaatttaaaagcacnnnnnnnnnnnnnnnnnnntcccttcaaaatgcactcccccaatggtacaatttttaataagcaaaat

SEQ ID NO: 5170 - DNA, 473 bp, Diabrotica virgifera
ccggggccacccacgcatccgaaaaaggtgatgattttaaaattcgtgtaataaaaatgagccacattgaattcaaagcattacaacttcaagaagaagctcagaggaaggtaaaatcagcaggattcttacagtccttgtttttgcggtctacaagtaaatcggaagagtcaatagaatattacaaaagagccggaaatctgtttaaaatggttaaaaaatggaaacaagctggttcggcgtttatggatgctgctaatctttgttacaaagctaaaaattttactgaagctgctctggagtatatcgaagcggcaaattgttttaaaaattgtgacactgaaatggctataaaggcgtacaaagaagctgtgaaattatatagaaataacggaaagtacagtgctgttgctaaaaattatgaagcaatgtcagaattattgcaagaggactataataaccagggagccgaa

SEQ ID NO: 5171 - DNA, 169 bp, Diabrotica virgifera
cccaggtcgacgtacgcgatccgcaaacgcgtccgcggacgcttgggcggacgcattggcacagttttagtcacaggtttcaaatccctgagaggcaatttctgcgattacgacaaagtatcgtcactatccggagacaatgatggtgacattaggcctcatgcttgta

SEQ ID NO: 5172 - DNA, 444 bp, Diabrotica virgifera
  misc_feature (118)..(167): n is a, c, g, or t
  misc_feature (361)..(361): n is a, c, g, or t
  misc_feature (434)..(434): n is a, c, g, or t
ccgtccggcaaagcatccgccgaaacgttagtccgaaagttaaccctcaaagaagtcctttcaaaccaaaaacgaatcctccaaaccaaggaagaagttccccggagcaataagggannnnnnnnnnnnnnnnnnnnnnnnnnnnnnnnnnnnnnnnnnnnnnnnnngtaggtttgcttaaccctcaaagaagtccttttatacgagaaaggagtcctctaaacagtgaaagaaattctctagagcaatatggaagcaattctggtaacaatattgagatactagattttaaaccaccacaagataattctggtaacggtattgcaccttcaaagggtaacaatttcggaccaattccgangggttgcgttcgagtaaaaatgtggattggtaagggaatatccttctcagattcaacgcgtattgtgaggcanctgtcacagc

SEQ ID NO: 5173 - DNA, 435 bp, Diabrotica virgifera
cggggccacccacgcatccgaattgactatgtgattccaaattaacctatgtattgtttgttttgaaaatctgccttatggaataataatcctcaacaaacgacattgataatgtttcactatatgaaaagggaacgggaactttggtgtcctgcgaagatgtagatacaaaagaaacaaatgatacacaagtgaaaatgtccatcaatgggaaagaaaaacccggatctaagcaacctctattgggtaacgataaacaaacgtcttttaaattaagaccaagaataaataccacaagcttgccatacatacgaacagttgcaaaagatggagactgcaatatttatccttcaaatgtacaaaaaaggcgatttttgagggacatttttacaacacttatagacatgaaatggagatataccttcacagtatttt

SEQ ID NO: 5174 - DNA, 70 bp, Diabrotica virgifera
acgcaaccgcagtgactacgtgtctccaatcttacctatgtatcgtttggtctggtaatctggcttatgc

SEQ ID NO: 5175 - DNA, 432 bp, Diabrotica virgifera
  misc_feature (8)..(26): n is a, c, g, or t
acgcgtcnnnnnnnnnnnnnnnnnnngaagaagcaccagccgaaggagaagctcctgcagagggagctgctgaggaggaaagaccagaagccgaagaagaatacttagatcccgacaaattgatattgtttaaacactggattaggcctaaatttctaccatacaaatacctctacatctacagacaaaactactacgatgacgtcatggattacctagataagagaacaagaggaatcgatagggaaataccaaaggctcaaacatgggctgagagggtactaagaacattttccaacagaaccacccaaaataacacgtacaccagaaggatcagaaacgacttggaaatggtagaaaagaccaggaccagcggccaattttactactaccatggtaagaattcctttaacagacagttctcaaaactgc

SEQ ID NO: 5176 - DNA, 449 bp, Diabrotica virgifera
cacgggtcccaccaacccttcggcatcccaaaacttgggtaataccaagattaaccaggattccaaaataacttggaattttggctttggtgcaacgggcaataattgaggaaaacaacacattaccaaaatccaattccccaagataaaagtaatgatatagataatggtgccgataaaggtggtccagatacaaagggttccgataatggtaaagatggtcccgataatgatagcaaaaagggtggtccagataatggtaccgataaaggtggaccagacagcaagggaaacggcggcaaagatagtggagaaaaaggaaatggcggcaacggtagtggagaaaaaggaaacggcggcaaaggtagtggtgaaaaaggaaatggcggaaaaggtaatggcaactcaagtgaaggtaatggcaatggagatgataatgattgtgacga

SEQ ID NO: 5177 - DNA, 413 bp, Diabrotica virgifera
  misc_feature (28)..(97): n is a, c, g, or t
  misc_feature (128)..(154): n is a, c, g, or t
gtacagtcgagatccgggtccaccacgnnnnnnnnnnnnnnnnnnnnnnnnnnnnnnnnnnnnnnnnnnnnnnnnnnnnnnnnnnnnnnnnnnnnnntgttccgaaatccggaggaaacttcaggtcnnnnnnnnnnnnnnnnnnnnnnnnnnnagcaacacattttgtgttggattgcagtatcgaaatattggaggaagttttgaaacaagctcaacaagtgggcttaatgaccaacaagcacaactttatcattactaacctcgacctgcatacaattgaattaatgccgtatcagtacagtgaaacaaacatcactgggatgcgatttgtagacccggatgacgaaggtcttgccgaaaaagcgaaaaagatctataaacaaaatctccaagtatttactgggtacaaa

SEQ ID NO: 5178 - DNA, 460 bp, Diabrotica virgifera
  misc_feature (75)..(93): n is a, c, g, or t
aattagtttgtatggaatcaacaggcaaatttagcacatcacaatgagtcttaaaaacaacaaagaaaatggacnnnnnnnnnnnnnnnnnnncacaagacgaaagccaaattgaagaacagatgcaaccagcttgcttaggcatttgtgactgtaatttaagatgttgcgaatgttacaacactggacttgcaatgatagaatttgagaggaaggataaaaggagaaaaggtatgaaaaaagcagatgaagttgataattttaagatccaactagacaaaagtccttatgttgtatcacgagactactatataaaaacctgtgaagttccctcatataaagacgccaaaaggactcttggtaatctagctacctttgtgtacaattattgtgaaccgggactgaaaccttacattccttctgaaccgcaaatgccttacggagacctgtggatatctcc

SEQ ID NO: 5179 - DNA, 472 bp, Diabrotica virgifera
ttccggggccacccacgcgtccgaacaggttggcctgtaccccctggagcaccatggcccattccaccagctttattttcaggaggtgctttggcggctatagatgaagcagctgttatgtcaaaaattgatccggaaatcatagctaaagcttctgagtggacagaacacaagggtccagatggaagattttattactacaacgccaaaaaaggagaatctgtttgggaaaaaccccaaccacttaaagatttagaaactgcaaagcttgctgctgcccagggaatttctacaaagccagctggagagactgcaggagaaacaggtaagacactaagtacaccaaatggtgcgttgactaaagaagaacaggataaagggaacgaggagaagatcaagaaactacaggaggagatcaaaaggaagaaagaggaggatgagaaagccaaagagctaaagctgctgataaatc

SEQ ID NO: 5180 - DNA, 141 bp, Diabrotica virgifera
aaggaacttacaggatggacattttggcagaaatctaccggccagtggtatgaaatgcaggatctgcacgtgacggatattttaacggcagatgattacgttaacggaagcctatatacaaatttatgaattaagaacaca

SEQ ID NO: 5181 - DNA, 317 bp, Diabrotica virgifera
  misc_feature (16)..(48): n is a, c, g, or t
  misc_feature (84)..(287): n is a, c, g, or t
ttttaaaaaataccannnnnnnnnnnnnnnnnnnnnnnnnnnnnnnnnaccattacatttacaattaaatatttttacattacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctaaaaaaatgtatatttagtacaaatata

SEQ ID NO: 5182 - DNA, 314 bp, Diabrotica virgifera
  misc_feature (14)..(43): n is a, c, g, or t
gtccgcaaacgcannnnnnnnnnnnnnnnnnnnnnnnnnnnnnaacattttcaagatttttgtcacataaaaaattgaacacgtttgttcgaagattacatacattttcaaacgcagtcaattttataactgtgaagatagcagttataaccatacgaacaaaaacattaatgtgctgcataaaatacgtgcctttcagcatagataatccgtgggttcgtttctgggagaattttttattgggactaacattgtttccttttagcagctttcctactatagaaatcgtgatcaatgacgaatagtagcaacta

SEQ ID NO: 5183 - DNA, 422 bp, Diabrotica virgifera
tcagcatctttgataattgttttcttcagtgtatttgtcagtctcctctgtttccgttttcctggaggttggaattaaaatgtgaaaattgttggtaaacatttattaattggaggtgattgatggatagttggctctctatgcgtgacaaggtaaatttttatgaaggctttaaaaatgtgagattatttagccgcgtccgtattataaatgtggccgttaataccaggtcataaataagggaatctacatataattgctttggagaatttttaaactggtcgttagtacaggtggctgttaacacaggttttactgtattatacatggcttacaaaatctactgatttctactaattttttgaaagcacaactactgaataaataaaaactgacctggcaaccctgctttaaaggcacgt

SEQ ID NO: 5184 - DNA, 407 bp, Diabrotica virgifera
  misc_feature (128)..(146): n is a, c, g, or t
ccaagccttcgggaggaacaaaatttggcaaaaaaaccttaaaataaataacaacccaaaatgtggttggaaagaaatttaaaagccttggttgaaaaaatccggcaaggttaaaatgaattagaaannnnnnnnnnnnnnnnnnngaacaacaagatggagatgagaattatcagaagaaaataagagttaaggagttttcaaatcgattttcaaggaactatctttatccaatcgtcaagcagattgatgaattaagtaaatttaagcaaatccatcccactacaatcataaggtgttaaacgcttataatgttatatataacggactagtagcatatcagaatcatcttcctacctccataggtgcatgttcttcagataaactaaaactactgcttaaacacc

SEQ ID NO: 5185 - DNA, 455 bp, Diabrotica virgifera
  misc_feature (364)..(398): n is a, c, g, or t
gactcatttacttctacacctaattcttatacaactcaatcagtttcctttccctaagttgttatattttggtctggtgacaatccacaattatcatgcccatttaagcttatttataggtatttcataggaattgttacaaatacaaaagttatttttatagtaattatttgtattaaaatctaccaccacttatagatgaggatatgttttagaaatgtaatatcgacatggagttctggaacaggtggtgcacgagtaattggagctgctacgtatgcaattcttgcccaagtccatttagaaatgaggacaattttacagatacttcttgtagttcccgttgccatgggtttagcgtttnnnnnnnnnnnnnnnnnnnnnnnnnnnnnnnnnnntgcacatgcattagaaattcagaatcttgtcaacagcgatgagctaaagaacccaaa

SEQ ID NO: 5186 - DNA, 168 bp, Diabrotica virgifera
ggggccacccacgcgtgcgcacacgcgtcagcgtgtttaaggaacccaggactcgactttccttcaataatcttttatttatttcgttttcgtcccttccagtattagggagagtcgctacgaagtgtgcgagaacagatacttctttaaaaagagaaacatatcttt

SEQ ID NO: 5187 - DNA, 379 bp, Diabrotica virgifera
atttaaattaaattgttcaggagaacctaacaaaaaaattaggtgaattaccgttcgtcaattctagtaaatgctgtgaggccgctcccatgatgagaacattttctttttttctgaaaagagaaacttcagtttttcttaagaaattgctcaaacaaattttgtccaaaaatatcctttcaatttgttgaaaggggacaattttaacaaaaatccgtaaagaaactgaatcagaaaatttttcacactagaccgccctcacaacatgaattatattctttattattcacatatcattattttttataataacaacatacaattttattgttaattggtatcaaatgatgcctctcatatgttgatacatttttattgt

SEQ ID NO: 5188 - DNA, 427 bp, Diabrotica virgifera
ggcgcaaataacaataacaacacaccaaaccataaccaagcaatttttccggtgaattaataacggaatggaccaaattaaaataaaaggggttaaaccccaaacagttaaattgaaatgcagccgtccgtttgaatattaacaaagttagtaagtagaacattttcaattttcagtatttgtcagattgagccagaaaaatgaaattttggttgatattagtttgttacacatggatatttgcagaatgccatacgacgaagaaccgtacggcactttttgaacaaatcaagaaaggtatagaagaaataaagactttcaataaagcgtcagccacctttgagactgctattaaagagtataacattccaaacatatttacatcatcaccagacaattttgataaagaagaggtatgttcgacatg

SEQ ID NO: 5189 - DNA, 374 bp, Diabrotica virgifera
  misc_feature (320)..(320): n is a, c, g, or t
gtacgcatacgcatacgcggacgcgtgggcttggaagatagtatatataattggcaaaaagatgttttaaaggacaggaatacgtatggtcatttcgcttatttacaaggccaggaatatacaatgtacaattcgtatgatgtccacttctacgcatcgcacgccttacataaaaactggcctatgcttcagaaatgtttgcagtacgatttaagagatttcatctccgtggaaattaatgaacccgttaaagtcctatataatggaaagctaatggaaaggtagtatcccagtactgttcctcatgatgcacgaagtcncggtgaagaaccattaacccttatcaatgcttacccaatccatgacgttagtca

SEQ ID NO: 5190 - DNA, 143 bp, Diabrotica virgifera
cacacgcgtacggcggttgaattaaaaagtaacttccaaacttccaataacctcggttttggcaattcctccaattttaaacaaagaaaaaataacaacaagagtaaattcggtggtttaatggcaagtttggcaattggtgg

SEQ ID NO: 5191 - DNA, 138 bp, Diabrotica virgifera
  misc_feature (18)..(43): n is a, c, g, or t
  misc_feature (83)..(102): n is a, c, g, or t
gttttaatggtaaataannnnnnnnnnnnnnnnnnnnnnnnnngaatggtaatccgttttaaataaaaccaaatttttaaggnnnnnnnnnnnnnnnnnnnnggaccattggattaataggaaataatttgaaaagaa

SEQ ID NO: 5192 - DNA, 440 bp, Diabrotica virgifera
  misc_feature (63)..(82): n is a, c, g, or t
cccacgcgtccggaacgattggaacaacgagacacctcagtttggttatgagattcaggacgnnnnnnnnnnnnnnnnnnnngcaacgatcgaaaaacctgcaaatataccatttgtgttagcttttccaagcgttctatatcaaacgagagttgggggatatcaagcagaaatatctctaccactaggcatggttgttaacgccgttttcaagaatcaacattggctttatgtccaaacgcctcacgcaagagaaggctatgtcagttatgctgcttgcttgcctttaggtataattcctccaccggaagatgataaactcgctcgatgctgggaaaaaagcaccgacgtcttctcgaaagcttcaggaaacctaacagatatcgaaaaactcagttctaagtccgattgcgaaggtggaggatgaagtataagatgtc

SEQ ID NO: 5193 - DNA, 232 bp, Diabrotica virgifera
  misc_feature (63)..(92): n is a, c, g, or t
ggcagaataaaacgtaatggacctttaagtcaactttgggcaaatcacaagatttttaagggnnnnnnnnnnnnnnnnnnnnnnnnnnnnnnggcctgtggcgattgtggctcgtacggacaatgttgcggttctccatgttctccaccaatgtatccccatgccgtacgttgtacgtcatgtcctccatcaggtatcctttccactaaacccagaccaatgaaacctttgc

SEQ ID NO: 5194 - DNA, 109 bp, Diabrotica virgifera
tcgaccacgcgtccgccaggaaactgggaatcaataagaagcacaataccaataaccaagggaatgaagttgatactaatatagattccaaactaatgccccgtggaaa

SEQ ID NO: 5195 - DNA, 414 bp, Diabrotica virgifera
  misc_feature (2)..(15): n is a, c, g, or t
gnnnnnnnnnnnnnnctttgcaaaaatatcttcaacgatctttacatggttcattgctaacataacagacatagatacctaatacatgaaaaatcttagtttctttcggtacgcgattctggtgcccagtttaaacgctatccccgtagatgtcatccagagaaatattccagtagaagtgaggtatgaccagatcctcccaggaattgtatccagggagcaagttcgaatgcacggaagaacgaacttagatgcaacggtgcaattatcttcatacgaactgcctcacgtagtgaaacatttaccgattccacttgaatctgatctcgttcctgaacttgttagcgatgacaaagttcaagtggcatcagaagtcggaaacaatgcagttaactctttacttcagcctgcaga

SEQ ID NO: 5196 - DNA, 331 bp, Diabrotica virgifera
cactttataatctgtcgagctgcttctgaccaaggatcaacatgtacagtacagatgtctaacattacctgagcaaaaaatgctatagaacacaccattttaatgtgactaaggatggcatgtgcccacgatcctatgatgggcgtctacgctggcatcctactaatgccggagaattggcggtgcggagctgctcatgggatatcttagagtccactcaacagggattggcaacatggcaatgtttataatatggatcctggttcgtaccccctgtagacatatttccattgtcgaatatttctcaatgtggaacgttttctaaaactac

SEQ ID NO: 5197 - DNA, 401 bp, Diabrotica virgifera
  misc_feature (80)..(80): n is a, c, g, or t
  misc_feature (124)..(124): n is a, c, g, or t
cacacgcgtccggcttcgaccagtagttctatctgcagcgctgatgatagatcaacgaaagtagcgaaggtacgggcgangaagtccagtaggataatagtgctgcaaccgactgcttcatcangtaaaaatcctcggaagtcgcctagacagcacgcctctactttagctattcttagcgacttggtacaacaaagaaagcgccggtccaaacatagacagcccgtagaagatattaacaatcctttagcaacatcgatgatgacaagaaatattatcggctccggtgcaagaagaagttgcaccagaacctcctcctccagttcgatcagcatctcctcccccagtacaagaaaacgactgccctccaaatcctcaaaaccaatccactcgtgttaagt

SEQ ID NO: 5198 - DNA, 438 bp, Diabrotica virgifera
  misc_feature (39)..(77): n is a, c, g, or t
cccacgcgtccgcaaagatgaaactactgagaagaattnnnnnnnnnnnnnnnnnnnnnnnnnnnnnnnnnnnnnnntcattagaagaaaatgtaacatatatatgcaccgttcttaggcgtcaacggccttcggtagtgatctatggaggagtatcaccaagccacaagcccttatctcttgccgtaccgctcttccataggccgatcagacactagtttattcgagaccaagtcgtagactctattgagttttatactacggcattggccttttataaatttcatgacctagctgaggctcgaaccagcgatcgcaaatcgcaaatccactaaacttgtcgatcgactgcgcctcagctaactagaccatctagaccgacagaaaagaagatataacatacggtgtataaataaatgaatactaaaatagaataaa

SEQ ID NO: 5199 - DNA, 234 bp, Diabrotica virgifera
gttcgccatgcgggaaattatgtttaatgttataaattattacagtacgttataaccgtcaaataagccaactacattaaattcggacgtcgatatttagtgtagctacggttcaacgatttttgtgggtgccgtaataggctatgcgagagtatacatgggagaagccaccattgcacatgctggtatttgcacagcagtcgcacttagatactactttattttacgacaatg

SEQ ID NO: 5200 - DNA, 317 bp, Diabrotica virgifera
caaccgcgtgcggtcagttatgtctaatgttgcagattattaatgtacgttataagcgtcaaatatcacatctacattcgattcggacgtcgatatttactgttattgaagttcaacgacttctgtttgtgccgttaccggttaaacgaatgtaagcataggaatagccaaaactgcaattgctggtatttgcacatgaatcgcacttacacttaactataacttgaatcatgtaagtgttggcgaacctgaactacgctttgtgcaagatcacttactctaattggaagttgatgtaccaatagatgacaaggacg

SEQ ID NO: 5201 - DNA, 428 bp, Diabrotica virgifera
  misc_feature (171)..(189): n is a, c, g, or t
agacccaattctgctgattttttggatgtaaatccgaattgttgggccgaatagctctaagaatacaaatgggacgatagttacctatatccgattttcgacctgatttatatattggagtgacataagaatttttccagtagtctggaaattcccctgttaataaagacnnnnnnnnnnnnnnnnnnngtgggcgcgatagaatgaagctgaatgctttaaggaaagtggggggaattccatcaggaccaggacctttgttggtattgagttcaaacagttttccgtaaatttttgaaatttcatggtgataattagacacattaacaaaaggtgaatcctgggtaacatgcggatgtaaggattggttagtataaatggaaaagaattggttagcaaaaagattagcaatatcagttccattgaag

SEQ ID NO: 5202 - DNA, 444 bp, Diabrotica virgifera
  misc_feature (370)..(396): n is a, c, g, or t
aaataaagtatcttaggtttaatttaatttttctatattcgtcaggatatacattatttcttaattttccttttcaaatggaggaggatacgtcaacaaagaaaaaagctcacagagatagacattcaggtagaaaattggaaaagaagaaagcaaaaaaagttactcaaaatggtgaagtgggtgctaaagaacgtaatccaaaagcattcgcttttaattcagctgtaagagctgaacgccgatttagacgaaaggaagatatagataccaaaaagcaacatgttcctcttgtagacagaacacctattgaacctcctcccatagtagttgctgtggtaggtccaccaaaagtgggaaagagtaccgnnnnnnnnnnnnnnnnnnnnnnnnnnncgaagttaccattaactaacataaatggtcctgttacaattgtaacca

SEQ ID NO: 5203 - DNA, 443 bp, Diabrotica virgifera
cccacgcgtccgagtagatcctttttcgttttcgaagcaatctgtgattaatcgtgatgttaaacctggtgtacaggaagacagtaaatggctgatacatagtgataggaatattccgaagaatgtggaacagtgggaggaaaggatgtacatccacgaccaatatacagggtactactgttggccgaaaaccttagaattatacgatacgccttccacgcaaaaaacggccgcgaaaaggctggacgatctgacggagatagaataggatgtttatacgttttttaacaataaggaaaatatagaaaagcttattaagtttctatcgttagatgaaaagaagggacgggatcatttcaacgcctatagattcctggcctttaagaatttatttacgatattcgaagactctctcttaccgaacttcgtacctcatctacaac

SEQ ID NO: 5204 - DNA, 412 bp, Diabrotica virgifera
  misc_feature (279)..(297): n is a, c, g, or t
aatcaagtaacgaaaaggtttgtactgtctgggcaggttcatgatgcgaataagaactggattaatgatataaccgatatgattaacgactatctgcatctaatttgaccttttagtgttaataatgttacttaagaccttctacaaggaaaattacaggctctgtacagtggagtgcttgctatagtccgttcgctaaactcaactggccagtgattttagtacgtaatctttttgtttttggccaattttgctaaaattggcaacattactaactannnnnnnnnnnnnnnnnnnccaaattggcaaaattacatactaaaatcactatccaattgtgtctgagtttagcgaaccgactataagagtcgaaattttactgaaatttgtagtggtgcatttttcgtcaatg

SEQ ID NO: 5205 - DNA, 260 bp, Diabrotica virgifera
  misc_feature (87)..(131): n is a, c, g, or t
tgttcccatagatgggcggccggcgtgttatttttaagtgcactcgacactcactatgaaaacgacgcttcgcgtcattagcgcacnnnnnnnnnnnnnnnnnnnnnnnnnnnnnnnnnnnnnnnnnnnnngtcgctgtagcaccaagagcatagaaccataaatcaggtgtgacgacgatgtagctgctcttgtcgtcgacattggctccgggatgtgcacagccggtttcgccggtgaggacgccccgtcgagctgtc

SEQ ID NO: 5206 - DNA, 279 bp, Diabrotica virgifera
tcttccccgtaattaacacgtttcttcaactacatatctccatgaagagtccaattttactacacaaagtgcgtgtacacaattagtaattggtcgtaagtgactgtaagctagacctcaaattgtcagcgaggaacatttttaagtatgcattataagtgtgagatcatttagccccgcccgtattagtgacgtcgccgttgagccgacggcatagataacgtattctaaatcgtattgcattgtcaatattctaaactggtcattagcacatgtggc

SEQ ID NO: 5207 - DNA, 446 bp, Diabrotica virgifera
  misc_feature (15)..(33): n is a, c, g, or t
gtccgcacacgcgannnnnnnnnnnnnnnnnnntatatccaagaactagatccgaataaatccgggttctggaaagtatctaaaatattaagaaacgaaagaaaaccaataccagccctacacggagcaaatggaatagtatacacagaaaaagaaaaggcagaagtcatgaaagataccctagaactaggaagcacaaagaactttcatcaggaagaagacctagacttcacaatagaagtagaaaacaacgctagaaggttaagaagaagaaagggaagaatagctctagaacacacgtctcctgaagaaattaaagaactactaaaaatggcaaacgcaaaaaaagccccaggggcctgacaatattacaaacaaggcattaaaaaacctgccaacaaaaataatagtttacatcacgaacattgtatactaagactaagata

SEQ ID NO: 5208 - DNA, 275 bp, Diabrotica virgifera
tcgtaattctcaggaagttagcaggcattaatatgcagtggttacgacgacatatgaggcatacgattatgaaaccacgttctctgtctcggatacatcgaggctagatgatttcgttttagctccgagaactacgatcttagcattgtcacagatcggctgtcatatggaatatggaaagaggtatgtcgtcaccaatcacggaaacagtgatctttatgttgaggtagtacatctcaatatccagggatggtgctccaacaatggtttgtggt

SEQ ID NO: 5209 - DNA, 458 bp, Diabrotica virgifera
  misc_feature (401)..(401): n is a, c, g, or t
cggggccacgcacgcgtccggaacattatataattaataagaataacatcttcatttaagaataacttttattttcgtatttatgtaatcttttaatacaaatgtaacacccaggaaacgcaaagaatgtctatcaatagtcaatttgctagtagaagtttgagacagcatttaaacttgaacccaaacactcctaggaaaaacgaggattatgcagcgaagggtgaagataccatgcatggatgtaatgtacgggatgaggtgttggccaaatattgggaagatggcaagtattacaatgccacagtaatctcagttactcctcgaacatttgctgttcgggttacaggatatggaaatatcaaggagatattaaaactgattgtttacaagtaccgcanaacaatgcgagaccaagcagtaatcaagatcagcaatatgaatataatagacaatac

SEQ ID NO: 5210 - DNA, 424 bp, Diabrotica virgifera
  misc_feature (400)..(400): n is a, c, g, or t
acccttccgaaaatacatgccaacctaggtgatctaattaactataattgtgccaatggtggtgctgattttggctgttttgactttgcgtaccacctcaaataatgaaatgtaccaccagtggtacatgtaccagagattgagaaccgctgacctagaccttaagatatataaaattattgttaatttgtccgttaacattttgctatttaataagggccggcgtagctcaggctgtaggatatctgactcgcatgctggtaggccggggttcgaaacccgcgccggcgagaacatctagatatttttaaaaatgtctataggccccaggtcgactcagcctgaataaaattagtaatttgggtaaaaccaagggtaataataagcggttgaagcgtancactgaccctgttacctttcttgt

SEQ ID NO: 5211 - DNA, 209 bp, Diabrotica virgifera
acgcgatccgcagatacctgtcgacctaggtgatcgattttcctatatttgcgccattggtggtgcagatttgggctgttttggcattcctaacacctcttacacctgtttgtaccaccaatgtcactttgaccagagtttgagatccggtgtgctcaccgttaagattgattggacgcgggatattgtctctgctaacgtttcgctat

SEQ ID NO: 5212 - DNA, 429 bp, Diabrotica virgifera
  misc_feature (261)..(261): n is a, c, g, or t
  misc_feature (302)..(303): n is a, c, g, or t
  misc_feature (330)..(332): n is a, c, g, or t
  misc_feature (358)..(359): n is a, c, g, or t
gggcccaccaaccctccggtataagttgagaattggttaaccgggaacaacaatacaatccaaccccaaataacaaccaagccaaattgggaaaggaaaaagcaaggttggaaacaatcctccggtttaatcctttaacaactggaataaaaacgggaagttggttaaattttgcccggtggccaagccggtgaatggtttggaaccaaaagccaaaagtcagcgaagaagaaacagggattctttgctctgaagattaantttgaggtaattttggctaaagtaatttgcctggtgcaagnntgctgttaaatttggaaaattgctagnnntgctttccgccaactaactcaacagnnaatgaagaacggggcgttcaaatcaaagttaagaaagaaaatggcaaagaaaagtcctacaaacgaatag

SEQ ID NO: 5213 - DNA, 336 bp, Diabrotica virgifera
gtccggattcgaaatcgttcacatatattcgtcataacagttcttatcacccatacaggtatccatcagacggatgcttttgtgctactggtctattattgtggagacagacactatccacattctagtcccgattatcaaagtattgatctacagaatggtgtcgttgtcggtggtccacatacacacggttccgataacggcaatgatgggcacgataatgagactacaataggtggaccagatgatggtaccgataaacgtggactatacatcaatgtaaacgggtgcatgtatactggacaaacacgtaatgcctgcaacagtattagtcat

SEQ ID NO: 5214 - DNA, 452 bp, Diabrotica virgifera
  misc_feature (315)..(337): n is a, c, g, or t
  misc_feature (365)..(366): n is a, c, g, or t
  misc_feature (376)..(376): n is a, c, g, or t
  misc_feature (410)..(410): n is a, c, g, or t
  misc_feature (423)..(423): n is a, c, g, or t
cgcgtccgcatgcaaatgatcatcaggcaaaaactgcttaacagtctttgaattaatattctgttttggaattaaaacagaatctttaattacagataaacgagttctcaatactcttccaaacataagttcacaaggagccttgcctgttgatatgtgtggggctgttctataacttaacaaccacgataacaatctctgctcagtttcatcagaatcaaacttactcgataacaaagctttcttaaaagattgaactgcccgctcagcttgaccattactggctgggtggtatggagcagtacaaatatgccnnnnnnnnnnnnnnnnnnnnnnnctactgaattcctctgaaatccactganngacattgtcnagtgacatctgctcgggcagtcaaaatctagcanacatactacgtanacatttaattgttaaccctgctgtagttt

SEQ ID NO: 5215 - DNA, 321 bp, Diabrotica virgifera
  misc_feature (14)..(37): n is a, c, g, or t
cacgcatccgcagnnnnnnnnnnnnnnnnnnnnnnnntatttatgttatggaaatttcgtaatggaatatatgcatttacaacacatcgacatgtcatgagcttcattacatcgcgtgctgatcttacactaggaggcgttgttgtctcacatctgagtagcagtttgccgagttatggaaatgttctagagactgagctcatttaagtaaatttatctattaatcgggcagctgtctcacttggtgtggcaactgaaagttcaggagtcatgaatttaggcatgttgtgcatgaaaatgtgtaaatatatatcattttta

SEQ ID NO: 5216 - DNA, 464 bp, Diabrotica virgifera
  misc_feature (345)..(345): n is a, c, g, or t
aagggtccaccaacccttcgggacttttaatagtttaaggaccggaggtacttaaaggacctattagacccaaaccacatttgaccacagggaaccatccatggattgactacctaaaattacccgtaaaatgcattggaataccatacgaccctacaaccagaaccaccagaactgacaacaaatgaagatgttaatataaatgcacaggaagttactcgaaaagctgaagaacagagaagctgcaggtaaagacggaataccaaacgaattactgtaatattgtaggaacaatgtcattgaggaacaatgacagaacagttaacagcattacataattattanacacaataaactactagaaaaatggagaacaagcgaaataatattttaaaaactgctatttaaaaaaggaaataaaaaacagccagaaatttacacaggtataaactgctaaatactac

SEQ ID NO: 5217 - DNA, 296 bp, Diabrotica virgifera
  misc_feature (2)..(23): n is a, c, g, or t
  misc_feature (25)..(58): n is a, c, g, or t
  misc_feature (60)..(132): n is a, c, g, or t
  misc_feature (135)..(154): n is a, c, g, or t
  misc_feature (156)..(206): n is a, c, g, or t
  misc_feature (214)..(269): n is a, c, g, or t
annnnnnnnnnnnnnnnnnnnnngnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnagnnnnnnnnnnnnnnnnnnnncnnnnnnnnnnnnnnnnnnnnnnnnnnnnnnnnnnnnnnnnnnnnnnnnnnngactattnnnnnnnnnnnnnnnnnnnnnnnnnnnnnnnnnnnnnnnnnnnnnnnnnnnnnnnntaagtattgatgataatataagtatta

SEQ ID NO: 5218 - DNA, 446 bp, Diabrotica virgifera
gtccaccgacccgtccgcaggtataattgaaggtccaccaggtcccccaggacccccaggggccaaaggcgattccggagtgatgggacctccaggaatttccggcctaaacggagaaccaggacttcagggacctccaggtcttccggggtctacaggagacaaaggagataaaggagactacggtgatattgggccgccaggacttatgggacctccaggattgccgggacctcctggttatcctggacagaaaggagagaaaggagaaaaaggagactcgaagtacaaaaaactgagaaggcgacagggagacggcacgggagagttttctaccggagaattgattatgggacctccaggaccacctggtcctccaggagtaccaggcttacagggtcctccaggaatcaagggtgatcgaggtgcagacggactaaagggtg

SEQ ID NO: 5219 - DNA, 439 bp, Diabrotica virgifera
  misc_feature (232)..(250): n is a, c, g, or t
cacacgcgtccgacaaaatacaatatgtatataaaaaggaatatgcatcctcgtctaacctgcgattctgagaaacgtgtttagctatttttagctcgtcagaaagaatttacttgaaggacgaggtaaagagaatatccttttgtatgttggttaattttctataagctataatctataaatttattgcatcgttttatgtttctacttaatatttaaggactaactcttnnnnnnnnnnnnnnnnnnncaaataataaccgtcagctattagtaaagaaaaagtggaaactgaaaaaaatatattatgaagaaacttagtatttggcaggatagcctttgtttttaacacagattcgagattctgcgaggcaaatagtttacgagaggagccaaatattccggtggaataactctaaaccagttttgaataatgggt

SEQ ID NO: 5220 - DNA, 187 bp, Diabrotica virgifera
  misc_feature (4)..(4): n is a, c, g, or t
  misc_feature (11)..(85): n is a, c, g, or t
  misc_feature (87)..(175): n is a, c, g, or t
agangatgacnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagtaataatat

SEQ ID NO: 5221 - DNA, 327 bp, Diabrotica virgifera
  misc_feature (22)..(61): n is a, c, g, or t
  misc_feature (71)..(91): n is a, c, g, or t
  misc_feature (136)..(136): n is a, c, g, or t
  misc_feature (299)..(323): n is a, c, g, or t
gtagtttacgtttaattataannnnnnnnnnnnnnnnnnnnnnnnnnnnnnnnnnnnnnnnatgtaaaagnnnnnnnnnnnnnnnnnnnnntttcgaccctacatctaattttaatttaacaataaacgtattagnaacagtattagatctattaattattccatctagatttgtataatcccctcgccttataattatttagtaatagacattattataacattacatagataaatttaaatgttttaaggtcaaattataaatcccgatgaagaacattaatttttatctcactagnnnnnnnnnnnnnnnnnnnnnnnnngctt

SEQ ID NO: 5222 - DNA, 427 bp, Diabrotica virgifera
tatttcctgtgctcctgttgatgttctactcataatattaatatcatcagcataagcggccagttgaaccgttcggttggtcagtagatttcctcgtcctcgtaagtccaatttgaccactgataattagtgcttttaatatttgattgatgcaaaccatagcagctagatgtattttatagctcctgcattaacaccttggctgcgtcgactgtgttgtaatgcatggtgataaatacggtttaccatattttcaactaaaaatataaatatgtctaaatgcagccaaggtgttaattccacataccagtatttaacagtaaggaatagatagaaaatatccattttaccctgattgtaatacagtatatcctccgttaaccaaaacatcgtttaactgaaatgactgaaagtttcaataacttca

SEQ ID NO: 5223 - DNA, 451 bp, Diabrotica virgifera
ccgggtgcacccacgcatccggattgctagagttctagtagatttgcttatcggttgtatcttatcatatcgtttaacagctttatttaccgtatggctcatcggtttcccggccctgtgccatatcaccatctaggacgaccgcctcctcagagatatcaacaacagccccctaatcaaggaattcggcaatatgcacaacagattttccctcaacgacctggatacaatcctcgaccagcaaatataccatctaatggcggtacgatgattcatagacctgctggtgctccctattcaccattcagacgtgggattattccgccacagcaatgatttacaatgcctgcagacaataggactcacatgcaacacagaagtaatgaatacatccatactacatgtaagaagaacgataagctggcggttaatatcctgccacataaagtca

SEQ ID NO: 5224 - DNA, 438 bp, Diabrotica virgifera
aaactcttaggtctgttttagaacttatttaaaagtttaccctttcagaaaaatgtcagggataatgtcttctagaattccaatgatacgaagagttatcccaatagtagctcggaggtttgtatccacttcccaaaagaagaatgttacagcagaagcagtagatgctgcaaaatctaaagcaaaagtagcagaccaaaactggataagttacgggtatgagtacacgtcgaaaacagatgaccgaaatgccatgcattcaataatgttcgtctcaatcaccctatgtatagttatgggaacactcttctttgcctacatgcccgactataatttaagggattgggcacaaagggaagcctttttagaattgcggaggagagaagaacaagggctgccacccatagatgctaattttgtagatccatcaaaaattac

SEQ ID NO: 5225 - DNA, 432 bp, Diabrotica virgifera
  misc_feature (219)..(294): n is a, c, g, or t
gttatattctctctacgcatttgagtataagtggtttaatatgggatgggaattacacaaaagactgtctttcatagaaactcattggccttatttcatgggatttggtttaccaatggccattgttacccagttatctgactcgtgggtgataagtggctgtgtgttctctgtattatttccctttttcataattagtggaaatgaggctagtcctannnnnnnnnnnnnnnnnnnnnnnnnnnnnnnnnnnnnnnnnnnnnnnnnnnnnnnnnnnnnnnnnnnnnnnnnnnnaatcggcagttctaagaggtgaaaaagattgaaatgctcaacaatgattcattgtaaatatatgattaagaatttatacataagtgacgattttattttaattctttttgacaacttggaatttatgtttttcttttt

SEQ ID NO: 5226 - DNA, 434 bp, Diabrotica virgifera
aatattgtccaggcctctgcgccatatagcaagaccggaaataataacattttaacagccgcatttttagtgggagagatattatatcgcaatgggtgaaaatatttctcatgcatgttgttaaatgttgctatgtccttttcaactctagatcttatttcggttgtttcgtatttcgagttgacaactgttccaaggtaaaaaatatttttgaacttgggtattatacatttcatttcaaccaatcttttcactaaattattaatgattataatgtaaagtcatgcctacatccacatgtagttatttcaaggtttacttttactgtatgtattattagaatcccgtttttaggaatatcccagtttaaggaatacaaatttgaggtcccgaaactttttcatttactctttaagggggtaggtgcaaaatct

SEQ ID NO: 5227 - DNA, 259 bp, Diabrotica virgifera
  misc_feature (213)..(239): n is a, c, g, or t
acaaatagttgccttataacaaggtcatttgtgccaaattgcaattatgaaatttgtcgtctcatatctgacaaatgttgaagattttaaaaacatcactgtaattgtatacattcatataaaaatgttaacaattacagtgatgtttttatatgaatgtatatttatatgataattatatttaccaaatagttgttaacattccgttgaccnnnnnnnnnnnnnnnnnnnnnnnnnnngtgaatatataattttatca

SEQ ID NO: 5228 - DNA, 217 bp, Diabrotica virgifera
  misc_feature (33)..(97): n is a, c, g, or t
  misc_feature (107)..(148): n is a, c, g, or t
catatttaaaataggttattatgtatttttagnnnnnnnnnnnnnnnnnnnnnnnnnnnnnnnnnnnnnnnnnnnnnnnnnnnnnnnnnnnnnnnnnctaagtagtnnnnnnnnnnnnnnnnnnnnnnnnnnnnnnnnnnnnnnnnnnaggtttaataagtaattgtcaaaattttttctacgtgtttattaaaacagtcttttgttctattaaata

SEQ ID NO: 5229 - DNA, 432 bp, Diabrotica virgifera
  misc_feature (57)..(84): n is a, c, g, or t
  misc_feature (166)..(183): n is a, c, g, or t
  misc_feature (214)..(227): n is a, c, g, or t
  misc_feature (229)..(247): n is a, c, g, or t
catcggtctaataagcaaattgcctaagtcacatattgaaaattttacaggaaagannnnnnnnnnnnnnnnnnnnnnnnnnnngaggataataaaaaagtaaaggaacaaaagtaaaaaagagaaaattgcctaactccctgcaatacataattgaccaaaatgnnnnnnnnnnnnnnnnnncacaaactttctacttattatactatatccnnnnnnnnnnnnnncnnnnnnnnnnnnnnnnnnncttacattttctaacgttttcaataaaaacaacttcagaaacactgacataggcaatattcgtataaatgggtaagaacgtttggacttcagcaaaattcgtttagcgaaattggcgcgaaataaaataataatggcgcttgtgggaaatgtcaggcggtagcttttaccgtctactactagatg

SEQ ID NO: 5230 - DNA, 438 bp, Diabrotica virgifera
cacaaactgcagatgacgctgcggagtcagttggcgaagtaaaagagtctgttagtacatcatataacaatctacctaatgaaacagctcaggctcaactgcttccaatagaagtcgatgacatgcaacgaaatctagtccagactgaataacatatcaacaccgtgaacgaaaaactgcgagcagtttttgaaagcattgaagaactagcagcactccaatcggacactaaacgcagctctgatatgatcaaatcaaacttaaataagctgactcagcagatcgacttagctagagatatagccaataggattaaactatgagtaaaattctttactaatacgactttggtattaagaaatcctaagagtctagaggccttgagtacttcttcgaagttttcagggtacttcaaaactaatgaaaggcagggtctta

SEQ ID NO: 5231 - DNA, 433 bp, Diabrotica virgifera
cgtccgggaatagaaaacggtcatgtttagcacattaccatcaccaaatccattattgtagcctgttcctgcaccatagcccgttgacgtcgatttgcaatataccagtgccagtgccagtcaaagcaccagtaccaatagatcgtccacatccagtacacgtgcctaaaccatatacggttcccgtagagaaaccactaccatgctcagtaaatccgatggtaccataccctgttatagtaccatactcagtacatcacccagtacctcatccagtacctgttcgaaatccagtatcaaacacagtccataagccaatgccatatacagttaacgtacccgtaatcgtaaacatgatagtctcagttattgtccacggtcatgacgatcatggcattggcagccgttttgatagtggttagcatggttttgg

SEQ ID NO: 5232 - DNA, 449 bp, Diabrotica virgifera
  misc_feature (16)..(34): n is a, c, g, or t
gaaagacaaacatgcnnnnnnnnnnnnnnnnnnncaatgctaaatgacactgcagtaacatagcaaagaaataattttgcagcaaacgtagcagattgtgttgttgaagttgaaaagtcataagtataaacaataaatttatttttgcgaaatggctgaagatcatgatgcagattgtaagactgtatttgtagaggactggctatgtagcagtaatattttaggtgaaggggcttatggagaagtgaaattgttagaacataaaaacaccaaagagaaaatagcctgtaaaatgattgatcataataaatataaagacgcttcagcaaatataaatagagaagttagtattcataaattattagaccatgagaatattattaaatattatggtagacgacaagaaccaaataaggaatatatattcctggaatttgccgctggcggga

SEQ ID NO: 5233 - DNA, 121 bp, Diabrotica virgifera
gtccggtttgtttcgtgttgttttcaccagtttttcggtgggttgcgtgtgtgtcctttctttgccgctgtgttttgctgtgggcgtctgtgggtgggtttcactgtgggttctggggtct

SEQ ID NO: 5234 - DNA, 421 bp, Diabrotica virgifera
cttacattgtcttaagggaaaagcacttttttcatgtccaaatgcggtcgttttttttttcaactcatccattttgcgtctgaataacgccaaccatccttgcgaaattgtcacacggttgcgtttgtggtcgattgtgagcaaacgcggcacccaactggcagaaagctttctcatacccaagtgatattcagaattgaaaccactgagtcatgtgagatgcctatagcttccataatatctctcactttcaatctacgattggctaaaaccatatcgtgaattttttcaattgtttctgatgtagaaacctcaatcaaaacgtccggcatcttccgtgcttgtacggccacatcaaaattcagtaaaccacttctttaaacatggaaatgggaagtgcagaattcccataatatatctc

SEQ ID NO: 5235 - DNA, 83 bp, Diabrotica virgifera
tcgacgcaggcgtcagcccacgcttaagttcttacttattttagagtaatagtctcattctcagaccatgtattcacgtattt

SEQ ID NO: 5236 - DNA, 98 bp, Diabrotica virgifera
atagagtaatctacttaaatcactacaagaattttccgattccacaaatttttgtatcaacaattatatacccaatccgttaacagacataatgccag

SEQ ID NO: 5237 - DNA, 195 bp, Diabrotica virgifera
  misc_feature (52)..(76): n is a, c, g, or t
  misc_feature (86)..(106): n is a, c, g, or t
  misc_feature (127)..(148): n is a, c, g, or t
  misc_feature (167)..(185): n is a, c, g, or t
tttgttaatataagtagcgacaacttttatttgttgatcgctaattcgtacnnnnnnnnnnnnnnnnnnnnnnnnncaagaaaacnnnnnnnnnnnnnnnnnnnnnctcacggattactacttaacnnnnnnnnnnnnnnnnnnnnnngatttaaaagagctaacannnnnnnnnnnnnnnnnnnacctcgatat

SEQ ID NO: 5238 - DNA, 323 bp, Diabrotica virgifera
atcacatactcacaccatggcgtcacgttttttgattgcatcaatccatgcgtaatgctttcgaggcatctgtttagcacgtggtcacgtgctgaggagtgtactcactagtcatcagccacgtcccattcatagtgaatcacattcagcatacccatacagtcctcgatcacgtctgccatgatcgaagcgctcggcagtggccgcgaacattatatcgtcatcagttactccgggagcatctaccactgtgtagttgtagaccatggatgtggaagtggatgtcattttggctgacactgacactgttgggaaggtggaat

SEQ ID NO: 5239 - DNA, 451 bp, Diabrotica virgifera
  misc_feature (428)..(428): n is a, c, g, or t
gataaattaaaaatccaatgtaaattttatatttgataaaatacgaaatattaaataccaaaactatgattgcatttaccagactagtatttgtagccttaattatagccactacatcagcaagcaccttagaacatgatggatcagtaaccattcgtcttcaacactctttaactttccaaaaccctcctgtttggactgaaagaggaaacataaccatagtgagtttgaggctagggcaggccacagtggaccaaaagccccttttgccagaagaaaagaaactgttaagggacttgtctgcaaaaaatagctactatcagatcaaagccatagttacagcaaatgatggatcacagaagtcttttatatccacattaaaagcttgtatgttggcagaatctgagctagatgatagactctccgtntctattgactatatgggtagagt

SEQ ID NO: 5240 - DNA, 447 bp, Diabrotica virgifera
ccacgcgaccggtagtattttattttgtacctatgtagcaaatatttatgcttgtactagtttctcatatatatgcaatttatattgagctaaagatttaattgtaacagaagtaacgacaatcaaataagacagaacatataactaaatgctggtttaaattaccaatacttcaaacctttcaaagtgcttctcatatttaatgaatttttttagatttcttactcttttcattttgtcacctattgtgtaattatgtgattcaatatatttttcgaaatcttgttctggtcttttgtacggtttcttcattatacacttttattatactagtacactacagtactgattctagttactgagctagtttgtctggccataggactcgagctaccttcgtagatatctcatttgggttctctttaatagattaacatttctttttgc

SEQ ID NO: 5241 - DNA, 149 bp, Diabrotica virgifera
ccccattaatgcgcaacgcaacgtgctaatgaggcctcgcaatgtcacagcgcagcgtgctaatgaggcctcgccctaatgcgtttctgcctttaacaaacattcactaacaaaaacaccttgggccttggtaattgggtggaataata

SEQ ID NO: 5242 - DNA, 94 bp, Diabrotica virgifera
cgtccgccaagcgtacggttcgtttgtgaatttgttaattttgtatatgacaaaggcataatttaaatattctaaattctagaaatcgcgttat

SEQ ID NO: 5243 - DNA, 119 bp, Diabrotica virgifera
cacgcgaccgccagcgcgtccgggtttatttatattcagtaaataaataaaaagtttacaattaatttcaatttttatcaaacattgttgtaaagtacgccttcatttacagtaaattc

SEQ ID NO: 5244 - DNA, 404 bp, Diabrotica virgifera
cccacgcgtacgctagatcatctttccctagtataccttaatgtatctgcctactacccaagtactggtaggcacgtggcattaggagttactggcaatgtaaggctactctgctctcaccgttcccagatttacattcgttcaagtccatactacccattaactgtcgacttcaccctcataagtccaaatgctcgaaccagaactctgcaaattgaagattccaggatcggtcagtagcttggttattccagcctccaatgtgtcaacagtcaaggtgtcaaccagtctgacgtacgtgctgatctattcagtcgatatcctggtattgttgattcacattccttctatcatttgttgtacattcttccacatttggtacatactcaattcagcaacaaaat

SEQ ID NO: 5245 - DNA, 282 bp, Diabrotica virgifera
  misc_feature (102)..(119): n is a, c, g, or t
tttatgtttgatcatttagtttatagtgagcgtttagagcaattttatttatagtaagaaaaataatattatgtcaataatattttagttttttactagtannnnnnnnnnnnnnnnnngtgtgtattagggattattaatgaagaggtattgttctattatgtacgtatttaggagagcatagatggtgagttttttaatgtgtacgttgtggtttaattatatttattgcatcaaaatgttaatcgtttatatcaatatcgtgattgattagttcataga

SEQ ID NO: 5246 - DNA, 131 bp, Diabrotica virgifera
  misc_feature (6)..(24): n is a, c, g, or t
  misc_feature (69)..(107): n is a, c, g, or t
catacnnnnnnnnnnnnnnnnnnngttaaggaaaaattttattaaaggaaagttaattagaatggtggnnnnnnnnnnnnnnnnnnnnnnnnnnnnnnnnnnnnnnngtaccttgggaaccagggattatt

SEQ ID NO: 5247 - DNA, 367 bp, Diabrotica virgifera
acgagatatcttggaatccaatcaggactttagaccgttcaaacacacttcttccagcgagactgaatgcgaagtcagaccgattcttaagcagaacagtagggaggaaccggtcagacaaagactgtcgttttgtagtgaacacaccaacattagagatgaaccaagacccagaacttccagaaggtcgcatacgatttgtactgattttaacgtaggggattttaatttagacacaagagaaagggatgaaatgctcaataaaccgagacctttttcggtgcgcgatttggtgaaatcgtttgaaaccgattgctcaaccggggctatacccaaaagaagtagtttgaagaggaatagcgataga

SEQ ID NO: 5248 - DNA, 399 bp, Diabrotica virgifera
aacatgtacaaaataattgcataagtccagaaccaaataatggcagtgaaatgtcaacttctgacgttgatgtatcacagcaagtcccgaatggtacgacgacggagaagataagcgaaggaatgacatcccttaagtccatggctcaacaagtgatagaccaagctggcctacaaaacaaccaagtcattctagaaccaagcaagttacaaaaccaaggcaagtctgacgcccacataccccccttactgggagttgcgccactgggcgctatacctctccaaaaagaacaccagacccagttccaacttatggaagcggcgtactaccacatgcctcacccttcagattcggagaggataagaacgtacctgccaaggagcccttgcacaacacctt

SEQ ID NO: 5249 - DNA, 433 bp, Diabrotica virgifera
  misc_feature (51)..(51): n is a, c, g, or t
  misc_feature (91)..(91): n is a, c, g, or t
  misc_feature (264)..(284): n is a, c, g, or t
ggtcgagcacgcgtccgaccacacgtccgggggttcagccacatccagcanaggggttcgtgcgctagacgttctacggtgagctgttcanaatttttacagtgttgcattgtttcttttcattttagttgtactagttttatgcaaaagtttttttcttttaatttatttaatcattaaattatttgaaacccatttctttagcaatttactgtttataatttcctgtcacaaatattggcaatatcattaaagtaatctacnnnnnnnnnnnnnnnnnnnnntacagaatagaacagaacagaatagaaaacgctagagcaaattttaacaaaatgagaaaagtgctctgcacaagagatttgaagttggagctaagtgttagtttggctaggtgctacgtgttctcgactttattttatgtaatggaagc

SEQ ID NO: 5250 - DNA, 420 bp, Diabrotica virgifera
cgtccaaatgttttcttatgttaattttgaaacaccctgtaggaaggacaaggtacaaattaggtatttcaggattgacaacattataccatgtcaaatgttacaatgataaaaccaatgaatggtataaacctaccgatatgaatatctacagatcagccttatcagcctgtgttattgatggattaccaaatgttcatgattatatacacaaacatagagataaactcatggaggaaaaacgacaaaagatgatagcattagaaaatcatcgaaatcttgtgaatgatcaaaataacaacaacaatcatgacactatagctgcagcagtgaacgcaaacatgcaacaactcaacatcctacaacaactaaatggtcatctaaatccagctctaacaccagcccatgttcccgatccgc

SEQ ID NO: 5251 - DNA, 219 bp, Diabrotica virgifera
agtcaaggtatagtcatagcactagcaattgtgtttgaatgtgtagctagaacattgggtccaagatgttagcctatcagcttcacagcgcaatttttgcttatgttttgtgaaagcgttgatcctgagtccgactggtactataatgacgttttcattcggagccatatacatgggaagaggagcatgtccgcatactacattttcaggttccataga

SEQ ID NO: 5252 - DNA, 526 bp, Diabrotica virgifera
  misc_feature (11)..(28): n is a, c, g, or t
cccaagcgtannnnnnnnnnnnnnnnnncgttccttgcccagtagttgagtgacacccaaaggtcaccagcgaccgataagtgataccacaaacaccattgctcccttacttcttttagtcgtgattatggtgttttcattcaaactttactaccctgcgtgactaatgtaaatagtgtgtgatgtccttgttttgattcgattgattgtttgtgcgcaccggcttctcaatgacattctttttcaaacgatatgatgttgtctacatcgaccgaaactcgaggatgaaacggctaaggcgacaaatcggccagatatgtctccaagtcatgggtctacccctcattggagccggcgttttcaccttcgtgttcttcgaggctatctacgaattcattcttgccgaagccctcaaattcagacccgaatcacgaccgtataaagcgtggagcaacaacgaccctccattcagcatggacatcttccggttcaattgggcaaatcccgaacaaatctataccatttc

SEQ ID NO: 5253 - DNA, 366 bp, Diabrotica virgifera
  misc_feature (110)..(129): n is a, c, g, or t
agaaatacatatatttatttgtcaattaaaaaaacacataaaacacgactaatatattacggaaagagatttagtgattgttgtagacgcctttatttattctccaatgnnnnnnnnnnnnnnnnnnnngtgagtacctgtatcaacacgatttattaaaattccattctcttccaatagaaccacaataagaaaccgcttatagatgcttttcatacataatataagtacacaaagtaaagtactatttaaatcttaaaatctttaagactgtatataactttaacttaatctttacgactttggtccaaatagtaattccactaaaattaaaggttaattttaaaaccagtaattggttaatta

SEQ ID NO: 5254 - DNA, 371 bp, Diabrotica virgifera
aaaaatacttactctgtcgcgttgaggcaacaggattatatttacgtaaaaagtaacgaaaaatcaagaaacatgatgaaatgattattacgacagtggcgtacattctaagggagaaaagggggaaaaagaagtatatatccctattgcatgcctctagtaacagctggaaactatcttttaacactagttaaagtattcttacatgtgtaaactgtttttgacttaaaaacacataacgcttggggaactgctggtaagaagaggaaccacttggaatgatgcaagacgaatggcaagaaataaaaaagaatggataaaatatgtatactagtagtggtatactgactgccacacatcattagatgata

SEQ ID NO: 5255 - DNA, 394 bp, Diabrotica virgifera
gccgtgcttgtttcagaccattccgggtggcagcggtccattttattgacctttagagctcactgagatggatttgctgtcagcccactcctatgctgagcacgacttggaggaaaatgtagaggattgtacatttaattaccctattgcatgccgctaataacttcaggatcctcgccttgagcacgtattaacgtaatcttatgtatgtggacagtgtttaaattgctgtctctttggcgtgttcaagtgcaggtaagcaatttgacctgttcggattacacatgtaccattgctagaattggttaaatgtggctaaaatatgtcttccaataatggtatactgactggcacacatcattagatgataataaaaatggctcctggttatcgc

SEQ ID NO: 5256 - DNA, 651 bp, Diabrotica virgifera
  misc_feature (310)..(310): n is a, c, g, or t
  misc_feature (405)..(405): n is a, c, g, or t
caaaatctatttgatttttctctaatctattttaaatgttttatgtacagtttaagtaatttacactttttgaatgtttatctaaattaaatccgtcatttatgcaatgaaagtgtaattacaaaatgtcaggaatgtcaccatcagagaggagattgcagaaggaattgatgtctctcatcaaagaacccccaccaggagtctcagtagatactgacataaccgaaaagaatttactacattgggttataaacatggacggagccgccggtaccctgtatgagggtgaacactttcaacttcaatttanatttagtaataaatatccatttgattctcccgaggtaaccttcgtaagaacaaacattccaattcaaccaaaaggttaaaataatggggcatatntgcttatcaattttaacggatgattggtcgcctgccttgtccgttcaatcagtttgcctgtcaatagtatctatgctaagtaactgttaagaaaaacaacgaccaccgggataactccttttatataaaaacttgcagtaaaaatcctaagaaaaccaaatggtggtatcatgatgattccgtgtaatggctggtcacagtgaatggaacttaaaagttatgtgattataataatatattattgtt

SEQ ID NO: 5257 - DNA, 515 bp, Diabrotica virgifera
  misc_feature (232)..(301): n is a, c, g, or t
gaaataagccacaatttaacttaaaaaatgagtgttattaaacgtcaacaaaatcattttataagttaaattgtggtttatttcccatttagaataataaactacatctcaaaggcgtcaattcttctatctgccgttctatcttaagatagtcaatatctgatacaacgctgactgaaaatcacattaactgagatatattttctgttccatagatattataagagagaannnnnnnnnnnnnnnnnnnnnnnnnnnnnnnnnnnnnnnnnnnnnnnnnnnnnnnnnnnnnnnnnnnnnncaaaatcgccatattggtatgaaaaaatattcttttacagtttctaatacctcaatgatttaataaaaaaaattcgtcgtcatacagtataagacagaccttgaaaataggtttttaacaacacctaaccacatatataacactaaattttagtaatgtcatataaaaaaataattccttaactagtatttaacaagaattattgataaattac

SEQ ID NO: 5258 - DNA, 536 bp, Diabrotica virgifera
aaattgctgaatttcttttagcgcttttagtatattatggaatctatgagatttttaacattgtttgtaaatatgtggacgacgagcatgtatgtcgtgtcacatttagtatgcacctatagatgatttttgtagatgcacaactagttattttaaatatgttattttacaactacacagttgagtccgcgattctttacccgtgcgtcaataatacctggcgagattaaacacatactttttaaccaacatcaatcccctccaagcatgaaattaatgacaaaccagctgccgtctgttaataagttaaaacacatgttatttttatgaacgatctagactcaatgcattgaaaagagataggtacaaagaaagacgattggggatgttttcacatattctaagtacaatttctgacgttttggtttgtttacttttgtggctgtcagtttgttaaagtttttgctgttattttgtcgaatttttgcattttgatgttttttataatttacaaacagttgttttcacaactaatt

SEQ ID NO: 5259 - DNA, 95 bp, Diabrotica virgifera
tttcgtacaattcctagcgtacgctgtccattttattgacgtttatgtctcatcgcggtcgttttgcttgcagaccatcccttgccaatcatcac

SEQ ID NO: 5260 - DNA, 253 bp, Diabrotica virgifera
agtcaacctccggacctcctgacgcacattcgaccatgacttatgattccagccgtcttcaacaaagcctcttgccatggtttccatgaagaccaaactttacgagatgcagcttgcgactcaccatggggatgattaagcccattcgatgctgggtcactaattgcacgcaactggtcgtgctgaaagtgtcaattgtgaagtacgttgatcatgactacattgcccctcatgttcaaagtggtctcatcac

SEQ ID NO: 5261 - DNA, 397 bp, Diabrotica virgifera
gattaatattccaaatgaaagaaatgtgtttttagacttaatatttacaaatgtttgtgatttacaagtagcaaaagcctcagatccgatttttaaaaatagttatcatcacataagttacacttacaatattagtttgtgtgaacatcgaggtaagtcattagaatatactgaattttatcatgattttgtaaatgcagactatgaaggtctcaataactatctttcaatgataccttgggaagaccatttgaatttgtcaaatgttgatgatgctttaacagaattttacaacatacttaatatgtcactatcattgtttgtaccggtgaaaagatttaaaacttctagttatccaaaatggtttgatgccaacttgcgttatttagttgtacag

SEQ ID NO: 5262 - DNA, 280 bp, Diabrotica virgifera
  misc_feature (49)..(49): n is a, c, g, or t
cgcgtcagcggaaacgtgggttactattctagtttgctcgttttttgtncggtttatgtcttttgccctttttggctgcttggcttcgttgcctccgtcttttgtgctctgttgctctggttggggggtgtccggtctgtctccatccgttatgcgattgctgtttgatttgctgtctctcatcatctaacttcgactatgagactcagtagttactgacatatttgtaaataattgactacattgggttataatcatggactgatccgtcggttacctg

SEQ ID NO: 5263 - DNA, 239 bp, Diabrotica virgifera
  misc_feature (12)..(73): n is a, c, g, or t
cccaagcgtacnnnnnnnnnnnnnnnnnnnnnnnnnnnnnnnnnnnnnnnnnnnnnnnnnnnnnnnnnnnnnntgggtaaatataaaaagaaagaggatcaaaaacaggatgtaactgtaaatttgttaagagtggatgtgatgttaaaaaaactgtcttaatttgccttagttttaattgagagtttatgcatttaagcttgtgttactgagtaagatctgggtgtacgatattgatt

SEQ ID NO: 5264 - DNA, 240 bp, Diabrotica virgifera
  misc_feature (11)..(50): n is a, c, g, or t
cggacgcgtannnnnnnnnnnnnnnnnnnnnnnnnnnnnnnnnnnnnnnnattcgtttggtttataaaatgagtttaaaagatggaccaccaagaaaattaagaaaactggaagatataaaacccaatgtccaacaacctataacacagagtactatagcagttccttctggttcttctacaagactttgtccttatttggatacgattaacaggcaataattaaattttgaattccaaa

SEQ ID NO: 5265 - DNA, 426 bp, Diabrotica virgifera
acaagcgtccgcaaaaattttcgtaaaatggaattggaagaacaattggatgaagaccttttggtttaattaaattttacaaacacattcctaagaagaattcaaaatgaagagctatcaaaaagagcacaagtgtgggtgcaaaaattaatccgcgaaccatgccaaaggctacagaaaaagagatgcagaaatatataattaaccaaccttccggtaagaatgcaaaatgggcctccagaaaaaccaattaaggcacccgcaagaaatactggtatactaaaccccaataaattgttgggaccaatcccggaaacggttaaattaccgtcttggctaaatgatccagaattagcccccacaagaattcaaacttcggaaggcaaaggaaaacgaggaaaaacttaggtagcaacccgaacatta

SEQ ID NO: 5266 - DNA, 57 bp, Diabrotica virgifera
acccacgcatccactacacctccggtctctgcttttcatatttcagttcttaatcgt

SEQ ID NO: 5267 - DNA, 237 bp, Diabrotica virgifera
ccacgcgtccaatttaatagcgtttgtcacgtaaggacttaacgctcccagtttttgctagttgcttgtggtcatacgagactggtcaaactagagtgtctaaggaaatacattgacagacttttgaaccgaattacgaaaacactgaagaaagtagtgtctatgatttttagccatagtctagtgacattagtagtaagatagtaagattttacgcttatggacgctttgtgacat

SEQ ID NO: 5268 - DNA, 361 bp, Diabrotica virgifera
cccacgcgtccgggaataggtcaggtatagtacccaaaatggcgggtgataatttcaaataaagttaaggcttttagttaacgcctccagttcagtagtgagaggaaaatacaaactgttttctggagtaaggattgcagtaactctaatggaacatcaataaaatcacacccgcttgtataacagttctttgcagtcgaagggttatatacaacgataacttaagtaccagaggatatcaatccgatattaatgtgtaaagcgtcaacgcccttccggtaaggatttatggaagaatatcaacgaaccgcaagcccttaatccttggcgtaacgctcaaggcgatttccaaaacgattaa

SEQ ID NO: 5269 - DNA, 428 bp, Diabrotica virgifera
  misc_feature (227)..(336): n is a, c, g, or t
agaaaaatcaacatgaagattacctattttattgtatttgtgcttgcccttttcgcaacaggaatattccaagcagaagcaggaaatgtcctctctaaaccagtcaccgaaaaaccaggcaaaggaggcaaaaaaacacggaggcaaacattaataaatagccttattttaatatgagttattagtttatattaattcattttaaagttttaccttacaaacacaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagggttcaaacttaacttacccttcaaggcaagttaaaacccctccaaaagggcccccaaatttaatttcacgggccttcgtttaaaaag

SEQ ID NO: 5270 - DNA, 162 bp, Diabrotica virgifera
  misc_feature (11)..(94): n is a, c, g, or t
cccaagcgtannnnnnnnnnnnnnnnnnnnnnnnnnnnnnnnnnnnnnnnnnnnnnnnnnnnnnnnnnnnnnnnnnnnnnnnnnnnnnnnnnnnggggctctagcgcgataagatttaggtttacgtgcacgtgaattcaaagtccttccacatcgatcacc

SEQ ID NO: 5271 - DNA, 414 bp, Diabrotica virgifera
acggacgcgtgggttctaaactagttttgttcatgagatataattgtgttaaaattcgttttctagttaattatgttttagcacctgttatttataaatcatcacttttatcatacagcataatggcagttactggatctagtaaaatagacctactaataaaccggctggatgttgctgaaacacgttctaaacggttgaattccgaagtgagaagtataagaaaagaaattgctgatttaagaagaactctttctggacctaataatcctggcgttttcccaaaaaacgggaacgggggtaacaccaattgaattagttccggtaaatggttgtccagttactaaaaaatttaaggaatccttaactgaagaagatggttatacaatagtttttacagacggtgcttgcaaa

SEQ ID NO: 5272 - DNA, 631 bp, Diabrotica virgifera
  misc_feature (11)..(28): n is a, c, g, or t
  misc_feature (110)..(127): n is a, c, g, or t
cccacgcgtannnnnnnnnnnnnnnnnntatgtggtgattagagatagtgattgttgcctcaataggaggtgtgaatgttagctgaaatgcacatatttttggtaaaagnnnnnnnnnnnnnnnnnngacagtattgcactccatcgaggcaaattagatgtaacgtggctaaaaagagaaaagaaagtatatataagtggatttttgtaagatatatttcaggactgcacataaagagatgtatgctactataatagtcattcgtaatgttcgaaatctgacaacaccgccttacacatcaactctccccttctctcatcctaccattttcgcctcgctgcattactcagtgtcggtctagcagctgtaaccgactgtgttcatgacatgtcctttgggcggttttcaaaataattactgctaacaactaaattcaactgctataattctaaatatttggaaaataaacgtcacctaaaatgtcaaatctggcgaacaggaaggaaactagcaattatagcctcaaactacacaatcctacgtaagtcttgaacaccaaactatcttggaatgtaccattttaaatagaggaaatagttttttctttctcaataaagagaccatattttc

SEQ ID NO: 5273 - DNA, 571 bp, Diabrotica virgifera
  misc_feature (249)..(267): n is a, c, g, or t
  misc_feature (441)..(468): n is a, c, g, or t
gttgaaatgagaagatttcagagaataattttcaatcataacataactcaaaaaaacttaaaacattaaattttcggactttggctgcccttaattttgattattggttattcaaatgtcattcttttgaaaacatgtcaaatatcgttttttgagataaagtggtatacagtgagcacgtcatggttggaataaattcattttttagtgaatgggcgatttttggaataaatttccaagcaaggtccnnnnnnnnnnnnnnnnnnngaatttttggcataaatatcaaaataatgatgtcatccaactgggcgttatgacatacctaatcaataatttttttaaatgagagtatgggttgtgtgatggcgtaattggaaggttaattaaatccaaattcagtaatataaatgttaacataattacttaaacaaggtgtannnnnnnnnnnnnnnnnnnnnnnnnnnnaggttccacgttgatggcagacatgtgagccgcatgtaagccttcaccaatgtgccgacgtcgcgcaagtatgctaatgattatacacattttaaatatgtaa

SEQ ID NO: 5274 - DNA, 372 bp, Diabrotica virgifera
  misc_feature (200)..(220): n is a, c, g, or t
atctagtaaagatatttattataacccataaaaatgggcaaatccgaaaagttttcaataagtgggtttaagtgagaaaagtaaaagaaatcgttaacattaataatcactttttacaatcatatttcagttaggttttgcgaaaatatttgcatactttctcttacgaccttgttctaaaaaataaacaataagaaggnnnnnnnnnnnnnnnnnnnnnggacttttacttgatggtatgtacaacctagtgggagtcgttaccaaatttgtgatattacttaggaaaatgtaaaagagcttattacgttgtattcgtaagtccttttaagttattatgattgagatattgatataccaatgccatgactg

SEQ ID NO: 5275 - DNA, 69 bp, Diabrotica virgifera
tgcgacctcgatgttggctttgggtttgtggttggtgttgcggctttgttgttgggtctgttcgtcttt

SEQ ID NO: 5276 - DNA, 391 bp, Diabrotica virgifera
ggtcgaaaatccgggtccgaccacgcgtccgaatcaacacatttcattggtttcataattcaaccggattaacaaatttccgaacctttaaccgacgataaacagtatttaacacacacttttttagtacctaagtttctcatacttcggaccattatacatgtatttatcacatgttgagataatgtaacgtgtactcacctactacgtactaggtaattcatcgtctacatatcacacaaatctgatcgagtctcacgattttgtgacgtaccagtaggaagagatatgtatctaggcctaaagaacccaatacaatgtatttttaacatgtttaaggaaaatccggtactaaaaatcaggtaactagccaatctaactatgggccagt

SEQ ID NO: 5277 - DNA, 466 bp, Diabrotica virgifera
  misc_feature (220)..(237): n is a, c, g, or t
ccacacgtcaagacgtcgtagtagtttccagtctcaggaactgtttgattagtacagactgttagtgttcaaggatttgtttatattaagtgttcaacttgcatccggatacaaacaaatggtaggtataaaaaacctagagttattaatgatttctgtgttacataagattttttaatatacatcataacaatttgaattaactattaatacgcaaagnnnnnnnnnnnnnnnnnncgagcgtgcaaaaatgtctgctttcgcccacgcattttagtttagaaagtttcacttttccgcacgcgtgttacttttccgcacgcggtttttacttttccgcacgcgtgttaatttagatatgttaatattaatatggccttaaagtaattataatacatgcaataaactaatatttagatattatttactaatttatttcaaatataacttattgtgttcctgtttt

SEQ ID NO: 5278 - DNA, 232 bp, Diabrotica virgifera
  misc_feature (7)..(32): n is a, c, g, or t
  misc_feature (48)..(61): n is a, c, g, or t
  misc_feature (63)..(77): n is a, c, g, or t
  misc_feature (87)..(104): n is a, c, g, or t
gtgttgnnnnnnnnnnnnnnnnnnnnnnnnnngtgtttgggtgggccnnnnnnnnnnnnnntnnnnnnnnnnnnnnntcgccggccnnnnnnnnnnnnnnnnnncgggggggcgcccggggggggcccggcgtggtcggcgggcggggcgctggggtgcgcctggcggggggggcccgggcggggcggcggggttggcggggggggcctggcgggggccggtcggggggggg

SEQ ID NO: 5279 - DNA, 395 bp, Diabrotica virgifera
  misc_feature (28)..(28): n is a, c, g, or t
  misc_feature (241)..(268): n is a, c, g, or t
gtccgcacacgcgaccgaaaagtaatangcgaaagtaataaaaaaacaggaatagacataaagtaataacgaaagaggtaaacacacatgtaataagaaaaaagtaataaagaacagtgataaacaacagtaataaaaggagtaataacgcaaagtagtaacccaacaggtaaaacaaaggtaatacatcagaagtaataaaaaaaaagtagtaaaaaaaagtatctaaaaaatagtacgnnnnnnnnnnnnnnnnnnnnnnnnnnnncaaaaagtaatagcacacaggaatacaaaaaggtattaacatccaagtaaaaaataggtattacaaacaagtattaaacacaagtaataaaaaaaggtattaaaaaaaggtaataaaggaaggtagt

SEQ ID NO: 5280 - DNA, 340 bp, Diabrotica virgifera
tttgtaccttgagttttgggaatattaattacatatgttccccattgctatctacaatatatattcagcttataggtttgattttgtgtcatatgtcataatcttgggacaatttgccggtatatcatcatcgacagagggcgatatatcatattgtttgttcattgtagttgttgttgttaaagaattctatttttattagttctcatgcttattttgtgtatttcgtatctttatattcgagcgctgttaaatgtagtatcatcagcgatatacctgtatttaatgttaagtcggatgcgttttcagatatgtgtctattttcagatgttcaatttag

SEQ ID NO: 5281 - DNA, 453 bp, Diabrotica virgifera
  misc_feature (134)..(158): n is a, c, g, or t
  misc_feature (420)..(420): n is a, c, g, or t
ccacgcgtcaggcaattcagcggaaccgtcaaactaaagcacattcctcgtccaaagatgcaggtatgcatcttgggagatcagcaacattgtgacgaagctaacgccaacaatgttccattcatggatgtagnnnnnnnnnnnnnnnnnnnnnnnnncacgaaattggttaagaaactagccaagaaatatgatgctttccttgcttctgaagccctcatcaaacagatccccaggttgttgggtccaggtttgaacaaggctggtaaattccctggtcttctctcccaccaggaatccatgacacagaaaattgatgaagtaaaagcaacaatcaaattccaaatgaagaaggtactctgcctttctgttgctgttggtcatgtaggcatgaatcaagatgaattggttcaaaatgtncatctttcaatcaacttcttggtctcactgttg

SEQ ID NO: 5282 - DNA, 93 bp, Diabrotica virgifera
attgatctgcatccgagtctgtgtcatggaccatttgcaatgccctatgtcggtttccgcccacgctgtgtcctgttctaacggtgagttttg

SEQ ID NO: 5283 - DNA, 167 bp, Diabrotica virgifera
acgcgtggttgtggttctcgcgcctggtgttacatcccaggtagtgttccttttattcgaagtttaatttcgagcagttgcatttggtttatttccagacaatcaggatgggtaaagaaaagagtcagattaacagtcgttggcattggacacgtaaattctggtaa

SEQ ID NO: 5284 - DNA, 132 bp, Diabrotica virgifera
gcttcctgccgttgtttgttctgttttgtggtctctttgttgctctctttgcccgcggtcgcggctgggcgggttggccgtggggattgtgcgtgtttggcggggtcgtggggttcgctggtccggcgtgct

SEQ ID NO: 5285 - DNA, 399 bp, Diabrotica virgifera
atcgtgttttactgtagctagatattatagattggcaattctttggattaattaactttagatttattaggaaatatgttgatgatacataagagtttaatacatttcaggattgacgtaaacttagtatttttctaaatacttctgtttacagtaccttcaggattcttaatttaccaacttgattgcatgtggctacattaccttttatatgcacaataaatgtcctgcgcacacaattgttatgttttaaaactattgtctgaaaccgattgcactctcgactggttttcaactaatttttcaattgttaatttaatacaattacatcggttgggctggagctatctgcacaatatttttcatatgtcaatcagcacgtagacttttagtttgaaa

SEQ ID NO: 5286 - DNA, 434 bp, Diabrotica virgifera
acgcgtccgcaatctttatgcgttattttgccggttattagcgcgctcatcactgtatttccttaaagagatacatcttttcctttgtgctttttcttcaatcgtctgatattactctctgtctcagtctctacacaatttttcaatgtataatcgttgtataacatttaatttcaaggagaaaaatgtaaaccatgtaaaataaatgtaaaaaaggtcctacttgtaatttaaccaacaaggtaagtagtcgacctattctttctatacttcttagtagatctcataggttattcttaaatgctaccatctaaggaatgagaaaaattatgaataataattaaagagaagcgacaacagttcacagccttccctaattcctgttaacaatttgaattttttgaatccgagtttttagtcatttgatgatactg

SEQ ID NO: 5287 - DNA, 400 bp, Diabrotica virgifera
  misc_feature (90)..(112): n is a, c, g, or t
tcagtaattttaaaatatcttcagttctaatgattggataaagttttaccaaacatccttttgtaggttttttaagaaacaaattttgcnnnnnnnnnnnnnnnnnnnnnnngtattagtttacgaattagaatcagttaaacaattaaattgttatataacaaattattatctattaaattgattatccctcattgtttgactgctgcccaaaaaaagatggaatatttactgtttaatttgaaataatatgaaatgtatgtataataactagataaatgcaccttcgcagtaaatacagattatagtgtaatgtctatttgacaagcctacgtcctttaatttcgtcctccaaatttcactaattgtataaatatacccgtccagaagatacaaaggg

SEQ ID NO: 5288 - DNA, 451 bp, Diabrotica virgifera
cggggccacccacgaatccggactagtcaagtatttttcctgcgagtgctaagagtcatcgttcaaatcaggaactctattaaggaaaatttaaaatcagctgagaccgctacatacgaactaccagcacttagtgagcaattaaatagtttaacgagtttttgggaaactttaagtcagtgtctttctgaattagagcatgctccagatcatcatgctgttcttgttttacagcctgctgttgaagcatttttcttagtccattctccacaacaaggccctattaaatcggaagagaaagataccgccaaagagactgaaatggaagaacacagtggagaatcaaccgaatcacaaggtagtgttccatccacttcagatgctgctgcacaagctacagttactcctgctgaagaagaacagcagccttcgagacctgctagtgaaataa

SEQ ID NO: 5289 - DNA, 427 bp, Diabrotica virgifera
  misc_feature (25)..(48): n is a, c, g, or t
  misc_feature (138)..(160): n is a, c, g, or t
gattgagacgaaatatatgttgatnnnnnnnnnnnnnnnnnnnnnnnncggtattttgacttgtgaatgatgccaaagactcaaaaatcgttaaaactaaaaatctcgactacgttacttcgagaaactcatacgtcnnnnnnnnnnnnnnnnnnnnnnnatttcacatgatccaatgccgatgtccaacgcaaaatccatttttgttaaaagtctgtaaaaatttgccacagttggcttatttttgaatattttgccttgaaacttttttgaatattctttgtaatgtactgaatatgtatattaatttaatttagacataatataataaacatattcaaaaaagatgtgcttgaaatgttgattcaaaccataaccctctccccttaacatacgtgtgatatattggctctctaataaaatttat

SEQ ID NO: 5290 - DNA, 52 bp, Diabrotica virgifera
  misc_feature (5)..(37): n is a, c, g, or t
gtttnnnnnnnnnnnnnnnnnnnnnnnnnnnnnnnnntttgtctgttcgttt

SEQ ID NO: 5291 - DNA, 424 bp, Diabrotica virgifera
  misc_feature (23)..(49): n is a, c, g, or t
  misc_feature (134)..(147): n is a, c, g, or t
  misc_feature (149)..(167): n is a, c, g, or t
aaatagatttgcgagaagtactnnnnnnnnnnnnnnnnnnnnnnnnnnngtattcacgttaacaattatgtctcttaaatatcaaactctcttgtatgtggttacttaatttaagttttttcaactataaaatnnnnnnnnnnnnnngnnnnnnnnnnnnnnnnnnngacatatacctatttataacctacgatatagacaacagtggtagtttccccacttctttttaatttgacgaacaaaggacatcacaccaatataattcatttatatccaaatataatcataataatgtaatttttacacattccaacttacctattatataatatgtattcctctttcatttccagagttcaatagtagcatttcaaagaacaatggtatagttagcaggaataattgtgttttgggaaacgacaac

SEQ ID NO: 5292 - DNA, 435 bp, Diabrotica virgifera
  misc_feature (206)..(241): n is a, c, g, or t
  misc_feature (388)..(388): n is a, c, g, or t
cacgcctgcccacctcttcgtgaaaattttttattgactaagaatattaattatgggtcatagagcagcagtattcttaactttaaagttaaacggcctacatacgttccgaccgtgccatccgacatgactgaactccccgaccatccttgtcggggtcagctctaaacacatcctgaccaaactatccgacaaaacaagttccnnnnnnnnnnnnnnnnnnnnnnnnnnnnnnnnnnnnggaatatcacggttgtacaaccagataggtcgaccgaccattatatataacttttttgtcgtgccaaaaacattacacacaccccaaccgtcgggcccaacgttgtcggtcatgacatttgtgtgatttaaggttgatttatcttangaagggacgtggacagcacggctgccttgcagggcatgttgaagaat

SEQ ID NO: 5293 - DNA, 425 bp, Diabrotica virgifera
ggcaaaactcaattcaacattacttttcaaaaccaaactcaggcgatgttggtcctcaacagaatgctggtgatagccagaaaaaactgtatgaggaaattgaacgacagaggtatcaacaagaacagcttagacagttctatcaacaaaatcctgatattaaacattcagctgtagatgatgccagaaactcccaacagcctagttttaaccaggaataccagaaaccaactataaccaacagtgtctcaaaggagatatacgtaacaacaacttccacgaccacaacccctgctccctcaactcctccaacgacaaccaaggatccaaagatattggaagcgcaacttccagatgaagttcctgaagacttaagacagcaattgttgtcgtctggtatattaaaccatgccgatatttctgtg

SEQ ID NO: 5294 - DNA, 424 bp, Diabrotica virgifera
accacgcgtccggcggcgcgaaaacatttgaaaatcgacgatatcagtcaaaaagtttgggtcccagaggcagctgcccccgatcactttttgtgttactgtgttggtgcaagtgaaggttattggtgcaatattgaaaattgcgtgctcataattggatttaaataaggatgtcacagcttccatccatttggtttctccttctaggaaccctattgggtacgacgacgggtcaatcaaatctcctggatggagttatcaagctacttcaagatggcgacaaccagatacagaaggaaccacccgacatgccggaatacgagatgctgaaagagtatgattttatcatagttggagcaggaacagctggatgtacattagccaatcggttgagtgaaaaccctgactggaatgtcctacttat

SEQ ID NO: 5295 - DNA, 457 bp, Diabrotica virgifera
ctcacgggtcattacacgccgccaaagtaactccaataataacggtaatggtcacggcaatggtaacggtaatggccgcagcaatggcaacggtaacgggaatggcaacggtaacggaaatggcaacggaaacggaaaaccaggtgcttcatatcttcctccttcaaatggaaatggcaacggaaacggcaacggttataaaaacggaaacggtaacggaaatggcaatggtaggccaagtggaacatatggaccaccgtctaatacatacggcctaccagtaaacggaaatggcaacggtaacggtaatggaaacggaaacggtaatggacatagtaacggaaacggtaatggaaatggtaatggaaacggcaatggcaaactaaatggattatatggaccaccttctgctacatatgggccaccttccaatacatatgggcaacctgcaaatgga

SEQ ID NO: 5296 - DNA, 218 bp, Diabrotica virgifera
  misc_feature (16)..(16): n is a, c, g, or t
tgagtcgtattaaacncagttattcattactcatcaacttccttaccatcaccctctactatttcctcaacatcatattttggctaattcctaagactagggggatgcggtccatttataactcggcaagtgttatctcgacatttcagcccactcgtacaacacttagttatgatagttgcccatcgatgtctcgatgtgaggtctagttgattata

SEQ ID NO: 5297 - DNA, 233 bp, Diabrotica virgifera
  misc_feature (7)..(29): n is a, c, g, or t
atacaannnnnnnnnnnnnnnnnnnnnnntttagaatatgtatagaactcttttattggtggttcgatagttatgactgttggaaattaattgatttgtacccaatatgtcttgagtttttggggggtgtcgtgcttggagttgtagctaattattagtcatttattattttcgatatttttacgtcgatagttatttcgatttctattgtgagatagatattttactgaatt

SEQ ID NO: 5298 - DNA, 446 bp, Diabrotica virgifera
  misc_feature (80)..(102): n is a, c, g, or t
ctcgtaggtcaatacaagactctaaattgagtcgtattatattttgacagcggcatccgatttggacgtcgaaacgttgnnnnnnnnnnnnnnnnnnnnnnnttgtggcttatttccctttaagcaacataatagtaaaatattacatgcgtacggaggccttagcattctccattatctccagtgtatatttagattactccatctatacattaatcaagtttcttcttttatggcattaataaacaataattatgaacaattaaaaaatatgattaaacgcgcaactaccttttataaaataatagaatattgtttatagaacattgtttaagtagtagtgctcttgaaagatttctgaaatgcacattaattatcaggtacccactatttttgaaatgttggtatattttttcattttagattattagcaatgtttattattt

SEQ ID NO: 5299 - DNA, 449 bp, Diabrotica virgifera
  misc_feature (387)..(415): n is a, c, g, or t
gggtctatcccacgcggccgaattgttatgccaaaggcgctagacaataccagtggttgatcgagttcggggcatagtgggatcgggccaaacctctgatgtggttgccaaatttcgcttagtccttgggagtggcgcatttgtatctcgagcagagcgcaaaggccgatttactactgcgagaagctcttccaaaattccccggtgtactactaccgttgctatataagtgcagcgtgcaaactgacactagagtctcaagccagcaaatttttgtcactgctgaatgacgccataatgcaacccacagcactgactcaaataatactcctatatgctaatagaagctatcacatatggtaagacagcgatctgctgccttggttnnnnnnnnnnnnnnnnnnnnnnnnnnnnntagtacacaaaatcgatgctgtgctgaaagacta

SEQ ID NO: 5300 - DNA, 270 bp, Diabrotica virgifera
tgagtcgtattaaaaacaatgactcactacaggtagacgtccttagactctattcgacactaatattcacaatgcccaaatgctctgactctcctgagtatggggtagtgggttcaagtgtacttgagacattgattcgtcaaaatatgtcagaacacatactcgacttgatagaggcattagcttgtctaatatgatctcatacagatttctccagttgataactgtacattgatcattgcgtatttatccgctttagtaaatgtgcat

SEQ ID NO: 5301 - DNA, 87 bp, Diabrotica virgifera
ttgaacctcgtacgtgtgcaatgatgagcctccaatactgtggattggtccttttggcctgtcttttgttggtttcctcccatcctg

SEQ ID NO: 5302 - DNA, 106 bp, Diabrotica virgifera
  misc_feature (6)..(20): n is a, c, g, or t
actacnnnnnnnnnnnnnnngtattaactagtcttaggctgtcgtccgctaatttctttctgactccctcgagtttttttgtgagctccccgttttctgagtccct

SEQ ID NO: 5303 - DNA, 448 bp, Diabrotica virgifera
cgggtcgatacaaaagtctagaactgttcataataagcaaaaatatgattttaactaataatgtattctacattacattcatttagagaaatataattcttagtccaaaaatacaagaaaatgactattgtgtctaaattgtagtggtaagtatttactccaaatttttagtaatgagaaaatgaaaaatattatcctacagtgtaatcaagaattagatccatactcataatcactaacgtcggtattttcattagtgtggcagtattaatgcctcttgccatgtttccaaaactgccctgtctctgtaaccgttatgttcaatatagttatcatagtttgcatattccccaaaaatgtttaatgcgattgaaattacaatgaaggataagggggtagtcaacacgttatgtccaaaactatgtataatcctttccttttttttttt

SEQ ID NO: 5304 - DNA, 155 bp, Diabrotica virgifera
cgactcacttcgggtagtcgtgccaacaagttgcgtgcacatccattcctaacaaacatttacttgcttacattcccgggcgggttagggcaaaaagtcggttaaatacttcagttcataagttccgttacgagaacgccatcccaaaatttatt

SEQ ID NO: 5305 - DNA, 393 bp, Diabrotica virgifera
  misc_feature (75)..(97): n is a, c, g, or t
tacaagaccctaaagtgacgtcgtgattaagcgtccgtaaaaatccgatttttttgtggggtttttgttacaagnnnnnnnnnnnnnnnnnnnnnnngagtacatatgaaatcagtaaatcttcgttactaagtttaaaagcagagatattaagaaaacatcaggaattaagcaaagccaaagttgagaatgatgtaaaaatacagacattaaacaaaagtcctttagaaataagaaataaaggggtagaagcatgggatagaaatgaccaaagtgatgtagatcaagatctattaaaacaatctaggtcagttttagaacacaaagccgctttatatgagaaactctcatctggagatgtttcggaaaatgataaggaaagaaataaattat

SEQ ID NO: 5306 - DNA, 407 bp, Diabrotica virgifera
gcgtccggaacaagagtagagtgggcgcttccattttacaacttttatattttattctttgaaaaagtaatttattatttgggagtccacaccgagaatcagttttctgttcttatctaaaatatcaagacaactaaaccgtttcgaaagtaaataattttaacatgagggattcgccagattctgcaacaaaaagaagcaggagcagaagcactaatagtagtgccagtagaaaaagtcgaagcagaagtgcttctagtggctcaaggtctcgttcaagaagccgtagtagtgaaatcgatggatttagattacacattggcgatattggtgacgagatcagaaggtctgatttggaaaaagttttttctgtgtatggccctcttaaagaagtctggatgactaac

SEQ ID NO: 5307 - DNA, 174 bp, Diabrotica virgifera
  misc_feature (4)..(68): n is a, c, g, or t
atannnnnnnnnnnnnnnnnnnnnnnnnnnnnnnnnnnnnnnnnnnnnnnnnnnnnnnnnnnnnnnnncagatttggagtgcatgctggaaagaagtgcatgtacatgctgggacttaaatgggatttcctgaatgtgagaagtcaaatagagcagttgtgggttgaagaaggg

SEQ ID NO: 5308 - DNA, 450 bp, Diabrotica virgifera
  misc_feature (271)..(288): n is a, c, g, or t
tcgcgggtcattacacgcggccagaaatgcgcccgttataaacaagttaaaaatttgctaccaatcaagacaaaaaggggcataattcctatgcaaactttggaaccaatccaagatgaacaagatgaagaagcttcagatgtcaataatgaagaagaggtaattgaagaaactgaacctgaaggaaacaatttttctctagaatctacaggatttgatacaggtgaaccaatttcagcagctcagctattagcataaagaaacgaagtcnnnnnnnnnnnnnnnnnncacattggaacattaagttctggtttattagaaaacccagaggagaaggtcttgaatttacgaacgttgctgtccttgatggatgaagaagctgcgcaactttacataacagttaaaaaattgatcactgtatctttgttggaagtgttcaaagatatatta

SEQ ID NO: 5309 - DNA, 425 bp, Diabrotica virgifera
  misc_feature (30)..(85): n is a, c, g, or t
  misc_feature (258)..(315): n is a, c, g, or t
cgcgggtcaacacacgcgtccatgttgaannnnnnnnnnnnnnnnnnnnnnnnnnnnnnnnnnnnnnnnnnnnnnnnnnnnnnnngaaatctttattgtccccagaaccacttagcgattcgaacactgttctgcaaaaagcagctccaaaacctgcccaggaggttagacactgtcgtgataaagactcagaacatcagcagagttggtcttaagactttgagagactctttcaaaccaaacacaggggaattgggnnnnnnnnnnnnnnnnnnnnnnnnnnnnnnnnnnnnnnnnnnnnnnnnnnnnnnnnnngataagcatatcctcgctagtagacaatctcaagcagtacaaagtggttccacagccaaaccattagcccaacaggctcgaaataagtgggtccagaatatcgttaatgg

SEQ ID NO: 5310 - DNA, 422 bp, Diabrotica virgifera
  misc_feature (241)..(258): n is a, c, g, or t
aaacagtcttatgaaatgaacatcttatttaaattagtaattttctctttaaacttcatttgtaaagcttcttgatccatgttttcagtaacattttttgaaatacttatctttaatcgtaaacggcccttagatggtcaatattatttcacaataaattagtggctgggtcttgtgctatcaacatatgggataaaaagacagcaagttgtatcgctattgcgttgtagcttcaaaaagnnnnnnnnnnnnnnnnnncaggtggataaaggaatggcaaaaaaagaaataactatactcaagaaaatttggcgtggagtgattttaaaaactttctgggactagatagtacattctttgatgaactattaagaatgattatacctgaaattcaaaaaagggatccagtgatgcgagatgct

SEQ ID NO: 5311 - DNA, 427 bp, Diabrotica virgifera
aatatacacaagttagcgcttgcctccacacaaaggataagtaaaatgtcactaccgaatataactccaaacaatggagcccactgtccaagctttggccacggtacatggttggcggctcctggagaacttaaagaaactgttaaaaccgcaattgagcttggttatcgactgtacgattgctcatggctttactggaactaaaaagaaataagcgaaggtttagtagcataaattcaagataaaactgtcaaaagacaataactgtttgtcgttacaaaattatggaatatttttcacgaataagaaaaagtagttccatcatgcaaagaatctttaaaaaattttgggcttgattaagttgatttgtatttgagtcactggccttgtgctactaagaacatagatttcaacattcaactcccaa

SEQ ID NO: 5312 - DNA, 385 bp, Diabrotica virgifera
cccgacccgtccgaactgacaccttatatgagattcatttacggtctaagttcctttgacagtccagttgctacaatcgcttactcatgcgtgatcaaatcataatgtcacacaatattctggggtcagccggcacagttgcatcgcgaatagatggtggatcaaggcggaaatattagtaacgaggtcactatgcgtgtcgacattagactaccacagcaacttacgggtttagctgtccttaacgctatttccatccgttggcgctcggtcaccaacatccgtttttaaacacaccccatgatttaggtatcagcagccaattagacaatgagctaattgcaactgactagctgtgcgccatatcagtgattgagcttaccag

SEQ ID NO: 5313 - DNA, 262 bp, Diabrotica virgifera
gagtcgtattaaacttgacgacgcacacagcggagtctttctgtcattcaattctcgctaatgtggcaggtaagcactgtgttaagtctcatgcatgggagcacatgtactactccacatcgtgtgtggtcacacaggctgctgtttatattttagcatacctctgtgatacatcacagcactcaatacatcccgtccctaacctgcgatatgcaagccatgcttccaaagtacactgttgatgtactcgattagaagatgg

SEQ ID NO: 5314 - DNA, 186 bp, Diabrotica virgifera
  misc_feature (9)..(27): n is a, c, g, or t
acaagcctnnnnnnnnnnnnnnnnnnngttttcgataccttatcgaattaatttggtgctcatggtatttcagaaattttggttgttgtcgatctggtgacgactcaacagaggagcccaggtgattcgtataaagatcttagtgttcgctttggtactgtgtggattttgctgtggaagtggaca

SEQ ID NO: 5315 - DNA, 378 bp, Diabrotica virgifera
  misc_feature (303)..(323): n is a, c, g, or t
acaacaccctaaactgagtcgtattatgattgatatggtctacagccaaaaatttctgtcattcaattttgggtaatgtggtaggtaggcaatgtgttaataaacatgcatgggactacatttactactccacaaagtgtgtggtcacacagtctgctgtttatattttatcatacctctgtgatacaccacaccactcaatacatcccgtccctaacctgcgataagaaagccatgcttccaaaaagaactgttgaaatagaaaattataagatggaatgaatattttacatagtaataggnnnnnnnnnnnnnnnnnnnnntgcaaaacaaggttatcgaacacaacaatttgtttttttaaacacactttcgtcc

SEQ ID NO: 5316 - DNA, 430 bp, Diabrotica virgifera
tacacccctctagagtgagtcgtagtatggtattggggttcagtcgccttacacgcttcgccacggagacaatgcgtcattacgtgcgaagatcgactaactaaactgattaaacttttgacatttttgaattaaatcagcatagtttgatctgaattgaaattagttagaattgaaataatacaacaaaacgtagagtcagaattcaatatattaggtgaatattgatggtaatcaaattatgtgaataaaagtattacatatactatgtattttggtacgttcaaataggtaggtacctacctatgaaattttttattaggatacgtactgatacatttaacaaataatacgtacctgttgctttgaaagaccatataaatatcactacagttataaacatgtttgtttctgtcctcacgacaataaa

SEQ ID NO: 5317 - DNA, 393 bp, Diabrotica virgifera
aagtccctccaatattattctgtcttcctctaattttttctgactccctccagtttttttattacctcccctttttctgagtccctccaatttttctgggtcctctaagttttcttgactcgctctaatttttcctcgctccttctcattctgtgatgaagtgcttgtctgtacaaaattggcagcgaacgtccattgctccacaggaatgctcagtgactgcgtcttcatcatccagcattacttctacgccttcttgcaagcgactttgtgcaagattcaccctttggttgcttatatttctttaagaagcaagttgtcgattttttttcgctgttcaggtgtctctcgttgcgattgctcctttcgcatctgtacctcccgagccaatct

SEQ ID NO: 5318 - DNA, 442 bp, Diabrotica virgifera
  misc_feature (383)..(400): n is a, c, g, or t
tcgcgggtcgatacacgactctaaattgagtcatactaggtacacaaccaattttttttaaaatgtataaacttctcgttctcgctatggtcctctacaccgtcagcgctggtgtcattctagaccacaaacctgccgtcattgtacaccatggagctacatctcatcaaaacagcaactcgctttcagtccaccctgttcctgttgttgctcacaaagtggccgttgctcatgttgctcatgctccagtaatcgcacatgctccaattgctgttgctcacgcacccgtagccgttgcacatgctcctgtcctacatcatgctgtgcttcatcattagggtctacgattgaagcatcgaagcatgcaaagagatgagcaacgnnnnnnnnnnnnnnnnnntattatgtaatatagaatttaaaatatgaaatccaatatttt

SEQ ID NO: 5319 - DNA, 420 bp, Diabrotica virgifera
  misc_feature (96)..(113): n is a, c, g, or t
aaatttggatgcattcgtgagaatgtcttttgtgcccacctaaactttggtataagatttgttttaagctgttttaagcttgaatttacattttgnnnnnnnnnnnnnnnnnnggctatatttgaaatattaaggtagagagaaaacaattagaggaggctgtgcaatgtaaatgtttcagttagataatttggccactttcatacaatatcagtaatttcttgaaagcattctaagtaaaatgtatgaagcctttagcatcacctacaagtgatactgcaataaagaagggaaagagtatctattggaggtatggttattgtaaagtcctttcgcctatattttcttcttccaaatcacgctatattgcgtctgacgccaagctactggagatcctcccatacgtcaccagctctttcg

SEQ ID NO: 5320 - DNA, 122 bp, Diabrotica virgifera
  misc_feature (19)..(38): n is a, c, g, or t
gtttttcgttacaattctnnnnnnnnnnnnnnnnnnnntcgtgggttgcagcgtgtgtttcctatgtctttgcgcggtggcgtcttccgctgctcgctcgtcgtcttcttcgtgatctgagc

SEQ ID NO: 5321 - DNA, 167 bp, Diabrotica virgifera
  misc_feature (16)..(17): n is a, c, g, or t
  misc_feature (19)..(19): n is a, c, g, or t
gtgagtcgtattaaanngntactttcgagtgaaggtacggaggtaggttactgattgatagttaactagcctcgggcgagagtaattgaccttgatggaccagcaattgatttatcgtcccgttgcgtatcacggaggagggattacttcgtatatatgtactaatt

SEQ ID NO: 5322 - DNA, 429 bp, Diabrotica virgifera
  misc_feature (3)..(29): n is a, c, g, or t
  misc_feature (181)..(195): n is a, c, g, or t
tannnnnnnnnnnnnnnnnnnnnnnnnnnttggaataggtaacatttgtgatatgtctgttgttgggggatcagttgacaatgccatctacgcttaatacaaccgacctgcggttacttacatggaccattataaattcaaatctatcttgtttactcacagtcacaagtctgcaccatgnnnnnnnnnnnnnnncaactggggattcatcgctgcgtatgtcgatgaggttcgtgctaacaacttgacaggaggatgaactttgaatctaatctaagacaacattatactcgattcctcaaatttggttaacacaagctactctttgaatacatttgcagttgattttagtacttacccaacgcaattcaaagcctatctcggttcgtaaacagtcttcagtcaatcgtgaacaaagtctggttgcac

SEQ ID NO: 5323 - DNA, 355 bp, Diabrotica virgifera
  misc_feature (47)..(64): n is a, c, g, or t
ctcgcgtttcgacacaagcctctaaagtgactcgtgtaactttaagnnnnnnnnnnnnnnnnnnatcagcgtagaattgtgataaaagagtttgaataaagagagtggcagtaatttctgatgggtatacacattgccaatagtaactgtattacaactagcttaagaatgtcatcaccagtcgcagtacatagcgataatctaataaatggtggctacgttagatgatcaagccaaatctgtgcctacatatcgtctaaaaatacgtcaagtcagtcagcggtcatcaagtcagagtacatcttgtaagaattgatagactgtaactcatctcgagttctactatcaacacgtt

SEQ ID NO: 5324 - DNA, 224 bp, Diabrotica virgifera
tgagtcgtattaagatgtacgactcactttagggagtcgtgggtagtataatgaacaatagttggaatcataagagtgagtgtgagacggttaggattaggaaatgctgctttaacatttgtgaaagataatctggtgacatgcttaccagtcctggtatggaacgggaagctattaaaggacggcaacgtgtaatgatcaaggcaagactgagagtacagacc

SEQ ID NO: 5325 - DNA, 329 bp, Diabrotica virgifera
  misc_feature (303)..(321): n is a, c, g, or t
tacaactccctaaactgagtcgtattacggcgaggaagtcatcatgagattggaaaaccagcgacagtatacgttcgataggaggctctttgaaaatgagatgtgccgccttggattccaaggtcactcttggagaatctcgaaggttaatgaaaattacaaattttgtccaacttatccgccttaccttctcgtcccgtcttgtattaacgatgacatgttggaaagcgtcgccaagttccgcagttcaagaagaataccagctgtagtatggagacacttcagaaacggagcagttattgnnnnnnnnnnnnnnnnnnnagtcggtt

SEQ ID NO: 5326 - DNA, 370 bp, Diabrotica virgifera
atcacgatgaaggaaggttggtagatgtaaattttgtgctacaaatgtttttgggggagtaattatctaatccaagtatgggagatactaaagaactgctaagacttatatagaccatgatgaataagtatcaaggtacatttttgacattcgacagtctgaagatggacattgttagacatacagtggatatttgatgtgacgtgtgcaaacctgactataaataagaagttggcaatagtatatacgacgaagatcaatttaccagacattatagaaccttcctcatatctgagaaacaacagaaactctttgatgacatttgcggagattttaagacagaccaacccaattcagacctatatgggtt

SEQ ID NO: 5327 - DNA, 280 bp, Diabrotica virgifera
tttaaaagtcatacttaagtcaaattacagtacatactattatattcacgaatatactcagttccgttttgttcgcggaagcacacaggtctgatgcatatcaagtagactggtgtaggacgtattaatccggtatcgttacattcgtttgatatatccaaataatcgctctcataaattcaaactcatattcttccacgtttaagttgggtgatcaatgggaaacattaaacattcttttgggatgaccaaaccatctctctcttgacatcaatcagat

SEQ ID NO: 5328 - DNA, 419 bp, Diabrotica virgifera
acgccggaggtggaactggattcggaggtggaagcggtattggaggtggcattggaggcggtattggaggtggtattggaggtggtattggaggaggaatcggcggaggaatcggagaagatgatggccaatacaggccagagctgtatgaaagacctcaacaacagttaatccaactaccctcccaccaaagagcttcctacccagcacctttggcagtctctcccactccaagttcgaatgctttagaagaaaaggactacttcgacgagcctggtaaggcacacagtttcggaagtggatatatatttgaattcggagggtagaaattatttatatttaggatattagtattatttttacaatttgtgtgatcgttgtgaggtgtatgttactattacgaaataaattttttgtac

SEQ ID NO: 5329 - DNA, 398 bp, Diabrotica virgifera
tgtagttaaagctacaccaaagatcaaaccttgcgacgatccaaacgaaagcataaacggagtcgggacagttctatttactccagccgatgtctataaacaatgctggtctctagaggaaatagctatattgacgaccaggatgatactagaagacttactgccagacgtaacagttttcaacatagacagcaacgcttttgttgacgatatagttagttatttccggttgttaattgaagttgtgaagacagccaccactggtcgaaagaaacgagtgactcttctagcgttaactgatctacttggagggtacttgcagtatgctgttttacccctggcccggtatgcgttctatgctggttttaattgattacacagcatgggaaaactaatcc

SEQ ID NO: 5330 - DNA, 415 bp, Diabrotica virgifera
tccgatcgtattcctttttacttttgtctgtttgtagttgtatccatgtcttccttactgtttatctttttttccagctgtttccgacattcatcgtcataccatgtttttgctctcttctgcctactccttccaaaaatcttgtcagctgtcttggttattatttcggcagtcgtttcccacagcctttctatatcattgtaaactgtttcagagttcaaggtttgttcaagttgttctatatattttttatgtttctcggtgttctgcatttcgtccatgttccattgtgggttcattgttttcttgtatttgtggctagatattctgcattttacttttgctgtgactaagtaatgatctgtgtctccgtctattcctctgaggcttcttacgtctatgatattgttcccat

SEQ ID NO: 5331 - DNA, 51 bp, Diabrotica virgifera
caccctgaggtgagtcgtattaaactctgcgattaggtaagatgtgcacgt

SEQ ID NO: 5332 - DNA, 218 bp, Diabrotica virgifera
acacgcgtctaaaatgagtcgtattataaaatgacgttatggagctgaagttacattaaattgtcgttcagggattctccatataagttcgttaaactgcatcactgatttcggaaaatatatccagtactgaacattttatatcaaggaacggggttgcaatggaatatactgagttttaacaaaagttgcggatttcagtattgaaatgctcaaca

SEQ ID NO: 5333 - DNA, 307 bp, Diabrotica virgifera
ttgcaccaccctatagtgaatcgtattacgtcttaggtcaccatcgcacatcagatggcaaaccaactagctgcggccacacaatgcgcagcacacgctgaaagactgtaccagcaggcacaagctcaggggtgattacatggtgcgggttatccgatggatggcgctaatggttcatagacagctgaggtgggtgacatgccattttgggccaacaaggactggttccaaagtgaccaggacagaatgagtatgtccggacagtgttagatgagacaaaatgttacagcccaagaatgctggtaag

SEQ ID NO: 5334 - DNA, 269 bp, Diabrotica virgifera
ctaaaatgagtcgtattaaagagtttcactatggtttaatatttcgatttcgtttccaatgttttcatggcaagtcaggttcgtagtacaattgcattggcgtctcaacaacgacgcctatcagtacaaaatgttacaaatggcgacatcgccacaatttactcgctatttgctcagatactccgacgaaatcattacgggaaatatcccgagcatcgatcacgtcatcaactttgtgttagaaatacgaatagaattggctcccagga

SEQ ID NO: 5335 - DNA, 325 bp, Diabrotica virgifera
tcctggtaacatacatctctcatttttgcgacttcatttaagctgacttactgatatgtgtaatgctgaatacatagtttggatactttgtttgcggtgctttgataatcgtttttcggtagatctattttgctagggcataaatgcctgtaaattattcagtttcggattacctccccaggtatttatcgcgagacgacacagtttttttacggatgctcctgaaacgttgtgtttcattgaattaatgttttgattggagattaggattatcatttttcaggagtaatcctacggtatgatatattcttacattttatcattt

SEQ ID NO: 5336 - DNA, 384 bp, Diabrotica virgifera
gcgggtcgccacacacgtctcgaaagttgctcgtaatattgttatatctgagttcaacattcactcagagatatgatgtggacagcgattctgattatacatcataggagtcttcccctgacgctgtgaactattttgcttaatcttcaaggactgcatcactagctgggtgcgaactttgggatcacgaatgttgagttaatctcaattcatgaacgtcattaattgattaacaattgatgcctacttgtaactcatgattagagtatgtcacacaaaagtccttagaaatatcattagcggtacgctatggtctagtctgtgcatactttttcaatgtgtgaaattgatcaatgatgtatggttgaccaaacatcatatgga

SEQ ID NO: 5337 - DNA, 370 bp, Diabrotica virgifera
  misc_feature (5)..(39): n is a, c, g, or t
acaannnnnnnnnnnnnnnnnnnnnnnnnnnnnnnnnnnatcaaattcatcgttttcgttgccattgcattcttggttatccaggctgttgaatccaaaccaagggcttcccatgagcaacgcccatctgcccataatgtagcagaagacgagctctcgtaagaaggctcacgatttgatcataattgccgatgaagtcgttactggttacctccccagcaccagaccagatcatcaacattgtaaatgaaaccggcataatattggttagcatcatgaaagatttcatcgaccaccttaagacccaactcactgcatacagaggtgatgtagacataattttgagacatgtatctgacactttgcacgc

SEQ ID NO: 5338 - DNA, 376 bp, Diabrotica virgifera
tgagtcgtattaaagcgtccgatttagaaaaatgtctctagctgaggaattgcttgctgatcttgaagacaacgatgcagatgacgtcgaagaagagatggaagaaattcccgaggaggaagttaaagaagaaaagccagatttagaagacttgttgatggaacaagaaagtgtacatataaattcagtcagagaaatttgcaaacttagggattctgaaacattacaacatttaatggagcagatacaagggtttggcacaaagattcggaaatctgtagatatagtacgtcccgttgaaacagatcccgaatatcagttgatagttgaagctaataatgtagcccacgatattgaataacggaataaaacagtg

SEQ ID NO: 5339 - DNA, 400 bp, Diabrotica virgifera
cgcgggccgacgcaagagtctatatggagtcatgcaagggttctccgtgcttcataaacctacccaaactgatacaactatacatagttcatcattctacacaacatagattagcatagcaatctatcacagcatgttacatacagtaacagaaattaccatgtcaaaaaaataacttcacgatagaaatgaatatcattaagcaagtagtagtaaataataggtacaacgaacaaacaataaacaaaattttaaaccaaaaactgcataacaaatccttgagattagttgaaaagaataaagaccgcgtcccgccatcaaataatttgatcaaactggtttgagcaaactgaaagtgacagttagtgacgtcacatcctgagtgttcattgtggataat

SEQ ID NO: 5340 - DNA, 401 bp, Diabrotica virgifera
gggacgatacaagactctatagtgattcgtataaatttatatttatgttttgtttgatatttaccgacaacagtcaaaaagctgaagattttaataaatatctggcctgtgaattaaagtgttattttgatagtttaatacataagaagtgttcttattttattactataatattcatcaaacatcattaatgttgctgcagaaagaccgacttgatgaatctttcaactccttcattgaagaagataaaagatatagacttctattgatgatgacatcaatgctattaacaataatggtggtgttagtttattgttttgacgttgtgctaccgatcaccactgaagatcccattcaaatgttgtatatcgaaaatgataaaccttccacatttaaaacca

SEQ ID NO: 5341 - DNA, 390 bp, Diabrotica virgifera
  misc_feature (21)..(40): n is a, c, g, or t
tcgcgtgtcaacacacgactnnnnnnnnnnnnnnnnnnnngatattacaaacatcccttgaggatataatttccagtatagcctaaaataaacctataattaaggtaggatagacagtagctgcaactcctcttgcactcaagattattgaagatcaaatcgacattatcccactttttgaaaaaaggccaataaattttggaattgagcaggatattcaatctccccgtgatttaactcgatttgtagaatggccaaaatacatccgtattcatagataactagctgtacatcacaatgagattgaaagttccaccaccaattaagcaattctctcaatccattgacacctcaccagtcacccaaatatttagggtcctggtaaaatac

SEQ ID NO: 5342 - DNA, 260 bp, Diabrotica virgifera
tgagtcgtattaaaatccgtcaacatgtaacgatcttatcatgttacggtcactgagaccagcccaggagattcagtggtattgatgtcttatagagattacctgtgggatagcgcgttcgcgatttcgcagtaatcgagactggcgaagttcgtttgacctcctataggtgctatctgtgcagtatcgcagaaccgacgagactctgacgtctgttataggtatgtcgtggtgcatcagggaagcgcagatctttgtgt

SEQ ID NO: 5343 - DNA, 428 bp, Diabrotica virgifera
ctcgcgggtcgacacaagcgtctacagtgaatctaattaggacgaacatggaattgaccctactggaacttaccatggagattctgatcttcagttagaacgtataaatgtatattataatgaggcaactggaggaaaatatgtaccaagggcagtattagttgacttagaaccaggtactatggactcagtgagatccggaccttttggtcaaattttcagaccggataattttgtttttggccaaagtggagcaggaaataattgggctaagggtcattatactgaaggagctgaattagttgattccgttttggatgttgtaagaaaagaagcagaaggctgtgactgtatgcaaggatttcagttaacgcactctttgggaagtggtactggttccggactgggtactttaataatatcaaaaa

SEQ ID NO: 5344 - DNA, 172 bp, Diabrotica virgifera
ttaaagctcctcatcacggaacgacattctgtcgctgagtgtatcatcaggtgtgaagatttcagcaccggtcatatagaatagggatgtttttcgcaatgaaacggaatgatgaattatagtcagcctgaattttcttaaacatcaaggataaagagaatcttatcgcaag

SEQ ID NO: 5345 - DNA, 384 bp, Diabrotica virgifera
  misc_feature (252)..(270): n is a, c, g, or t
gtttacacaattcaacagggtttgaatgttttctacactgccgttatggaggagtcatctgcgtatctgaagttattaataatttcaccaccgattttaacaccttcacgacggttattttaacgctgtctcaaaaactggtttagagtaggcattaaacaacataataattgagaagtaatttgtccaagtttgcatataattgtcaaaaacaatgacaaaaaatatgtatgacaacatatttctgttcannnnnnnnnnnnnnnnnnncgacaaagtgtttttttattactgtgaatagaccaaatgtgtcgtaaataatatacaagaattaacaaaaaagcgctgattatttataaatctgaacagttaaatgaggagctc

SEQ ID NO: 5346 - DNA, 399 bp, Diabrotica virgifera
actcgcgggtcgatacacgcctctaaacacacgtctgctaaaatattagtatttgagttagtttcaagcggtttctgcaaaataatttgagtcacctctcaacgtccatctcaatacagatgcgctctggactataaaggaactggaatttttcgttacgcatgatgtgacctatgccgtattcctttacttgatggatcctatatgttgggaatcatggatgattattttgaggacaactacatttgtgactttcgccgtcaatagataccatctttaagagacgacgatatagccacatttcgaatgctgcaaagttgtgtaaatccctcgtttagagtgctcattccttctacgcgatatatcagcatcgatcatacgtagcacttagtaagtctc

SEQ ID NO: 5347 - DNA, 398 bp, Diabrotica virgifera
gcgcgggtcgatacaagtctctaaagagacgtcgtgactaacgcgtcagcacacgcgtcggctcaggcgtctgaagaatggcattttatggatgagtctcaagcgtcaccaaaattcatgttcaatttttcacagtactttttcttcacacgagagtcaagcatttcctgattcggagactggtttacactccgaaagtagctttggtgtaactgatgagtaagtttgccaagttcgcataaatctgacagtcgtaatgtgtatactgctgtatggtcacagaactgtgcgaaatatgtgatgcacattagaccgcatactgtttggatagtacagatgacagagaagatgttcagaaaattttgggggatcttatcggagccactactgagtagata

SEQ ID NO: 5348 - DNA, 249 bp, Diabrotica virgifera
cgggtcgccacacgcgtctgtaaagggtcccgttattgcgtccgcttttttcagatgtacgttcgaatgtgcatgatcgaaaccttacattggcggaagatctagtaatgtccgtatatcaggtatcgttcgtgtagtaggactcgctgttacatagagtagtcggaatatgaatccttacgagatattgtgcttgggacgaaggtcgaggatatggtagacagttgagtgcacattctgttacatggt

SEQ ID NO: 5349 - DNA, 227 bp, Diabrotica virgifera
tcagtagacaaatacaagttcaaaatacaacaacctgacagcgtggcaagatcacgcaaccaatgggggtcccagttccagttgaacggcctgtggctgttccgagatcgtatgctgctgtcctggcgcttccaatatttgtcaccgtgcagcatctagtacatttaccagcacgagaaaccattgctgtgccagcgctacatccccatccagccagtgtcccagtc

SEQ ID NO: 5350 - DNA, 435 bp, Diabrotica virgifera
ctcgcaggtcgccacaagactctatacagacgtcgtactaagcgtccgaacgaaatgaatctgtcggtcgtacagtaggacatcaagttcggcttaattcaaacttcaatccagtaacaggaagaattctgtattgtacaacgggtatacttttacgacatgtccaatcagatagcaccttatcagaatttagccatataattttggacgaagctcacgaaagagatgtcaacactgatctgctaatgaatttgttgaagttttcgttgaataacaatcctcacttaaagttaattgttatgagtgctactatagatactgatatgtttaaaaaatattacgatggtgctccagtgattgaaataccggggattacctacccaattgacaggcattttgcacattcaatcgatggagttgaccttaccaaaacta

SEQ ID NO: 5351 - DNA, 358 bp, Diabrotica virgifera
  misc_feature (9)..(27): n is a, c, g, or t
  misc_feature (36)..(102): n is a, c, g, or t
  misc_feature (104)..(116): n is a, c, g, or t
  misc_feature (126)..(152): n is a, c, g, or t
acaagactnnnnnnnnnnnnnnnnnnntaactaatnnnnnnnnnnnnnnnnnnnnnnnnnnnnnnnnnnnnnnnnnnnnnnnnnnnnnnnnnnnnnnnnnnngnnnnnnnnnnnnntgtaatgggnnnnnnnnnnnnnnnnnnnnnnnnnnnattgctcattttttgatcgaatttttttgaatattagaatatattaccttagggagttcagggtaattttattggaaagttcaaatcggtgataaagattgcgaactcgatgttggatttaagttaataattggtgttagagccatattactaagtctgttagaattttaaaagtttataggatcggagtttagaacggtgtgaag

SEQ ID NO: 5352 - DNA, 76 bp, Diabrotica virgifera
acaacaccctatagcgcgacatagaatcgtattagactcactaactggagtcgtggaatcgtattctactcaatga

SEQ ID NO: 5353 - DNA, 67 bp, Diabrotica virgifera
cgtgggtgaaaacttgggatggaatataaaggtacttgctatttaatagggcctacattttgacaca

SEQ ID NO: 5354 - DNA, 320 bp, Diabrotica virgifera
gcgtgggccgacacacgcctctacagagactcctaataacgcgtgagatgtctcgtgggttgacgcttgggcgcgccaggtgtttcatcttatttatggtacctttaaatctaagtttattttcttgtagttgaatgttattcatttctaaatataccgaatttgtaaggaaaagattcaaaatatcattattgacattagatatgtacattcagatgtttactatcaacaactggtaaataattttagggatgtgctgatagctacaattgtactagcatttaattctgaaataaaggctacgaattgggtttttgatc

SEQ ID NO: 5355 - DNA, 377 bp, Diabrotica virgifera
tctaaaatgcgtcgtatgacgcgtgggtgaaaacttgggattgaataacaaggatatcgaaacattaatcaatgaagtaaatgtagtatttcacatgggagccactttaaagttggaggctaagttgtgcgatgctatagaacagaacacagcaggtacggcaagagttatagacattgctaaaaagatgaagaatatagaagcatttttgcacttcagcacagcgttctgttctgctgatgttgatgtttttgaagaaaaggtttactcgagtcaagataatccaagggatgttatggatgtaacaaaatggttgaacccaaatgcactagaacttgcaactccctcaataatacagccgcatccaaatacataca

SEQ ID NO: 5356 - DNA, 80 bp, Diabrotica virgifera
  misc_feature (22)..(46): n is a, c, g, or t
ttctagtggagaacgggggaannnnnnnnnnnnnnnnnnnnnnnnnggatcaagttggatcacgtgatgctccctccgaa

SEQ ID NO: 5357 - DNA, 356 bp, Diabrotica virgifera
  misc_feature (48)..(48): n is a, c, g, or t
  misc_feature (92)..(93): n is a, c, g, or t
  misc_feature (128)..(129): n is a, c, g, or t
  misc_feature (266)..(266): n is a, c, g, or t
  misc_feature (277)..(277): n is a, c, g, or t
  misc_feature (293)..(294): n is a, c, g, or t
  misc_feature (335)..(335): n is a, c, g, or t
tccctgaatgccccctgggggaaaaacaaaggggcaatttcgcccgcncccgcctgcggggctgaactttccgcaaaccgcccgccaatccnnctgggaagggcagttactttaaggggaaacgcacnngctctaacgtttcgccccttttcccccgcaaagttactttccccgaagggaatttctcgcgaggcgttttcgtcgcgccctgctcgaaggccggccgaagggagcaaaacttaaatgcgaagcaaatgtcgttgtgngtaattccgcncgccgaatcgaaccgnngacagagccgttattaaagtccgaacttttaatgttcttgngggctttgcggtattgtctcc

SEQ ID NO: 5358 - DNA, 354 bp, Diabrotica virgifera
gtcattgcaccaccctaaagtgaatcgtattacatcttaacatggctcagattgattttgaagtggttgattagtcaattactttttcgtaaaaagcagttcagaatggcatcagccaagtactcgatttttacgaatcggaatatgcttagtagccgttatgcagtggagagcattaatgaaaagagcagtacgaaagaattgcacgtaaatgggagatcaagtgttattgtttacttcctttaagaacagtagcaacatgttgggggtatataaccgatgtaacactagccgacgtactgacgcctcccgtttacaaaatgtactcaaacgcattcggtgttaacatcgcat

SEQ ID NO: 5359 - DNA, 346 bp, Diabrotica virgifera
gcgtgggttcgactggccctgtacctctagtgtatttgcaaattgctaacggctcttggcacttcgtcgttggatggttcggcaatccttagatctgcaaccgctgttctgtctgacatggtcggactgatcttcatcatcactgtttagtaccgtttcgaaatacattttccattctttcacatcttttcccggctcagataatagcactccatctcgggtcattatgtagctagtagtgctttggtaaccatattcaactttatttaccacttaataaaatgatgtgatttcattgtttttataactttcttcaaactcctgcatcattttttcattggatgct

SEQ ID NO: 5360 - DNA, 423 bp, Diabrotica virgifera
  misc_feature (9)..(40): n is a, c, g, or t
  misc_feature (349)..(349): n is a, c, g, or t
acaacaccnnnnnnnnnnnnnnnnnnnnnnnnnnnnnnnnctacaatgcgattcgcaatgttagcaatttgtttagcacttgtggctgtaacggcagtagaaagcgtacaaaccaactggctcaatgacccactttactcctgcgtcagatgcttgtgtcatgctagaagtggatgctggatcagacaaaattgtgccaagtactcaattaaccaggattactggataaaagcaggttctctcactgcttcaccagatgaaagttcaacaagtccatcagcatatcaaaattgtatgagggatgaaaactgtattgtcggtactatcattaattatactggacgcttangagatatggattgcaactgcgacggagtcttcgattgtaaagacatggcagccattcatcttatgggggccggt

SEQ ID NO: 5361 - DNA, 179 bp, Diabrotica virgifera
agtcgtattaagaacttctgcaaccccagaaccaagaaatggtccaaacaaaaggatgatgagaacagacgttcattccgtacgtacatctagcggtccaatccagaggatttgaggcgccatcatgagctagaggcgggaagaacatgaagcactccgtgccggattgggtattgcct

SEQ ID NO: 5362 - DNA, 393 bp, Diabrotica virgifera
acaacactcaatcgtgatacctcgtacggtagacaaagtttcgacacaacctctgggaatggacctctacaacttgacaaagtagctatattatgccacgctgatacggattcagacgacagtacaaagtgtcgcgtactaaatggtgactgacgcataaattttttcggcagacttgatatgcaacagaatggttgtccaaacattacagagttacagtgagcctcacctgttcaatttcgcgagtcgccaatgacgacaatatgtagtcataaaatgttgtgcgtcattgaaataatgaagacaatggagacacaggatagtttagtcaaggatcagtcgcgcggtatgaaaagatctagcattttaaccatttcagtgataacttttttt

SEQ ID NO: 5363 - DNA, 307 bp, Diabrotica virgifera
tgatttattaacacaatttatttgaccgcgttataaaaatcgataccgtttatcgtaaactaacccatacaaacagttttgcttcttttaaatagtaaaataatacttctctaatattcaatctaattctggttaagaaaatcatatccaaaaaaatatttacacagacaggtaacaaatcatcgtatataaaaaaggtatgtttacagcattccaattataataaataggccgggatcttcagccgtataggagcgctgattgcgtcacagtattatataatcctttcaaactatactcaaatgac

SEQ ID NO: 5364 - DNA, 94 bp, Diabrotica virgifera
  misc_feature (2)..(2): n is a, c, g, or t
  misc_feature (9)..(9): n is a, c, g, or t
antgcgacncaagctgggagagttcacaggaaaggagcttgagcagacgagcatccgttattattcagggacgagcggaactggtcacatttta

SEQ ID NO: 5365 - DNA, 52 bp, Diabrotica virgifera
tatagtgagtcgtactaaaaattacgactcactatatggagtcgtattaatt

SEQ ID NO: 5366 - DNA, 383 bp, Diabrotica virgifera
caacaccccaaaattaattcttataagcatgtcagtgaatacttcagatttgacttaccattctatgccaacttaactcagctggaggacgaaaatcatgatgatgacataatttttgatgatttcgcaagattacgacttaccaggatgagaaactgatgcatgaaatcgggtactggtcatcactcgtcgatttgtacccctacgtaacgaggtgtacttcacctgcgactatgtactactaatctacacatatgtatcgaaagttaatgttcgaaaaattgaatccaatggaacaatacgtattttggaagaataattttgagcgatattggtagattctaggaaaccgtaccgatataaccagtgtgtgtgccctagtc

SEQ ID NO: 5367 - DNA, 145 bp, Diabrotica virgifera
tcgtgggacgttacaaccccctatagtgacgtcgtattaagacgtcacatggaccaccgttacatatttgggatcgtatgtctagagtggatcggtactaagttcatcagaagatggacgccgttaaaatgaatctattgcaagt

SEQ ID NO: 5368 - DNA, 418 bp, Diabrotica virgifera
  misc_feature (6)..(24): n is a, c, g, or t
  misc_feature (42)..(64): n is a, c, g, or t
  misc_feature (249)..(265): n is a, c, g, or t
ctcgtnnnnnnnnnnnnnnnnnnntactgacgtcgtgactannnnnnnnnnnnnnnnnnnnnnnaaatatctaatacctgcaagtatagacctattgcactactaccggtactctccaaaattattgagagactcataaaagaccgacttatgtcctttctagttgaaaacaacattttatcacaaaatcagttcggctttttaaataataaatgcaccactgatgccatcttttctgtactgcatgannnnnnnnnnnnnnnnnacaataatcttcacactgcgcactgccaccgttttttgtgactacgccaaagcttttgattgtgtaaatcataacattttgataagaaaactaaaggaattcgaggtatttctttagattggttccaatcttacttggatgataggaaacaac

SEQ ID NO: 5369 - DNA, 230 bp, Diabrotica virgifera
ttagtcgttgccaaacgggcaatcccaagttattcacattgatcgtcgggcaatctatacgggcgtatatgaagcagaaaaatctttaggcctccaacaggagatcggagaggtctcatagacccgtgtaatcaacgtacgtgcccttacacagcgtgaaagatcgctacattcggcgtgtccacttgcatgcaggcagatctgttggggtttccaggaaacatcgctct

SEQ ID NO: 5370 - DNA, 337 bp, Diabrotica virgifera
  misc_feature (206)..(235): n is a, c, g, or t
  misc_feature (270)..(292): n is a, c, g, or t
aaaaatacaaacctaaagacccaaaatgagttgctgcccaccttgttgttcaccctgctgctccccttgctgtgtaccttgttatccctgttgcgtcccatgcgtgtactacccatgttgtttcccctgctgtagtccctgctgtagtccgtgctgtcctcccaaagggtgctgctagaagatatccatgggtttattgattttannnnnnnnnnnnnnnnnnnnnnnnnnnnnnaaataaaagcaggtcataaaagagaaaaatatggnnnnnnnnnnnnnnnnnnnnnnnggtttgaagtttttaactcgaatagtgggctggtatctgcaaaga

SEQ ID NO: 5371 - DNA, 72 bp, Diabrotica virgifera
cgactcactacacggagtagttattagttgtacgacccacgtgtcggactcgagcggcgttttaacatgcta

SEQ ID NO: 5372 - DNA, 79 bp, Diabrotica virgifera
  misc_feature (56)..(56): n is a, c, g, or t
gtcgttgcacctccctatactgtatcgtgtgacgtattatcgaggtgtacattgantttgttgcaaaatatggggatcc

SEQ ID NO: 5373 - DNA, 382 bp, Diabrotica virgifera
  misc_feature (12)..(32): n is a, c, g, or t
  misc_feature (154)..(200): n is a, c, g, or t
  misc_feature (213)..(261): n is a, c, g, or t
  misc_feature (291)..(313): n is a, c, g, or t
gttgcaacatcnnnnnnnnnnnnnnnnnnnnntgtatgactcacataattggtttgtaatgaaatgtgagacgcttttaaagatatcgaagtttttaagaaataccttaaatttatgtattaacaatatattgagaattaactattttgatagnnnnnnnnnnnnnnnnnnnnnnnnnnnnnnnnnnnnnnnnnnnnnnngtaaaatttaagnnnnnnnnnnnnnnnnnnnnnnnnnnnnnnnnnnnnnnnnnnnnnnnnngtatttatgtttatagatcattagttgtannnnnnnnnnnnnnnnnnnnnnnatataagtttaagttatttaaatttagtaacgatgataacattagtagtaagaaattgtatatgtagta

SEQ ID NO: 5374 - DNA, 375 bp, Diabrotica virgifera
gtcgtagtaatatgtacgattttaagcgccatcgaacaattaagacatcatacatgatcagcaatgtcatctatcctcgatcacagatactaatatttatacaataaatatctcaggaaacatcaatacggtgacttcacaccattccatattaccattactagctgctccaatcttgcacttacaatatttttgatcaacttgtttttgggctgctgctccagacattctgaatattggcaagatagatacacaggtaatcgctggattgtctctctgtggacctcaactcctcatcagcaatcatccttacattacacagaacttcaacacgtccaaatagagaaccaaggtcccagagtaatctactagcct

SEQ ID NO: 5375 - DNA, 462 bp, Diabrotica virgifera
  misc_feature (68)..(96): n is a, c, g, or t
  misc_feature (168)..(200): n is a, c, g, or t
tcgcgtgtccatacaagaccctaaattgaatcatattatgattaattttatttcattttctttaatcnnnnnnnnnnnnnnnnnnnnnnnnnnnnncgggacaccctgtatggttggacaaccccgaacccaattataaatacagcgttgttttgaatgtaaataaannnnnnnnnnnnnnnnnnnnnnnnnnnnnnnnnatttaagattgtaactgttgcactacaaactttactttgttacttctaacgaaactttattcacactaaaacacttcaaacatcatgtgtaattcattaaaaatagtaataaaaactcattcacatcgagcattttttgtttattaattacgaattcctttggtttattttaagtttattgtatacaaaggttttttttatcaattgaggcagtacgaagtctgccgggtcagctagtaataaatatatttactaaaaacac

SEQ ID NO: 5376 - DNA, 333 bp, Diabrotica virgifera
  misc_feature (15)..(33): n is a, c, g, or t
gtcgttacaacaccnnnnnnnnnnnnnnnnnnnaagtatttagtaaagccaagaagcaagtaatgaaacagactcagggattatatccagcacctttaaaggcactggaagttttacgaatcagtttagacaaaggtgaaaccgtcggattcaaagaagaagctcgggcttttggagaactagcaattacaccccaatgtaaaggactgataagtttgttcaagggacagacgcaatgcaaaaagaaccgtttcggtaaaccaaataaagaggttaagactgtccgagttttaggggctggtttgatgggggccggtattgcgcaagtcacga

SEQ ID NO: 5377 - DNA, 137 bp, Diabrotica virgifera
attcacattcttcggatcctgaaaccgctaataaatagttttagcatgtttataggctgattgagatattccagtattagcgaaggccgaaagttgctaagaacatgcaaaaggtttcttgtgcacacgatatttga

SEQ ID NO: 5378 - DNA, 430 bp, Diabrotica virgifera
acgcgcgggtcgatacaccccccaaaattgagtcatcttacgcatatgttgaaggcgaatctctactaatggccctgaaagacgtagccctttctagtggatcagcgtgcacttcagcatccctggaaccttcatacgttctacgtgcgatcggaacagatgaagacttagcgcatagttctatcagattcggcattggccggttcaccacagaagctgaagtagattacaccgctaaaaagtgcattcagcatgtaactagattaagagagatgagtccgttgtgggaaatggtacaagagggtgtggacttgaagacgattaaatggtcgcaacattaattgaatgagattgtactctgaataatgaattactttatggcgtaaaaactgttacgggttgtaattattagatgttagtgtttaatttt

SEQ ID NO: 5379 - DNA, 341 bp, Diabrotica virgifera
gatttttaaggcaacgattggctacgaggatcgattatgcaatatcctggcatacattttggaatctggacacagctgcgcaataatcatcccaatttgaaaacatcccaatctatcactaggtacaaaacgaccagcaacacgatgagattgatgttgagctgatgccaatgtctcctaagctactatcaatcgcacacacttcaactccatatagaaatagtgagactcacaaccgtcgtcatccatattttgaataacttacgagtcaaattattaaatcaacgtctaaacgacatattacaatcgaaagtcctatagccgttttataagagattggt

SEQ ID NO: 5380 - DNA, 367 bp, Diabrotica virgifera
  misc_feature (221)..(238): n is a, c, g, or t
cccacgcgtccgcacatatgcctcatttagaaatcaaaccacccaactagcaatcgcaaaaaaatccagttccggattaacaaaaaatataaattcatggtgaccttgaaacaaccaaaagtacatccaagtgtgaccctgtacatccagatttttaaaatccgtttgcatatttgaaaagagtacaaaaaactaagtggttcgcttcaatcaccaaatannnnnnnnnnnnnnnnnngatcatgtcggccttcgacaataatccataaatattatattatactaacacgtcgctaaatagttctaaaaacaactgagttttatataaaagcagactaaaaatctaaaaattaatgtattaattcag

SEQ ID NO: 5381 - DNA, 231 bp, Diabrotica virgifera
  misc_feature (174)..(191): n is a, c, g, or t
tctaaagtgaatcacgatacgagtgagcgcatttctgagattgatatagtttgcatacatctctgttgacactgatttgtcgatctacgggccgaggtcaggatacccattgtgaaattcgatctctgcggcgatctttagcaacagactttgatgcgatatttttcattttgnnnnnnnnnnnnnnnnnntagatatttacaacactagcggggcattcgttgagaaatt

SEQ ID NO: 5382 - DNA, 383 bp, Diabrotica virgifera
  misc_feature (65)..(146): n is a, c, g, or t
agtccttgagttctgagcatacgatggtaacaccacaactcagatgcttctgatttattaagatnnnnnnnnnnnnnnnnnnnnnnnnnnnnnnnnnnnnnnnnnnnnnnnnnnnnnnnnnnnnnnnnnnnnnnnnnnnnnnnnnntattctggtcgaaatttcctcgtcgctttcaaccctgcagtcaatctagctacccagatatctaaggtgttccaccctttccaggattttgttatctaattttagtaccgagtcttcgatagtaatttctccgaccgcgatccattttgttttctttgcgttgattgttaagtccttttcagtgcattcgttgtttacaccattcaacagggtttgaaggttttctagactgccgtt

SEQ ID NO: 5383 - DNA, 423 bp, Diabrotica virgifera
  misc_feature (7)..(24): n is a, c, g, or t
ctcgtannnnnnnnnnnnnnnnnntagcgagtcatataaaccaatgtaaaacattcttttaagctttgaacagaaaatatgaatttggaacttttagaatcttttggacagaattatccagaagaatttgatggtacattggattctctctcaatagctgtaacttgccagtttaacaaaagaggaacccttctagctgttggttgtaatgatggaagaattgtgatctgggacttcttaacacgaggaattgcaaaagttattgcagcacatgtacatccagtttgcagtataagttggtcgaggaatggtcataaagttgcttctgcttccactgacaataatgtctgtatatggaatatactttctggagaatgtgaacaaaaatataaatttccctggtccgttccaaaagttcaattt

SEQ ID NO: 5384 - DNA, 397 bp, Diabrotica virgifera
tcacgggtccgagcacgcgtccgaggacgcatgggtaaaaaacaagccttccgggcagttattatgcaaactctttattttgtttagaaccgtgaatcaaatttagtatttgtttacaaaatagtttttattcatacatccgaatttttccgtaaccgattgagtcgaaaaatattcacgtttgacaacaccgcaaatatttaaaaacctaacttctttcacgctcgaagcccacgttgttccgagaaacaaaaacgatacaaatacaggaatcagcaaaaagttatcacagagttttttttccgatacgtgccgacattaaattttaccgaacaatttgtttcgaaataagaatattactatttactaatacagaactaagcaaagcaaactgtaa

SEQ ID NO: 5385 - DNA, 109 bp, Diabrotica virgifera
tcaacacatcaatcacacagtgctgtgtctactactaatatctatgtaatacatattcaatcatctgattcaggaaaatcgtgtccatccatgactggacagttacagt

SEQ ID NO: 5386 - DNA, 325 bp, Diabrotica virgifera
  misc_feature (19)..(36): n is a, c, g, or t
  misc_feature (70)..(93): n is a, c, g, or t
  misc_feature (236)..(253): n is a, c, g, or t
  misc_feature (303)..(324): n is a, c, g, or t
gacctctttgtcatcaacnnnnnnnnnnnnnnnnnnccttaaccatgtctgacgaagaagaagtttactnnnnnnnnnnnnnnnnnnnnnnnntcgttgaaacgactaccaccactaccaccaaagtcgaggaaggagcgggagatccagaattcatcaaacgtcaagatcagaagagatcagatctcgatgaacagcttcgcgagtacatcacagaatggcgcaaacaacgtgcnnnnnnnnnnnnnnnnnnaaagaaactcaaggaaaaacaggctaaacgcaaaattactcgtgctgatnnnnnnnnnnnnnnnnnnnnnng

SEQ ID NO: 5387 - DNA, 393 bp, Diabrotica virgifera
gtccatgcacgcctctaaaatgactcttgctaaatgcaaagtctataaccacgtagtagaatgcgtctgtccaccatgaacaatcagcgatggtaatacgggttgcttaacaatagaagagaaatgcagggttgactctgattgtccattacaatttgcttgcattggatttaagtgcattaacccctgcatagctaccgaaccatgtggaattaatgcggaatgcacagttttgaatactgaacctgtgagaaccatggtgtgcctctgcttgccacgataccaatgaaatgctgctaacatatgcaatccaattgcactctgcagataatataaaggatacatccaaacaccagatggtcgattcgtatgcgcaccgaacttagctctcaa

SEQ ID NO: 5388 - DNA, 400 bp, Diabrotica virgifera
  misc_feature (151)..(176): n is a, c, g, or t
aacacatcactttcatcacattttcattcacctccaataggagatacaatacgcccccaaacatctataaccttttcaaaatacttactaatcctagatatctaaaattattacttttcaccaacattttgccatccagatttaacatttnnnnnnnnnnnnnnnnnnnnnnnnnncagggccgtgccgtactatgatgcggtgctatgatgcggtgaggcagtcgcatcaggcggcatcataagaagggcggcataatcagtaaaatcaaatcactctttagttattttaaaaatgaagaaagtatcttcttctacaaaaacgacaacgttttttttgtaatacaagaactgaacactttttttctggttctacaaagcgttgggaatttccggaaaaa

SEQ ID NO: 5389 - DNA, 393 bp, Diabrotica virgifera
  misc_feature (117)..(134): n is a, c, g, or t
cacattggtcagccttattttgtccaaatacagtactctatcctcatagtccagtgaacttttatataccgatagttatgtagtattgtgatagaattaaattagtcttcagaaagnnnnnnnnnnnnnnnnnnacctgtgtaacagggattacgaattactagttacatagttactattttcgagtttaatcgaggtaatcccctatgctttttattgttcaacaggtattttacacaattttttgtgtaacgacacgtgattcgattttaactagaccaacatttctaagtaatgcctgtcgtttaatgatgaatgatatatttagaattaactaggtatatatgattagtcttacttaatgtgagggatgagctgaaaattggcatttta

SEQ ID NO: 5390 - DNA, 355 bp, Diabrotica virgifera
aattatgtacgattcacgtggcaaatgtgttcacgagcttgcggtgatattcaatggagaagatagtacatgttctccatacaagattcacctagactcatttagttctggttacgtaactgcatacggtctcggtcgtagtcacggcattactggtgaacccatcaacctcactaattccaccatatgatccgagcgctgggggcttgtctattaccgtagaatgtcccagtaaagctgatatcagttgtcatgatgttaatcactgtaacgtgtcggtatcttatcttcccacagctccaggtttagttcaagatctcagttatatttggtgactatcataataatagatctc

SEQ ID NO: 5391 - DNA, 370 bp, Diabrotica virgifera
acggacgcgtgggataaagttaccactctttgtaatgaagaaagttgacgagtaaagtatgagaatggagacactgcttacgaggcaacatttatgttcaatgacctgtaattttgttggcgagaaatttaagcattaacagttaatagaatatttggcttgtggacattgtttgtcacacaacgaacctagtagaatgttttaacagtgccatttattaataatccaacggaaaggcatattgaatatcctgtacattttaacattaatttaagaattctaattcgtgaatatcgacatccatattcgaaagatagacttggaactaacatatgactagaatttttgggttccccgattgcaccaacgt

SEQ ID NO: 5392 - DNA, 348 bp, Diabrotica virgifera
caacggttgattttcctggtgcagagtccaaataatgtttatacgctgtgagctcgtaggtagaggggataattaaaaattcgcgagcgccagtagtaacaagtttgtaaacctttactgggaaatttgctttttgacgttctgcattaagcgttgcatattacagcttttaaatgtctcacgaaagttgttgtcttaaagagtgtcgaaatactggttataatagtaactgtgtattctacaactttcctgtcgctaagcataaggtgattcaacgacaaaaatggattgatgcaattagaaaaaagtaagtaaacacaattttaattttaaaacggtagaaaaatt

SEQ ID NO: 5393 - DNA, 248 bp, Diabrotica virgifera
  misc_feature (112)..(133): n is a, c, g, or t
atctcacactcgcgttagcttacagtgacacatacatataccatcgagacaatcaacaacaatcaatactattcaaggcaatttgtacactctgatacagcacaatagtgcnnnnnnnnnnnnnnnnnnnnnnctacaaatcgcgtttgacatgaaagatgaccttcggctcataggacttcatcattaatgattcatgagtcacaggatcagttctcataatcagactctctgacaggcaagatttt

SEQ ID NO: 5394 - DNA, 387 bp, Diabrotica virgifera
gggtcgcttgagcagactcgagtgcagtagcggtgggttatcgtgtgatagtaccacatgcctgagttcgaacttttaaaacatttagacatagatacggaattaggaatgtgagagaataagttatgctcaaagacaacatcattagattgtggaccatgtgtatcacggaatattacagtggaattatgaaggtagaaagacccaattgtgtacagcatgaccgggttggcttttattgtcatcaaaataccgtcactaattttttagctgagaaatgttaaacgatttcaaatagatctaatggtttacgacaatgatctaaaggtagttaatattgatacgtttataaccaaggatctttacactactacgattaaacccttt

SEQ ID NO: 5395 - DNA, 326 bp, Diabrotica virgifera
cacacgcgtccggccacgcttccggagaaagtgacacaacgaatgatatgatgaaccatttagcaaccttagcattagctggtgccttagttggaactgcattcacatctgacagtatttccaacgccgttaacattgcctacatcttttcctacgtcgataccatcgacaacagtctaagtaaccatcaacgtatccggatacgtttcgactatggctcaaggttaatctgcacgttgtcaagtagaggaagcatcggagccaccattggcatatacattgataactacgtactgacaaatgtactatcagatgcacaacacatg

SEQ ID NO: 5396 - DNA, 364 bp, Diabrotica virgifera
accaagcgtccgcccacgtcgtccggaaacgaaagtgatcggtactagatgtttaagcacgtttttcgatcagtgacactgaatatgtggtcatggttatatttgtgttattacatgtggcaattattagcatatcaaatgcccaatttcgaacgtggttacaaatccccggagcccttgcagttttagacaattcccgctcctttcaacttaggcattatgggctcaacgctcatgacttcgttccattaccatcatcacctaatcctataccaactcgggaaatagcaacagttatcgaagaaccacaggataattatccttcggtacagccagaaccacaatcgtcattaaccagtcttga

SEQ ID NO: 5397 - DNA, 381 bp, Diabrotica virgifera
gcttacaccgctttcatgatgaaatgatcacatcaagttacacgtcacataaaaccactattacggatgaacattacgattatgtttccacattctccgtttcgaagttatcgattctgaagaatttcgttcaacctccaagatctattatcatatcattgtctcagagcggaggatacaatgatgaagactttttgtatgtcgtcaccattcacggaaatgctgatctttttgatgaagtatatcatcacaaaaaccatgatgatgcaccacaatggtttgtgttcaatccagagcattccactgatatagatacagaggacaatcatgaacatgtcgtgttgaaagtgagcaacagtagttactaccaggaagtgtcat

SEQ ID NO: 5398 - DNA, 237 bp, Diabrotica virgifera
caagcctctagagggagtcgtagtagaaggattgtcaacagaatgccgtataatagacggcctaatagaggacgtattagggagaggcctagatatgattatgatgacgaggaagatgatctagttgacgatgaggaggatgttaatagcaggcgagcatgtcccatcgagacagatagtatatctagttccagaaagtgaccatcacagggaggcagtgcatgagcggtagctgta

SEQ ID NO: 5399 - DNA, 139 bp, Diabrotica virgifera
  misc_feature (32)..(53): n is a, c, g, or t
ccctatagtgagacgtattaatcggttcgtgnnnnnnnnnnnnnnnnnnnnnncgagataggctggatttatgtagtagcaatatatttataattgaatagttttatagtattgagatcgggtatttttaaggatgagc

SEQ ID NO: 5400 - DNA, 408 bp, Diabrotica virgifera
ctacaattagagcgatgagagtgatccacaaattcaaacacgacaacaatcaacatctagaagctaatctgaaagctcaattcgccagtcaagcggcagctcgatggcttggtcttagattacagtttataggagtgatcataattacaggtgttagttttattgccgtcattcagcatcagtatgatatcgcggatccaggttttatcggattggccatttcgtacgctctgggaatcactggatcactcagcggcgtcgtcaactcgttcacggagacagagagggaaatggtggccgtcgaacgcatcaaccaatacgtagaatccattccaatggaaagtaaatattttgttatggatcctccattcgcttggcccagtcaaggtgttatctcttttgaacatg

SEQ ID NO: 5401 - DNA, 380 bp, Diabrotica virgifera
  misc_feature (351)..(351): n is a, c, g, or t
cccacgcgtccgcgagtacgaggcagatgtatattctattgagccataagaaaggacgaggtaaaaagtcacatggttttgagtctgtgataaaagagggacgtaagtttattgtagagaaccttttccttctgctgtaatgcattttgcagcttttttcttctactatctaaaatatttagatgccagcatgtagtttaattcaattaattgatgagaagctgatttgtgaacaggaataacaccaaattaatcgcaagcaagaacaaaaaaatcacatgatgtcaagtctgttctagcacatgcagggatagaagaaaacatattgtaaaatgcaaaattccggtgtantgtctttaatttgtatagtaacttccttc

SEQ ID NO: 5402 - DNA, 374 bp, Diabrotica virgifera
tacaaaataactacctactgagaaatacgattctcgatatgattaccggtactcaaatacaaaagtaatcatagtaatccagtcatttttatcccttaaacagatcggtgaaggtcgttgttatatcggaatacctatacaaaatacctacctactgggatacgattctcgatatgattaccgttactcaaatacaaaagtaattatagtaatgaaatcatttttatcccttaaacagatcggtgaaggtcgttgttatatcggaatacctatacaaaatacctacctactgggatacgattctcgatatgattaccgttactcaaatacaaaagtaatcatagtaatcaaatcatttttatcccttaaacaga

SEQ ID NO: 5403 - DNA, 401 bp, Diabrotica virgifera
  misc_feature (303)..(327): n is a, c, g, or t
  misc_feature (371)..(371): n is a, c, g, or t
cggacgcgtgggaaaaattatttagaaaaccttatgtccaaaagtgcaactgtagactgttctaacaaagcgaacaagttattttttaggtctcggatgtacttccgaattaaagaattaaacaagtctcttaacaacctgacattgcgtaaaagaaaaattatgaaaactgctacatatttgctgtatgtacgtctatttcacatgcacaaaatttaaataaagtgcatggcatgaaaactgtaaaacttatttttgtcttttccaagcctcttacttaaatctgatgaaatacattatttnnnnnnnnnnnnnnnnnnnnnnnnnatcaatccattaaatttatggttttattttgaggcttttcttcnccttggtaaaaattatatttactaatgtgt

SEQ ID NO: 5404 - DNA, 357 bp, Diabrotica virgifera
  misc_feature (185)..(203): n is a, c, g, or t
cccaccccaaacttaaggtgttacttcttcaaatcggttatatgtttataattttctttaatcacatcatattgttcattcattggaactaacttgtatgtattgtcgtcaattgcagcgtagccatataataaatgggtgcaatagcgcaaagcttcgtttaaattataaacaatatgatgtgnnnnnnnnnnnnnnnnnnnatataaccgatttgaagaagacccaccccaaacttaaggtgttactttctgtgggaggaaacgaagatgtcagtggctcaggtgacgagaaaaatgaacaatatagaacaattttggaatctaccgctcaccggttaagctttgtcaactctgc

SEQ ID NO: 5405 - DNA, 380 bp, Diabrotica virgifera
gctctctttagacgaggacaagcatacattcaattgcgagagcccgagttggccagacaagactttacaaggtgtttagagatagatccgaacaacacagctgcgaaatctcaactaaccatttgttcgaaaacgttgaaggaacaactacagaaagagaagaagatttacgccaatatgttcgacaaattcgccaaaatggacacgcagagggaagaatatgagaacagaaaactgcccaatgtgatgagctccgtcggcgaatggggtcaggaagacagagaaagagaacccagcgaatttgaaaaggaaaatcccgacattattctactaaataaaactggcgagtttaaagatatgtaaacattttgtatttcaat

SEQ ID NO: 5406 - DNA, 270 bp, Diabrotica virgifera
  misc_feature (81)..(81): n is a, c, g, or t
  misc_feature (170)..(189): n is a, c, g, or t
  misc_feature (225)..(244): n is a, c, g, or t
aggagacagaaacaattttagctttaatatgacgttttatatatttacagcttaactgtgtgaattgacaggtcagtgtangatatgataaggcccgatatatggataatgtattatgtttagtattttttgtataagatcaagtgtattcgatcattgtacataaaagnnnnnnnnnnnnnnnnnnnngccatatttatatcagtagtttataggagatgaagnnnnnnnnnnnnnnnnnnnncattgaaataaaagtatttgcaatgg

SEQ ID NO: 5407 - DNA, 419 bp, Diabrotica virgifera
aatttatataagtatgtctgaagcacgggaagtaaaattgactttatcccagttatttatgtggttgcaaggccggcagagatctttggttgagggtgaggcagtttttgatgctggtcacataatattttgcaaactaaaaaagcaagatgccctggaagtggttgcattatgtgtgcaaacatccagcataaacactctgcctcatgaaatatcgataaaaattccgtgtgaagaagatttaacaacatggagctgtaagtgttcatgcaaggctggtgaatcgggatgctgtaaacatgtggtggcaactttaatttacataaatcggaagagcaaattagaattctgtagcccaactgaactggagcaagcttggggcgttaataagcccctgataaaagaaacctatcaaaggg

SEQ ID NO: 5408 - DNA, 323 bp, Diabrotica virgifera
acagacacgtgggacgtcttttcacaacatatctaactttgtgactatttatgggaacatttgatgctctaaccataatctatataaatattgacgttaattactatctattgatacgtatgctgttatacagtacagtgagaaagcacatgaggaccatattcgacatagtatccggggctgaaatactccctatcaacatgaggatatcccaggacgacaagcctagttatgatcacaaatgcagatatgcacatcattcatataaccctccgagtcagtacagtgttactggaggagaatataatcatatatacgttttg

SEQ ID NO: 5409 - DNA, 377 bp, Diabrotica virgifera
gtccaaatgctccatccagaactctgcagattgatgaatctaggaacggccaccaacttggctattccaccctccaaagtgtctacaacgatcgtgtcaatcatactgatgttcttgctgatcatttcagtcactatgacggtattgtctatgaccataccttctacagtttgttgatcacacttcaacattcggtacacgctggagtcatcaacagattagtcttggatgttgtcataaactgcgatcagcaaggtgtacaaggtgttagtgacattgtctctctgcaaggactctctggttatggcaacttccaaagatcaacaacagtatattccccactcaatgagatcgtaaagaatagactacaaggaaag

SEQ ID NO: 5410 - DNA, 355 bp, Diabrotica virgifera
  misc_feature (10)..(37): n is a, c, g, or t
gcgtccacannnnnnnnnnnnnnnnnnnnnnnnnnnnttgtgaaaaacttgctttcttagactcaaatggtacaatgcctggcctaagaaagcaggtttttcagagataattttagaattattgctttagatatcgctcagttttacctcgagcgtcaacaagatattgcgggagtggtgcttatagtgaaaattacacagattctgcataaatgacacttttagcgcgaatgagattaagttttaggccaggcgttcagcacatgttttagagttgagtcgctgaacgagtttttccatcatattctggagtgagtggatatgagagtgaggaattttgctaagtttttgtacg

SEQ ID NO: 5411 - DNA, 342 bp, Diabrotica virgifera
  misc_feature (17)..(44): n is a, c, g, or t
  misc_feature (71)..(89): n is a, c, g, or t
cacacgcgtatgctaannnnnnnnnnnnnnnnnnnnnnnnnnnncacgtatggcagatacagaaaacatgnnnnnnnnnnnnnnnnnnnaagacggcgacgcagcagctgccgctcctgcccccgccgaaacgaggtcctcctcatagagttcctcgaagaaagccaaagcgtctggttccaatgtcatctccatgtctcctgaatctcaagtagctgagttcaaagaagctttccaacttatggatcacgacagtgatggtaacagctctaatagcgatgtgagggccaccttcgatgctgtagggtcactcgccagtgacaatgagctcgacgagatgat

SEQ ID NO: 5412 - DNA, 379 bp, Diabrotica virgifera
  misc_feature (196)..(253): n is a, c, g, or t
gccggccttgtgatgggggaagaagaatctacaccgatgttcttgccaggtgagtcgactataaccgaagaaggacagttgaaattcgaatcgaccgaagaagaccgaccgagacgacgacgtcttccctctgatagcccccctccaccacccaaaccaaagccaagacctaaagttgaggaggagatcgtcattnnnnnnnnnnnnnnnnnnnnnnnnnnnnnnnnnnnnnnnnnnnnnnnnnnnnnnnnnngtgcgccagttattgagctcaagagacccgactctccacctagggaaattagaaaagtcagagaacctatggaagaccctctcaaactaatggaagaacagaggagaaaacgagaagaagaagaaa

SEQ ID NO: 5413 - DNA, 322 bp, Diabrotica virgifera
  misc_feature (54)..(90): n is a, c, g, or t
  misc_feature (107)..(128): n is a, c, g, or t
  misc_feature (161)..(176): n is a, c, g, or t
  misc_feature (178)..(216): n is a, c, g, or t
taaattgtaatttatttattaacattaatgttagaattaaatattgttatgagnnnnnnnnnnnnnnnnnnnnnnnnnnnnnnnnnnnnnaccatgttattcaaggnnnnnnnnnnnnnnnnnnnnnngattaataatttccatattttaagatctgttannnnnnnnnnnnnnnngnnnnnnnnnnnnnnnnnnnnnnnnnnnnnnnnnnnnnnnaaattcaaattatttatatctaatatttgaagataatattagtattataataatgtacatttaatatatatatatatgtttataaaaggaaatcagcaacaatttt

SEQ ID NO: 5414 - DNA, 401 bp, Diabrotica virgifera
gatttttaactagaacaaaagtttctataggagaaacactaggaaaaagattttttacgtcgaatgaaattagtctggagttgttgcgcaattgaaaatgttgtattttattaactaattctagtatattttttacggtgaatttaggtgaaaaatttagtgtattctgtaataatatctgacagtttttttgaaagtttatatgacagagctatataaaaagaaactacagatcttattgggtggtcacacagatctgtatctacgttgtaatcgatcgggcggtcagcgtgtactgaatgatttcccagcacagactgccaaccctcctgacttgttttcaagccgcgtgcacgtggcggcgtagcagaaactatcgtgttctcagtgcactccgcggg

SEQ ID NO: 5415 - DNA, 404 bp, Diabrotica virgifera
  misc_feature (200)..(215): n is a, c, g, or t
gttcactacagctggaggattcttatcattttatgaaatctgcgaaagagttcgaaaacaaggatggacagtaaccagggatcctgaaggaagaattgggccctacgctacccatggaaaccaatgggtttcctacgacgacatatccgaagtgaaaagaaaggcccaacttgtcaaagacctcggacttggtggaggannnnnnnnnnnnnnnnatttggacgactttagaaacagatgtggttgcggcaaacatcccttgctaaaaacactaaataaagaactgagaggaatcagaactgatatttatgtgcagaattgtacttagtgtacattaattttagacaataagtcagaagctattctttccactgagattttcaatttgatctggcaacgtcccg

SEQ ID NO: 5416 - DNA, 423 bp, Diabrotica virgifera
gggccgatacaagcgtctacatagatgcaccattaatattaaatactattgattattgaaatggagtctgaaaattttctaataacagattataaaaaagtctggactcattttggaaaaactgaggaaactgttgataaagatgtaaaaattataaaaaactggataaaatctaatcattattttcctgaaataccagatgatattatgatccaacactttctgaccaactgcaactttagtattgaaagaacaaaacagtgcttggacatgtattatgcagttagaattgttgtaccggagatgtacaattacaccaatccaacatcaagttacatggctgcagcttacgaacttatcttatgttgccctttgccacgtctaaccgaccaattggagagaatattgtttctaaaactaaat

SEQ ID NO: 5417 - DNA, 399 bp, Diabrotica virgifera
  misc_feature (43)..(59): n is a, c, g, or t
  misc_feature (61)..(79): n is a, c, g, or t
  misc_feature (105)..(139): n is a, c, g, or t
  misc_feature (301)..(320): n is a, c, g, or t
tcgacccgcccgtccgcatatataaatatttgtatatatgtannnnnnnnnnnnnnnnngnnnnnnnnnnnnnnnnnnngtgtttgcaatttatcaatcaaaagnnnnnnnnnnnnnnnnnnnnnnnnnnnnnnnnnnncgcgggcacataaatttgatacacccggtatattgagctgttttaaaatttatttgaatttagttaggatgtaaatagatttctcttttaacgagctttccgcggaaccattaaagacttttgtgaataattaaagtgaaaaggactatgtatttagatttnnnnnnnnnnnnnnnnnnnnactgtataggtaattataaatatttctcgaaattgataattgaaaagaaagttggaattttaatatcttcatttcaata

SEQ ID NO: 5418 - DNA, 58 bp, Diabrotica virgifera
cgcgtaggacattacgaccccctaaagtgagtcatattagtagagaagtatatacaca

SEQ ID NO: 5419 - DNA, 458 bp, Diabrotica virgifera
  misc_feature (257)..(257): n is a, c, g, or t
  misc_feature (326)..(354): n is a, c, g, or t
  misc_feature (388)..(388): n is a, c, g, or t
  misc_feature (439)..(439): n is a, c, g, or t
gcccctttcgtcacaggaagctacgtacaatcgggcaacgtagtaattttatttcatcaataagccataatatccaaaaatgggtgataaaattgaaatgagtttgggcgacataatcaaatcaaaccgaacacaacgagtccgaagaagcaaaagggggcggaagaaggccgtggaggaaggcgtaatatgagcaaccgttggggttggcaacgcccttggaggaaatttcaaaaagttcaggtcgtcccggtggnaaatgtgcaaagaagtcgtgggcgatgcggcatatctcgcaatacacgcgggtaactacatttagtacnnnnnnnnnnnnnnnnnnnnnnnnnnnnnggctcgggctggaatgtcgtggagtcttcttaanatacaccagaagctatagatgctgaccaattgtttctttaaggagacgtanacagtgcatggaagcatga

SEQ ID NO: 5420 - DNA, 413 bp, Diabrotica virgifera
  misc_feature (177)..(200): n is a, c, g, or t
cgaggtagacgctacggtgtcgagtgtagttttctcctttcttgatcttttacttctgtttcgagctttccgtagctagataatgtgatgcctagatatttgaactccatcactttctctattatttgaccctccagctctatttacatcttagtagatttgctcttataaccatgnnnnnnnnnnnnnnnnnnnnnnnngaaagtaatgtgataaattttctagcggttatattgaattggtgcagggtgcagcatatatacattgtaaatcatcttcaatttgagagataaaaactctgcggttaccacagcaggacccaagcccgcataaaatgtggagggtgattggcaaggttagtactactcaaataaacatgtgaagcctttgaaagtactaaaacatgaaatcgg

SEQ ID NO: 5421 - DNA, 415 bp, Diabrotica virgifera
aaaaaatctgtaactgtcagaacaggaatcatgtgtgacacagttattaaaataccagttgtgatatctattatattaataaatagctcacctattaacaaagctaactaattataaaattgcgtaagtaaaatgttgttatacgtaattaaagatcgttattgagaaattcacacctagaatgcagtactgataagatacggcaatgcatttcctaagggggaataaacgcacacggttgtcggtcatcactggatgttgattgctctctcaagagcgtcgcagaagaactgtgtcaacactgaatgcgcattcaaagattaaccgtactgccaaattgatataagtccctacgaagaccttttatatgaaacagatggtcacgtttataaacaagcttggatgacatggatgt

SEQ ID NO: 5422 - DNA, 299 bp, Diabrotica virgifera
  misc_feature (13)..(33): n is a, c, g, or t
  misc_feature (59)..(79): n is a, c, g, or t
  misc_feature (190)..(220): n is a, c, g, or t
acgcctctaggcnnnnnnnnnnnnnnnnnnnnngttgtagcagcgttcgcgaaattgtnnnnnnnnnnnnnnnnnnnnnctacataggtaacctaatcaacttttcactaaggccggtatcacaggagtaccaagcaccacgcagaagactttccaaacgttcacattacgtggtgtggatccacatcannnnnnnnnnnnnnnnnnnnnnnnnnnnnnngtacgcatgcttaggagttccagtgtgcggtgttacaaagggattgtaacggataccacaggtcctactgtaaacacta

SEQ ID NO: 5423 - DNA, 434 bp, Diabrotica virgifera
  misc_feature (111)..(136): n is a, c, g, or t
  misc_feature (377)..(394): n is a, c, g, or t
gtgatgtatcggaaaatattttctctatggacttaaaaatttaagtaagtcataggtatcgttaatcattataaatatactgcaatatgaacagattttaataaacttgcnnnnnnnnnnnnnnnnnnnnnnnnnngaggagttaatttccgtccttttgggaaataaccacatttcaatgggagaacaattgacgtttgacagtataacgtcaagctttgacatttgaaaagttgtaacgtccaaactttgacattgatatatttctcaaggctcactctgtatcacattatgtatattaacaatatgaaatatatattaagatatcaataatttcggtatataatacactactaaatttccctattcataaaggnnnnnnnnnnnnnnnnnngaaatttgtatttttcttattgtaacgtaaacaatattta

SEQ ID NO: 5424 - DNA, 361 bp, Diabrotica virgifera
  misc_feature (31)..(49): n is a, c, g, or t
aagcctctacagagagtcgtattaacgcgtnnnnnnnnnnnnnnnnnnncttgtccaagggtgcaattttcatttcgtcatcatcacttggtttcacaatgtttcctaaggccctcatgaatctaatgagtcaccaagttttattgagcgtatccagcggcaaaatttggtacgtttactgcttcattgattcgcctaatagcttgaatttgtgacgttcttaatacagtttcgaaagacgtatgacatgcttacaaagtagtcggaacgaatataaccgtaagtctctttaaaatgcattatatgatttccgagattctagactaaatttttgactgtagttgaatcatgtctgaaatgc

SEQ ID NO: 5425 - DNA, 320 bp, Diabrotica virgifera
gcgggtggtcgcaagagtctggagtgagtcggactaattaacgtctgacaaaaagaaacaccattggttaaaataatttcaatacaccttcctttattgaagctcttactctgttcagggatgaatttcgttagggaggggaattgtgtgatcgtaggcctttgtttccgggaggtttaggttgttgggctgggaagtcttctattgtcgatcttgatggggatgttagtaggaggttcggaagatggacctattcctgatcttgtgtagtgtaagaggttaggggttttttgtaagtttttgtatgttaagttatatga

SEQ ID NO: 5426 - DNA, 171 bp, Diabrotica virgifera
catgttatggctcgtgtaactcaatattatcctgaccgttaaccatcatgtacgccagcagtatcccgtccttgctaaggagcaggtcgcccaagatgcccaggacgtcgggagtcggtcgtccagcttgtaggccagtgataggaacaggctatcttcctgctcaaagtt

SEQ ID NO: 5427 - DNA, 401 bp, Diabrotica virgifera
atgaataataatgaggttaatttttggtgggaaaatcatcacacacattgacacacatgagatcatgatatgaaacgtctaacaaacaaactgttttactgttttgttatttgttgacgtgtctagaatctgaaactcgttaaattagcacataatacttcatcggaaaagtcttaattatggcatagagactggaagatttaaatttacctaataatacagtacagataattatgtaatgaggcacttcctgattctgtgaatatctgaaaagatgcaagatctgctttgtccagagctgcatcagtgtatgttttatatgttacttctcaagcatctaatgaagcccattttaatagcagacagacgttaatggccggcgacgttttaaagggcataca

SEQ ID NO: 5428 - DNA, 448 bp, Diabrotica virgifera
ctcaaatctatcgacgctcccgctattcgtaaaaaggccgcattttaccggctttttttgctatcgttttataccgctcagataattcaatctgctcagtattatcgacgatgatttatttagcgtattagtgagtgccttacaaatgaaccaaatggattatggaattcaatcagagctctgatgtgacacgtcatcaaggaataaaactgtaagtactctacatgtatgtgaacataacttattagtcgtgatactgtatgcattttgaaccatatacctctcgtagcaaatattctttgtgccatttatgcagataatactttaaattacatatgaaaaatcgttatctactcttaaccagcttacctatgggaatatactctataaccgtacaataagtataggttactattgttaaggatactttacgtattgcctaaacaga

SEQ ID NO: 5429 - DNA, 472 bp, Diabrotica virgifera
  misc_feature (404)..(423): n is a, c, g, or t
gcgggtcgacacaagcctctaattagaggcatgatatctcaacgttaattcttaatctttctcttcttcttatacttattgtagatctgtcgatctgttaattccgactttgaagtatttcttgagaggtaaacttccagctatctctccatctttttggtggtctccccggtggatgcttgccagctagttttccttctagcgcaatccttggtagtctgtgctcctccattctttttacatgactgaaccattctcttcgtctttgcctaccccatcttactacatgttgcacgccacattgttccctgagcccatcgtttcctaaaatctttccctgacttctcccataatatgtgggcatcaagagttttatatttcactaaatgaaaagattttaaagnnnnnnnnnnnnnnnnnnnnctcacatcaaattgtgccacaaagacgccatatttctaaaaacgaactg

SEQ ID NO: 5430 - DNA, 439 bp, Diabrotica virgifera
  misc_feature (156)..(156): n is a, c, g, or t
caattggttaatgatgttcaattccaaccaaaagttaattttttggcaagggaatttctgtcagtccatgtatcatgctatggtaggcttctaatttgtgttgtgtaggatgggatgatgaattgtgtaaagttatatcaggggtatgtttatcangggtcagttatatgggtatgtttatgatatacggagaactcatgtttgttgtgtagtctggtaattgttacatctagaaagtttatggacttattctgttctggttctattgttaactcaatattactatgaagtgaattaatgtatgatagaaattggtcaagttgcctgttagttcctgtaaagcatactagtatatcatccacatatctccaccaatataagaactgtttaaatacgggatgtttagaaattgtttcaagctggttcatgaattatgaat

SEQ ID NO: 5431 - DNA, 332 bp, Diabrotica virgifera
  misc_feature (304)..(322): n is a, c, g, or t
tctcctcaatacggagtacccagctaccaataccgcgtcgttggaatcgatctagagggaatcaaacaagccatccaagttgcccagtacaaccaaatctcacagggaccaagctttggaggataccccagcggacctagttcgataccatccgggtcttacggagccccttactaaggctctagaactgatttcagtgtgaataccatcttttaccatctcagacgggtcatgatgcattcaataccatcaagtttcaaccataccatcaaaagttgaatgtttgtataaagctttcgtaggnnnnnnnnnnnnnnnnnnnttgtcaccgt

SEQ ID NO: 5432 - DNA, 196 bp, Diabrotica virgifera
actccctatagagagtcgtattaacgtgtccgcttcatttcaatacggggttcgttttgaccatggatctgtaatcgtagttgtatctagatgaaatcattctttccgcgcttgtgtcccattacaggggatttctcatacggatcaatctttcggtgatagcccagccctgttagcttgatgccttcctagtctt

SEQ ID NO: 5433 - DNA, 384 bp, Diabrotica virgifera
  misc_feature (29)..(46): n is a, c, g, or t
  misc_feature (348)..(348): n is a, c, g, or t
gaggacactgatcgatgttggcacaacgnnnnnnnnnnnnnnnnnncgcattgcagtcatttgaattaccgacagtccattagcactctgagagaacaccatagttctcaaacgtaaatatccatattatgtaccttgtgtctcaaggactattagttaataattattccactattatattcgaacttattagagctgtaacattataatttttatcgttcctttaatactctgaataatttttttgtgcagacatgtgattcacttttaaatatagctgtctttttgcgtaatctctcaactgtaaatattaacatgagacctataataatataccagtatattaantatatcacataatatttagggatgatcttaagttta

SEQ ID NO: 5434 - DNA, 460 bp, Diabrotica virgifera
ctgaaatcaacatgattgctaaggttgtacttgtttgcgcattcgtagccgttgctcatggagtaggcatttctgtattagatggaggactgggactgggtttgggtggtcatggtcttcttggatctggagctcttgttactggacattcagttgctgtagcccaaccatcagtagatttacatgcaccagccaattatcaattcaaatatggagtccaagatgctcacacaggagacaacaagcaacaatctgaagtgagagtaggggataccgttagaggagaatactcattagctgaaccagacggcaccataagagttgtcaagtacactgctgatcctcacaatggtttcaacgcaatagttagtcgagttggacacgctgcccatcctcaagtagtccaaagaactgtagtagctgctccagttattagccatgctccagtcatcgcacacgc

SEQ ID NO: 5435 - DNA, 97 bp, Diabrotica virgifera
  misc_feature (27)..(91): n is a, c, g, or t
gggtcgaccacgcgtcaggaaaggatnnnnnnnnnnnnnnnnnnnnnnnnnnnnnnnnnnnnnnnnnnnnnnnnnnnnnnnnnnnnnnnnntcgtac

SEQ ID NO: 5436 - DNA, 467 bp, Diabrotica virgifera
  misc_feature (240)..(240): n is a, c, g, or t
  misc_feature (456)..(456): n is a, c, g, or t
aataaaagtgtcattagacctaatacccgttgtaaccatcactttagcatacttttccgattttcggaatatcgagagcacctaataagttacacagtatttgttatattgtcacaaagcttaaatatctatttgtaagttatttagaccttgaaaatttttggtcactggtaaagttcatttttcaactgacgcaagtgttatctctgggtgttgtcgttaaactggttgcctactaanaacaagaaagaaatgaaagagtcctctaaaatgattatgatttattgtctccccttgtaccaattctagtgatatttaacagaaaaatcgcgtgtaaactgtagtttttattagcgaatgcacggtgttgtttaatttatagtatttaaaaaagtgtcaccctattattaaatttaacttataagattatttgtttgtcgggaaaaatatcaacanaataatataaa

SEQ ID NO: 5437 - DNA, 399 bp, Diabrotica virgifera
  misc_feature (28)..(29): n is a, c, g, or t
  misc_feature (34)..(34): n is a, c, g, or t
  misc_feature (52)..(52): n is a, c, g, or t
acaacaccctatagagagtcgtattagnngctgngcccagtggccgaagacnttagtcctgttgtgtatttgacagttaattcatcagctgatgttacactaaagggtatagggggtgaagattctttttatcctcatgtgttccacgtttcgtcatcagtcgagagttttattgataagtactcatatctgacagacggcgatattctatcgattgacgaccttaatgtgggaggaagctttcatgctattaacgagtcaggtcgtatgttagttttctactccttcatgggttagggagttaagatatacttcatggctaatgctaaatattatagtcattagtcggtctttgtagatgatactcctaagatcatgatcaggggatatcattggtac

SEQ ID NO: 5438 - DNA, 270 bp, Diabrotica virgifera
tgcaataaacccttagtactccttaaggcgaaatatcaaaataggaatattaatattaaagtcactcccgtaaacctaacacgctctaacactggctttgccaagactatgtccgaagctttagaagaatctttaagtgcagatactcaggattcagtcgaggctcccagacacgctttcacagaagtagctagcttaaatgcagaggatcctagttttcatcctcaaaacaaatcggcaatgagttgattaaagatgatatgttaattt

SEQ ID NO: 5439 - DNA, 465 bp, Diabrotica virgifera
  misc_feature (118)..(135): n is a, c, g, or t
cccacgcttcagaaaatgtagatacattaaacataaatatgggtaatagaggaagtctggaacatttttcacacctgtttataaaacacatatcattatgtatgaccgatatagtcannnnnnnnnnnnnnnnnnattgagtggccgcggcagctcaaccatgcaaaagtagcataatcataagtatacctattgaaagctgtaatgaagggttgggtgatgtacccactgtcattagtgaacttataaagaaatttcactctaagttataatacataaatttgattacaacaccagtcacccctataaagattaataagattgataataaatttgtggattagtacctttagataaataaaaccgccactgacatgaggtgatgaccatggaagtccatcattatatatagcaatatataaattacaaatatcttgatccacttcaattgaatgtgcaaataaa

SEQ ID NO: 5440 - DNA, 353 bp, Diabrotica virgifera
  misc_feature (174)..(191): n is a, c, g, or t
cccacgcgtccgagttgttgttgtctgatagattcaaagactgtaaaagtattattgtgtattgtacgagaaggcaggagtgtgagaggattgccggatttttaagaacgtgtcttaaaggggaagaaccagtaaataacagtaataccaagaaacggaagcggatgaaccttnnnnnnnnnnnnnnnnnngcaggtttgtcggcgtctcgtagaaggactatacagaacgcctttatgtctggacaactgagaatagtagtggcgacggttgcattcggtatgggcatcaataagtctgatattagagctgtgatacattacaatatgcctagtaatttcgagagctatgtg

SEQ ID NO: 5441 - DNA, 358 bp, Diabrotica virgifera
tgctgcgcgaaggttggggctgttgttgcagtgcttttagctgtttgagttgtctatcgtacaacatcgctatttcaatcacgcaaggtgtcagggttgggcgaaaaatggtggtcagtggccgcgccggcaagagtgggtactagtagcaggccgttcatgattcaaatttcagagtgagattttaaaagacttgaacgacagactatatcggtgtcttccatttcaggcatccctagatggcgtgaaacaacattacagaatgaacactaatctcctgactacgaaagtggactattggcagaacacatgtgacgggtgacaaagggaagggtttttcaaccagtatccacagttt

SEQ ID NO: 5442 - DNA, 467 bp, Diabrotica virgifera
  misc_feature (111)..(130): n is a, c, g, or t
  misc_feature (248)..(248): n is a, c, g, or t
  misc_feature (383)..(383): n is a, c, g, or t
agcaactttaacgaaccgactatgacaagtgacggttttgtaaaatgcttcctttgtttttatttcgtttcaagtgttctagttataagtcatggatatactataagtgtnnnnnnnnnnnnnnnnnnnngtttagtgaggtctccaagggcagttaaaaagtgtgatggatttgtatgtgccacatcgggaacatgtattaaagctgaagatagatgtgatggtaaggtagactgtccagatggtantgatgaattttcagattgtaaaacggcagtacaatgccctgggtatttatatgtttgtgattacggtgcttgtataaatcagacaaacaatgcaatggagtccaagactgcagagacaattcggatgaaaatcantgtcctgacgcgccatctgtcaattgcaaaccaaatgaatttgaatgcagtaatggccaatgcatacaccgagatctcaaatgc

SEQ ID NO: 5443 - DNA, 111 bp, Diabrotica virgifera
  misc_feature (2)..(46): n is a, c, g, or t
  misc_feature (65)..(110): n is a, c, g, or t
annnnnnnnnnnnnnnnnnnnnnnnnnnnnnnnnnnnnnnnnnnnngaccttgggtaacaaggannnnnnnnnnnnnnnnnnnnnnnnnnnnnnnnnnnnnnnnnnnnnnc

SEQ ID NO: 5444 - DNA, 453 bp, Diabrotica virgifera
  misc_feature (28)..(57): n is a, c, g, or t
  misc_feature (436)..(436): n is a, c, g, or t
gtcgacccgcgcgtccgcccaagcgtannnnnnnnnnnnnnnnnnnnnnnnnnnnnncgtttaattttatgttaatataaagtactacctattaattaatatttgataaaacatcggaggtcacatgactaatatatttattatagtcttcaacttcagttggcgcgtagggtagtataggattattgtaaagtattacgaatatttttatccacggctgttaaaaactaaggtatttgccacttctatgtaatttagtacaagttttataagtacataattaatattagtgtaaatatttgatggaagtgaccatttcatctaattttttttaggattagattaatattgttataaaggttaataatatcaaacccttagttttcggcctggtttcacaagtgaattgtgttgtggttgagcttcgactctcttnatgacctaaaagactgt

SEQ ID NO: 5445 - DNA, 413 bp, Diabrotica virgifera
  misc_feature (320)..(320): n is a, c, g, or t
taggcagagaaattgaattttttagtatataaaatattaccggtgaaggtgatagtgatattactttcttaaattcatggcagatactaaatactacgtaaatttctcacttataatgcttttgatggtctgtaaagctatgtgctctagaaataattctagaatagtaactcttactttgtcccaatccagaaagatgtctttttgtgccaaccttggtttcctttttaaggaagaaaacaatttaataaacagatataaacttgcaaagcaggcaggattttattcagtaaaaaacaccctttccttacggatatganaaagatgaaataatagccgctaaaaatgcagcaaatgttaaccaagttctgataaatatatatactggagatgtttctaaaggggaaatgggt

SEQ ID NO: 5446 - DNA, 332 bp, Diabrotica virgifera
acgcgtcagcagagagttgtattaatgcgttggagtttgcgtgggtggtggcttagtatgaatagtttatacaagattgatatttatatgtggtgcgttgacacgttgtagatattgtgaaagatatgatatattgtcaacatttgtttatatgattatggatgtgtaagtgactgttgtgatcaacagattggtgtaagggtgtcttcagtatatgtgttaaacgattgaatctttagtgaagtgttattatgatgatatgagtagcctaagaatatgtacatcgtttgtaaagggtaacatgtaagctgaggttacacgtttggggggta

SEQ ID NO: 5447 - DNA, 225 bp, Diabrotica virgifera
caagcgtctatagagagtcgtattaatgatctgcattttaaggttttgttgggttagtatgagttgtttatacagtagtgatttttagatgtctttgcagtgacgcgttgaagatgttgtgatatggatgatgatagtgtcagcatttgatcatataggtatgggtgtgtcaatcgagtgtactaattagcagcatttgatgtagggtgtcaggtcgacatgtgt

SEQ ID NO: 5448 - DNA, 176 bp, Diabrotica virgifera
ggcaaattcagttcagcgcagaagtcgattaacaaatttaagctcaaatggtttcaccttgggaacaaaatttggggtaattgaattacgccagtcaattgatggaaaacaagatttttttaggcaccggtaacgttgaaatcagaaatcacaatacagaatttagaaaccaagcc

SEQ ID NO: 5449 - DNA, 229 bp, Diabrotica virgifera
  misc_feature (54)..(77): n is a, c, g, or t
  misc_feature (166)..(179): n is a, c, g, or t
  misc_feature (181)..(199): n is a, c, g, or t
acgcctctgtactgacgtcgtagtacttagttatttttatatattagtatttcnnnnnnnnnnnnnnnnnnnnnnnnactatagatttagattatttacatttagtactgatgataatattagtactaaaacattgtatatttagtagaaacatatacgtttaacnnnnnnnnnnnnnntnnnnnnnnnnnnnnnnnnngtaatatcatgtcattcagtattaaatata

SEQ ID NO: 5450 - DNA, 263 bp, Diabrotica virgifera
  misc_feature (39)..(56): n is a, c, g, or t
  misc_feature (58)..(70): n is a, c, g, or t
  misc_feature (76)..(89): n is a, c, g, or t
  misc_feature (91)..(138): n is a, c, g, or t
tcactataaagagtcgtattaaatttacaataagaaagnnnnnnnnnnnnnnnnnngnnnnnnnnnnnnngtacgnnnnnnnnnnnnnngnnnnnnnnnnnnnnnnnnnnnnnnnnnnnnnnnnnnnnnnnnnnnnnngccttgtgtaccagggattaataattaataattcgagaattattagtttcgaacttacaagagctaacaaattaacatttttattgtcatctaaatactttagctaatctgtttgtactgaaatg

SEQ ID NO: 5451 - DNA, 465 bp, Diabrotica virgifera
  misc_feature (319)..(338): n is a, c, g, or t
  misc_feature (437)..(437): n is a, c, g, or t
  misc_feature (439)..(439): n is a, c, g, or t
cccacgcgtccggtttcctttggacagtgaaagaaaagcagctatctagcatattagagaatactgtactgttttccgagattgcattaagatttccggaaatttctacttctttattaaaaagaaataaaaactgggatcttgttcttcaatggggtattgcatttacttaccatatgagacaccttttagatgacaataccatacagctgttgaggttagtgagtcaagaattaaatcatgttgagagacacccagattatgtaaatccctatagaaagtctccagaagtacaaaaggatattgtgcaaccaaagcnnnnnnnnnnnnnnnnnnnnatcaagaaaggaccaaagctatctagtcgttttgagttgtaaaaactttttcataatcaataaaaatatttataaaggacttatttttccaaatattananggtaactaatattcaaatacttttgt

SEQ ID NO: 5452 - DNA, 304 bp, Diabrotica virgifera
  misc_feature (2)..(24): n is a, c, g, or t
  misc_feature (26)..(26): n is a, c, g, or t
annnnnnnnnnnnnnnnnnnnnnnancttccgccgacgtctccgattgcatgaaaaatgacacatgttgtatccgatgaaatatcaataatgatggtgaatgatttccatctggtacctgcatcatgctgtagtgtcatgtttcacgttgttataagattccaagtcattgtgtaaccaactggccatcgtaggctccaacatgatatccatcgtctacttagtcaggatcctgatcttacatcttgtcgttttgcacgtaattcagcagtatcccgtcatcataaacatctatgtagcccagc

SEQ ID NO: 5453 - DNA, 473 bp, Diabrotica virgifera
  misc_feature (53)..(72): n is a, c, g, or t
  misc_feature (87)..(112): n is a, c, g, or t
gggtcgacacaagcctctatacataagtcgtaatacatctgcaatgtttgcgnnnnnnnnnnnnnnnnnnnngatcatgaaaaggannnnnnnnnnnnnnnnnnnnnnnnnngcaggaacatacgaagcatttgcaagttgcagaggaggcacagaaaatgggaagagatgatttcaagatagcgactgaacaaacagatcaagagtgtttaagttttgacttggaaaaaaccctaccgcttcccagaagacctacaggcatcgtattttaaaagcgtcagttgtgggtgtataatgcaggaatacacagtagtgctaaagaaaatagacgatacttctacgtttaggtagaaggttcagctggaaggggcgcccaagaaataagctcttaccttataaaacatgttacaactaaattaactccagaagtcaaacatcttacgctttggtgtgattcttgcggtgggcaaaat

SEQ ID NO: 5454 - DNA, 120 bp, Diabrotica virgifera
agtcgtattataacgtggggtgtcggggaaagctgagaattcgtgtggaaggtcaaatgtgccggtcgatagtaaggatgtagcgacaacatttcaagcgtaagagtttaagggaacctg

SEQ ID NO: 5455 - DNA, 477 bp, Diabrotica virgifera
  misc_feature (19)..(63): n is a, c, g, or t
gcgttttaggctacaacannnnnnnnnnnnnnnnnnnnnnnnnnnnnnnnnnnnnnnnnnnnncaaggtaaagaagttcatattattaatgaattagaccatattgtgaatgctggttttgacaagaactccttctatgacgacaaggacaaagaaaatcatattagaggacttttgaaatctgaggtattaaaattagtgtctgctaacaatattgtaattttggatgccttgaattacataatatgatatagatatgaacttttctgcggaaccaaagctaataaatgtactcagtgtacagttcacactgaaataaatcgagaagaggcttggcagtttaatgaaaaccgaacaaatgatgctgaatgatacaatagataaacctttgatgcacttgttatgaggtacgaagatcctaatggtaacaacagatgggacgctccgttattcactaattttcctaatcaagatttg

SEQ ID NO: 5456 - DNA, 82 bp, Diabrotica virgifera
atagagagtcgtattaaacttcacaccgataatgaaattacgctattaccactgacgtaatttgatcatagaatcacgaata

SEQ ID NO: 5457 - DNA, 469 bp, Diabrotica virgifera
  misc_feature (286)..(312): n is a, c, g, or t
  misc_feature (437)..(454): n is a, c, g, or t
tcggacgccgggtgtccgaggaaattaatcattgatggcaccacggatattatagataataacgctttcggtcaacgtatatccctcggtccaaaggccctcggtatatgcaccattgacctcaagcgttattatccttataatacccttggtaccttaataactataagtacaagaagattccactataatattgttacaaattaagaaagtaacatattagatatattcaatcctttatatctctgaaaatattaaaaaagcatacatctgatttacaaaagannnnnnnnnnnnnnnnnnnnnnnnnnncagctgttaatgtttttttgtgtcctttagtaatattccagtgtttttaatatatctcataatattggaatattttttaaagtttaattaagtaaaggaataaagtaaaaagagtcaaaagcatnnnnnnnnnnnnnnnnnngtgtgatgacagctt

SEQ ID NO: 5458 - DNA, 216 bp, Diabrotica virgifera
caacaccctattatgagtcgtattaaggcgtccgattgcttttataacttcgaaatcctttgtaattcaagtcaccacacattctacacatgcagacataactgctcatgcgagacagaaagatactgcaactgagggaagctttagttactgaaccgtgtctgacgcagatgagacattagcagttattcattcactaggttccagtattatcca

SEQ ID NO: 5459 - DNA, 437 bp, Diabrotica virgifera
cggaaacgtcggatgggactcaactcgctgaggcctaatcgctggtccggggattggtcaatggaacgttgcagtggctttcacacacaacattggaataactgtttattggactcccttaaatggacacattagcaaaaaagtctacatgccaattgaaatgtcgaaacaataaggttccacaaaacaattaatggtccctggtttacaaaaggtacggttgtttaaatagttctgaccaaacaagtaatgaccgagtttacaagacttgctaaaaatgaggcacttttactatatttatcaaccatttttgtgagaaatacttgtattatggtgcctatatggaccaacgatagtacacagcgtatcaatcacgaagttagaccatctcgagctgatgttgtgccacatcaatcatataattatttaaatcaaca

SEQ ID NO: 5460 - DNA, 334 bp, Diabrotica virgifera
cttgaacagacttattggtgtaggttgatgtctctctgcaaagactctctggttatggcaacttccagtgtcaatcatgaggatattcctcactcgaagagatcttaaagaatagaatacgctgtatgagcttcaatcaccagtggttgtacaattccacagtctagtctatgcacgcctatcgtgcatgacttacagcagcagcctgaacgtcagctacagttattgggacatcaccaagcattggcccatcaatatttgagtgcaggacgtcgcccgcactaagatataggttccatcccacaatcgtaaagctgcatctacatataacaac

SEQ ID NO: 5461 - DNA, 373 bp, Diabrotica virgifera
  misc_feature (194)..(226): n is a, c, g, or t
  misc_feature (255)..(275): n is a, c, g, or t
  misc_feature (349)..(349): n is a, c, g, or t
caaaaaatgaacaataattaccaaaaattaaccaaaactcaacaatgccaaaaaaataatatgaatcgtccgggatttgaacccgcgatctcgcaatctctcgatctctggtccaatgctctaccaaccaggctatcaaggcgcctgttattgacgtttcggatatacataattacacatcacggcgacaagtnnnnnnnnnnnnnnnnnnnnnnnnnnnnnnnnncgcccaaggaagacaaatccaaagacacnnnnnnnnnnnnnnnnnnnnnatttactaaaaaacactaatatattattttaatggcttatattttataatggagaagagatgtctgcttttaanattgtttaaatcactcattgtcat

SEQ ID NO: 5462 - DNA, 129 bp, Diabrotica virgifera
ctagtgagagtcgtgttacttgttttgtcacgggttattttttcgtgtgttgcgcgcatcgacagtccacacgggtgagtcttatcgtgggattattgttactggccacagctggggtctgggcagtgg

SEQ ID NO: 5463 - DNA, 435 bp, Diabrotica virgifera
gttttgattattctaaaggcggttatccgttaatttggaattattatctctttacccagtgaatttacattattgttgttatatattttaaatccgatggtttattattgttttatcttagtaaaaatttatccgtgaaacaatgtaaatactaagtgaaaatagtgtgtgatgtaaaagtgtgttcccaatcctaatatcaagagtagtatccaaaaatgacgaataatacagacagtaccttattaaacgcctcagaatttatcaaagacagactgtattttacttgtgtggaatgtacagtggatctaaaacctacacctacacaccattatttcacactgaataacagtatatattatgacagtttctatgaagactttgggcccctaaatcttgctaagatataccgcttttgtacgaagttgaagaaga

SEQ ID NO: 5464 - DNA, 438 bp, Diabrotica virgifera
  misc_feature (201)..(222): n is a, c, g, or t
tccggcgataaactctcccaactttaggtatacagcagcgaggttgtgttggactattgaaccggtttctccacagttccgggcagagttacatttgaaatgtaaaaagcaaatagacgataatcccgacccaaaaaacgtcttaccgttaatagctgaattgtatatacagctaccgcatctccacgtttatggaacgcnnnnnnnnnnnnnnnnnnnnnngttgcttgatattggaggcaatgaaaatattaagactatatgccaagctttgaagttgactggatattcgttggaacaaagtaataagtcagagttagatatgatattcagtcacctcagatcagttagaaatagagtagatggctctgcagcatttttattggattctctctatccgttaagagcatcgaattggggacattttactgaagaatc

SEQ ID NO: 5465 - DNA, 462 bp, Diabrotica virgifera
  misc_feature (89)..(106): n is a, c, g, or t
  misc_feature (308)..(359): n is a, c, g, or t
cccacgcgtctgattggattgttttgagaagtggtaggagtttccattgttgataaattattattcatcatttaattttactggaacgnnnnnnnnnnnnnnnnnncatattcaagtacggtcctggttttaattgttgttagtaaaaaaccagtccggtgttgtgttgatatgaagattttatttggttagatttccaaaataaagatattatttcaatctaattaatgttcttctactcacgtttttatgtcttcttataacaccaaccgtcgtattctgaatatgtatgtgggtctaccaccgtnnnnnnnnnnnnnnnnnnnnnnnnnnnnnnnnnnnnnnnnnnnnnnnnnnnngtttgaataaaagttgcgaagtagtgaacacggttaaaaggcgcaaattggaatactttggtcatataatgcgtcacccagaaaaatatgacatacttcacct

SEQ ID NO: 5466 - DNA, 381 bp, Diabrotica virgifera
  misc_feature (240)..(240): n is a, c, g, or t
cctaaattccggaattaatcctgggaaggttgggttaaaccggaacggatgacaaaccttggaaaaaagtaccgtaacccgaaaagaaaaatttataccccgaattatactcacgaataaccaactacacaaatgctgactgtaaggtatatattgataatgaggagtttaattgtcatttaatagtactccagtgttactcagagttatttgatgcctatattgcagttaagaaagtanagctgccatcggacaaatgtaccgcaacttcctttgcatttatctacgaatggatgattactggtgaaccttcttaacgggagcttacaagggataacgtactagacatttttaacagcgctaaatatctcaaaatcaaag

SEQ ID NO: 5467 - DNA, 347 bp, Diabrotica virgifera
  misc_feature (253)..(282): n is a, c, g, or t
cgtatcctaaccataacctaaaagtacaaataaatttagcaggatttaagaaaaaattttaatagtgttattaatgaattaaaaacataataaataacaaaaatgtctactagatggtatcccatatatcaaaaaggagggccccaattgagggtgttccttccaaacttctggatgaaattggttcggcctcctcatgcgcaacctgccaacatcgttaccttttcttgttctatggaaatgactaaacacnnnnnnnnnnnnnnnnnnnnnnnnnnnnnngaggttaagtgtgctgatgtacatactaagatacacatgcccaaaaccaaaagagagaaaacaca

SEQ ID NO: 5468 - DNA, 115 bp, Diabrotica virgifera
aagactctatagagagtcgtattaacttttacgtcaagtgattttgagttcgtgtgatgactgtcttcaagacgcgtgtcgaaagcctcaagatggacgttatataagagaggtg

SEQ ID NO: 5469 - DNA, 197 bp, Diabrotica virgifera
aacaccctatagagagtcgtattagtgcgatctcaataggttatggtgactgatatcaccacaggtatattcagtgggaaactatgtagtatttctcatacacatagtgtaaccgccttgcgcgatttcgagatgtatcgaaactggctaagattcagttttatcgtcctatagagactaacttaggagtatcacag

SEQ ID NO: 5470 - DNA, 420 bp, Diabrotica virgifera
  misc_feature (42)..(59): n is a, c, g, or t
  misc_feature (310)..(343): n is a, c, g, or t
  misc_feature (373)..(390): n is a, c, g, or t
acaccctatagagagtcgtattaatgagcaatctacttatannnnnnnnnnnnnnnnnnaataatattacgtcttcttagggatgcgcttacacatgacatttcagtaacgtttatgttccacaggtcagttaggataaatgagttgcacatcttagcgtgtgttattagttatttttagataatgactatttttagcttttatacatcttttacgacaacacatattccacctgcttatattcagtaatgatgatcatattcgtatcgtggaattctgtatctagtagacatatatgcgttgactactnnnnnnnnnnnnnnnnnnnnnnnnnnnnnnnnnnggaacatgtcattctgtattaagtatggcnnnnnnnnnnnnnnnnnnctgagttgaatggccgcggtaagttgaccg

SEQ ID NO: 5471 - DNA, 451 bp, Diabrotica virgifera
acactctatagtagagtcgtattaatgtgcattagaattaaagtgcatcatgtctacgtgctaccagctgtttgtgatgtggactcctactgtgttagatgtgtgagtacggctaatgggcccttggttctcaaggatgtatgtgcgggtgatatgaacgtaggtgatactttcgactgtgaacattcagatatctggatacactaagatgactttggctggatgtggagtacatctatcttgaatggctgaccctcagcatctacatctgcctgccttctgatggaatttaatccatttagtcaggatttgtagatgacgacctaagagaacagtttttattatcagcaaccgtacagatgggacacacgtgtaccactcgatagaattctggttgtgctatagctggcgcgccagataactacttactcgggtcaaagttgctcctcat

SEQ ID NO: 5472 - DNA, 462 bp, Diabrotica virgifera
cgcgggtcgacacaagcctctatagtaagtcgtattagtacgtattaaagtcagattatcgaaatattattttgagagaaattgttcatatagagactggccaatgtggatatcaaataggggcatttatctgggaagttatgtctgacaaggatggaattgaccctactggaacttaacaaggagattctgatcttcaattagaacgtataaatgtatattagaatgaggcaacttggaggaaaatatgtatgaagggcagtattagtctgacttaaaatcaggtactatggatacagtgagatccggatcttttggtcaactttacagaccggattatttagttttatggccaatgtgaaacaggatataaatggactaacggtcattatactgaatgagctgaattagttgataccgttttggaagttgtaagaatttacacagattgccgtaactgta

SEQ ID NO: 5473 - DNA, 310 bp, Diabrotica virgifera
tctatagtaagtcatattactgtgttttcgagtaagtgttacttaatattttttagagatcatcatgtggcattccgctcaaatgcattctggacatcgcggtaagctttatgtagcgaacctcggggaacacggctccgttgttcactgttacagccttaccgagatccgaccattagagacatctgaacctccatacttgatttgaatcaatgtctacaacatcgacgcctctggcttgaaatgagtagtccgtgccatccacgtcgacctggtttctggtaacatggattcaatatagtcaggacca

SEQ ID NO: 5474 - DNA, 165 bp, Diabrotica virgifera
tcgcgggtcgacacacgcctctatagaaagtcgtactaacttggctcttactagctacaactggcaactgctccagtttctaatcttccactcgtcgtgctatcaatgcatgagtctcgattcgcagcacatatcctgcgttagggccgacctggcagtatctaa

SEQ ID NO: 5475 - DNA, 67 bp, Diabrotica virgifera
aacaccctatagagagtcgtattaacacatcggagcacatattatgactactcatgtccggaggact

SEQ ID NO: 5476 - DNA, 259 bp, Diabrotica virgifera
cgtgggtggacccaagactctagagagagtcgtactagtatatcgtaactcaaacgaacagtcaagatatcgggaagaatcgaggcttgaagctctaacgaggaggaagttaccaacatgttggcggcatctagtcacctgggaacagcaaatgttgctcttcatgtggaacagtacgtatagaaatcgtcctcatgacggtactcacagcagcagcttaaggaaaacgtgggaacggattcgcgtggcagccggtgcc

SEQ ID NO: 5477 - DNA, 458 bp, Diabrotica virgifera
  misc_feature (268)..(286): n is a, c, g, or t
  misc_feature (395)..(395): n is a, c, g, or t
tggcgaaactcatagtagaaactgtgaaagggaaccacttatgtgtcatgaagtacccaagcttccttttgagatagctgcttcagatatcttggactttggtggaaagtcatacttagtcatagttgattattacagtaattggactgagctcattagaataaaaagtaagagtatcagtgaagttatttcacagctaaaaaacgtatttgctacacatggcttaccaagaaaatttgtgtctgacaatgtaccatataacagtatnnnnnnnnnnnnnnnnnnnaactactataatattgaatactcgttttccagtccaagatatcccagaagtaatggcttagccgaaaaggctgtaggtatttgcaaacaaatgttaaggaagtgttcanatcatgatgattctttttattatttgctagagtacagaaacagtccattgtgtggtcttaatg

SEQ ID NO: 5478 - DNA, 147 bp, Diabrotica virgifera
aacaccctatagagagtcgtattagacgttgtgactggcagccaggagggtctcgacagcttgccatgcatcctttatcgatatccgcatcatcgctcttgctctatctcgaaacgtcatacgtggggagatttgagtatcatagtt

SEQ ID NO: 5479 - DNA, 390 bp, Diabrotica virgifera
tcgcgggtcgacacaagcctctagacagagtcgtattaatgtggcttaaatttttgctgttgtttgtgatgtggtggagtgtcaatacggccgaacaagtgaatggaaccggggaattgccattaaaggattgcctcgattctgaaaatatagttccttgtttagcagaaaaggcagcttcaacattcgaaaagtcattaaacagtaatatccaccttttggatggactggaactgcttagaaacgaccaaaagatcaacccaaggagagctaaatccctcgatggtgtacaaagactttttacagcagtctcagatttcatcgacactcattctttttccattgatttaacacgtggtcgagctttggacgacgatgatgaagaatacg

SEQ ID NO: 5480 - DNA, 409 bp, Diabrotica virgifera
gtcgtactaacatgcctgagcgccaggtgtgacatgtcgtgacatgttcctttcagtctagacgtggtacagacgattttcgtatcttggggttcgaggtctgcaatctgcgtctcaacgatttacaactatcgtccattgtcatagctctgatatattcacgacactcgagtactagtggaaatagatcattgcagagcgatcggtacgaactcacgtgcaagcaatgagtccaatcttcatcagcagattccgggtattggttgcacacgaagatcacggtgaaagcaatctagctaaagcgcagtagccaattcgtaagactcttgatatcgatccagtaggtaattagatcctgatttctacggagtgcagatcaatcacacctttcgcatacgacactgcgtta

SEQ ID NO: 5481 - DNA, 370 bp, Diabrotica virgifera
atgtactctttggtagagtcgtggcagtcacaatctcattcgttgcactcgaaatcataacttcgcaaagtgacgattgtagaggcacgcacctccaagatgggtgacgtcaagttgctggtcgataacttgtcggtggacagctagatcctggggaaacctatagcattggagattgaattgagcatctgtctgtagctaaagacgtaccagcaagcagttcgatggggaagaccacgatatggctaaccgttcactcaaatacgccagcgaaggcgagcaagttagggcatggagagcgtgtggaattaccattgatattgcctagtgtaaattggagacagcttgacagtatctaacgatcattggt

SEQ ID NO: 5482 - DNA, 508 bp, Diabrotica virgifera
  misc_feature (137)..(158): n is a, c, g, or t
tcgcgggtcgacacaagactctatataaagtcgtatgagttgtttttaagggttgaaagggggttaacaatatgataattaaaatagagaacgtaaaatatcatttactctatatttaaatctttttatatcatacnnnnnnnnnnnnnnnnnnnnnntttcgatttaggggttgtttgcaagggttgtacggttttcaaggggatgaaaatgagtttagaggttaatgtgttagaaatcacttcacaatgtcacctttgttccttgaagtatcttctaactactcaccaatttccatgaaaatcgatgaaggttcaacgaaatcggaggtgaaaaccttcagtgactccactatatagaaaccaagccattccaatgttttattatcaatgataaactttattgtgttagtgatatagttcttcaattccaaggcaaggttgtgaaaatgagcgttttcaatgaatttttgtttgtccgaacatttagttgttagagctcgtatatg

SEQ ID NO: 5483 - DNA, 506 bp, Diabrotica virgifera
gtgggtcgacacaagactctacagagactcgtattactctattgtactaattgtaaccattttcttgttgtccttttgacatttaccaaacatcacttagctgtttctttatatagttcatttgttctaatgtattggcccacaatattttttacttctagtaccatttctcattatcgaatctgctaacttcctagtcctagggatataaatatgtaacaataagcttctttttgattccggtacttacttttcgtgcccggaataccaacaactttaaattctgtacttccaatggatggccacgtagatggccctatcatttgctaaaattaaatcttcttactgtgcaggtgtctctctcatcgctgtgcgtgatagtagagactattctgaacagcgccacagtcactggtatcatctttctggtatccccattctttcaggtttctagtatccccattctttcaggttactagcacaatgtgaaacgccgattcttaata

SEQ ID NO: 5484 - DNA, 460 bp, Diabrotica virgifera
tgaaaatactgctcacgagtgcgcatgatttctcgacaaacaatgaagtggtacataataaagttaccattttccattccagaggccacaaaactacactatatagaaaatctatgattcttacatatactagcgacgatttacaaaatcctctgtttgcaatcagaaatgccggtaaaaaataagggaaacgataagaactttcgacattatagtgcagtgcgcaccatttatcaatcagtgcgcatgattaccctcatggctggggaatcgtgcacaaaggcacttcttttcattttttactattctactttagtatgtactttgtatttctctaaaacctattttaaatattcagagtagaataattagagcttactgtaacatactatccgttatgatagatttaaagaatttacaacaggatcgatttctgcttaagtgcgcactattctcccac

SEQ ID NO: 5485 - DNA, 486 bp, Diabrotica virgifera
  misc_feature (274)..(427): n is a, c, g, or t
tcgcgggtcgacacaagactctatagaaattcatactattttgcttcagaattccaagttacaggtctgcaattcttcgtagcagccccgtcgtggtactgccgattgtgcgatgtttggatcggagatctgcattgtgcttctcatcatttaaaatcaaaagtccatcatcaaaactttgagatatttacgactcagaatccacattgggaaatggaatggctgaaggatcgggaaaagtccatgaccagaaaaagagacgaagcttcttctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggatactgatcgtagtaagagtatcagagtggccatgcgcaatatgaatgagaaatgg

SEQ ID NO: 5486 - DNA, 446 bp, Diabrotica virgifera
  misc_feature (297)..(321): n is a, c, g, or t
  misc_feature (389)..(389): n is a, c, g, or t
  misc_feature (412)..(412): n is a, c, g, or t
  misc_feature (439)..(439): n is a, c, g, or t
attttgggggcaacccctgcataggaatcttgtagattataagctcattataggttgccagtaaatattcattaaactttgatgtagattccacaaatgtatgtcattagattgacatgcaaaatcagtagtaactcattcttgtctgaaactattgtttattctaataattccatatagcctgtgatttaatttatactttgtgattgtatacatatatcattccacttctagataaatgcacacattctcaaatatagtttaaaaaattgaactaaaagaaacgtacatgccagnnnnnnnnnnnnnnnnnnnnnnnnngttttgtttaatatctatagaatatttatttttaacttatttgaatacaataacttattcgctcatcncgaagaaaagtgtcacaactcanaaaacaactttttttcaggggagacanatatgga

SEQ ID NO: 5487 - DNA, 147 bp, Diabrotica virgifera
  misc_feature (8)..(27): n is a, c, g, or t
acaacacnnnnnnnnnnnnnnnnnnnnggcctttattcaatatatggatgtgatctatgacatctggttgcgtttactcaacatcaaacgcataatatagaccgtcttgggcgcacgtatcgtcgggatcgtctcctcatacacagc

SEQ ID NO: 5488 - DNA, 356 bp, Diabrotica virgifera
gataatgtccattgtagcggctatgcagttctaaagtatgttttagagtgcgtaattcagatctttcacgatgactgttgacacatgtcgatacccataagtctctgataagaccacacgcaagaacatcatggtgtatttattgagacctggcgctgaaatttctcagtacatttcaccgaaaggtacattgtagtagcatacatgatagtattgactgatataaatctcgtattagagatggtcaatacgattatctcgtaaaggcgatctatgacataggtacgataatggatgtgaatccattggttggatcacctattatcatccgaacattctgtaatgatcacacatgt

SEQ ID NO: 5489 - DNA, 333 bp, Diabrotica virgifera
gtggaactcgcgccaggtgtaacatctcaagtagtgttccttttagtctatgttgagtttcgatcagttgcatttactttaattcgacacgatcacgttgggtaacgactctagtcatcataacatctttgtcattgggcacgtgcagtctggtacagctacgactacgggacatttaatttatacgtgttgtggtatcaacaactatcccatctagttcatgcgatcaagaagcccagacattcgcatatccgctcagctctaaatatacctgggtacacgatcaatcttaactgtcgaggagagaacgtgtgtattatcaggtgatattgc

SEQ ID NO: 5490 - DNA, 397 bp, Diabrotica virgifera
  misc_feature (346)..(346): n is a, c, g, or t
  misc_feature (378)..(378): n is a, c, g, or t
cagattagaagagcatgaacccattgtctgtaactgtacttttcgtagcagtcgctgccgccagcgctagcggtctccttggagccggtctcgtagccgacaaaggagccctcgaaggcgcactaagaggccaatggattcctgatgtaccagttgccggacacggacctgcaggtatcgtcgctcccggagtagtagcagctggagcaagtgccagaggtgccctcgaaggtgcccttggaggacaatggatccctgatgtaccagtagcccacggacctggtgtacttggcgctggtgtacttggagctcccggtctcgtcgcccctggtatccttggaggtcnccttggtctcggtcttggtcttggacccgtangacttggtcttggacccgt

SEQ ID NO: 5491 - DNA, 363 bp, Diabrotica virgifera
aggtaaaataatttttgttatgtaaatttttcaattaattgaagttgtgcaaaatcgtcataatagcatatttctgaatgaatccttatcatttttaagtaaccactacaacaggtcatagacgtctacagtggtgcttatctgcttatcaatcagttccaagtttgacgtttggattagtaaaacatgacagcaaaaattaattttcaggtaaaaaataaagatattctgcaaagtggtatatttaatcaaactttaagggactggcagagtatccaatgtgaaatcacagcgaaaaatttgatgtacccagtctttattgtggaagatgatgatgtcgtacaacccattagtagtatgcct

SEQ ID NO: 5492 - DNA, 386 bp, Diabrotica virgifera
ccaggtcgacgtacgcatcagaacgataggcacatcgcatttttgtgagaatcagtacttgagcggacggaaatgaaacctggttttaaaacgttatttgaacttcattaacctacttattaaaatcactacaaaaaaatttaaacgaacttaagttcaaacacgtgtatatattcaaccaaaaactgacgtttcctcgacgtaattgacgtcacttggttgcctgggtagtctcttactatatagttgacttcatctaattttgtgaggaaggacaaatttaatgacaaatcataaatttcgtatacatagaaaaatgaaaattagaaaaggccaaagtaacagaaacaaagttctgagatattctacaaaaacaatacattatc

SEQ ID NO: 5493 - DNA, 223 bp, Diabrotica virgifera
gtatgtagaatgtttttattgtggttacagtatgaatccaattccagtaaaatgttgcaatagcctctcattatttatcttttagttttttaactcatatttatatatcatcagaccatgtatgttactcacactgaaatgtagttccggaattggtgtatttaggtactcgtctagtactttatactgaaatagattttgtatatatacaagctcaaattaa

SEQ ID NO: 5494 - DNA, 351 bp, Diabrotica virgifera
aggacacgtgggtaaagttacatcgaagaagccatgatttacctccatattatgctcatcactgttatgcatccctgaaataattccgagatgctgacgattgaagtaatgtttacttatagtcaatatctatataccggcgagactagactacatcaatagtttgcaaatgtataggatgcaccatgttcttcatattctatcacgatatcactcatcaatgaggcatatgggtaaactatttgaggtatcacttcatgtaactagataattataccctccgacatcattacctaattcttctccacgaagtagtctatgaatctacagtatgcctcatgggccatgata

SEQ ID NO: 5495 - DNA, 424 bp, Diabrotica virgifera
  misc_feature (20)..(45): n is a, c, g, or t
gggtccacgcccgcgtccgnnnnnnnnnnnnnnnnnnnnnnnnnnccttctctgttgacaatagacaaattgtgtctggatcccgtgacaagaccatcaaactgtggaacaccttggccgaatgtaaatacacaattcaagatgatggacattccgattgggtatcctgtgtaagattttcccccaaccacgccaacccaatcatcgtatcagctggatgggaccgtatggtgaaggtatggaacttgaccaattgccgtctaaagatcaaccactctggtcacactggttacttaaacacagttgcagtctctcctgacggtatcttatgtgctagcggaagtaaagactgcaaagccatgctgtgggatcttaatgacggcaagcacttacatatcttggagcataatgacatcatcaacgc

SEQ ID NO: 5496 - DNA, 421 bp, Diabrotica virgifera
acgacgcgtccgttaaaatataacctcattatggaatatggtaggataccgtcagttcattctattacctatgttacgcctatgcgtccatatgagagtgtccgtttagatcaagaattgaatatcatcggagcctttggtctcagatacaaatgtgaattatggagagtttaatacactctatccaatttccgttaggccgccatagaactgcttactctaaatgagaatgaacccatgtggttgtatgaaagtaatgcacgcttacgtcgtgtggttcgtattggagtattaaacgagaatagaatgaagctctattacttaatgggtcacaagattgagcatgtcttgggaagacgtctgctggcagcagtcttcatatctggtctaggtaagtcaatccatcatgctatggtattga

SEQ ID NO: 5497 - DNA, 375 bp, Diabrotica virgifera
  misc_feature (113)..(153): n is a, c, g, or t
gggccgccaccactgacgatgacgacgaatgacaacgatgacaatgatgacgacaatgacaatgacaatccggttagtgacttatttgacgatgacgatgacgatgacgacannnnnnnnnnnnnnnnnnnnnnnnnnnnnnnnnnnnnnnnnaccggcctggaggatgtcatcgaggcgaagagatcacgtgagtccaaaaaattaaagcatactaagaatgccaaaaaaatctaggaaacaccatcgccatcataaagttgctaacacaatcagataggtagttgacgtggagtagggtatagacactttattttcttctgttttaaagacctgatttctggaactgttcaaaggaggtttgacatgatggac

SEQ ID NO: 5498 - DNA, 393 bp, Diabrotica virgifera
aataaatgtgtatagtaactaaaaaagagttccttatgtgcaaattgtaattaagttaacctccgaagttaatttataggtattatagcagtaatttctacagtagaaatgtaattgaaatatttacaatgtcaaaaaataaattaaacctaacactacctcctggttcaatagaccaaacaccggcggtaacaccaacatcatcatttcaagaaacaccagttgcaagtaaccttgtgaggggaaatagtattgaaaatttaactgcacgtatagaagaacttgattcaactcttgaaatggatgatacccagcgtaaaagaatagaggttttcctttgtcaaaaagaaaaaattggaggagagttttctgatgaatgattcgaaaaattgg

SEQ ID NO: 5499 - DNA, 105 bp, Diabrotica virgifera
gcgtccgaagaaattagaggcgatgggttcgttaactttatgagtgatctttttatcgttagcggctttttcggtcgctgaaaatattgttgtgtgtagctacga

SEQ ID NO: 5500 - DNA, 246 bp, Diabrotica virgifera
  misc_feature (15)..(33): n is a, c, g, or t
  misc_feature (146)..(168): n is a, c, g, or t
cccacgcatccgatnnnnnnnnnnnnnnnnnnnctggttcaggacgtgtttgtcaatttgggatctgaggacaggtatgttgcaagcatcttattatgatctatgttggtgtaccttgtgtatcatgggattattactagatcagnnnnnnnnnnnnnnnnnnnnnnntatttgagcttgtaagttgacgattttagtgtcgaatcaattttttaaatagtttctttgtaataaaacgttatgcgt

SEQ ID NO: 5501 - DNA, 156 bp, Diabrotica virgifera
tacaataatctgaggtgagtcgtattaggtctgctgattaaacacatttgttggtgattggtttctgtagtccggaagtttcactcttcgttttatttaggtggatatttaattctttgtatgggtgcgtttttagttctgtgtgtttagaggggt

SEQ ID NO: 5502 - DNA, 156 bp, Diabrotica virgifera
cccacgcatccgagcacggtgtcaaatctggatgaattgggcagcagtccgtagcttaatttgacgaagtggctcgtggcaacgtcggacgtgtgagtagcgagagaagagctatctatcagattttcgaccggataggacggtcttgtacagtgt

SEQ ID NO: 5503 - DNA, 421 bp, Diabrotica virgifera
  misc_feature (72)..(92): n is a, c, g, or t
  misc_feature (398)..(419): n is a, c, g, or t
gggtcccagcacgcgtccgcaaatatccaaatgtgtttggtttgtgttgattttataatatttacgattacnnnnnnnnnnnnnnnnnnnnncaactatggaatcacccttaaaaagtgaaaatgatacagttacagaagagaatccgtatgcttatttggatagagatttttcttcggagaattttaaaattgaagttaagaatatgcctaaatattatggaataagtgaatttcggaagcttctcaatgaaaaattgaaattaaattccaataaaattaaaacaactaaaagaaatagttcctttgcctttgtttgctttagaaatactgaagatagggacaatgcaatgcaagtcctctctaaatacaaatggaaaggaaaagaattgcaggttnnnnnnnnnnnnnnnnnnnnnnat

SEQ ID NO: 5504 - DNA, 413 bp, Diabrotica virgifera
cgggtccacgcacgcgtccgacgacgaatcagctgcactactagccaatctgaacgtcggtccaaattttgtgtcaattgtggtgtacaagttaaaactcatcatccagtatgcctgactgtatcgcagtcgatgtaggccaagccggagtcgaaagcggtgatgcctgctgggagttgtactgcctggaacatggcattcaaactgactgtcagatgccagcagacagaactgttggaagatgagatgacagtttcaatacattcttcactgaaactggtgtcggcaaacatgtacctagagcagtagttgtagatttggaaccatcagtacttgatgaagtatgtagtggcatataccgtcaattgttccacacagatgagctcatcaatggcaaagatgatgccgccaaa

SEQ ID NO: 5505 - DNA, 445 bp, Diabrotica virgifera
  misc_feature (294)..(313): n is a, c, g, or t
gcgggtcgatacacgcatctgaactgacgtcgtgatatgatttaacttatatttgcttttgtagttattattaagttcctatattataattttgtgtgagctgtagaacatcgcagtgaattttgtgtatgagagaatgtgcgtgtgggaaatttgttcgttgtattttggagatgattcgatattatctggtgaaaaattgaagtttgattacatttgtttgacaaagatttcgataaaataaataactacacctaacgatatttttgctttgattacttaagcaaaatcggnnnnnnnnnnnnnnnnnnnngcttaaattaaccaagaaaatctttaaaagtagaaaatttttggtttatcgagtgttttcggagtttagtagttgacttaatgattcttcttgagaaatgtgttcaggattttttaagaacagaaatttagg

SEQ ID NO: 5506 - DNA, 423 bp, Diabrotica virgifera
  misc_feature (272)..(291): n is a, c, g, or t
ggggcatatccaaacagctattgtttcagattgcgttcataatcgtcgctgttacaatgtgttgaacagatacgagcgtggttaacggtaaaattgtctgcacgtttacgtttacataattgttttcacacacatcgcacctttttgtcttttgagaaactaaaaaacttgatattcgtatcgaaaccttgtgattgattgtccacattacaaccaaacacggcacacctcatttttaataaaagtttaacaaattataagtcaaattcacnnnnnnnnnnnnnnnnnnnnccgtttactatacgacaacactgaatttaatgctgttctactcacagagtgacgtagctacgtaggccccgcccaccgactccatgtcatatcttcagttattgtatcatgggagcagtcgactcttctacg

SEQ ID NO: 5507 - DNA, 331 bp, Diabrotica virgifera
  misc_feature (26)..(81): n is a, c, g, or t
acgcgtctgaggtaaatcgtattatnnnnnnnnnnnnnnnnnnnnnnnnnnnnnnnnnnnnnnnnnnnnnnnnnnnnnnnntacaagattaaaaaagaaatacgacaaaaaaagggggggccggccaaagggttcaaactttatttacctgtgattgctacttcagaccccttcaaaagggcacacataaatttattgaccggaccgtcttttaaaacctctgagtcgggaaaaaccctgggttcacccaactaaacccctttgcaccaaaacccccttaccaaaaagggctatatcccaaaaaggcccgcacagattgcctttccaaaaa

SEQ ID NO: 5508 - DNA, 432 bp, Diabrotica virgifera
tacttctgaagccaaagacaaaccaatgggctgtgctattctcgtcacaacatattctatgatcacccacacgcagcgtagatcatgggaagctgagcaaacaatgaaatggttgcaggaacaagagtggggaataatgctcttggatgaagtccacacaatacctgccaagatgttcaggagagtgttgacgatagtgcaaagtcactgcaaattgggactaacagccactttgctgagagaagatgataagattgctgatctgaatttcttgatcgggccaaaattgtatgaggcgaattggttggagttgcaaaagagaggttatattgccagagtccaatgcgcagaagtctggtgtcccatgacaccggaattttatcgggaatatcttgtgtgcagaacaagtaaaagactgttgttgtacgttat

SEQ ID NO: 5509 - DNA, 332 bp, Diabrotica virgifera
atgacattaaaaccagatggtatattcgataagcagtagtactataacatactggcagtttcgatagatacgttattgttagaagcaaactttagagcccaggaagcaggagagactggattcgtgcacgttgtcggtttgggattgggagtttggaagatttcacctcagcaagaaaaagtgtatatggatgcatttgccagtagaattgcaatccctggagagcaactaaatcacataagcgacatgtgttttgcctggatgtttcaagatgtatgcggcaactatgtcgatggagaacattcttccattccggaccatccatcatgcgg

SEQ ID NO: 5510 - DNA, 428 bp, Diabrotica virgifera
gggtccacgcacgcgtccgacgctgttcaatttaaagtcagttatactgtttacccttgttggtagcaccctcgtaacatctcgcaaggtgccaaactgggaagatgtttttcgagactaccagtcaaaagttgttcctctcagacattggggaaataaaagctactggatgggcaccagctttcaggcaacttggtttgaagcattaaccttttgcagtcaaatgcatatgcagctacttaccatcaactcagaagaagaaaattcagtaatttacagatacataagagaggccagcaaaggttttgaatattggacatcaagtacgagactaattgacggaaataagtgggtatggttcccctatggcgacttaatagaatacacaagatggtcaaacggtcaacctaatgatccaaatggggaaa

SEQ ID NO: 5511 - DNA, 332 bp, Diabrotica virgifera
caacataacataattttttcacgttataagtttaatcttcaatttaatattaatattgtaataaactcataaatatttcaattatggcaggatctgcactgcgaagacttatggcagaatataaacagttaacactgaatccacctgaaggtataatagccggtccaattaatgaagaaaacttttttgaatgggaagcactaatcacaggtccggaaggtacttgttttgaaggaggagtgtttccggcaaaacttatttttcctcctgactatcccttaagtccaccaaagatgcaatttacctgtgaaatgtttcatccaaatatatac

SEQ ID NO: 5512 - DNA, 380 bp, Diabrotica virgifera
aatactcagcctccttcagcgtcttagacttacgatacgacttactcgaatttatcgactgcctttcactctcaatcgaatttaacttgcaatggcagagaccgaaccgtcaattgaaataactaaagatgacaatactttacagaaacttgaagagaaagcccaaaaagcccaagaagccttcgagcgtgaagaaaaagccaaaaaggaattagaagctctctatgccaagctcttagctgagaagaccgagttgttatctaacttggaaggagaaaagggatccctttccgaaactcaagaaagggccaacaaactccaagcccaaaagaacgacctcgagtctcaacttttctgaaaccaagatcgtttgagccaag

SEQ ID NO: 5513 - DNA, 389 bp, Diabrotica virgifera
  misc_feature (25)..(50): n is a, c, g, or t
  misc_feature (237)..(255): n is a, c, g, or t
gacgtacgattccgagggggccccnnnnnnnnnnnnnnnnnnnnnnnnnngtgtgttatgtttttattaaatatacaaatgaatgtttaatacgataagtataacagtgtaaaagctgataaattttttaaaatgcaaaacaatgtacaatattaattaatgtcaaataggactattgaattgaattaattttgaagttcaagaaattaaaaatgcaatttgtgtaacgcacatgcnnnnnnnnnnnnnnnnnnncaggtactgtatttccgttgggctcttttcctaactacatttttttgaccagaccattacagaatattttcttaacgacgcgacgttcaacgttcaacgtattttaaaatacatttttgcctcatattaaaata

SEQ ID NO: 5514 - DNA, 383 bp, Diabrotica virgifera
acgctgttgaagaaattaaatattggaagaaataatatgtaccaatgaaaataaaaagtctggaaaagttgatttttatacctatagataatatggaaattatggtggaggaattttggtcattgcaattgtactggtattttttattggttcacaattttcaaaaagttatactgataagattttaagcaactgggtaaatcacattcatcacaacacaacgaatatcaatgaagaaaatacagtgtgggatttttctttgaagatatattcagcgtttacactgtcaaccacgattctttccatattctcagcctttttgttacttaattttacaagaaaggcttctataaaactacatcgatgcttaagtaacactgtta

SEQ ID NO: 5515 - DNA, 349 bp, Diabrotica virgifera
cgggtaacaagccttcgttaatttaaaaccctaattccggcaatccaccatggccaccatggaaaacttcattatacaattcgcagacattgtaggtttcaccaagatgtctggtagcaaaagcgccgaagaactagtagatatcctcaacaacttgttccaaaggtttgactccttgtgtaagatacacaattgtgagaaaatatctactttgggtgattgttattactgcgttagcggttgtcctgaagctagatcggatcatgctcagtgctgcgtcgagatggggctgagtatgatccaagccattaaacagttcgaccatgagaagaacgaaagggtcaatatg

SEQ ID NO: 5516 - DNA, 98 bp, Diabrotica virgifera
tgagtcgtattaggtttcgagggtacagtctgagcgtcaattcaactcagtgatgtgtctcaactgtgaccaggtgaaggtgccgctactgcagacat

SEQ ID NO: 5517 - DNA, 110 bp, Diabrotica virgifera
gccagacgatgcgacagtaagcatgcgaggagcggcatgggacgtgtatctctgcagtttgccaccatagaagaatgagaatcgcgggggaggagctgtgcgaagacgag

SEQ ID NO: 5518 - DNA, 240 bp, Diabrotica virgifera
tctagactgagtcgtagtacctacgcttggctcatcagtaaccgatgttcgtccacgttgagacgcatcacgccaatttgtgacagttgcagacgagcgagaagaggcagcgtacacagcatccaaccgctctttgatgtcgcagcgggatttcgcttccaaaatcatagcagaatttggaattggctgacattatgacaataaccgtgtaccagaacgcaataaatgagagtacacgtc

SEQ ID NO: 5519 - DNA, 341 bp, Diabrotica virgifera
  misc_feature (15)..(15): n is a, c, g, or t
gtgagtcgtattaantcgtattctgaacacttacagtggggttctagcgtgtgcaagcactgctgtcgtggtcgccggcagtgcattcggatattcctacaatcggtttagcgtcgcttggcgcagaaccatcgagggatggaaccactccttggcgggtttactgtccaggaagcgtcaacatatggccatatcatgtgatgagcggactctggatcgagctgatatgtactgacgagttggcgaacgtgtcagtaaacagccgcgcattcaggatcagactccctgaagacagtgcaatggtcatacttcaaagccccgatatgttattgatagccgat

SEQ ID NO: 5520 - DNA, 385 bp, Diabrotica virgifera
ctcgcgggtcgacacacgcctctacagtcactcgtactaataaaaaggaactagtcactggccgtcgcaactctacccgctggacgtagttgattcctacgacgttcttgcagtcgcgacagtgcaagcggtaaacgttgtaccataagccatcgtagacgtcttggcacacgacgtagtcctagacaagagtattagaaataatgagtaccagtcaccatgctaagacatttattcaaagatggaagaatccattctcttgaagatatcgaccagttctctatgccaatcaatgagttcgaaatcatcgatcatttccatggatcagacttgttagataacgtacagatgatcacacctgtacacatccatgctcttacttgtc

SEQ ID NO: 5521 - DNA, 404 bp, Diabrotica virgifera
  misc_feature (297)..(328): n is a, c, g, or t
attatcttgtcaagttttagcactgaatattagcggcatttgagttttatcaactttcgtcaatcgtaaataaatacttatcccgtttgaagctagttatcaagtttttacacaatatagaggcagataaaatacatcttgtgaactagttatctcaaaaacgtaaattttggagttatcaagttatagtactaaggcgacgaatgtcaatcggttttcattacttgccgaaatacattaattaacaacaatatgatcatagtgtattgagataacccggactcatactctctccannnnnnnnnnnnnnnnnnnnnnnnnnnnnnnnttacatatagaaaagttcctttttttctactaaaaatgtcgttttctgattatatgaatgaaataatcaacttact

SEQ ID NO: 5522 - DNA, 276 bp, Diabrotica virgifera
gtgagtcgtattaactcacgacagtatcattgtggagtaaaccattatccggattaaggccacaggagcatcctgtattcatgattgcatgtcaagtagtgaacaattccaagctcttcaatcctaggctatttcaattgcgaaacttgacaggtctgaggtgaattgatttctcatcagtatggtggaaaaattggacagctcgtgtcacgtaatagacgcatgtgtgtggatacggcaaaagagtgaacgtagagtgggcggtggcagtcgatt

SEQ ID NO: 5523 - DNA, 290 bp, Diabrotica virgifera
  misc_feature (63)..(88): n is a, c, g, or t
ccgcctttgcgttgtggcctggcgcagccgggtgtcagcgtccagaccacagcaggaggtagnnnnnnnnnnnnnnnnnnnnnnnnnnccagcgcagtagcattggacgtcccgtgttggtgtccaaatggtcagtgataaattggatggaaagaaagggtacaattcggtgtcacgtacctgccacgggggaacagatcgacagattggcgctgtgcgttacgagctgaaatccaatgattaacctggagattttactataggaatcacccgtgtgttagaagcttaaa

SEQ ID NO: 5524 - DNA, 255 bp, Diabrotica virgifera
tgagtcgtattatgtacataagcattaggattacaatttttcatattttaacatatgttagtatttatttttatgtatcattcattttaatattttagaagttttttgagcatgtataagttaattttagttagatttggtatggatggacatattggaattaacaaattgttgatacagtagcaatctgaaggtataatagacggactcggtaacaattatatcatctgtgtatgggaagcatgtctctttgtc

SEQ ID NO: 5525 - DNA, 125 bp, Diabrotica virgifera
gtgagggtctgtgcggagtttgcatcaattgtggcgattgtcatgaccgctcggatggctcaaaatgttgtgcgcattctaactccatgctttggagacgagggtccacttgggtcatttctgtg

SEQ ID NO: 5526 - DNA, 408 bp, Diabrotica virgifera
gcccaggtcgacgtacgagtccaagctaagtcatcacacggtctccatatgttctgccaatgcaagagtatgtgataacagctaatgtctcagaaacatacccaaaaaatgggttcaaatttagaatacgtcgattcatcacaagtttacgctaccagctacgtcagagattccaaagccgtacgaatgttatggggaagttttacgaaatgctacgctatcatcgctactgtttcctttataacagctgaatggattggtactactagcggtgaaacacccggaaaaactggactgtattcaaattgctacataggacaaaatgctgcacagtgcatcgagaagttttgggatacctttatcgaccacgctcatgctcttcaagcatccagggtgtctgtaagattg

SEQ ID NO: 5527 - DNA, 366 bp, Diabrotica virgifera
gtgacgcagcgcgagactttattatatcacgagttaagatttacgtgagttgcggacacctacatagcacagtgatagagcatatcatatgtttaatataaatatttagtgctcggacgttgtccgtcacggaatatgacgaaatacttaccaactaattaatgtcgaattcgcaacaccagcattacaagtacttctattgacagaccaacttcttcccataacttatggatgaccccatgttcaacatttgttaacagcctccaatttttcatcaacagtatcatcctcagttatcagcgatgaatctaggttaatatatacatccaccgattcctcctcgatacttttaaggatcgatcttag

SEQ ID NO: 5528 - DNA, 339 bp, Diabrotica virgifera
  misc_feature (300)..(300): n is a, c, g, or t
agacaatggcatcttcactcacaaaatggcgtaaattcgttggcgatggtgtcgtcatagccgaattaagtgaatttttaacccgtgaactcgccgaacatggatagtccggtgtggaagtacatgttaccccatcacgtacatgaagtactattatggcgactagatacgacaaggtgttaggtgagaataccaggaagataagagaattgacttccgttgtacatcataggtttagcttacctccagattccgtaattctgtaaggcgaaaaagtatccaacagaggtctgtgtgctngtgcccaagctgagtcagttaagtttaaattgattggag

SEQ ID NO: 5529 - DNA, 391 bp, Diabrotica virgifera
  misc_feature (27)..(62): n is a, c, g, or t
gtttatattcgaaatcataaatttccnnnnnnnnnnnnnnnnnnnnnnnnnnnnnnnnnnnngaaacttgtactagagcaacatggaactaagagatatcaattatgacaaaggagaatatgtagaaacggcttcaggtaacaaggtgtgtcgccaaactgtattatgtgggtcccaaaacatagttttacagggaaaagtaattgttcagtccgatgcaataattaggggcgatttagcaaatgttaaaacaggaaggtactgcattatcagtaaagaagcagttcttagacctccatacaaaaagttcagtaagggggtagcattttttccattgtcaataggagatcatgtttatataggagaaaaatctcttgtaaatgcagctact

SEQ ID NO: 5530 - DNA, 363 bp, Diabrotica virgifera
gaagtactgcagtatttatatcagttaattgctgctatgagcttgctatcggttaactggtgagaatgaatactccgatgatctagagtacttcttgtgtcaagacaaagggggcattcttagagtagagcgtcaccgaaacagccgaccagaactcttgtcgtcgtctggatccgaggtacagtacatattcagcagcaagtcgaaccctggagatgtagaatgtgtggagattcacagcatcagcacagagaagttgaaaacaagttcatttacaacaaatctagatactatttttatcgtgcatggatggaacgatagccaagacgcatatgttaattctcatgtcagacaatatatact

SEQ ID NO: 5531 - DNA, 108 bp, Diabrotica virgifera
  misc_feature (2)..(19): n is a, c, g, or t
annnnnnnnnnnnnnnnnntgttttattagcaataataacataaataaaaaagacaactgacaaatgacataaacatctacaaactcttccatcaaaagtaaaacata

SEQ ID NO: 5532 - DNA, 146 bp, Diabrotica virgifera
  misc_feature (10)..(51): n is a, c, g, or t
  misc_feature (53)..(68): n is a, c, g, or t
  misc_feature (78)..(97): n is a, c, g, or t
  misc_feature (107)..(134): n is a, c, g, or t
taaacatacnnnnnnnnnnnnnnnnnnnnnnnnnnnnnnnnnnnnnnnnnngnnnnnnnnnnnnnnnncatatgttannnnnnnnnnnnnnnnnnnnctatttgtannnnnnnnnnnnnnnnnnnnnnnnnnnngatttaaattag

SEQ ID NO: 5533 - DNA, 377 bp, Diabrotica virgifera
cccactcgtccgcggactcatgtgcaggtaacaacgtacataggagtcatcagcacatgtaatagtatggcagttcagcagcactggaacatgaaccacaatgttatggagatgatgaccccactagcaagcctagtaatgcgccttcaacacgtcaggcaatgtcactactgacgctctatgatcgaatggtcacactatcgatgcaatatgcgctcccagtgatatatgtgctgcgaataccatcagtacatgtcttatcacgcatgaccgtttcaatgtctccgctcgtgccagttctgtctcttgaccagcgtaacgcttatcaacagatatgcacatatatacgtattccattagttactaagggtgcaaat

SEQ ID NO: 5534 - DNA, 249 bp, Diabrotica virgifera
gtttgatcaacttcaccacaatggcatattttttactagcagtattgaataagtttatttaactgatcgatcattactattgtcacagaacactttatttctagcggtgattcatgttacattcctgtaccttgcgtatcagggacgattacttcgtcagtctatatttagtatctacgtcttgactggagcttaaagtttataatttctagtgcaaaataatcagtttcaaggattcttttgtaatga

SEQ ID NO: 5535 - DNA, 57 bp, Diabrotica virgifera
  misc_feature (26)..(44): n is a, c, g, or t
ctgtcacataggcgtacactgtgttnnnnnnnnnnnnnnnnnnnctgagtgaaaagt

SEQ ID NO: 5536 - DNA, 267 bp, Diabrotica virgifera
  misc_feature (211)..(231): n is a, c, g, or t
aaacggattaaagaacatgattgcacaggttttatttatctctacaattggagcgattgcccaagcaggacttcttcaccgtggtctagatttaggaggatcatcatatatcggaagccatagtatagctgttgcatcagaaccagttgtagaatattttgctcctccaaaatacgagtttaaatatggagtacaagactggcacactggnnnnnnnnnnnnnnnnnnnnnatctacagtgggagaccttatccaaagtgactactc

SEQ ID NO: 5537 - DNA, 100 bp, Diabrotica virgifera
tacacctccctaaactgagtcgtattacgtttgacgtatcgtgtgaacgtcctaccagtttagaatagtgtgctatcgtgcagtattctgggagcttttg

SEQ ID NO: 5538 - DNA, 381 bp, Diabrotica virgifera
  misc_feature (152)..(175): n is a, c, g, or t
aataaaccaaatttagaagccttacttattcaaaaaaatgtatatgtggccatgttatcagaaacatggtttaaaccagaaaaattttataacttctcaggatataattgctttaggtctgatcgccctgatgggtacggaggcacagcaannnnnnnnnnnnnnnnnnnnnnnncagaagagataaatttattggataattataattttacttatacttgcatggctgttaaaatttcgtgtatcaagaaaccaatacatataatatccgtatataaagaaccaggtattagagtaacggttgaagaatgggtcaatttttttcaaaacattccttctccattcatcattggaggggacttcaacgctcacaacatggca

SEQ ID NO: 5539 - DNA, 234 bp, Diabrotica virgifera
  misc_feature (68)..(85): n is a, c, g, or t
  misc_feature (87)..(100): n is a, c, g, or t
  misc_feature (110)..(148): n is a, c, g, or t
  misc_feature (188)..(213): n is a, c, g, or t
ggcgtcagtcgggagacgatgacgatgacgacgatgatgacgacgacgatgatttggatttaggagtnnnnnnnnnnnnnnnnnncnnnnnnnnnnnnnncagtcccgcnnnnnnnnnnnnnnnnnnnnnnnnnnnnnnnnnnnnnnnctactttggaggatttttagatgatattttaggcggtgannnnnnnnnnnnnnnnnnnnnnnnnngagacgatgagcctagccagg

SEQ ID NO: 5540 - DNA, 370 bp, Diabrotica virgifera
attgttcctcaggagaacttctaaacactactaggaatccttcagaccactcagtagtctgagtttttctttatctagtctatcttgtatgaatcatgttaattcgatcgatgaagtatgtagtagatgcacactggcacgtgtcaatatatatcgtctagagtcccatacacgtgtttatagaataacgacagtcttgcgagtataatctcacatcaatgtacactcagatattctgacacgaggtaattttaaatattttagacggatagggcattacgataaatcacgttagcacacactatgtgtaggagcatgttaaatattcatgtcatgctttactcatatgttgaatactcttatagcacta

SEQ ID NO: 5541 - DNA, 397 bp, Diabrotica virgifera
  misc_feature (280)..(306): n is a, c, g, or t
aatgaaactaagttcatgtcagtaaatcaaacagtgtttaattgccattacatttatttgtcaggttttccatctctgctataaacaataagaaatgtaatgattatatacctcctcttccctttataatctgtttaagctgaacattattagttacctttgatgtatagtatatttacagttgcaaacacaaataggctcaattattccaagtaaatattatattctagaactgttttcaactagtattagacatgggtaattttaatagtgtagaaannnnnnnnnnnnnnnnnnnnnnnnnnncaaagttggaatattcgtgtctttgcaaaacctatttaaaatacagatatttttatctaagagagaaacataacagctaaaagaagattat

SEQ ID NO: 5542 - DNA, 335 bp, Diabrotica virgifera
accacacgtccgcccaagcgtccgatagagtgttctgtgtgatctagtaacagttattgaatagattttataaatcacattgagggaaatcgttcatatccaagctcggctgtgcggtaaccaatttggacccatattctgggaaagcatcactgatgaatactgcatcgaccccaccggtgcctatcatgagcacactgaccgccaacgtgaaataatcagtgtctactacaacgaggtctaccggagacagtatgtactcggcgccatcatcgtcgacttggaatgcggtaccatgcactcagtatagtcgggtcacttcggacaaatcttca

SEQ ID NO: 5543 - DNA, 401 bp, Diabrotica virgifera
aaaaattatcaaatcttaaaagagaacaagtccagatcacgatggatatcgatgatttggaaagatggcgagacagaatttttgaagctattcagtctggtcgagtacaaggtagaaatggcgaaaccattttgctaactgaaaatgaaggaatagatgtcttgggcaacatgatcgaatccagtgttctctcacccaacagagatatatatggagatctacataacatgggtcacgtatttctttcatatatacacgatcccgaccatagacatctcgaatcttttggagtgatgggtgattcagcaactgctatgcgcgatcctgtattttatagatggcatgcctatattgattacatgtttcaaacctataaatcagccttgcctagatataccgtt

SEQ ID NO: 5544 - DNA, 242 bp, Diabrotica virgifera
  misc_feature (91)..(108): n is a, c, g, or t
catcagccggcgggtaaacaattttgacgctggtgcacaaatttttttaaacgtatttcttgaacaaagcgttttaataaaaactcgtagnnnnnnnnnnnnnnnnnntttttgaaagttgggtgtgtaataactaatcagtgcatctatatactaatggctaaagtccaattgtgttacataatcgtgatggacaatcctaatcctatcatgacaccatttcagttcgaaataacttttga

SEQ ID NO: 5545 - DNA, 149 bp, Diabrotica virgifera
gtccagggtcgagcgacccgtccgaccacgcatccgtaatgtaatacctcaacagacataagcaccagtacaaatatatttcacagactcacgagcagttgcacctgttacagaacacagcacgtaatacaacagatcagttactgtta

SEQ ID NO: 5546 - DNA, 266 bp, Diabrotica virgifera
cgtccgaatttaaggccgacattgattgcatcggtatacgtctcagttttagcaccattttcacataagtattttacatatgaatcaatcatgtcgttaccatcttcgatctcagcgatttgtaagttgtatatcagatacatgtctgtagcaatttttgcactatctcgccactcataccaaaacattgccctctctcgttgtacctgtatagtataggagacaatctcgcaattggtaaagcttatagtgaatgccattcaatc

SEQ ID NO: 5547 - DNA, 301 bp, Diabrotica virgifera
aataatattacgattaaaatattgtttatatagtaagtatatataggtttaatgtaggaattcagcaacagttttgtcaccagtttagtgagagcatgtcttattgtaataaatttaaggtctcgcctgcgcactgagtatttcgagtagccgcggtatttagaccgtgcgatagtagcatcgtcattagtttagctattgaattctgaaatgaatggttggatgaatattttagtgactttatttgattcgtaatgaaattcatctttaagtttatcagcttaattatgtttaaaagtcg

SEQ ID NO: 5548 - DNA, 423 bp, Diabrotica virgifera
cagtattacgggtctaggacgcgtccgaccacgacgtcggcccacgcgtccggcttctctgaaatggccactgttgtttcatgacctcatggctgctgctcaagatacctttatcttgcaaaagatacgtgaggatgacttttctttgtttgtaatctcggaatgtctactgatttgcactgcttcacgattttttctataaatactaaagatttttgaaaatacttgagtcttttgaataatattgaatggctggtttcttggaacgaaattttctaccattacataatggaagaaattcaccacaaataatgcattgttaggctcttgtgtacatttcgcttcagttatacggaacttcatcatgaataagatataatgtttctcttcgagattttcctgccgcacttctccaaaaatcca

SEQ ID NO: 5549 - DNA, 373 bp, Diabrotica virgifera
  misc_feature (62)..(90): n is a, c, g, or t
  misc_feature (149)..(182): n is a, c, g, or t
  misc_feature (225)..(244): n is a, c, g, or t
gtaaattctgtaatgggtggaatgcgtttagaattaaatttaatacgaataaaaaaatggannnnnnnnnnnnnnnnnnnnnnnnnnnnnataggtgagaaaaacgaggtctggggtcagctgcaccccgcaccgccttacgacagttnnnnnnnnnnnnnnnnnnnnnnnnnnnnnnnnnncttgttatgttaaaaatatctatttctaacaattattaaaagnnnnnnnnnnnnnnnnnnnnctcgagggatacacgacaacaaaacaaacgctaaaataaaagataacagatacaaggaaacggaacaaatactaaaatataaccacagtatgtaattccgctggtatgtcggtacaactgttcttcttt

SEQ ID NO: 5550 - DNA, 414 bp, Diabrotica virgifera
  misc_feature (12)..(33): n is a, c, g, or t
  misc_feature (165)..(197): n is a, c, g, or t
  misc_feature (241)..(260): n is a, c, g, or t
acgatacaacannnnnnnnnnnnnnnnnnnnnntggaatgcgtttagaattaaatttaatacgaataaacaaatggacagaactcagaaaccagttattagccaagataggtgagagaaacgatgtctggggtcagctgcaccgcgcaccgccttacgacagttnnnnnnnnnnnnnnnnnnnnnnnnnnnnnnnnnacttgttatgttaaaaatatctatttctaacaattattaaaagnnnnnnnnnnnnnnnnnnnnctcgagggatacacgacaacaaaacagacgctaaaataaaagataacagatacaaggaaacggaacagatactaaaatataaccacagtatgtaattccgctggtatgtcggtacaactgttcttctttcgtcgttacgtgccatctccgcaac

SEQ ID NO: 5551 - DNA, 294 bp, Diabrotica virgifera
  misc_feature (2)..(20): n is a, c, g, or t
  misc_feature (123)..(175): n is a, c, g, or t
annnnnnnnnnnnnnnnnnngatttcgacggtagacgatggtgacgaaggaggatgaataggatgatgatcaagctagtgatggagacgacgaaccgctgatacagatgatgcagaggaaacnnnnnnnnnnnnnnnnnnnnnnnnnnnnnnnnnnnnnnnnnnnnnnnnnnnnngccagagaagtagaaggaccgatggaagccgagcaaagacatggaccacaagctgagggataggaagaaggaacgaaagcactgtggatagttctgggatggccgtgaaaattggtgtt

SEQ ID NO: 5552 - DNA, 413 bp, Diabrotica virgifera
  misc_feature (121)..(133): n is a, c, g, or t
  misc_feature (135)..(147): n is a, c, g, or t
cacaaagggtcttaaacggactagagaaactactgaaaagaaaaaatccaagcacaaaaagaaaaagagtagttatagctcctcatcagattcacaatctagctcagatgaagggtatatnnnnnnnnnnnnnannnnnnnnnnnnnttatgaatatagttccagcagtgattcttctgatggagataggagtagcaaatataaaagaagttcttataggtctagatctagaagtcctccttataagtccaatatggaatcccaagaaagtaagctacaaaaacaagaatcgagtgcacaaagagaagaatggatgaacattcaaactaaatttttaacatcatctaattctgatcgaaaaaaggaaagggatgagcagaagaggttagaaagggaaaaacagcagtatgatc

SEQ ID NO: 5553 - DNA, 394 bp, Diabrotica virgifera
gtgatgaaggtcaggatctcgacgataaagatggtgacgaagaggagcaagaggatgatgatcaagctagtaatgaaaacgacgacaccgctgatacagatgatgcaaaggaaactgaacaagatgaagatgatggaactgatgataacgtcaaagccgctgatactaccaaagaagtaaaaaaaccgaaaaaagccgagcaaaagcaggaaccagaagctgagggagaagaaaaagacaacgaaggcactgtggatagttctggcatggccgtgaaaattggtgttggggtagctcttctagtggtcgcacacctcgtattgattaaaaaatggagaaacgctgaggatgaaatcctgccaactgaaaaagctcctccaaatatacaagacag

SEQ ID NO: 5554 - DNA, 343 bp, Diabrotica virgifera
  misc_feature (170)..(185): n is a, c, g, or t
atcatttgtagacactatttatctgatgcatgtttcatttagatcatttaacctatgcgctctatgtagttttttgatgtcaaattattgcattagttagtttatgaatagattttgaacatgatggtagtgcctacgcttttaagcatctgtgattaaacgcatcactnnnnnnnnnnnnnnnnttcattaaggtttatataggaaatgagtcttttatgtgctatagtgagattttagccgtcgctgtatatccttcgaacagattttttttatcaagtgaagtcttcacattttttctacttgtaggtacttgtagagtcaagaatctggcgtacagtag

SEQ ID NO: 5555 - DNA, 429 bp, Diabrotica virgifera
  misc_feature (321)..(333): n is a, c, g, or t
  misc_feature (335)..(353): n is a, c, g, or t
aaaaaatagcagcattttgtcagaatccaactttagtggaatgtcggcaagaagaatgtagaaggaaatgtctcgagttctggaacttacctgataaatcaaaaacggcactacctcagcttagcgcacttcagcttgtcaatttagttttagataaaccagaaattcttttggtgcaacccagaaaagttgaccatattgaagcatttaacgaattgatctcagacgtggaagattggtattattttccattgtatagttctcagaaaacaaataattgtaacttctatgctggtgtttctggcaaggtttataggttannnnnnnnnnnnngnnnnnnnnnnnnnnnnnnncaattgtgcagaggaaccttgttgtacggcgaatttgtcaaagaaaaatgtttaacaacggaaggaagtaaagaaa

SEQ ID NO: 5556 - DNA, 185 bp, Diabrotica virgifera
accacgcgtccgcgaatttaagaaattgagtaatattaagactgattcctcacgtttcgctactgctaatttgccttgcaacaaacacaaaaaccgtttggtacatatcctgcccttcgagaccactaaggtgtgtcctacaccgttgagaaacatcgaaagttccgattatatcaatgcgaact

SEQ ID NO: 5557 - DNA, 416 bp, Diabrotica virgifera
accacgcgtccgaaaaaatgtcaatggtatatttttaatttccctgtacattcctcacgtgtggtggtagctttagaatatcgagatacatcttatttctactgctgtggaatcagaagtcactaaaaaataccgcttgcttctttgataactttgaaattgtatttatttatcgaaaattttgtctaatttgttgtcttggatttttggtaaccaccatttacgtgcatcttttcttgattgaccttaaggccaacttccctggcacctctttcaaaaaggataacttcttttgcatctctggtgctttgtacaattgtgtcgacatcgtcagcaaaacctaacagtactttcgttcactgggcagcgaagccatttgataattctggttgtgctttcgtagtgtgtttcaaagc

SEQ ID NO: 5558 - DNA, 403 bp, Diabrotica virgifera
accacgcgtcagctatattgttgacaaatgatgctgtggcatactgaaggaatcactcaattcggcaagaggtttgggaagtgcgaaacatcaatagtgtcccattttttagaaggtacgttgagtgtcgtgcttagtgtagtatggtatctatataatttgtgaatcttagacgtcgatactaatgtaaggtgccactttaatatatagagttatatacaatccttttacttatacactgctggacaacggctacgaatgcaagcataatttagtcattttcaccaagaaattagtgaaattttatattagccaagggccgatcaaagttcaatgtgtttcagagtgtattcttattaagtttgacccgctgttaaaatttcttccacttcttcttcttcat

SEQ ID NO: 5559 - DNA, 398 bp, Diabrotica virgifera
aaaataatcaaaatattattcacattaaaaggtatgtgcgtatttaactaatacattatcatagttcattgttgaagactcttgttaacatctaatatcaattgaaatgaatgccgatccccgcagacctgaaaaagtatcaagatatgttccaaaagctaccaatgggactggccaagaagacctcacccctgattacatgaatatcttgggtatgatctttagcatgtgtggtcttatgatgcgtttaaaatggtgtgcttgggtagctctatattgctcctgcatcagcttcgccaattagaattacagacgacaccaaacagatcctgagttcgtttatgttatctatatctgcaatcgttatgtcgtacttacagaatcgacaacctatgact

SEQ ID NO: 5560 - DNA, 231 bp, Diabrotica virgifera
ggtcgagcacgcgtccgcaataaaggaatgattcatagttgtgataaccaaatttcgttgtgttgtgaatttgatattttcaaataatcagagataatatttcaagtatatattaataaactgtaatacagaatattataggcaactactaataatttgtggaatatttacatagcagttgttgggccatatagtcatacatacatttacaatacataatgtaaggtgagc

SEQ ID NO: 5561 - DNA, 407 bp, Diabrotica virgifera
  misc_feature (55)..(78): n is a, c, g, or t
  misc_feature (147)..(163): n is a, c, g, or t
accacgcgtccggaaaatttaaactattagaaataattaaattaagtaattgttnnnnnnnnnnnnnnnnnnnnnnnnggataaaagtgtagatgtcgaaattatactcactgaatacaatagcaataccaccaagaaatcaatagnnnnnnnnnnnnnnnnntatttgaaaaataagatttttcgtccgaatagtgtaataaattttgaacgcgaaaatacaaacattcttcatggggttgttaagacagttataataggagagattgcaggttatgataaatcctttgtagactttaacaacttaaacatcaactggttcgtttataaactagatgctgaaggacctctcttacaaaatgaagaagatggtgaagaagaagtcacgatatccacacaactaatgc

SEQ ID NO: 5562 - DNA, 331 bp, Diabrotica virgifera
  misc_feature (32)..(143): n is a, c, g, or t
  misc_feature (169)..(229): n is a, c, g, or t
  misc_feature (231)..(288): n is a, c, g, or t
  misc_feature (290)..(321): n is a, c, g, or t
ggggccaaccaaacatccgaccaagcgtccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtaatcgtttttaaatataaccaaannnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnngnnnnnnnnnnnnnnnnnnnnnnnnnnnnnnnncattttaaaa

SEQ ID NO: 5563 - DNA, 396 bp, Diabrotica virgifera
tgttaatgacattagatctcagattaactctaaatttctgcaatttgctgaggatttaatgatctatataattatcgaatctgtctcatattgtgaaatacttcaaaatgatattaagaaaattatggcatggtgcaattggaaccaaatgagcattaatgttggtaaatgtcactttattagtttctgtagaagaattaacaacctcttttataattacaaattaactgaagaaccactgaaggctgtatcaactgtaagagatctaggtgttcaattacattccaaactaaatttttgcgctcattttgattatgtgaataaccaggcatttaatcatgtaagcttcagtattacaacttctagatgtctgcataacattaattccatcagact

SEQ ID NO: 5564 - DNA, 400 bp, Diabrotica virgifera
  misc_feature (194)..(209): n is a, c, g, or t
  misc_feature (229)..(266): n is a, c, g, or t
attacttacttggcactttgctaaaatcaatgcacaggacgaagaatgttgcaacgcgtactcacatgccgatgcaaaagaaatggagaattttttgaaacagcaaggctgcaccgaattatcaatgaaaccagtattagcaaatagaaccaaattcattttgagcaaaccaagtgcgtccaacgaaagtggtnnnnnnnnnnnnnnnnctcaacccttaccacccacnnnnnnnnnnnnnnnnnnnnnnnnnnnnnnnnnnnnnntttttagtttgtcttcattctaaattaatcttcgtcattagtaattagtacaagtttactttgccttctcggaacacacgaaattgttgtcgcacttgttttggtgtgaaaaagcgtgtttcgaagtcagtttg

SEQ ID NO: 5565 - DNA, 425 bp, Diabrotica virgifera
  misc_feature (143)..(160): n is a, c, g, or t
  misc_feature (251)..(278): n is a, c, g, or t
  misc_feature (416)..(416): n is a, c, g, or t
tgtatttcctagttaataattgatttcgttgagttttaatgttatagtcgttattaggaagattttttttatgattttacgttctcgtgtgggaagtggttagaatatactgccacattcttctcgcaggtttcttgcatgcnnnnnnnnnnnnnnnnnnttttcaatttcgtttaaaatgaaatagatctataataaaaaatattcacgaacgatatacaagaaatggttgaatataactaaaattatannnnnnnnnnnnnnnnnnnnnnnnnnnnaacagcatattttgccaattctctatttattttctctctgttatattttatgttaactcgaatttgttactgagttgattttagacgaatgattcaggtattagtaattactaaatgattctaacgaaatttaggtanaatacaaat

SEQ ID NO: 5566 - DNA, 378 bp, Diabrotica virgifera
gccagttaagatccgtccattctattcggaggtaactaagggttgggtgatgccctttgcaggacacgatagaaagataatgcaagagactcaaaagtatttctatgaaaaagaatcgcaaagaccaattaatggtcaagtactgatgtccgttacgagtatctttacattgatttatattaatattgtattgttaacgctatttgctttagctcaattttccttcacaagaaattggttgatagaatatccccaaatcttttcttttggctacgtcaaaaaagaagagcatccttctgaagaagtcaaagcaggcggtcgctatcgtctaacattgtatggagaaggatggaaagagaagctggcaaatgtaaacga

SEQ ID NO: 5567 - DNA, 143 bp, Diabrotica virgifera
  misc_feature (22)..(40): n is a, c, g, or t
cgttggaccacatacaaaaccnnnnnnnnnnnnnnnnnnncatttcagaacttgtgttcaaactttggattgacatgcacagaatgtgtactgtgcaagtatcaatccagatcatcctggagctcttaatggattggaacatg

SEQ ID NO: 5568 - DNA, 321 bp, Diabrotica virgifera
  misc_feature (146)..(146): n is a, c, g, or t
attaaacggcattgtttgactgacattgctttaaggaccaatttgatagtagaagtcgttaataatttaattcagagatatttcgataatttcgttcaatgataatatccttctataaatgaattatttagtttgtggactatgantaacatggattaacaattgacacttatatatttactatgttccgattatgactaacgtgtgttgtaaaatttatatacggaatgaattaaattaaaacaattttgtgttcacaaatgataatcgtgtttaaataaaaccaacttattcaataagtcagttaatttaattaataac

SEQ ID NO: 5569 - DNA, 274 bp, Diabrotica virgifera
  misc_feature (38)..(57): n is a, c, g, or t
gtcaaaaaaaaccaaaaaccgttacgggctgaattccnnnnnnnnnnnnnnnnnnnnccaagcaaaaaacacacacctttggacttcccccaaaacatcaaaaaaatatcaaaacccaaaaccttcaaaaaaaaagccccaaaaaagttattcacccgcaaagccaatcccaaggcaacttgggaaacttgcccccgggccaaggaaggtacccggccgtcatgaaaacccagtaaccgcaaaacactttggttaaaaggctgacgagtaaaaa

SEQ ID NO: 5570 - DNA, 428 bp, Diabrotica virgifera
  misc_feature (420)..(420): n is a, c, g, or t
aacgttagaatcagtgtgcaagcgggtttgccatatgtcgcccattctgtgaattatcataaataaatcctccttttgtatttcacagcagttaacagcgataatcctctacaaggccctgcctaattctacctttcaaggccgctgccgtgaagggcggcaacgggtgtcaggaaaattgtcatttggtttgcatggccctatccttcgtacactgaatcgcatgtctgaaatacgctgtagaattgagtagttattgtatagttttaaggcattctttttattgctatgtaaatgctaaacgctaaatcggtaaaacactttcttaatcgagtattataatgagggtgttgttttaacatcttgtacgagtcacttctttttaatgtcgcggtgtttactgtgttgtttagtcaatantaacacat

SEQ ID NO: 5571 - DNA, 340 bp, Diabrotica virgifera
aaagctgatgatgcaggttaattagcattcaccgtccgcgtttacattaacgtagcagatatcagcgagacatcaccggaaattgtatgagatccttaccatttgacagtcagggaatgtctatgtaggacacctgtcgggtttgtgcaagctactgatgcatatgaacgtgtcaccgctcaggtcacctagttcattccctcacatttgcccttcgagatagacaacgacagtggaaagatcacgacgaacacacctttggattatgataaactgagagattatcaacttgtagtaactgcataagatggtgctacagatcccatcattgcaactgcca

SEQ ID NO: 5572 - DNA, 428 bp, Diabrotica virgifera
  misc_feature (91)..(110): n is a, c, g, or t
  misc_feature (256)..(277): n is a, c, g, or t
accacgcgtccgggtttttttcggccatttatttgaggatttctagttctaggtgactgataggcgcgaagtggttgggatataagccggnnnnnnnnnnnnnnnnnnnntaataatcagaaaaaaaagtatcaacgcattaccagttatggccgataatgaagacttgggtttaggtgaggatcacatagattccttcgaagacgctaacggaatgcacgacgagaatctgttaaatgacacagatggggatggnnnnnnnnnnnnnnnnnnnnnnttggaagccatcaaggcacgggtactagaaatggaacaacacgccgagaaactgaaacagttacaaaatgaagtggataaacagatgcatatgggaagtccaccaggacttacaagcacattgaataagtcactggaggaaaaaatggaaa

SEQ ID NO: 5573 - DNA, 425 bp, Diabrotica virgifera
gccctagttcatccgtgacatttctttctttgcaattcgggaaggccctaagctgtggtaaatggttaaagcggagagaagaggatatgggtttactgatgaggggaaaaagatctccgaaaccggtatagactcttcctgcactctccgctttaaccagaatattatgcagctgctgcattttcgttttgcaaagaaattgagaatgtttatacatttttaattcatttactcttttgagtattaaggaatctttcttgttggagctttaccatgctgagtagatgagttgtgaattatttaaaattctctcatcttaattttctcggcacctgtatgacttataaattgtaaaagtctcaggaggtgtaaccaaagaaagtattccacctgttgtcaatctggtggtacggaggcgatattta

SEQ ID NO: 5574 - DNA, 388 bp, Diabrotica virgifera
attatcatcctattttttaattattgattaagtttatgtaattggctatttagtattaatattcaattcaagatttttcacaattgttattttgctagcattgaatatctttatggatttataccaatttgatttagttattgcttcagcacaagcttataatagtgatgaatatataataagtgatttaattaatgatcgatttagtttacgacttgtaatatttgtattttcagtactagtattaactatcactcctaatttaatttcaattttattaagttgacatgggtcacgtttagtatcataatgtttagtgatttattatcagggtattagtacatttaatgcaggtaaatcaactgcgtcatctaatcgacttggtgat

SEQ ID NO: 5575 - DNA, 335 bp, Diabrotica virgifera
  misc_feature (6)..(61): n is a, c, g, or t
  misc_feature (113)..(154): n is a, c, g, or t
  misc_feature (185)..(220): n is a, c, g, or t
  misc_feature (289)..(308): n is a, c, g, or t
  misc_feature (311)..(324): n is a, c, g, or t
gtaacnnnnnnnnnnnnnnnnnnnnnnnnnnnnnnnnnnnnnnnnnnnnnnnnnnnnnnnngtttgattaactaggatgtttagtttttgtaccttgtgtaacagggattagnnnnnnnnnnnnnnnnnnnnnnnnnnnnnnnnnnnnnnnnnnctaagaaattaacatttttagtgtctatctnnnnnnnnnnnnnnnnnnnnnnnnnnnnnnnnnnnngtcgtttttagatatatctaatttttgacgaaggaggttcagtttatttagtatcaatatacttaggannnnnnnnnnnnnnnnnnnngcnnnnnnnnnnnnnnagggatgagct

SEQ ID NO: 5576 - DNA, 366 bp, Diabrotica virgifera
gatattacatacctaaataacataactaagcaaattttggtatatgttatgcgatattcacattgcatctctcattttaaaaattgattgctcagtcatttgacaaccgattttaaaaacttttatatagctggataggtacatgaccatttttatgccatttttttttcgtatttgaaagcgatataaaaaattcaatacattcagacaaaacttttactaaaataaacaatttcagcgaaaaccgtatatttctatcttgagccgtttagaagttagaagcagttaaaatgggggaaaatataggtggacacccggtataataagtaaattcggtagttcgtcacctcgatttaagtagcgttg

SEQ ID NO: 5577 - DNA, 360 bp, Diabrotica virgifera
  misc_feature (82)..(103): n is a, c, g, or t
cgagtatccaaggtagtttgtgaaccctgcgcaacagtgatcaggcgttggtcttcagttccattccacacttcgggaatgnnnnnnnnnnnnnnnnnnnnnngtaatgtcaactgacccattgccattttcacagcaattctgccaatttgtgcacatgatatttactcgatgcagctatccgctttaatcacatcaaggctgatgaggcaccggcaccgtcgtgtatcccactcaccggacatattacccgcatatggtgcagacaggtataagaacgcgttttccatcggctgcaactgccacactaccaggcttcccatgactacatggagaaatcaaatctgtagcggcagacac

SEQ ID NO: 5578 - DNA, 418 bp, Diabrotica virgifera
gaaccaaatttatagacaacaacttggttcaagatttggttacggttgattgggtcgtctcggacgtgttggccgggtgcatgtagacgaagttcctaacgcagtcgtttcccttcaacttctcgaacacctcttcgccagtcaataattgatcaaccaatcatattgactgatatcaccgaacatttacatccaatcactgacgacattcactaccagcatcatctgattaaccaacagattcatttccttattgatcaattaacttaccatcacaacctcagtacacgtgaatttgaacaatacattgttaaaggacaagttgttcctcaggaacttgtctctcatcagagattgatataccaccatcttcatgatgtaattgaacctctgacctcccaacaaatattcatcaatc

SEQ ID NO: 5579 - DNA, 383 bp, Diabrotica virgifera
cggacgcgtgggttgaattatgataacgtacagtatgtagcagacaacaacattgatcaaggggccggacagcagcactacaacccacagcagtattattatttgcaacaacagtaccaagcacctactacgtctatacaagctgtggtggacccaaaagggggtttgcagtacataatgtatatcccaacatatgtgtccaaccagggaagtcaacagcagtcaactgaccaaacccagaactacgagaacgtcgtctatagcgacaacgaccagacgtaccaacaaccacaatcatcgccccaatataccacatacacagagaaacaaccactcttgaaactggcaagagcgcatacaatgttaaagctacagacttcact

SEQ ID NO: 5580 - DNA, 84 bp, Diabrotica virgifera
  misc_feature (12)..(32): n is a, c, g, or t
attacaacatcnnnnnnnnnnnnnnnnnnnnntatgagaacgtgcagtacgtaccagacagtgagattgatcaaagggtcggac

SEQ ID NO: 5581 - DNA, 332 bp, Diabrotica virgifera
  misc_feature (28)..(45): n is a, c, g, or t
  misc_feature (99)..(226): n is a, c, g, or t
ggtcgaggcacgcgtccgatatgtctgnnnnnnnnnnnnnnnnnngttattgtttttttttctgtacactatgtatttttgtagaattgggcttgcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtgaccgaacttaaagtcaaaggccgacgttttacaaaatcaagactggaaaacccctagagtgacccaaataaaaaatcctgcgacagatctttaaaaacgcca

SEQ ID NO: 5582 - DNA, 397 bp, Diabrotica virgifera
cagatttttctgcacaagtaaaagataaaaagctttttaactttaaaaatgtcttctaataaagaaaatagaattaacaagcaagtagaacaatatgtatcaaaattaaaaatacccaagcaaatagatcaagatatgcgaaacttagttaagtcgatgatatcccatgatgcttttggaaatacaaattacaaatggtcaataaatgatttcgaacttggaggaagactcggtagaggaaagtttggtagagtgtatattgcccgtgagaaaaaaactggattcgttgtggccttaaaaacgctgttcaaaaaagaaattgttaaaggacgagttgagcgacaaacattaagagaaattgagatacagagtcatcttaagcacccaaatattctac

SEQ ID NO: 5583 - DNA, 205 bp, Diabrotica virgifera
  misc_feature (46)..(72): n is a, c, g, or t
  misc_feature (93)..(111): n is a, c, g, or t
agtacaggtatggcgtctgtttatttaatgatacttaagtagtagnnnnnnnnnnnnnnnnnnnnnnnnnnngggacaatttagtttttgtcnnnnnnnnnnnnnnnnnnngtggttaataactagatatgtattaggttcgagtttagacgagctagcagcttaggatttctagtgtgaaggaagtatctgaaatggtttgttt

SEQ ID NO: 5584 - DNA, 355 bp, Diabrotica virgifera
  misc_feature (190)..(208): n is a, c, g, or t
acgcacggtctcttccttgcagtaccaattggtgctatttagttttgtgttctgaggaaagattgtgaagtgtatgtattcaaagattcggtttaaatatgaaagcctgtgatctattgttgtggttttgcctatttatagctacagcgacttcacaatttataaacagtgagcacattaattctacagnnnnnnnnnnnnnnnnnnncactagttacaaatgtacgctaccacagttcccacctaatgggagatggatcataattaatggagaaggttatccaggtgacgaaattgaagttaacaccatccttcaaatagaatgtaaggacggctatcgattacacccaaacat

SEQ ID NO: 5585 - DNA, 386 bp, Diabrotica virgifera
  misc_feature (14)..(39): n is a, c, g, or t
caacactctataannnnnnnnnnnnnnnnnnnnnnnnnnctcttatagttagaatcgatgggtgctcataccgaaggccaacaaccacctatgatgtcttttaaggcttttttagctactcaagatgataacatttctgatagcgaggctatagaaaagtacaatgattataaactagaatttcaacgtcagcagcttaacgaattttttgtggctcataaagatgatgagtggtttagacttaagtatcacccagaagaatctgtaaaacgaaaagaagagcaaaaggcagctttgaagagaagagttgacgtctttatagagcttttaaatgctggcaaaatagaatgtgttaaggtggattgtgcggaaaccaataaattact

SEQ ID NO: 5586 - DNA, 305 bp, Diabrotica virgifera
caacaccctatagatgagtcgtagtatgtccggcttccgtttgcataccgccacgcgatctgtcaatttgactaattgtatcgcttcgattggtaagcgctacacttggatgcattctcaatgcagtcgttgaggtctgcgatcgtaccacaaccatcaggagacttgcgcatcatgtggatactcaatctctaaagtgcgatcctacaactgggtcgagacagccaatatgaggaggactaccggaactgggcgcactgttcatttgcgtgatgtcgagcgtcctttccactttgggttccgtc

SEQ ID NO: 5587 - DNA, 212 bp, Diabrotica virgifera
  misc_feature (22)..(23): n is a, c, g, or t
  misc_feature (37)..(37): n is a, c, g, or t
tatagagagtcgtattaaaaanngcgactcactagtnggagtggcactaaccagtacaacgcagtgaagcgactcttaatttggtaatcgcgaaataggtacgtagcccctatgctgtgggggaggttgacgttcagagcagacaaacggggggctcgaccttcatggggatactcaatcgcgatcgtgggatactcccggagatacaaagt

SEQ ID NO: 5588 - DNA, 295 bp, Diabrotica virgifera
  misc_feature (152)..(281): n is a, c, g, or t
atagagagtcgtataaaagcgtgggatttttttatatgaatctccgtatatcgaaaataactacaatgatggaaacatttttgtattgaatttaaatatagcaataccagatgcagcttgtgaaatgtatttttatatcgagaaaaataagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccccccaaagggt

SEQ ID NO: 5589 - DNA, 394 bp, Diabrotica virgifera
  misc_feature (8)..(26): n is a, c, g, or t
  misc_feature (82)..(100): n is a, c, g, or t
  misc_feature (108)..(125): n is a, c, g, or t
  misc_feature (217)..(244): n is a, c, g, or t
  misc_feature (346)..(367): n is a, c, g, or t
acaacacnnnnnnnnnnnnnnnnnnnatagaccaatacgtatatattacataagcttaaaaacaagatataatagtatccgnnnnnnnnnnnnnnnnnnnaatgttcnnnnnnnnnnnnnnnnnnttctaatagttattaaggtatcaaagttattatctatcatacccgtggtgccttcaacgtttaatgtccgactaaattattatttacatgcnnnnnnnnnnnnnnnnnnnnnnnnnnnntagttttcaaataagtacatttagttagcaatagtcgtaacgtaattgtggtagcaatagttggaactaaggtgggaattggcaaccttggaattattaagnnnnnnnnnnnnnnnnnnnnnntaaggcgttatttttcaaaattattgg

SEQ ID NO: 5590 - DNA, 352 bp, Diabrotica virgifera
tcgacacaagactctagaaagagtcttaatagatgtgttagtgatggtaaagggcaatatataaaatatgaatttagttgcgctgaaggaacggtttgggatcaagatgcacttgcttgtaattatccttcagcagtaactggcgaatgttcacaatcctctcagtcacaatctaacggtgaccaacaaggatctagtaataataatcaaaatcaacaaggttctggcaaccaaaaccaacagggaaatggtaatcaaaatcaacaaggttctggaaatcaaaaccaacagggtagccatagccaaaaccaacaaaacaatggacaccaaaatcaacaaagatctggtaaca

SEQ ID NO: 5591 - DNA, 156 bp, Diabrotica virgifera
tagtgagtcgtataaacgcagcaaggtactatgagtgttgtggatgctagtaacgtgcagtgctcatgatctcagccatattaaacgtatcgataggcgcttcgcatcgtgtcgttcacttcaggaaagaggcaggggttcttgcatgtgataatt

SEQ ID NO: 5592 - DNA, 306 bp, Diabrotica virgifera
tagtgagtcgtatatactggtcgctccactgttcggaattgtcactttgtcggcggaatcttagaatgactgatgcggaatctaggaatgaccgcggaacgcgcgagtggggcataccacgggaagataccttcagggagggcagccgacaccggggtaacgcgagtacaacacgttcgagctgtatggcctccggaactagagtgtttgtatcagggattccctaggattatcgttggcaagatgttagcgacagtcttctggaatgaggtgggtgatgtttcgttcgtggagctattttacgat

SEQ ID NO: 5593 - DNA, 386 bp, Diabrotica virgifera
  misc_feature (293)..(312): n is a, c, g, or t
cttctactgtggaaccagttcattttctaatattacgcagtcatgttagtttctttccaccaatccatccctttctctccacttttccttgtactataaggcgaagtagatgatatttagatcccctaattatatggccgaaatatttggcatctgcctttgacatctgttcttttcgaattcctctgtggccctggattttacctttttacctttcgtgataagctaggattctgtaggtaatggtctcctctaataacataccctatgtgtgaagtaaataccaattgagnnnnnnnnnnnnnnnnnnnngaatcaatcaatttttcgaagagaaagttcagcctctcacgactctcaccacaaatggactgaaaaaatgaaca

SEQ ID NO: 5594 - DNA, 395 bp, Diabrotica virgifera
  misc_feature (291)..(291): n is a, c, g, or t
aactccctatagagagtcgtattaatacagcttatacagcaataccaggaattcgaaacataggacgtgagaagattcattataaacagcattgattgattctcaaaaattaatctcaacaacagaaatatctttagaacagtaagggaaagatgatgatgcagaagtaaaagacttttagattggtgtttataaagctcattatataactacaagtaatatggtttgaacaggtaagctatgaggtcaccaaatgcatccaatgcagaattgaatgaaggaaaggtttanaaaaaggttgtaaaaggattcaagccagtgttgttgttgattgatgttaaaccatataatatttatactgaaaatttggatccaagtgttgtaaagggtttttt

SEQ ID NO: 5595 - DNA, 156 bp, Diabrotica virgifera
  misc_feature (2)..(2): n is a, c, g, or t
antgcgagtcgcaaccaggtatctgtcagcatggtgtcacccgtccttttgagacagcagcatcagatcacgtggttcttgttggagagtcatacctactcacagttttttatgacagtggccgagctgacctcattataggtgaatcgtaagggt

SEQ ID NO: 5596 - DNA, 214 bp, Diabrotica virgifera
  misc_feature (23)..(23): n is a, c, g, or t
cctatagagagtcgtattagatncaaatctgtcggcatcggcgtagaatcacgattaatatagtgagtattttatagagaggtgaagtcagaatgccacgcaagttcgatcccacagtcgttgggggtgtatacatgagatgtgtcgggggagaggtgggagctacctcttcgttggctcggacagttggtcgcctgggtttgtatccggggaa

SEQ ID NO: 5597 - DNA, 378 bp, Diabrotica virgifera
  misc_feature (347)..(347): n is a, c, g, or t
  misc_feature (352)..(352): n is a, c, g, or t
ggctgtgcaaccaggcattagttacttaaagatcgccaaatagcgatagcatcgctagttgtgagtttttatcgttgctatcaagcatgtcctctcttttgtttaatggttgttgttatcgttaacttaggtggatattttaaggggaacgtagctgtttcctggatttatcagatgctcattaggttttagtgtattatgtatttaacagagtgaaaggcagcttttgatatatgtgttggatgtatacgataatgttttgattgcagtctagattctagttcagcgattttagtttaacacagagacttgtggagacgatgtgaatatttgccaacaacattaanaggangagatataatttttcctctaagtact

SEQ ID NO: 5598 - DNA, 409 bp, Diabrotica virgifera
aacccacgcgtccgttcacccctaaaatgcaaaaagcgcaagttggcactatgtcacctttgttccttgaggtatcctttaaccactcaccaatttttatgaaaatcgatggaggttcaacgaaatctgaggtaataactcatatccaccttcattgactccactatatggttttttcaaaaaactaaaccaaagccttacattctaaactcgataaaatttgtttaccgtttaaaaccttctacgaattatttacaaaaatcctattgatgttcacaaagcgaaataacatgcactttccaatattttcgaaccattgtctgtaaatcctttcaaaaaaacccattaacgatttcaccttccccgaaaaggcactgtttattaactaaattagactctatacaatttt

SEQ ID NO: 5599 - DNA, 106 bp, Diabrotica virgifera
accgaatgggagttcagtcgggggtggagcgtagcgtgttcgggcaggaggagttgtgagtgctgtcagaactgttagccggcggaccattcttctgcggctacga

SEQ ID NO: 5600 - DNA, 257 bp, Diabrotica virgifera
ggaaagcgttgccgacaaactgcgaccataacactgcgatgaatgacgtcataaaaaactgtaccatgcaaactaatagcggtggtttccaaggatgcgttggaagccaccgcttgctgattttgcacattccattgccgcagtgaagaaccttgaatttttcaccgtaatctgaccagcgcttaagcgattgtttcagtcctggacattttcgctttccgggtgaaacaatttatatatatatctgattggtaaaa

SEQ ID NO: 5601 - DNA, 287 bp, Diabrotica virgifera
  misc_feature (13)..(83): n is a, c, g, or t
aagcctctataannnnnnnnnnnnnnnnnnnnnnnnnnnnnnnnnnnnnnnnnnnnnnnnnnnnnnnnnnnnnnnnnnnnnnncggcccaacaggatgatagttgcttaattcctcatggatgcgacatcatacttctacaatatagccaactttaattacatcgccggccgttttttaacatcgtcatggggaaaacccccctgttgtcaaccttaaaagtcttgtagaagaacacccttttttcaccagctgtaatagtaatgaggcggcccccattgttccccc

SEQ ID NO: 5602 - DNA, 221 bp, Diabrotica virgifera
ttccaggaattttttctttaacgatagttactgagaaatgctgagatagtatttcagcttttagaaagggacaaatttgactttttgtacctctgggtctcacggattattaggtggtagttagacatttattattttcgagtttgaaagagctacaagatttacagttttattgtcatgtttctatattagatagcttttttgtgatgatacgttagtcg

SEQ ID NO: 5603 - DNA, 347 bp, Diabrotica virgifera
cccacgcgtccggtcatcttgaggacggtgtggagtgttatactacaaacgcccagtcatctattagaagaaattattttagtggacgattccagtacagatgagtctcttaagggtttgctcgactattatctagaaacaagactggcaaattataagatcaaaatggtacgtctcaaacaccgtctaggactgattcgcgcccgtcttcagggcgccagagtggcccaaggtgacgttttgatcttcctggatgcacattgcgaggcgaccacaagttgggcggaaccaatgctctctaaaatagaagaagacagaacggctgtcctggttcctaacattgatgt

SEQ ID NO: 5604 - DNA, 217 bp, Diabrotica virgifera
ggtgcttgaagatcacgcattatgtagattatctcagcctcgtcgcgaggggccgagagagttcgatggtggagttgtcagtttctacgatgttcacatttcaggattgttattgcacgtggtcggtgtctacacgtactcgtgaggtggataaatgtgatgagtgtcctgcgtgttatcacgaggttgtatatggtctagctatgtaggcataaaa

SEQ ID NO: 5605 - DNA, 85 bp, Diabrotica virgifera
  misc_feature (22)..(22): n is a, c, g, or t
tatagagagtcgtattaaaaantacgactcactacacggagtagtactaacttgaacgactcactattgggtctcgttttaagtt

SEQ ID NO: 5606 - DNA, 352 bp, Diabrotica virgifera
ataaaactaaacctttttagcacaaatggtgtaaaacatagtttcactgtctataacgtttaaatgagtgatacttccaatcgaacttctgagaagacttgatttttcccttgcgacttaaagcattttcacaggaataataaaatgatttttttacacagtatagtcaataacttgcaatcacagtgagttgaataatcggcgattgatttaagactaaccattcatataatacaatagtctatcctacccttaaaacagtgttgccaactcgatgaatatagtaattgccaaacctcacatgaatgatggaatgatcagttcaacagtaggtattccactaacagctaat

SEQ ID NO: 5607 - DNA, 56 bp, Diabrotica virgifera
  misc_feature (11)..(37): n is a, c, g, or t
  misc_feature (40)..(54): n is a, c, g, or t
cgtttaatacnnnnnnnnnnnnnnnnnnnnnnnnnnntgnnnnnnnnnnnnnnntc

SEQ ID NO: 5608 - DNA, 300 bp, Diabrotica virgifera
gtgaatcgtgttactcgtcagcacaacatcgctgttcagtcacaactgcggtttaatagtgatatacgaatgagtttttcttctagtttggtcagctttatcggtgaccatgttgacgagctcatgtcttctactcacagatcggtgaatcatataatagggatggtacatctctgagtttatcattggtgcatacattgctagtatactaagattgtgctaacttaaagtcaccttctagatctaccatgtgataatatgagacactattttttaacaaactgcaactttagcatctac

SEQ ID NO: 5609 - DNA, 382 bp, Diabrotica virgifera
  misc_feature (342)..(342): n is a, c, g, or t
gttgtctacgaaagaatccagtctcctcataacgttggaacactatttgaaccgttgcgcttatcatatatagttgtctagcaacacctcgctggctaaatctattttctattaatgcaataacttggacgactttctctggtatagtatccattattgttataaacatcaaataaacacctttctatgtttatcggttgctacgcgcatacatgattaagcaatcaatgacaaatttatactcctagtaaagcgtaataaattgtcttttaaacagtatatcccttttttgatgcaagtaatcagttttagaaatatatgtagttcaagtcaaaggtttanagtggggcgatttctatgcacgcaagtttagtacatttac

SEQ ID NO: 5610 - DNA, 218 bp, Diabrotica virgifera
atcttctgcaccagtgagtgtagtagcaaactacagtgtgtacgtacgtattgaattaacttacggcaaatttatcacatgaatctaacgatcatagcaccaccaacacgagttccgtagcggtctacgaaggtttggcctgcttcacaggtttagacgctggccagctgacctgtgcaccacatgtgctaggcatcgcaacagattgtctcaacatg

SEQ ID NO: 5611 - DNA, 431 bp, Diabrotica virgifera
  misc_feature (374)..(374): n is a, c, g, or t
taaaaataaaagtgaaagaacttacgtgaaagttaaaaaagaaactactctgcgttcacttctttctattattcaatatctcaccgacaagtgttttagaacaagtactcctcctagggctgaaaccgttgtttcaccaaggaaacgttttcttcgtgaaatggaaaaagataaagttcccggcgatgacaattctcaaaagagaagtcgcagtaaatcgcaagcgaatcaatcgatttccggtgttccacatgcatcgctttctgctccactaattggtagtccagttgtttcaaatggcgtggaggagaccaaacctctccgaaattcaagttacagcattacgtcattactggcagaagatcggaacgtanagagatcacctacgtcatctcctagtcactatccactagcccatccacaatattgtt

SEQ ID NO: 5612 - DNA, 289 bp, Diabrotica virgifera
caatcctctacattgattcgtattatgatgcatgcaacatcttaatatgatcaacttcagccaatacctcgttgagcaatgtagtccagttgatcatcaattgtacactgtttgttgtgttcctgactagcatgaccattgacgtattcaagatgcagttccacaatccactcaactaatcgattctctcaagtaatgattgaaagttgttaagaaggtccacttaaacaatctttaatcaaatgcgggctataccaattaacgtgtgtgctcaagacattttaaatca

SEQ ID NO: 5613 - DNA, 413 bp, Diabrotica virgifera
cccacgcgtccgggaaaaagtgtttagcaacccacctcgtaagctagattttacaatatttatttatctacaagcgatcaataaaatatgaatagttatgctatatatacatacttttgttctttatattattttcatgatctttgtacttatatccaagatattgttcagtctcactccggatgtggatgcaagaagtttagaccatttaaacgattcttaaatgcacataccaaatcaacttactatatcatgtttaggtttcatcatgttcatcatcatcaataacagctgtccattaatttctgttcgtttcttttgcatccgttcggggccaatcaatcgcttgatgtcatcagttcatctgatttcaggtctgtctctacttcttttatttgctcttactcgccatt

SEQ ID NO: 5614 - DNA, 418 bp, Diabrotica virgifera
  misc_feature (385)..(403): n is a, c, g, or t
actaacagtgaaatacagactgaagggaatgagcaagatcaagcaaattgattggggattgcctaagcatcatcggaaatctcctatggcagcctggacttggctttcaatctcctttgatcccaaggacggcattatccgattagatttggactgcgatcccagcagatttgaaacaataaagcagaaaaagcatttgggtaacttcagtgttccttttgactcacttgtttattttggacaagaaccaggacgaaagaaaaagtttttgggatctatccaggttgcaaaagtcctgccgtacattttggaacagaggctatggtcctgcgtgcagatagccacaaatctttctccagagtttagaaaaccagtatcctaaatnnnnnnnnnnnnnnnnnnntattaaattcacaat

SEQ ID NO: 5615 - DNA, 281 bp, Diabrotica virgifera
caagcgtccaccatgagtcaaatacttactcgatggattgaacaagatcatccaagctaaatgaggttttgcttttttacgtacgtttactactaccgctgacgcctctaggtttgagtctgtattgatcgtagtgacactattgacgattcagagctcggcagcgatcactactagatctgaattcgttgttcagtattagcatttccgctagtagagcgtcccatggggattgctagagcatgtcgctgggagcctagcatcagtggtggtccttatgc

SEQ ID NO: 5616 - DNA, 211 bp, Diabrotica virgifera
cagaatatcacaactttataggcaaatcaaatggttcccgaggtgaagaaaggaattcttgcacatgacgatgattctcgggcagccttagctactgctggcttggctgaacagaattcgcatgatcctgaagtgcgtcttaaagacagcttggtgtactgtctgggtcattccagggaataattgtgatgtaaagatttatttccggtta

SEQ ID NO: 5617 - DNA, 351 bp, Diabrotica virgifera
  misc_feature (9)..(27): n is a, c, g, or t
  misc_feature (29)..(29): n is a, c, g, or t
acaacaccnnnnnnnnnnnnnnnnnnncncgtcaggttatagcaagagtcaatatatcttttatggatggacattgagatagttggtgtaacattccatcctaatatgaggcgaccagacatcgaattattgatcattgtatgacaaggacaaatacctgcttgttaaatatttaggattggccatcctatttttccgtttgccattccagctttaattgcgatctgctacttattctacgcattgcattgtatatgcagctgtctgtccatttggagactatataccacgttccataggtagtagggattagtattataatctatgtgcagcagatgttacaatcatacc

SEQ ID NO: 5618 - DNA, 108 bp, Diabrotica virgifera
cacaagcgtctacagtgagtcgtattaacaagtcacagcacatagcattttatacctgtgagtaagtcgtaagtcactcgttctggcaacaggtatgattgttatagt

SEQ ID NO: 5619 - DNA, 389 bp, Diabrotica virgifera
  misc_feature (94)..(111): n is a, c, g, or t
  misc_feature (144)..(177): n is a, c, g, or t
  misc_feature (242)..(259): n is a, c, g, or t
aaataaaagtgacaatatttttataaacaccctgcattttgtatacaattcttctaacatattttgccatgtactatttatttgcagtggaatnnnnnnnnnnnnnnnnnnatttagtaaattccaaggattgtccctaaaacnnnnnnnnnnnnnnnnnnnnnnnnnnnnnnnnnntataaatgatcattttaaggatgtttatcgttaatacgcttcttacaactgtgtccattccagcnnnnnnnnnnnnnnnnnnggataaagtaatgctcaactaagattacctattttttacatacatgatatgtgtatctatgtggaaagattagtgatgaaacgtaaagcattttatacttattgttgaagatattttgtacatatattta

SEQ ID NO: 5620 - DNA, 417 bp, Diabrotica virgifera
  misc_feature (18)..(38): n is a, c, g, or t
  misc_feature (68)..(90): n is a, c, g, or t
gatacaagactctaaaannnnnnnnnnnnnnnnnnnnngttgacaatagttgacattgacatttagannnnnnnnnnnnnnnnnnnnnnnagattaaaaatggacaattctttgggatgttaaagtttatcaatctaaaatcttgtacttttaaattttaaactttcagtttagtctctttcgtataccattctttcctctacgaaagatgcagctgtatttacaaactgactctattttataatcaacaaaaaacgacataaactatttttctttgatcaacaagtctggaaaacaaatctatacttacctttaatatattttccaaaatgaatcaaaataaaattattaagtattcaccataaatgatgcccagcatttttaatcagtgccatccaattgccaatacaactgaac

SEQ ID NO: 5621 - DNA, 144 bp, Diabrotica virgifera
tcctcttaagccttagcgctgacaattcctgggattcacatttacaatgtgccacacatttttgcattgagatcgtcaatggacacattcattgggatgttatggttaatcaatctaaactcttgtgcttttaaagtttattca

SEQ ID NO: 5622 - DNA, 214 bp, Diabrotica virgifera
tccgaatcgacccacgcctccgattttttagaattatatttatgtaaataccaaattaatttacttggggtaataaacaagcaaatttaacttttctaaaccaattcaaattactgaacattttctgaatcgactcatggcgattgaagaagtatgtcacgtgcgggatcgaaccttcgtctaattgcagagtccaaacctctaataagaattc

SEQ ID NO: 5623 - DNA, 406 bp, Diabrotica virgifera
  misc_feature (28)..(41): n is a, c, g, or t
  misc_feature (43)..(62): n is a, c, g, or t
  misc_feature (192)..(222): n is a, c, g, or t
  misc_feature (316)..(335): n is a, c, g, or t
ccacgcttcgaaatttttggcggtcaannnnnnnnnnnnnngnnnnnnnnnnnnnnnnnnnnttacaccaattacaaaataacttcaaattcacggaacaaaggctccaacccaaactttatttaaatacattgtcttatttatgttacaattaatctcgccaacatggcggattgattttgatattgtgtnnnnnnnnnnnnnnnnnnnnnnnnnnnnnnnggtgtgttttttacgaatgttactatgtgaatgtgtaagttaggttagtttttcaagtcatcggtcgtagagttttcgtattacattccgcggnnnnnnnnnnnnnnnnnnnnctgcttttctcatttattgttccctcttatcgtgtgcctatgtatcgccagtgtataagaatagtgacgct

SEQ ID NO: 5624 - DNA, 353 bp, Diabrotica virgifera
  misc_feature (9)..(41): n is a, c, g, or t
agtgaagtnnnnnnnnnnnnnnnnnnnnnnnnnnnnnnnnnggatgggaatctacaccggcatgtgatcactcatacatcatagaacagtaatagctaaccataacaaaatatatctaagatagtcgtcatatcggaatttcaatgatatcaagctgtttccacccacgtggacatagagcgtgcgctatctggtacaaagatgactattattaaaatagtatagacagttgatattgtgtacactgtctaatgcatccatgttatatctagtcggctttatatagtctcctgatggctcaatggattaaccccctatttgagctcagcaacgcactgaacattgctacaagc

SEQ ID NO: 5625 - DNA, 423 bp, Diabrotica virgifera
cacgcgtccaaataacattaattattgtgatattctttactggtactgggagtattcctttagaacaaagtgatcacactaatcagagtaatcacattatcacaaataaagatggctgtttatcatgtaagataccgaacaacacaccagagcctccttcttgtggaccatgccaaagcttagtgtttaataagtgtaaaaacacatttaataaacaatgtccacgtaatccccctgcccgtcaggccaattaacgtacgacgatatacgcctactatgattacaaagatggaggaaatactagtgaatattacttattagatagtaatttagtccttgagttaaactagtcagataaatataccacaaataagaaaatatctaatgtaactccaacttttgctataagtttattcctataac

SEQ ID NO: 5626 - DNA, 426 bp, Diabrotica virgifera
tttgaaaatcaaccccaaggtcattataaccaacaaccaacccctatttctggattttaccaccaaaacggacaatatcaacccgctggacaataccaacaaactggacaataccaacaaactggacagtaccaacaacctggacagtaccaacaacctggacagtatcatcaatctggtcaaattaaacaagttcaacaaccaggaccccttcaacaaggtcaatattatcaatcatctaaatcgcaatcttctggtcagcaccaacaacctggtcaataccaaccaactgatcaataccaacaaactggtcaataccaacaaccaggtcaacaagtttctgttcagcaattaaccaatcctaatcaaatcgattacactggagcatacagtgaaaagcaaaactcttacgcaaacccaactcca

SEQ ID NO: 5627 - DNA, 239 bp, Diabrotica virgifera
  misc_feature (15)..(49): n is a, c, g, or t
aatccggtcaatatnnnnnnnnnnnnnnnnnnnnnnnnnnnnnnnnnnnaaagggctccccgcttgtcccaagaatcatgtcataattacaccggtaatagacgtgaattcatcgctatgctgatatatctccagatcatgtcatcagggagacaaggcagtattagtatctattcgtgagtgaagagatacttttcagaaatgagctgatacagatatgttaagggaatacctgttta

SEQ ID NO: 5628 - DNA, 375 bp, Diabrotica virgifera
aaaccaacttgcacttgccgatgttcagagttggtaaggagtggtcgtatagttttaagaagtatttttaaaagtattacagtgaacaaaatgtctgatgtgtatatagttgcggcctgtaggactcctatagggagctttcaaggacagtttgaaaaacattctgccgttgacctaggtgctgttgtgattgcagaagctattaagcgagcaaatcttcaaccagaagatgtacacaaagttatcatggggcaggttttaactgctggtcaaggtcagaaccccgcaagacaagctgcattggccgcgaaaattcccacaacttgccccgcgcttaagttagattttctttgcggatcaggacttagcactgtt

SEQ ID NO: 5629 - DNA, 406 bp, Diabrotica virgifera
  misc_feature (220)..(247): n is a, c, g, or t
aggatgactataactgtttggtgacagttacaataggtcagaaataccctataaaaaaacctacggtattacggtcatcattgtattgcccggaatcaaaagcatgcagtacaatcttaccaaatatccctaaaaaccccacgttgaagccgaaagttaatgtggaacatttaatagagttcttgcacgacgccgttctaatgttcaagaatcatagacnnnnnnnnnnnnnnnnnnnnnnnnnnnngtatactgtgctgttcgaatgaatagacaaataaaaaacaagtttttataaccttagcttttaatacgtaccataagtagactgaacaatctatatattagtacgaaatttgtcctcgtttagcagaagtgaccttacacatctaggcattccctctcc

SEQ ID NO: 5630 - DNA, 267 bp, Diabrotica virgifera
  misc_feature (36)..(81): n is a, c, g, or t
  misc_feature (100)..(132): n is a, c, g, or t
  misc_feature (148)..(169): n is a, c, g, or t
  misc_feature (171)..(198): n is a, c, g, or t
  misc_feature (215)..(228): n is a, c, g, or t
  misc_feature (230)..(266): n is a, c, g, or t
ttaaggaaaaatttaattaatggaaatttaataagnnnnnnnnnnnnnnnnnnnnnnnnnnnnnnnnnnnnnnnnnnnnnnggaacctggggaaccaggnnnnnnnnnnnnnnnnnnnnnnnnnnnnnnnnnccgaatttaaaaaacnnnnnnnnnnnnnnnnnnnnnngnnnnnnnnnnnnnnnnnnnnnnnnnnnngtaaggaaatgtaatcnnnnnnnnnnnnnncnnnnnnnnnnnnnnnnnnnnnnnnnnnnnnnnnnnnng

SEQ ID NO: 5631 - DNA, 424 bp, Diabrotica virgifera
  misc_feature (14)..(47): n is a, c, g, or t
  misc_feature (50)..(69): n is a, c, g, or t
  misc_feature (92)..(129): n is a, c, g, or t
  misc_feature (148)..(180): n is a, c, g, or t
  misc_feature (183)..(245): n is a, c, g, or t
  misc_feature (292)..(312): n is a, c, g, or t
  misc_feature (317)..(345): n is a, c, g, or t
  misc_feature (347)..(414): n is a, c, g, or t
tgacaagcgttcgnnnnnnnnnnnnnnnnnnnnnnnnnnnnnnnnnngtnnnnnnnnnnnnnnnnnnnnggaaggtaaataataatgggagnnnnnnnnnnnnnnnnnnnnnnnnnnnnnnnnnnnnnnggaacctggggaaccaggnnnnnnnnnnnnnnnnnnnnnnnnnnnnnnnnnccnnnnnnnnnnnnnnnnnnnnnnnnnnnnnnnnnnnnnnnnnnnnnnnnnnnnnnnnnnnnnnngtaatgaaatggtattcgttttaaaaaataccaaattttttaggagnnnnnnnnnnnnnnnnnnnnngcagnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnggagtaaaaa

SEQ ID NO: 5632 - DNA, 354 bp, Diabrotica virgifera
  misc_feature (320)..(347): n is a, c, g, or t
ctaaccttagccagaagcatttcagttaggaaaattccccaatagactcccaaattactacgggaacaaaataataactttccaaataagttaattgtaaaacttgaaggtgaacccggttaccaatgccatttcaatattaaacggccaaatgatcttggactagaaaatggtaatggatgctattcagatggtcataatattgttatatgtaaacttggaaccaagctggataatctaactagatcgatcagcgttaattttgataagctccctagtccaaatctgaattattcgaccttggacatcatatttgagtnnnnnnnnnnnnnnnnnnnnnnnnnnnnatcagat

SEQ ID NO: 5633 - DNA, 302 bp, Diabrotica virgifera
  misc_feature (279)..(299): n is a, c, g, or t
ttgccaaaaccggtccaaccttcaccaataacaacctggttgataaccggacgggcaacttcttggaaaaccattaccatggccaacggaacttacctggaaaagcccccaatttacaaaggatgatggaaaaacacggaccccttggcaaatggctctaacacaagaacctcaaaggagcctcctcataatttcattaaagttgtaaatatttttagtgcagttttcggtttgacgtccgtgaaactgtgttacgtgatatagtgatagttcctatcnnnnnnnnnnnnnnnnnnnnngta

SEQ ID NO: 5634 - DNA, 399 bp, Diabrotica virgifera
gtccgcccactcgtcaggttcacccagcattcagtatatcaatcgtcgatggacattgtgcaatgttggtatatccttccgtcggaatctacgtgagcatacaacgcatgattgatcttcaaaggatgtcaccatacacctgcatggttataattaatgcatggacgtcctgtttttctgtttgctatccagctgtatatccgatctgctacttaatctactctgtcagatctaccgctatctgttcattggtgacgataaccacaagcaacatgtacagatagtacttcttaaagtgctgccatggatcactctgtccaagcattatcgatgattactatgtgcatctacaccataatggcagagcttatctgtacatttcttcaggaaagatctgtg

SEQ ID NO: 5635 - DNA, 195 bp, Diabrotica virgifera
gaaatccccagaatactctgagtaaggagacatattggaaagtgccagtgagtggattggcagattaacaaatgtagttgtctgattttactcgcctttttatatgattatgcagttaccaaattgtgcttttagtgattttactgattttacaaggtgatacggtcgagacatgtaccgcctttttaagcggcg

SEQ ID NO: 5636 - DNA, 300 bp, Diabrotica virgifera
  misc_feature (9)..(85): n is a, c, g, or t
  misc_feature (87)..(253): n is a, c, g, or t
  misc_feature (261)..(261): n is a, c, g, or t
  misc_feature (267)..(267): n is a, c, g, or t
  misc_feature (280)..(280): n is a, c, g, or t
  misc_feature (285)..(285): n is a, c, g, or t
ggatgaacnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaactgtntattanaaacatgtctttntgtantaaatataaagtctc

SEQ ID NO: 5637 - DNA, 400 bp, Diabrotica virgifera
  misc_feature (34)..(34): n is a, c, g, or t
cgcgtctacattgcagaaggtcttattgaaccangatccaatggtacgactattataagaactggatggtggattaaggaaataaagcaagctgtaaaaaggaagaaagaaatgtggaagcgatacataaacacaaatcaagagcaagacagagacgaatacagaagacagagaaatatagtgaaagaactagtaaaagatgcgaagaagaagagctggaaggaattaggtgaagaattaaacgaaggttttgggaataacaataaacagttttggaataaaataagaagcatgaaaggaacaaaaaggaaacaaataagaggaattagaaatgagcgaaatgaattgaaaacaaacatacaagacatactaaccatatggaataagcactattaagaaa

SEQ ID NO: 5638 - DNA, 425 bp, Diabrotica virgifera
  misc_feature (183)..(202): n is a, c, g, or t
  misc_feature (296)..(316): n is a, c, g, or t
acggacgcgtgggtttcaattgccgtcatattagatacgctattttgtttttatttcaaaaagaagttgtatttatgtaatcaacaatttcaaaaatctcgtatatgtattatgaaatttcaaaaaaaatgtggctttaagataatataatttctttccgccatattgaattcgcaattttgnnnnnnnnnnnnnnnnnnnngctatgtttataatcagcgtccttaaaactctttaacatcaaatttcgaaaaaatattgcgtattgattaatattttcaatttctttccgccannnnnnnnnnnnnnnnnnnnncagatttgtaatcagctattttagaaataccttaaatcactaaatttggaaaaaatacagcgttttgattgatatttttaatttctttatgtcatgttggatccgccac

SEQ ID NO: 5639 - DNA, 390 bp, Diabrotica virgifera
acagtcgttagtagaatatagtgatttcgtcagctatgttcaagatgacaatgttaacaaacttgttaaaaattacactatgcgtcaaggggtacgcccaaaaatttccatctggtcctccgttttcctggccaagttggacaaccggctggtgacaagccagttgaataatcccccaaaccggtaactttggagaaaaattgggtaaacttccgggaacatgctgtccaaggtgtgttccgaatgactggtcagttaaattgtattacagtcaggtgtgattttccggcttgtcagataggcactgtatcacagaaagtgtattgtaagtgttgtccacagtgtgtgcctattcgttcaagttgaagaagatgctgctatgagtattag

SEQ ID NO: 5640 - DNA, 205 bp, Diabrotica virgifera
  misc_feature (33)..(52): n is a, c, g, or t
  misc_feature (171)..(191): n is a, c, g, or t
gtccggccacgcgtccggccaagcgtccgcccnnnnnnnnnnnnnnnnnnnnggccttagaaatctggacagtttttaaaagtcgttcaaacgacttttttaagccgtaaacaattttggaaataatacaaaattagtggtatcctagtaaccaattcccaagggagcctnnnnnnnnnnnnnnnnnnnnntggggtttaacaac

SEQ ID NO: 5641 - DNA, 429 bp, Diabrotica virgifera
  misc_feature (283)..(297): n is a, c, g, or t
atcttgaaccacgtttctgatgtggatggagcagagtttcccaatgaaaacgaatctcctgttagacccccaaggcgcaaaaataaatcgaaggtgtctttttcatctgaaactaaaaccggaaaaacaacatccaacaacaaaataaacttcgacccgaactcttttacttgtgcactacaaaacatcctaaatttctccatacccgaggacgattcttgggacttggactccgattcggaaatgagtgaatatgaagaagataactatgtcaaagatcaannnnnnnnnnnnnnnaaagataaaaataggctgcaaaaatatatggaagaaatggaccgcgaattagaaggaactactattggacaaagttttgagaagaagaacggagataatttcgaagatatagagaatttcaagccggtcgag

SEQ ID NO: 5642 - DNA, 372 bp, Diabrotica virgifera
  misc_feature (31)..(78): n is a, c, g, or t
  misc_feature (307)..(335): n is a, c, g, or t
gagccaagcgtctaaagagagtcgtataatnnnnnnnnnnnnnnnnnnnnnnnnnnnnnnnnnnnnnnnnnnnnnnnngatttgaacttgaagtataaaccaaaatattttaagactaacggaactaattgaaaattcaattgacaatgataagagatttatttccttctttcgaccctacatctaatttgaatttaccagtaaactgattaagaacagtagtaggtcgattaattattccagcgagattttgattaatcccctctcgttaaaattatttatgagtaaagattattagaacattacnnnnnnnnnnnnnnnnnnnnnnnnnnnnntagaaatcccagggaagaacattactttttatctcac

SEQ ID NO: 5643 - DNA, 394 bp, Diabrotica virgifera
  misc_feature (2)..(24): n is a, c, g, or t
  misc_feature (49)..(90): n is a, c, g, or t
  misc_feature (121)..(146): n is a, c, g, or t
  misc_feature (160)..(183): n is a, c, g, or t
  misc_feature (191)..(244): n is a, c, g, or t
  misc_feature (258)..(258): n is a, c, g, or t
  misc_feature (264)..(349): n is a, c, g, or t
  misc_feature (351)..(393): n is a, c, g, or t
gnnnnnnnnnnnnnnnnnnnnnnnatagttaaatagtaatgtgagaagnnnnnnnnnnnnnnnnnnnnnnnnnnnnnnnnnnnnnnnnnncccttgtggtatcaggggattaattaaattnnnnnnnnnnnnnnnnnnnnnnnnnncaatttaaaaagannnnnnnnnnnnnnnnnnnnnnnnggtaaatnnnnnnnnnnnnnnnnnnnnnnnnnnnnnnnnnnnnnnnnnnnnnnnnnnnnnncaattttttaaganataaannnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnng

SEQ ID NO: 5644 - DNA, 61 bp, Diabrotica virgifera
aagggggtaaagtttttcaccattcagattgaaaggggtattcaaattactgcagcaatat

SEQ ID NO: 5645 - DNA, 336 bp, Diabrotica virgifera
attacgcgccaatctgaacgtctgtcgataatctgttctcaattgtcggtgcttaagttagtaccacatcatggagtatgcgtgaatgtacctcagtcaatgtgggtcaatctggagtcctcaacgtgtgtgcctgctgggacttgtactgtctggaacattgcaactagtctgaccgtcagaagcgaacacacactaatgttcaaagacgatatgacagtatcgtcagatgctgcaatgacactggtaccagattccacattcctacagcagtatgtgtacatgtggaaccaacagtattagatgaagtaggtaccggcatataccatcaattgt

SEQ ID NO: 5646 - DNA, 55 bp, Diabrotica virgifera
  misc_feature (9)..(28): n is a, c, g, or t
tactacacnnnnnnnnnnnnnnnnnnnntggcagatgtaacatctgttcacgaac

SEQ ID NO: 5647 - DNA, 261 bp, Diabrotica virgifera
aggaagagttcaccaagtagaacttcttagaacctttaactgcagaatcagaggagttttggttgttaagccagaagatgccgatgctgtttggaatttgatcaagaacgaacgtgctacgattgtacgaaaagttgtcagaaacgaaaaagatcaagtgatagttcacaacttctctgaagtgatggaagctgcaatgagaaaatacgtcccaagcgtcgttgagaatacacctagtttgaacaaaaggtaagagtttta

SEQ ID NO: 5648 - DNA, 418 bp, Diabrotica virgifera
atttgctacaagtacacagtcaatcaaaaatgggggctatgtattaattgtggtttactgatgtaaagatgtggttagaggatcgatataagtcttgcattaaaaataatttagcattgaaataatgacataatattacaaaattcccatatgaaaaatatgcaagaggtagaaaaacaaaagaaaaggaaaccgaatactcaaactgtaagaaagtatcatggactctgctttactcgagaacaaaaattggttgcaacagtatggtatcatgaaagatcttatacaggaatatcttttgaccaactctgccaaaattttcttactcgattccatgtgcaatatccagctattaggaccctacatcgatgggagaaaagactatttaaagaagaaggtgatattgaaaagagaaaaa

SEQ ID NO: 5649 - DNA, 247 bp, Diabrotica virgifera
tgagtcgtattagttgtgtatcgcggtggggatgcacctacgaaggtggacaatacaagagtacctagagactatgatttgggatatggagtactcatattctctaagtgtagaatgttccactcaaatgcattatacaggattcggtgggaagaaagtatacactacgatgaaacctcaaaaggcccagattcttgtaaaaccaattgtgggacataaaaatggccgaactatatttgttttgggc

SEQ ID NO: 5650 - DNA, 400 bp, Diabrotica virgifera
  misc_feature (29)..(46): n is a, c, g, or t
  misc_feature (138)..(138): n is a, c, g, or t
accatattttgttgctgtagtcggcaagnnnnnnnnnnnnnnnnnntgtaaatcatacataaagtatattatttacattaagaattttgttcccgccgttaattaaatattgaaataaaatggcagtgggttcaacanaagtcgtccaagtgacgaatatagctccccaagctacaaaagataagatgcagatattatttggatacttgggtaaaatagaagatattcgtttatatcctactatcagagatgtttcctgtcctgttcagtcacgtatttgttacatcaaatttgttgatagtacaactgtaggaattgctcaacatatgacaaacactgtttttatagacagagctttgattgtgattcctatatcaagtggagaaattccagatgaata

SEQ ID NO: 5651 - DNA, 256 bp, Diabrotica virgifera
  misc_feature (190)..(203): n is a, c, g, or t
  misc_feature (205)..(217): n is a, c, g, or t
tgagtcgtatgtagtcagatgctcgctggggatgcagcagcgaacgtaggtaatccaagtatacgtagaaactatggtttgggaaatggagtactcaaattctctaggtctaaggtgttccacaagaaaacattatacaaattcgtgtggtaagtaagtagaagctaccaagaaagctcaagagccccannnnnnnnnnnnnncnnnnnnnnnnnnnaaaaatagaggaaagagatttggtttgggcaacaaacgt

SEQ ID NO: 5652 - DNA, 408 bp, Diabrotica virgifera
ataaaatgaccattaatagcagtgaatacaaatctccttcaatatgggagttttggagagcaagaagatacgtagtgacgtttatgctctttctgggatttttcaacacctactgtctacgagttaacctcagcgttgctattgtagctatgactcagtattacaatgtcacattggcaaatggtactactattgtgacacgagattttgactgggataccaaaatacagggttatctcttgagttcctttttttatggctatatatttactcagtttattggagcatatatgggtatcaggttcggaggaaaaattgtttttgctgtaggactcggcatggcatccattttgaccattcttacaccagtagctgcatatataaatgtttggctcctgttacctgtaa

SEQ ID NO: 5653 - DNA, 397 bp, Diabrotica virgifera
tccaaccctctaaaattagtcgtattaacccggatacggtcaacaacaaggaaattacccacctgaagcttatcctccaggaacctaccccaactggcgttaaatcctgtgttaaatatggcttcaagtccagcatataccactgcacaacgtgaataacagatcttgtatcgattataaaaaagatagacctcggttatatccaacagaaactataaatactcgatttttggtcgcgactgttatgcattacatttttgtacggacactgtagtagttgttgaaaaagagttttctctcttagtactagtattagaaattggcagtgctggtatacataatatttttaaaggtcttctgattctagaaaagcatttataagttttagtttttatat

SEQ ID NO: 5654 - DNA, 389 bp, Diabrotica virgifera
  misc_feature (186)..(186): n is a, c, g, or t
  misc_feature (346)..(347): n is a, c, g, or t
acaacaaaatggcttttaagtttcgtagttttgaccactcggctcgctgtcgcccaggcaggccttattggggcacccttaccaactccacgggaagcgcccgttcttcaatcatgcacccatatcttatgcagctcctgcgaatttcttacggcgctcaactggctcctgctattgctaaagtanctgttgctgctccagtcgccaaggctgttgttgctgaggaatacgatcccaacccacagtactctttcggataccaagtggaagatgccttgaccggagacagtaagagtcaaagtgaaaccagaaacggagatatcgtacaaaggatctactcattggnnaatcctgatggcacccgtcgtaccgtcgagtacactgctgat

SEQ ID NO: 5655 - DNA, 366 bp, Diabrotica virgifera
  misc_feature (114)..(131): n is a, c, g, or t
  misc_feature (133)..(145): n is a, c, g, or t
actcatttgtttggaaaaacgtcggtaaagtagatttattgttcgagtgtgctaccaaaaattatttccacactttttgggtctttgtctatcgaatgttgagacagtaaatannnnnnnnnnnnnnnnnncnnnnnnnnnnnnntgtttgatgtgtttttaaaaagccaagtgtttgtttggaattttttggataaagtcagatttggatagtttattaaagtaattccaattagtaagtaattgtcatacaaaatgggtggcaagcagtcaaagaagtcagtagatattacaaataccccaacaaaatgagaaattgaagctgtaggtgaaggaagaaggaccagtagttaagattggtgatgc

SEQ ID NO: 5656 - DNA, 306 bp, Diabrotica virgifera
  misc_feature (95)..(120): n is a, c, g, or t
cgaacatcagtctcctccactcccgatcctcaagacagaccagctgccgtttgttattacgttacgacagatgttacttttgcgaaccacgcgannnnnnnnnnnnnnnnnnnnnnnnnngtacaagaggggacgattcggtacgttttcatattttaagcacaatttggttgacgtttctgctttggttactttttggggctgtcagtcagttgaatttgttgcagtttttgctgaactttttgcgtgttgcagtttctttagacacaaacagttgtgttcagatttaattttagattgggcatt

SEQ ID NO: 5657 - DNA, 228 bp, Diabrotica virgifera
  misc_feature (95)..(114): n is a, c, g, or t
gtttgggggtcaggtctcatggctcgggagctcttgtaacaggtcatacttatatatgtactagtttcgaatttcatttacatgcagcattaaannnnnnnnnnnnnnnnnnnntcgatgatgccacgcatgggacgtcatgcaacactcttgttgtgatatatccgggatttctgattagaggagaagtaccatatttaattaccaagtatattcccaaattaaaat

SEQ ID NO: 5658 - DNA, 269 bp, Diabrotica virgifera
acttttgtgaagtgtgtaccctttggttcgaggggtcaaattctcaagatccgaataaaagccaccagggttgacgcagcaattttggacaaacttgaaagtggactcgcgaatattaaagattcgacatcgatctggcacatacagtaacagcttacgcaaaaaatctacgacaaccactaaatgaacaaaacccccactttcggttgcacaattcaagatgtcaacaacactggcttagaacatcacgactccggcgtacgtatcta

SEQ ID NO: 5659 - DNA, 367 bp, Diabrotica virgifera
gggtcgagcacgcgtccgaccagaaaccgtcaatgggggaaactttttccaataatgggtcggaacaatggggaccaaacaagactttaattccacaaacgaatccaaactggtaagtgccataagacttcccaactaaggtacgaccttaagagaaaaatggaaatacctaactttaagagggtggggaagaacaaggtaatttaatgggtacaaatttttttttacaagcctgggaaaaccaagaaaaggtttttaaggaatttggcccaacatggaacggttcgttaatggcgaaaaccgaaagaccccgaaaaactccaaaaccattaatttaaatagctaacaggggtaaaaaccaaggaaa

SEQ ID NO: 5660 - DNA, 215 bp, Diabrotica virgifera
  misc_feature (36)..(73): n is a, c, g, or t
  misc_feature (121)..(156): n is a, c, g, or t
  misc_feature (161)..(208): n is a, c, g, or t
tacggtcttagattcccgggtcaaccaagccttcgnnnnnnnnnnnnnnnnnnnnnnnnnnnnnnnnnnnnnntaagaaaaaatttaattaaatgaaagttaaataagtaatgtgaagagnnnnnnnnnnnnnnnnnnnnnnnnnnnnnnnnnnnnggtannnnnnnnnnnnnnnnnnnnnnnnnnnnnnnnnnnnnnnnnnnnnnnngaaattt

SEQ ID NO: 5661 - DNA, 409 bp, Diabrotica virgifera
  misc_feature (304)..(316): n is a, c, g, or t
  misc_feature (318)..(333): n is a, c, g, or t
gcaaaagactaagttttcaatctaatagcacataaaacaacaccaaaatatgctgttccacatcctaccagactgaaaacaatgggaaccttctctggtaacacctacgaggcttctacaatttgcaagccataacggatgctgagactaaggaagatgagggaatctcatctgagagaaaggtcatgaagaagatatatgtacatgaagaagttgtaagtaaagtaaaactgtaaatattgcagaggctttttgcagtttgagcggcgtaatgccacggttaaattttgttgattaaactacnnnnnnnnnnnnncnnnnnnnnnnnnnnnnactacatacccttatctgttcttatagttattgtgcacacattacaattaaatcggtgttataaataatgttaaaa

SEQ ID NO: 5662 - DNA, 395 bp, Diabrotica virgifera
  misc_feature (2)..(28): n is a, c, g, or t
annnnnnnnnnnnnnnnnnnnnnnnnnnaaacatccattttcttagggccggttattcgagcactaatcagaaatgatcattgtcaagtttttaattgctgtggctagctgtcagtgtcaacttttgtttgggtttctgaaaacataattatggattacaattatgaaattagttaatcaattatgttaataattatgttaattgattaactaatccataattataatcaattatgttttcagcaacccaatcaaggttgacattgacagttggtgacagtaattaagtatttgatggtgatcattgttgattagcgttctaacaaccggccctatgtgtcctacatttatgattagtatatttctttctgcttccgttttttttactgttttta

SEQ ID NO: 5663 - DNA, 318 bp, Diabrotica virgifera
gttttccatctgtcatataaattcaaaccattgtagacataacaagcatgttaattatatgttaatgccgatggatgttggcaaattgatcgagttgttccggtgaaagaactatcaaatttctggaaactagattcgactgttccaagtttaacaatgcaatccacacacctgtcatacataatacgcggaattgctgaagtagaaccctagataatgtatcagttaacatgccaacatagttatacacacaatatatctgacagtcgttatcatccaaacgctctatccatgatatgcccacataagttatgaaaa

SEQ ID NO: 5664 - DNA, 229 bp, Diabrotica virgifera
tgagtcgtattagattattcgatccattaataaatacgaacacagcttgagctactgcgttcatcattgtatacgataataattcaagtaacataattatatagtggggtacataatagtcactggatagtggaatatgaaggtgtaaacacgatgtatactttaaacgaaacccttatggccgaattgtatcatagatttcaacgtcggtacaagatttcatgtattt

SEQ ID NO: 5665 - DNA, 380 bp, Diabrotica virgifera
  misc_feature (14)..(14): n is a, c, g, or t
cgtcgatataatanaatatgaaaatggttaacatttcagtaagataaaagtaaagctatttgatgggacaaaaaacaataattaccttcaataatacaaattgccaaaaacaaaacaactgttttgattgtacaaaagggttattcagttctcggtattgatcagtttaataaaatgtattgtaaaaagtattcaaataatatacgaaagtataatacagtgagaaataattacatactaataaacagtcctaatctcatgtacttatctgataaagaaatttattggaagcattttagcgatatagtaaagatgatgattgcaagaaacagagttaatgaaaaatgtgctcgctaacatccattggtggatttgcatct

SEQ ID NO: 5666 - DNA, 348 bp, Diabrotica virgifera
  misc_feature (274)..(297): n is a, c, g, or t
cgagatgccagggatcatgaaggctttcatcgtactatccatcttttgcgtcgccgctttggcctcccaagacacctgttataatgacgcagttaccgcatgtgatccagctgctgcgaggagtgttgacaagttgaataattgtaatgcaaaattcggaggtatagattcagctcaatcggatcttcaaaaattcgtaaaccacaacttcatcagatcctttgaatacctgcttctggctaccaacttcgacaactaccaaagaaatcgcaannnnnnnnnnnnnnnnnnnnnnnntttgtctgataaaaaatggaatgatggtattgaattcatcaagtaccttac

SEQ ID NO: 5667 - DNA, 142 bp, Diabrotica virgifera
  misc_feature (47)..(47): n is a, c, g, or t
  misc_feature (54)..(54): n is a, c, g, or t
ttagaaatagagaacaagaattaagttataatcttacgttaaagtanataatanaaacagtaattataataaaacaaatacttatagtaaagaatataaacaaatatgaagtgtcatcaccgcaactgtcaaataaatgtga

SEQ ID NO: 5668 - DNA, 222 bp, Diabrotica virgifera
ggatgcacgagacgaggtgcacaggggagagaaaggcagagactgcgatttgtgaagtggagtactcatattctctagggggagggatgttccagaggagaagcattatattgggtcgggtggatgagagtagcgaggtgaacgacacgtcataagctcgaggttattgatcgaccaattggtggagagcagaatggaggaggggaatttggtgtgggcatg

SEQ ID NO: 5669 - DNA, 403 bp, Diabrotica virgifera
atgcaaaatttcagtgatattgtactcattttttaaataacttatttatacaaattccagttatcttagcaagccgaaccatccaaactgaatttccttaatttaaatgcatgattgtttatgtccatctacaccgactgctgaaagaagaaagccaataactactagttcaaagaatacaagttgttttacaacaagtgataacaactgtaataataattgcagcagatgtgatatattatataactgtaccaattttccagataaatccatatctcattatacaactgcaacgggtgaagattgttcttgtccaaattgtgtctgctcagaaatggaaatacagaatcaaacgtgtgactgggtaacttgtgtttgttcggtttggtttgaaaatgggaaa

SEQ ID NO: 5670 - DNA, 412 bp, Diabrotica virgifera
  misc_feature (24)..(42): n is a, c, g, or t
gtcgcgtgtttcgttgcaagtgtnnnnnnnnnnnnnnnnnnnttctattctattctattctattctattctattctattctattctattctattctattctattctattctattctattctattctattctattctattctattctattctattctattctattctattctattctattctattttattctattctattctattctattttattctattctattctattctattctattctattctattctattctattctattctattctattctattctattctattctattctattctattctattctattctattctattctattctattctattctgttgtagttctgttgtattatattctattgtagatgtaatctaatagttcgggttaaggctttcttatgat

SEQ ID NO: 5671 - DNA, 350 bp, Diabrotica virgifera
gtcacacatcagtaaaattgtaaatttgtcatggcgctgattgcaatcagtagggataattttgtcacacagctttataggaagttcgaagattacgtacaagtgaacagtgagtaattattttcagtcaggtacatctatcaccaagctcaaactttcgatcagaatgttgacaatcctgaccagtctgagtgacgacgatacaactatctagccaacgcaatgtatatgcccgctctatacttcattaagggctcgaacttgaactggtgctgtcgacttagtgcaaaatcgagtagcctgggagatgtggcattacacgccactgttcgatcatattatgaccgaca

SEQ ID NO: 5672 - DNA, 393 bp, Diabrotica virgifera
  misc_feature (18)..(148): n is a, c, g, or t
  misc_feature (151)..(237): n is a, c, g, or t
  misc_feature (242)..(343): n is a, c, g, or t
  misc_feature (345)..(391): n is a, c, g, or t
gggccgacccaagcgtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccnnnnnnnnnnnnnnnnnnnnnnnnnnnnnnnnnnnnnnnnnnnnnnnnnnnnnnnnnnnnnnnnnnnnnnnnnnnnnnnnnnnnnnnggatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnat

SEQ ID NO: 5673 - DNA, 448 bp, Diabrotica virgifera
  misc_feature (6)..(24): n is a, c, g, or t
  misc_feature (426)..(426): n is a, c, g, or t
ctcgtnnnnnnnnnnnnnnnnnnncagtcactcgtgttacaataagatttttgataatgtaggttaatctgtttttattgttcttaggattctctgttatatttaagtacgaaccattatacgaagctttaggtttcgttaaagttaggcctgtactggtaggactctttgtagtattgcagtatgttatgatgccgtataatacagttcttaacttcctaatgacttgtttatctagaaagtttgaattccaagctgatgactttgctgtgaatctaggcaaatctgaggctttagaaagagcacttgtacaactgaataaagataatttaggttttccaattaatgattacctttactctgcttggcatcactcacatcctccattactagaaagaatagccgtcttgagagagagtgcgaganaatcccaatagactgagtttta

SEQ ID NO: 5674 - DNA, 178 bp, Diabrotica virgifera
tgattcgaatgattcaaatattctccttctcgggttgattccaaggttttatttgtcaacttttgtagtccacattctaccctctaagttcttctctttcgtttctctctctaaatatctctacatagaacattcttttggagtttatgagtatgttgcgtatgtgcaacataaacaa

SEQ ID NO: 5675 - DNA, 294 bp, Diabrotica virgifera
  misc_feature (244)..(244): n is a, c, g, or t
acgcgtacggttaaggctgtggtttagcgaagtcatgtaaaactcagcctcaattttgtacacgcacggtcaccggtcacttagtttgagtctatagtctacactcagtctacttacttaactatgttgattaacacgtgcgcaataacagtcttcattttaaacgtatttttattgacacatgttcgaacaaacgaaacaaatgatacccaaacgtgtgttcagttgtacgaaaaaggcctanaaacttacttggaaaacagatgggaaggttgtgtaattaaatttgaaaaa

SEQ ID NO: 5676 - DNA, 158 bp, Diabrotica virgifera
tttaaaaaattggtcccttccgaacaaaattgtattattaatttaaggttggaaccaaaccggctcaaaacgggttaaaacccagttaaggtaaaattttaaaatccaaccagccttattataataccggcgagacaaattataaactttaacccagc

SEQ ID NO: 5677 - DNA, 444 bp, Diabrotica virgifera
aaacacgcgtccggtgaaaataatgtacttgcgttttgactcaccctgtattcgatataaagaaaattagcaatattaaccatttttataattttgacaatcaacaaaaaaatatggcaccaataaaccatcgctgttgtgctaaaaattatgagggaggatggtggtataaaagttgcttcacaagttgtctgaacggaaagtattcaactgttattgtccctgatgcgataaaatatcacggaattaactggcaaggattccgaacaaaagaatacaacttatccggatcaaggataatgatccgtccaataggaagttaagctaaataataccaacacagtttaccatctttgaaacaaaattaaataaaagtgttacaaggaataattggcataatatattataaatgtatatttaaatatatctaaattagttactatt

SEQ ID NO: 5678 - DNA, 252 bp, Diabrotica virgifera
tgagtcgtattaagttgggggtaataacgtattttttcatcctggtctcgaggtcttttagcttgtgatcgttagttattattgtgagatggtatatcagttttgggggatggagcttagtttttgtacggtgtgtcggggggattatatgttagttcgtacatattgagggcttgcgcagttagcagagcggaaactttagtagttttattgtgatgtagcgtgatttacgttggtttttttggagtggtg

SEQ ID NO: 5679 - DNA, 407 bp, Diabrotica virgifera
actccctaaagtgagtcgtactataacagataaatctatctacgaatctcaatctaagtaagactcatgttaattgtgcaatactagtgatgttttctgtcacacaaagagattttgtatgatctttaccaaatgtaacataatatggtgaactcccaacatgattcaagatagttgatcggaatgctgctttaaaaccgaaggtcatagcgaattgacaaatcgtttcgatcgcatattcagtttcatcgtcaaattaacgtgctgtcagatgtcatattgacgtctctgcaccggtgttgccacatctacaaaatgataattcaaagtacggttgcgcagaaagtttgtacttcgataatagcagctttcatacatctatgtttttaacgaaattgaaacctatt

SEQ ID NO: 5680 - DNA, 460 bp, Diabrotica virgifera
  misc_feature (66)..(66): n is a, c, g, or t
  misc_feature (172)..(195): n is a, c, g, or t
  misc_feature (433)..(434): n is a, c, g, or t
caggcctctagatagagccagatcacgtaactacgtatacatcggcagaactatccgattcatcanaacccaattcaaaaaatatcaaaggatactttaaatcttcgtctaaagtttcgtccttattccttgtctgcaatggtagaacaccgccaagataaagtacattccnnnnnnnnnnnnnnnnnnnnnnnncaaaaatctctccttctattaccgaaaaattagtgaaacggaagaaatctggaaccaacactgcagtgcctttcagaacaaatcaatagacgcgacggcggaaacagcgatcgacgccatccgaagggacatcacaatggtggagaaacctggtggaaaagtgtataaggaccgttgcataatgttttagacctagaatctatataaaactatgtaatgaaaccatataccagttaannaaaacagttgaaaacaaaaaagaaac

SEQ ID NO: 5681 - DNA, 248 bp, Diabrotica virgifera
tttttactaaaagtaaagaacgcttgtatttgatgatagttaagtagtagtgtgacagaatatgtgaggtatattcaccaccgatttattatttgtaccttgcgtaccagggattattggttaagatctagatacttattaatttcgtatttcaaagagcgagaccctgaaaattttcagtgtgatctagacagttcaaataattcttttgtgctgcaatgttaatcgattttagagacatcgaattt

SEQ ID NO: 5682 - DNA, 328 bp, Diabrotica virgifera
  misc_feature (11)..(29): n is a, c, g, or t
atgcaagcctnnnnnnnnnnnnnnnnnnntgacttgctaccacatgtaatgaggtactgtattctaagggacattaactgtgcttgtgagagaatatgttagtcatatacaccagtcgtttattattcgagccttgcgttccggggattaatggttcatgacgagtaatttggcactttcgtttctcacagacgacttccctgaagtttttcagtgggttcctgacaggtcagctaactcgtttgtaatgtgccgttcatcgttcttaactatatcgagatgtgcatcaaatgtcatctggtgattcagtaccagctgctttatacat

SEQ ID NO: 5683 - DNA, 354 bp, Diabrotica virgifera
aaggttcataacaatatagtgatagttacggggtttaccccccacagcttcctgtgagtagaccccatctgtactacaccgacctaggattcatccagccatacaagattcagtactacgacaatgctgtagcaaatagacgcgtttcgtccacttcagtactgttcaacactgatcccgctaagccccccaggttagaaatgaactatgcctgtacaaatatctctgataatgtcgacagggacacatataatgtctccggttattccaccaccgtatatggaagctccacggggaaatcccccaatttgtgtccgaagatatacggggatagccttggagcttccaatttag

SEQ ID NO: 5684 - DNA, 324 bp, Diabrotica virgifera
ctcgcgtttcgacacacgcctctacacacacgtcctgctaacgcgtccgcatccgctcaacaccgctccatgttcttggcatgtataagtgccttccacgcagctgcaggactggtatcgatatcacacgcggtgccctccgagagtctacgacaccactttaccgtcaccttgcccggaaccgtttacatatggaacgactgatctggcatgatatcggacgtgacatcgcatctgatgacgacatcatgacattatcgcactccgggtcaggctgacatgtgatcacgaaatgcagattgtgacactacatagctaagagtt

SEQ ID NO: 5685 - DNA, 402 bp, Diabrotica virgifera
  misc_feature (4)..(26): n is a, c, g, or t
ctannnnnnnnnnnnnnnnnnnnnnngccgctaagcctttaaaatgtttttctgcattacagcctcacacaaatgttccagatcccatatccagaagaaatcgtgtgagaactaaagaagaaagaaagagtacgctggtaacattaatagaacaacgaaatgaagctaaaggaattgtaaaacgtagatcacttcaagctgctgaaaataggaagttagacgacttgaagagaaaaagtagaccgaaacgtggagatgtttcctctgatttgtggcaagatagtgataaacaggcaattattgaaaagtgggtcgataaaaacgctaagaagcataacttgagaggtgtaagtgtacctgtgaaaaagacgaggtctagtaaattggctacgaatattccag

SEQ ID NO: 5686 - DNA, 356 bp, Diabrotica virgifera
  misc_feature (117)..(117): n is a, c, g, or t
  misc_feature (154)..(172): n is a, c, g, or t
  misc_feature (291)..(291): n is a, c, g, or t
  misc_feature (339)..(339): n is a, c, g, or t
tggccacactgtcatccacgctgggagggcatggtcatgaataccgaaaaaagcgagaggctgctgatatggcctaccacgcttggaataagttcaaaacaacctaaattcttttangaaaactattggaatacaaattgttattcgaatgtannnnnnnnnnnnnnnnnnnctgtgtatttgaatttcatagttttatatatatgataccgtaagttgttacaattgtaacaatggagtatattaattttctgtgttttgtagttagttaatttaatttaatgtatttantgttaatttaatgttttgttattataacatctaaacatcttaactttnactacttcctcttcatc

SEQ ID NO: 5687 - DNA, 426 bp, Diabrotica virgifera
aatgccgggtcatgaaggtgtgcatgggaataaacgaaaagatctcttggcaaaagaaggctcgagagaaacctttgtaggcctataaccttgtggcatcaataaagatactacaaaaatcgaggttcagatgtggcttattataaggaaccattaacagaaatggagagccactcaagagcaaaaccagacttaaaagaataatcaagaatattgataaaaaaaactcacgaataattttatgaacctcaataaacgtgataataacggtcactgaaataatgattggttgttactgtttaagaaaccacctatacaaacaaggtaaggtaaatgaaccattgtgcacaaagtgcgaaatggaagaagagaccatacacatccaatgccattggaattgtgaggcaagaattcactggtcaactg

SEQ ID NO: 5688 - DNA, 255 bp, Diabrotica virgifera
gagcatatctgtgctatggtgtcgtaggattcgtctatctatagatgatatgaatattatgactatgctgtagtagaaggacgtgtttcgttgacttaaacagtgtttatgtctgaccctgcgatgcctgctaagttaagaatgaactagtctggtactaatgtcacatgataatgttgatagggacttaaagtaggtctcatgttattccactaaagtatatggaagctcaattgggtaatcccccaatttgtg

SEQ ID NO: 5689 - DNA, 332 bp, Diabrotica virgifera
caagcgtctaaagtgagtcgtaatataacagttgtgtcatataatgctggggttgatacatttggatcacgactcttgtcaaatcagaacaaagtctataggatgatatcctcatatgtgggagataatgctgaattcgatagacagtttttaagaggtgaactggaagtacaattgactccacagggtactttaccagaaaggataattggacgtggtacaggtactccaacaatttttactccagaagcagatggaactcatgtacatgaatgtggggccctcattaaatatggtaacgaaggcacaactgaaatacctatcacaacacg

SEQ ID NO: 5690 - DNA, 316 bp, Diabrotica virgifera
  misc_feature (25)..(53): n is a, c, g, or t
  misc_feature (55)..(95): n is a, c, g, or t
  misc_feature (266)..(283): n is a, c, g, or t
cgatgcaagcctctaaaatgagtcnnnnnnnnnnnnnnnnnnnnnnnnnnnnngnnnnnnnnnnnnnnnnnnnnnnnnnnnnnnnnnnnnnnnnntttgtaaagatatctaattttttgagaagtaaattatatgtagttattaacgatagatttgggactaaatatttttatagtatgaatattgaatacttttagggatgagctaaacaatagaattttattaaaatgtaagttttaaataagagttaggattaggaattttcnnnnnnnnnnnnnnnnnngtatgtatttttagggagtagtagctggagttt

SEQ ID NO: 5691 - DNA, 247 bp, Diabrotica virgifera
  misc_feature (41)..(58): n is a, c, g, or t
accctgaggtgagtcgtattaaacttgaaaatttttagtgnnnnnnnnnnnnnnnnnngagtttttttgtgatgagatgttagtcatctgcaaagacatctgattttgtgagaagtagattatgttgagttggtgcgaggatattggggactaaatatttttatcgtatgaatactgcgtacttttagggatgagcttagcagtaaaattttattagacgttcatttttacataagagttacgatta

SEQ ID NO: 5692 - DNA, 96 bp, Diabrotica virgifera
  misc_feature (39)..(57): n is a, c, g, or t
gtcaggattaagtttaaatttttaatggtaaattaaagnnnnnnnnnnnnnnnnnnntaagaaattgtaagccgttcttaaaaacttcaacttcat

SEQ ID NO: 5693 - DNA, 354 bp, Diabrotica virgifera
  misc_feature (9)..(26): n is a, c, g, or t
actccctgnnnnnnnnnnnnnnnnnncttgccttagtcgaatatcttgttttattgacactgtctattaacttaataattgatacgattttagctttaattatgatccagcatatgttaaagctaaccgaccgcatttggggttcaattgaaattgatatggtatttattttcctctttcgacccgacatcgagttttaggttaccaatacactgattaggatcagtattaggtctatgatctagtccatctagattgtgattaatcccctctcgttgtcattagttatgactacagatgattagaacattagatcgcgactttcaggttttagttggtaagtataaatctcca

SEQ ID NO: 5694 - DNA, 439 bp, Diabrotica virgifera
  misc_feature (246)..(247): n is a, c, g, or t
  misc_feature (383)..(383): n is a, c, g, or t
aggaagactaccacaaagctggaatctgggagttaggaaagcgattagcgctcgaaatctaaatgaagacctaactcaggacagaatacagtggcgtttgggagtcggacaacgtcgtaagtcgttatgaaaccgaatatatgtatactaaaatagctatcgcccacattgacggtgtacctgcaatacttgagtggacgtattccatcgaaaaaaaactataatgtggcaatccccagagaagannaaacgaggaagacccacacagagctggaatctgggagttaggaaagcgattagcgctcgaaatctaaatgaagacctaactcaggacagaatacagtggcgtttgggagtcggacaacgtcgtaagtcgttatganaccgaatatatgtatactaaaatagctatcgcccacattgacgggtgtactgcaat

SEQ ID NO: 5695 - DNA, 402 bp, Diabrotica virgifera
  misc_feature (13)..(41): n is a, c, g, or t
acattgaaaatannnnnnnnnnnnnnnnnnnnnnnnnnnnncaattcgttcagggttcaggtgcaaattcgattaacatgtcgctgtttccattagaatcaaatccagatgttatgaacaagttcatgcatgttctgggcgttcctgagaagtttaaagtagtagatgtgtatggtctagatacagatgcacttgcttgggtgccccggccggtgattgctgttatcctactgtttccctgcagtgaaaagttctatgcacacgcccagaaacaaaaggaagaatatttgaacaaggcaccagagcttagtccaaatatatggtatatgaaacagaaagtatcaaatgcatgtggtactaatgccttgattcacaatattgcaaataatgacgaaagattgc

SEQ ID NO: 5696 - DNA, 113 bp, Diabrotica virgifera
  misc_feature (3)..(3): n is a, c, g, or t
  misc_feature (22)..(51): n is a, c, g, or t
aanattgtacctcaaatactgnnnnnnnnnnnnnnnnnnnnnnnnnnnnnngggcgagaagtgtatgtgctgtactttatctattttttgtactgtacgaagtaaattcctta

SEQ ID NO: 5697 - DNA, 411 bp, Diabrotica virgifera
aaatatttggttttacatttggaagtgtatttctcgagatattagaccgtctccataatttgcctatggtagcagggtaaatagttttttccgattatagcgccatctatccgcagttgaaaaaagtgtctggaataaaagttacctacatttacgtaaggaaatttaatctcggaaaaaaaccgggggggtccacatataatattacagttatcatatctccccccccccaaatctctaaggggtgaattatataaatgacagtagtaacttttttatacctatttactgaacaaaaagtttatattgtaattttactacaatactaatattttattgacaccctttgttttaagaagtgcagctactgtcctaggcatgccatctactcgtatatcgtgctgctatttc

SEQ ID NO: 5698 - DNA, 344 bp, Diabrotica virgifera
cgcatccatcgacactaatacgagcagtacctgagaatacctttctacggagatattcaactaatagttgtaaatacagcttgtacaacatttttaatactggagtctgctactgagatggaaattagtgccagtgatattcgtgtgcgactcagcctgcgcgaaagtgaatgtgtaagagaaaaacattcggaaacgcatgcaactgccaaaactgtactctcgggaagaggtacctcgtttcatatccgatactgctatacagtcaggtgctcgacgacgatcatctacaaagacaagacagaactctacttgtagtgataatggttcttcagaagaatatt

SEQ ID NO: 5699 - DNA, 325 bp, Diabrotica virgifera
acggtttctagagattacaacatgacaatgaatctacgcattggaggtgtaagtttacttgataaaattgtattcaatactgatcttcatagtggtggtacagactcagtttcatcgattacatttcgtttataaggtcgcacaaatccgtgtgttacagcattgccactccagaagaacgcaaatcagatttatcaattgagtcatacatatattgttcgtcggaagcgaactatgaaacatggatttccacacatttaagagtcatcgagataatcgaccccagaatataaaaagtgacgtcacaatcgggttaatttcttcc

SEQ ID NO: 5700 - DNA, 287 bp, Diabrotica virgifera
cgacccaagcctctagaaagagtcgtattatattttgagttcaataattttttttgcgtcaattagtttaagtagacttttactttctgatcaccctgtacaaatcatgatgttgaagtctatgttactgaagagggagttgaggagacttgcaaatgagctgacacatctctaatacggacgcgatcctcatgaggcccctcaggggcgtcggaagttctatgcatttactaacgatctgcaccattacgtgcggtctcttgcacactatctcagtcgatgatgtg

SEQ ID NO: 5701 - DNA, 374 bp, Diabrotica virgifera
cgcgtccgacctggtggaaaacaattaagccggaagcaattgggtaattaatccaagaaacgaagcctttcaactcccaaattttggagaaataaacgaattgcctgaaaatttgagaataagtagtggaaggtccaaggattaaaatctatatgatgccggaaagcgcttttgccgtggcggccacccccatggtggaggcgcctttcggcatcaaatatattttgatccttggatcttggactatccactgcctattctcaaattttcaagtttgtaaaatcgatctattctgtaaaaattgcgaggttttgtcctattacttggactaattactagcttcattacttggactaattgtacatattccatat

SEQ ID NO: 5702 - DNA, 412 bp, Diabrotica virgifera
gaaaggtaaaagagctaatagacacaatacaaaacttcttaacgcgggtgaaactggtattgcttcgcaaaagtaaagcaaatgtgcaaaaagaaaaatcgttgttaatattttaaacatagtggattaaaatgttgttagttctgtttttgtgtatagcaagattagcaagtaatatatactcacctgtactagctcaaaacgattgtgggcgtttgtgtcagtggtttccaggtctttttaaagtaaaacctgtagtggaatcagctactgaagctgtgcaattccaaaatactcgcccaagtagaccaaataatgaaattgatcaatccaataatgtacagttccaacagcctcgtccaaatagaccaagtgttgaaagtcaacgacccgacaatgtacaattccaaca

SEQ ID NO: 5703 - DNA, 237 bp, Diabrotica virgifera
  misc_feature (9)..(27): n is a, c, g, or t
acaactcannnnnnnnnnnnnnnnnnngacgtcacgatttgtgatcgattttctgtaacggacgtcagtttctaaattccagtgatccttcatatcaggcttcacgataaggcattaagatcggacgcttacacgttacgcgtgtagcttgagtgttgacagataattgtctcattaaggttgcagatctacagatatatctccatattcacctggggccctatcactgatatactt

SEQ ID NO: 5704 - DNA, 361 bp, Diabrotica virgifera
acacattcatccacttacacgtcacgaaagttactcaaatttcagtacctgccatgaatgatgcatccaacacccccatcatgccaagtatcagaaaaggcatttatgtggccgcttaagatattcacgtgacatctgatcatcactccatgcatgcctcataaagcttcaacatctccagaaatttctataccttcacaatgggtcccttcaatgatctactctgcaacatgattaccgataccggtgcctgaatcaatatatccacagtatacgacgacaacgatgacctcttcattgcaggagataaaggatgtcacatggctgcatttcacaggacaatgatgtgtactgcatcgat

SEQ ID NO: 5705 - DNA, 413 bp, Diabrotica virgifera
agagagaatctagaaaagcagaagcatacaaatgctttattaaaaatgacacagacgattcaatcgtaggaatatctgtaaccgctgaatgtaacacactaatcagtccaaaagagagtccagaagtactatatttaagtgctgtaaagcaaaatccaataaatgagggaagtttacatcctgcctctataggtggagactggatagacagtgtcaacatcgatgcaaaagtctttataaaccaaactcatattgcagaaactgataatattaacggtaaactattaacaactgattatatttgccaagaacaaaggaataatatcgttgtgatggcaaggtattctgtgaccgggtgtccaaatgactatgtatgttttgaatttataaaaaatgatgacaacattattaaa

SEQ ID NO: 5706 - DNA, 412 bp, Diabrotica virgifera
gcctccagtgcagagatagtgatttaaatgtaaatctaagagacgaatggaaattgaacaaggttaacacgtcaagagattcttttatgcccacaagaagacccgcaaatatcttcatgcacggagtacttggttgggatcaactgcaaatgattatttccaaatctacaacagccgatctgctcaaaatgtttaacaaactagaagaattcttttcccagcagtttaacagcagcaaaagagcatttagtagttttgctggatccggaagaccttcgagagtaactccacaaaaaaatcgagaatcgtcagtacctccccaacttcctgcagctccaactacggatgccagacaccacaggcattggcaaaaagtcttggcacacgtagcaagacttcaattgaaaactaa

SEQ ID NO: 5707 - DNA, 237 bp, Diabrotica virgifera
  misc_feature (11)..(29): n is a, c, g, or t
atacaactcannnnnnnnnnnnnnnnnnngacgatacgatttgtgatcgaattacttgaggaaattcagatgctgaatacatggctcgttcaaaacaggctgtacgtaaagcattatgacggaaggctccgcgtgtcgagtatcacagtgagtcgttgacacaaaattgtctcagtcagcttgaagagcgacaaaaagatctcgatactctcatggggcactatcactgatatactt

SEQ ID NO: 5708 - DNA, 417 bp, Diabrotica virgifera
atacaagccactacagatgacgtcgtacgtaacgcgtggggcgtggaaggattttatataaaaggtctagaaaaactacaagaagattcaaacttggttgaatctataaagcgttggaaaacaattcttggagaacatagagttcttatagtaagcgatacttttatctcttccttgaaaccacctgcgttaaactttattctagataaggttgatttggttgatatcaggctagatgtaaagcaaggagttaattccgtaagtagacaaatcaaatctttgcaaaataatacattatattcgaaacctggaatgccatggatacattggtcagtaggggatgttaattcccaacgtttagctaatattttaccttccgggaactgtaccctacggggtaccctcctccaactaatg

SEQ ID NO: 5709 - DNA, 418 bp, Diabrotica virgifera
  misc_feature (89)..(112): n is a, c, g, or t
acaacacactatagtgacgtcgtattacaaccggccctaagagttgccggttgccggaaaaaaaaaattcagcataattctatactcgnnnnnnnnnnnnnnnnnnnnnnnnacgtggtagaaggaactagccacagttttaaggaaaactagtcactaatgaactataaaacagctcaaaagtcataatctacagaaattatgttttacattgttccccagtttaataatttcttattaaaacttcctcggggtacagatgattctattgtatatacgtgttagagttttattaacgtaattatttgtactctcatatgagtaatgcaagttaaaaataacatgaatttcaccttacattgttgtatttttttctgtattatttatcccaactaattgttctcaaggattgttgtat

SEQ ID NO: 5710 - DNA, 406 bp, Diabrotica virgifera
  misc_feature (53)..(76): n is a, c, g, or t
  misc_feature (360)..(374): n is a, c, g, or t
  misc_feature (377)..(377): n is a, c, g, or t
tcgatacaagcctctaaattgactcattctaaagtcacagtgtccatttcgcnnnnnnnnnnnnnnnnnnnnnnnnatattttgcttgttattttatttaattcatcgaaaaaagagccagagccccagcagaatattgttgatgtaaagttattatagacaaataaaaacaagttctggttctaagcaatctgtggatagtggcgtggccgagtggcgtgggtgtaatacaatacacaaccatattttagtcgggcgggaacacattggattttagtggtttttattagttttgtttaaataattattcgtcatggcatctccaaaaacgtggactgttgtgtgcttctgttcggatannnnnnnnnnnnnnntcncaacaacatggataaatggagacacttgt

SEQ ID NO: 5711 - DNA, 333 bp, Diabrotica virgifera
  misc_feature (278)..(290): n is a, c, g, or t
  misc_feature (293)..(306): n is a, c, g, or t
  misc_feature (318)..(318): n is a, c, g, or t
agcaatcgctgcccccgttgccgttgcagctcaagctgtagctgtagcccccgcagccgtcggtgttgtcggtgttcccgcccttggtttgggtctcggtaaagtcggacttggactcggaggacacggactcgccggaatcggaggactcggaggactcggtttgggaatcggtcacggagtcggactcgggctcggactcggtggtcacggagttagagcttggtaaattgttgttgccgtttaagattttttaattgtgatgaaaaaactgccannnnnnnnnnnnnggnnnnnnnnnnnnnngtgttcaaatanaataagttgcgtcat

SEQ ID NO: 5712 - DNA, 289 bp, Diabrotica virgifera
gccgttccacttaaagtcagttggactgcttacccttgttggtatcagcatcctcaacgttcacaatgtgctcacgtgtgatgaggtttttcgagactatgagtcaccagatgtgcctcgcagggatcggtgagttacaatctatgcggataggcagtagctttcaggctccatttgcttgacagcacaaaacgtttgcagtcaactgcaaatgcagctatctactattcgctcatgagaaggagattcagtactttacacatacgtattagaggacagcaaatgtttt

SEQ ID NO: 5713 - DNA, 245 bp, Diabrotica virgifera
  misc_feature (27)..(54): n is a, c, g, or t
  misc_feature (75)..(111): n is a, c, g, or t
  misc_feature (212)..(226): n is a, c, g, or t
  misc_feature (228)..(240): n is a, c, g, or t
ccggtcgaccacgcgtctgaatagatnnnnnnnnnnnnnnnnnnnnnnnnnnnnggattaagttaaggtaattgnnnnnnnnnnnnnnnnnnnnnnnnnnnnnnnnnnnnnattggtaatttaacaaaatggataaccttaaaaattaaaaagattgttttaattatttcttcaatagtaaatttatatagtgaagaatatataagaggtgnnnnnnnnnnnnnnngnnnnnnnnnnnnngttgt

SEQ ID NO: 5714 - DNA, 240 bp, Diabrotica virgifera
gtggcctcggaaggggtagggataatttgcattatgaccaaagggggggccgccctgggggttcaaggtttcggtccgttttgttgcgaattcaggcctcttcaatagggtcccttaatttgatttcatgggctgcctttttcaaacttcggatggggaaaacctgtggggtttcccactttatccccttggtgaaaagcccccttttcgcgattggggttaataccaatggggccccac

SEQ ID NO: 5715 - DNA, 250 bp, Diabrotica virgifera
  misc_feature (7)..(46): n is a, c, g, or t
  misc_feature (48)..(68): n is a, c, g, or t
  misc_feature (88)..(128): n is a, c, g, or t
  misc_feature (148)..(179): n is a, c, g, or t
  misc_feature (193)..(216): n is a, c, g, or t
  misc_feature (218)..(245): n is a, c, g, or t
cgtcggnnnnnnnnnnnnnnnnnnnnnnnnnnnnnnnnnnnnnnnngnnnnnnnnnnnnnnnnnnnnnggaaagtaaattagaatggnnnnnnnnnnnnnnnnnnnnnnnnnnnnnnnnnnnnnnnnnggaacctggggtaccagggnnnnnnnnnnnnnnnnnnnnnnnnnnnnnnnnccaaattaaaagannnnnnnnnnnnnnnnnnnnnnnngnnnnnnnnnnnnnnnnnnnnnnnnnnnngtaag

SEQ ID NO: 5716 - DNA, 351 bp, Diabrotica virgifera
  misc_feature (11)..(29): n is a, c, g, or t
  misc_feature (132)..(146): n is a, c, g, or t
ttgcaactcannnnnnnnnnnnnnnnnnntccaacagggaaaggtctttgttattcaccattggaacgtgatttgggttacacgatacttgcaaacgggtagtccataattgaagtacctgctgtagtcgcnnnnnnnnnnnnnnncaaaagaggctacgacaacttcgaagtgatgatacgtggagtgtctggcagcattggacaaggcactttcattgatcgtgcatgataactctctggaccacctgttgactcagtaaatctcatgtactgattcctggtgtagttgacgacttggctccattagacatcgaattgaacgttacagggttcaatggtccttagtgtc

SEQ ID NO: 5717 - DNA, 371 bp, Diabrotica virgifera
cgcgccggacaatacttcgcactaaagtccgtttcaattaaggtccggccattcaaaataattttaattaaggtaaccttaaataactccaaaatcccaaaaatccaaggtccaaataagtttaagtccaaaaataataaattaactggaataataaattaagttgtacaagggaaccaaagttaccaaatgtacaaaaaccggttcccgggtaaattggaacatggaaacccgtaaagccttgtccaaggttcccaacaataaagaaacctataaattacacaaccttttaccatttccaataattggtgagccttttctgatatataattcaataacatgggaatgataaaatacgaaatacatgcata

SEQ ID NO: 5718 - DNA, 373 bp, Diabrotica virgifera
  misc_feature (4)..(39): n is a, c, g, or t
ttannnnnnnnnnnnnnnnnnnnnnnnnnnnnnnnnnnnctaaaatacaaagaatattccagcgtgacagatacatttctaatggcgaaaatgttggatactactcccaatgcggcactcatgatatctcttcgtcaccattaccttactcgagggattccagatcgtaaatgccatgctacgtatatttgggttgacggatcatgagactatgtctatgcaaaactaagactttacattttgttccaacattctcacagtagttaccagtgtggaacttcgaaggaaattcaccagatcaagccacaggatatatctcagatgtctttctgtgcccagtagctatgtcgaaaggtcgattcctcagtggaaa

SEQ ID NO: 5719 - DNA, 76 bp, Diabrotica virgifera
tgagtcgtattagattattggttattttgagcttctagatgtgtgttattcgttcaaacacaaaagtgtatggatg

SEQ ID NO: 5720 - DNA, 419 bp, Diabrotica virgifera
actcacagaagcatttacgataaatatgttaaaaagtgccacatttctctgttttgttatttcagtgtgttcagtggattactacactgagcgtgatgttaacgcttatgaaaaactattaaacgaagcatttgaatctagcaaaacttacgaaccagcaaccagttctctaaaatataaagcgttgaaatctggacctccagaagatgatggcggtgattatgatttcattgtggttggttcaggatcaacaggatcattgttagctagtcgcctctcggaaatttcagactggagagttttagtgctggaagcaggcaaatttggaaacaatgttactgacgttactgtaatgagttacaaagctacaattatgagcgacttcaattggggttactacagtataccacagaacaata

SEQ ID NO: 5721 - DNA, 340 bp, Diabrotica virgifera
aaaactattcaggtatacagatcggaaaagctgctcaggttagtgtttgcgattacttgcgactgcggacagtgcattttggtgcgtgagacatttatagtttgtttatactcggcgtaccggaagatctttctgtgaatatgttggggtactacctcgttctgctggtggtatacttgatatgtatagctaacatatcagcatatgaaacgccttctccacaccaataccacatccaaaccgacgaaggacctgagcgatatttccgataccagaccgatagtggacaataccgaaaagaaaacgactcgaagatggcaccgtggttgcacatacccct

SEQ ID NO: 5722 - DNA, 400 bp, Diabrotica virgifera
atccaatcagcagcgcaaaacttaatcacaatcaacatgaaattcatcattgccgtttctgcactcctagcttgtgcggctagttctcctaccgcatacatagtaccactagcggaaatatcagcgcccatcgcgagccaataccactctcaagatagcctaggacaatacacttacggatacgctaatcatctcagtgccaaatcagaagctagagcatttgatggatctgttttgggaagttacagctacttggatcccagtggtaagattcagtcggtagagtatgccgctgacgatcaaggatttagagcgacgtcttctaatttaccggtagctcctgcagtacctgaagttcctgttgttgcggttcctgttcctattcaagacacacccgaag

SEQ ID NO: 5723 - DNA, 409 bp, Diabrotica virgifera
  misc_feature (253)..(271): n is a, c, g, or t
aagtgagtcgtactaacgcgtggggcaatattaggtagacaacagtcaattaaagccaaacgatcccgacaaaaccaagcaaacgaagtgaatcttacaagatcaaatggaatagaaccgcaaataaaagtagaaaataacatttttaatcaggaagaagtacaattaactgttgtagaaccaagggcaaagtatgaaagaacagctgtcagcaaaagagaagaaataggacatgattcaaagctagctgccnnnnnnnnnnnnnnnnnnntggcacaagttgaaatgatttatcctagtgaacatgaagaaatagaaaaaattaactatgcacaagaaagagaaatacatatcgacttccaaaaggttggtgatgaaataatattccctaagttaacaaatagaacac

SEQ ID NO: 5724 - DNA, 220 bp, Diabrotica virgifera
tgagtcgtattagacgggtgtaggtatcgataaattctgtgaacgtttcatttgaggaaaattcattgcacaagccatggctcgcacgacgcaggctgcacgtaaagcagcacgtggaacagggcggcgaaaagagcttgcgacgaatgctgcaggatacgcagcaaccgcatccggaggtgtcaagtttcgcgatcgttacggtcctggtacagtagcg

SEQ ID NO: 5725 - DNA, 363 bp, Diabrotica virgifera
gaaataaccatttcttttatttgatgatagggactcagtgtcgcgagagaagatttcatctctacacaagaaagatttaattcatgtaccgtgtgttccaaggattattacttaataattacctctttactaatttcgactttaatagagctagaccagtcgtattttgatcgtcagacatatactttaaatgatttttttgtgatgacctgtcagtcgttgttatacatatctcattttttacgaaatacattatgtcttaatattatcaatatctttacaagtacacaattttagagtattaatatgacatacttttagggatgacctcaaccataaaattttactaaaattgaattttta

SEQ ID NO: 5726 - DNA, 403 bp, Diabrotica virgifera
  misc_feature (29)..(113): n is a, c, g, or t
gtttcgttacacgcctctggttattttcnnnnnnnnnnnnnnnnnnnnnnnnnnnnnnnnnnnnnnnnnnnnnnnnnnnnnnnnnnnnnnnnnnnnnnnnnnnnnnnnnnnnngggcgtcgaccctatgggttatgttctctttaatggtagttcgtattaggtcatccctcctgggatttccctgaagttctttttcttggccgtcttttttcacatcctcgtttgggaaactctcgtggtatttcagttgattgcctttttagcccttccccctttttccacaggcggtataacgaatgggacccccccagttgtccttccttaaaatttgtgaatcttgatgttaaacgtggcgtcaccgtttttcgtgccattatcctcgtgggggttcctgttgcctt

SEQ ID NO: 5727 - DNA, 386 bp, Diabrotica virgifera
gcgggtcgatacacgagtctgcacagacgtctgctcaacgcgtccgattaattattatcttctacacgctattcggcgttaactacaataaagtatccttcgatctgtagtttccattaatcaattgataactgcgctatgttttaccgtattaagaagattctcgtgtgttcgtgaagtgaagtagtttgtatgaaatcggaaaatgtttaaaagacagagatcgaaaaatagtggttctccgctccaaaacggtgaatcgcaacattctcacatggaaaacattgtccctgtgtcacaattttccaaaattacgcggcaattcaattgcaaactggccaatggaattcgaaaagctttcgtatcaggatttccaaaggtgcaaa

SEQ ID NO: 5728 - DNA, 448 bp, Diabrotica virgifera
  misc_feature (253)..(274): n is a, c, g, or t
aatacaacactctacagtcactcgtactaacgcgtgggtggaaatggaggtggtaatggaaatggaggtggtaatggaaatggaggtggtaatggaaatggaggtggtaatggaaatggaggtggtaatggaaatggaggtggtaatggaaatggaggtggtaatggaaatggaggtggtaacagtaccagtaccacagaaggcgctacaaagcctactactgaaaaagctactactttaaaacctactactnnnnnnnnnnnnnnnnnnnnnnatgacacagatgaaaattgcgatgaaaattcctcagaagaaagtaatgaaaaatctactgaaagaaacgtcacagatgataatagcgacgaaaattgctcagaagaaagtagtgaagaatctactgaaagaaacgacacagataatggaaatggaggtggtaatggaaatggag

SEQ ID NO: 5729 - DNA, 222 bp, Diabrotica virgifera
tgttagactagtgtctgataccatcgaagatgatctcaagggattatataatcttcatcgatgtttaatctaatctatgtgaatgcaatcacactgggttacacatcgatacacagttgagacctttgtcagtaggatcattgattcgagtcagccgagtaagattggattatgtggttaaacgggtagtggtaacgacgctggtacaagcggacgattcga

SEQ ID NO: 5730 - DNA, 428 bp, Diabrotica virgifera
acaagcctctaaattgattctgaggactagaatgcaataatggcagtgagttcgtttctcctgtgcttcatacaaataaaaaaactccgaattggtttaactttgccggtaaaacttattacgtagatactgtctttaaggctaatttctacaaggcgttacagttctgtcgacaacaaggaatgcatttgttaagtatcaatagtcaacaagaaaacgacagaattggaaaatttattaatgagaatggtttaggatacggccactactggacatcagcttcaaaccaggtcggagacggccagtgggtctggctatccactggacaaaatatggtatactcgaattggtaccccggggaacccagcgggaaaaactcccaaaataacactgagcactgcgttgaagcccgacattgggctcagcct

SEQ ID NO: 5731 - DNA, 393 bp, Diabrotica virgifera
  misc_feature (95)..(109): n is a, c, g, or t
  misc_feature (370)..(370): n is a, c, g, or t
caatgttcaatcagcaaatcttcaaatacaaaaacggataccatattacgagggtaagttttaggtactctattactcacacgggttgtgctcannnnnnnnnnnnnnnataaaatatttttaaaacttgtctttatgttctttttcaataatttcgtatacattttatttcgaatcttgttatgaatgaaatttaaaacatttgcggcatttttaaacgaccgagagcattttaactgctcaaagaaacgtaaaaattgtcgaatattgtcatactggcctttgtctttcttcttgatagatgtagatgtaaaggcgcatgcgtaaaagctgacagcaacttctctgcgtctgaattttcaaaattganatatctcgtgcatgtcatatgcc

SEQ ID NO: 5732 - DNA, 409 bp, Diabrotica virgifera
  misc_feature (16)..(16): n is a, c, g, or t
  misc_feature (19)..(19): n is a, c, g, or t
  misc_feature (251)..(283): n is a, c, g, or t
  misc_feature (345)..(401): n is a, c, g, or t
tgagtcgtattaaacngtntttgtctactatatactacaaccatgggcgtatgtttcactttatgctttgacttaatttttttgaaagtgaatcgtgacgcatgggaaaagttatagcggacgaacactataatggcccgtttataaggtgccccttttggtcttaaaaattatcttacctatttttatattctcataagaaataagtaatgcatctgatatgcctaaattgttgctcggtatagacagcnnnnnnnnnnnnnnnnnnnnnnnnnnnnnnnnngtcatatcgaaacacacacctttaatgttatatatggtacggaatatgactcgcgtaaatannnnnnnnnnnnnnnnnnnnnnnnnnnnnnnnnnnnnnnnnnnnnnnnnnnnnnnnnacagtttt

SEQ ID NO: 5733 - DNA, 401 bp, Diabrotica virgifera
  misc_feature (6)..(25): n is a, c, g, or t
agcctnnnnnnnnnnnnnnnnnnnnatatgtcaatgttcaatcaacaaaatcttcaaatacaaaaacaaggtacggtattacgatggtaagttttaagtattctattactcagaatggttgtgctcagctcattcatgagtgatataatatttttacaacgtgtctttatgttcattttcaagaatgtcatatacattttatttcgaatcttgttagcattgaaatttatcacatttgcggcatttttaatcgaccgaaagcagtttaactgcataacgattcgtaaaaattgctcactattgtcatacatggcattggctttcttcctgataaatgtacatgtaaaggctcatgggtaaacgctgatatcaagttctctgtgtctgaattttcaagattg

SEQ ID NO: 5734 - DNA, 409 bp, Diabrotica virgifera
cacttgtgtgaaaatgtctttataatttacatttttaggtatattttaaaactgtagcatcatcacgattatatgtgtcttatcaaggaaatactacagaagcattttagttttagtttcactgtatttagtcaatgggaccacaatattagtttacttgggacgtatccaaacatttggggggtttaatgttcagaggagtactacagtcatatcatttttatgtaaatatatgaaagctgaagccaaatctcgattaaaactcgcgtttcgaaaaattactataagccacaaatgttttaataacattgtgtttaactaatggtaccacagtagtgaattaattgtaccgtacacaaacgttttagggggtttaagggattaatacccccataaaattttatggggt

SEQ ID NO: 5735 - DNA, 232 bp, Diabrotica virgifera
  misc_feature (24)..(63): n is a, c, g, or t
  misc_feature (119)..(133): n is a, c, g, or t
  misc_feature (136)..(195): n is a, c, g, or t
ggtaacgaaacattttatttaagnnnnnnnnnnnnnnnnnnnnnnnnnnnnnnnnnnnnnnnnaaaggaaaaatttatttttggtaccttgtgtaccagggattattaattaagaattnnnnnnnnnnnnnnnccnnnnnnnnnnnnnnnnnnnnnnnnnnnnnnnnnnnnnnnnnnnnnnnnnnnnnnnnnnnntttgggaaggaaaggtaacccgttttaaaatataccc

SEQ ID NO: 5736 - DNA, 400 bp, Diabrotica virgifera
aatggaaataaagaatgtaaatatctataggtcttcccttaatactgttttaccaactgcttttaaggttgtaaaagaatgtgcgagaggttcactgacataaatattatagaatagtcgattacttttcgctttcaaagttgctacagttcgtgtgaaaggtgtatgttttggtgtgaatttgtttacagtggtagttttggaaacagtttttagtgccatttaagatatttttcaagacaaaactttgtgccaatttataaatcagaatgctcgacaaaacttttacaaacgaaactgccacacaaaacgataagactgtatattctacaatcattagacataacattaatacacttagacatgttataacaattgaaccgttagctggattttacca

SEQ ID NO: 5737 - DNA, 395 bp, Diabrotica virgifera
  misc_feature (201)..(218): n is a, c, g, or t
caaacgtcctgccacgcgtccgcccacacgtccgcttttaacacgaagagacgaacttttcccactggctagacaagttgtcaaggattccggttgttattactcagaaacacaattatctacagtttatatgaataaaccaggaaatatgggccatgatcgggaggtggatacatcagctagagcgagcccaagactaannnnnnnnnnnnnnnnnngatctataagcaagaggccaaaaatggaagccacttccgactcagacgaccggcaggattatgatgaagcacttgtagtaagaacctctatccattcgctgtttcaacacaattctaaaaaccatcattcaagcgcaagatgcaatacgtcacgaagatcctcagtgggggccgatg

SEQ ID NO: 5738 - DNA, 377 bp, Diabrotica virgifera
  misc_feature (14)..(29): n is a, c, g, or t
  misc_feature (255)..(272): n is a, c, g, or t
acaacactctgatnnnnnnnnnnnnnnnntcctacacccgcattatcatataccgcatctcagatgtacgagacgtttctcacggagaaacagaggaattcctgtctcaaatggttgtgagcacaacgatcaaagctacaaccgatacatcagcaggagtggtccatttccaccatagcaaagatcccagcgatgtcatgaacgagtgggctcatgatgtgacacagctgacgcagcacgtcaacattatcactnnnnnnnnnnnnnnnnnngaatgtgtccacaagcatcttcagtcgacttcagcttagtttacgagttttcagtctgagaatcattttttagttataaaatatagttgcaaataaatgttttgt

SEQ ID NO: 5739 - DNA, 240 bp, Diabrotica virgifera
cgcgtccgattaaaaataagatttgattgcaatttaatttttaagtacaagttaggattagccattttcagattttacagtcatttcattatgtatgcttgatatattagtagtttgatttttcacgacttttctatcaatctatctgtttagatggggtagttctacgtacctgactgactggtattagtcttgatatgttgtgcaatcagttcagctttggaggtttcttcaccgcac

SEQ ID NO: 5740 - DNA, 437 bp, Diabrotica virgifera
  misc_feature (31)..(51): n is a, c, g, or t
  misc_feature (111)..(138): n is a, c, g, or t
  misc_feature (201)..(226): n is a, c, g, or t
  misc_feature (294)..(323): n is a, c, g, or t
ccggtcgaccacgcgtccattcaaatttatnnnnnnnnnnnnnnnnnnnnnctttattaagtttatttattatcactatatatataatgaaatatttttacattagtaagnnnnnnnnnnnnnnnnnnnnnnnnnnnntttagtatttgattaatatttagcttgtacatgtaaattatgattaaacatttacaaatttcnnnnnnnnnnnnnnnnnnnnnnnnnngattataatgtctacttgttagaaattttttattaatagatagatttagttaagcgatatttactatnnnnnnnnnnnnnnnnnnnnnnnnnnnnnngatttagtacatatatataggtttaatagatgaattcagcatcatttttttcacctgtataggaatagcatgtccatttgtatttaatataaagtcactcctgcccactgatta

SEQ ID NO: 5741 - DNA, 407 bp, Diabrotica virgifera
  misc_feature (2)..(29): n is a, c, g, or t
  misc_feature (194)..(215): n is a, c, g, or t
gnnnnnnnnnnnnnnnnnnnnnnnnnnnnggataaccattgaaatgcggaaggtgagtaattgtaaaattgtaaatagtgaaagtatagatattgcagaacaagaaaaagagttaggtaattttatatatagtgcagaaaatgaatcagatcctgttgaaagtgaagaagcccaagatatttgtataaatgaannnnnnnnnnnnnnnnnnnnnnatgatcttgagaacgttaatattgcaattttttttcatagagttgacagtgatcaaattatatatcagaagaagaaacgaaaacttaagcttgtggggaagtatgtgatgggggacttactcggggaaggggcctacggcaaagtgaaggagatgttggactctgaaacgttatgtagaagggctgtaaaaa

SEQ ID NO: 5742 - DNA, 132 bp, Diabrotica virgifera
  misc_feature (7)..(46): n is a, c, g, or t
accacannnnnnnnnnnnnnnnnnnnnnnnnnnnnnnnnnnnnnnntggcggacgcagctccagccggtggacgtggtggattccgaggaggttttggaggtggtggccgtggaggcggtagaggtggtccc

SEQ ID NO: 5743 - DNA, 233 bp, Diabrotica virgifera
cacgcgtccaatcaatatgtcaccactccatattcataatcacagtcgtagtttaaactgcattgaaattattacatcatgtatgatgacgcagaatatgcacttatcgcctggtttcacaatctagcatgtcgggctgattacctttgaaatgacgctgatcatactgtcgcacctgttatcaacgatagtacttcataattgagtgacattaatgatacccctgtacagga

SEQ ID NO: 5744 - DNA, 377 bp, Diabrotica virgifera
gtattatagtggatagtaaggaagtggtggcaaaggtattggtgaaaatggaaatggcggaactggtaatggcaactcaggtgaaggtattgacaactaagatgatgattgtgacgacaaggataacggtaatggcaacggacggcgtggtaacaataatggccgcgacggtattgaagaatagggatctactgacaaaggtgatggagacaagcgaattggtggtaatcgtactggagaacaaggagctggctggcacggtactggtgaaaatggaaatggtggtcaacatagtgctgatacaggtatttccgacgcaggtgaaggtgttggcaactgagatgattgtgattgttatgacaattagtttggtaaca

SEQ ID NO: 5745 - DNA, 459 bp, Diabrotica virgifera
gtcgacccaagactctaaaataagtctcactaaatcacaaggagacacatgtcctgcacaaagtccaaaaaatgtttattatttaggagacaaacaggtaacttggtctgacgctattatagcatgtcaagccgttggaatgtcattagtaagtatccagagtcaagctaagcaggatgaaatcattaattatttggaagtcagaaaagtaaattacactggactcgataactccatatggatctcaggaaatagacgtctggataaagttaaatggttttggttagctgtagaacctattatatacactaatttccttcctggtgaaccaaacaattctggtgggaatgaagaatgtctaaccgtagtttactccggaaggcctggttggaacgatatcgcatgtagcagcaagttttatcctttatgcgagaaagagaattgttgtgctggttgtaa

SEQ ID NO: 5746 - DNA, 258 bp, Diabrotica virgifera
ttctttcacattaagtaatatttctatcagtaaataattttggcaaaatattagctactggcaatattctaattggtggaagaacggggttcataggcaaatcgctttataatctagtaaaatatatatggtgtggggtaactttgatatcacgaatgctaggcattcacaggatatcatgtaacgaattataaatctctagtcttccagatgatatcctatcacttgtgaatctagctggtctcaatgttatggaca

SEQ ID NO: 5747 - DNA, 413 bp, Diabrotica virgifera
  misc_feature (314)..(332): n is a, c, g, or t
  misc_feature (374)..(374): n is a, c, g, or t
tcatattacaacactgaaatttaaaaagcatgaattattcatatctgtctgttcatacacataaattctccgtaaacattaataaccaaggttgtaataatggtgagaaatttgaccaagaacttcggattctatacaaaaactccgataaaagctatagattaaattaaagatgggaaagcataaggattcaataaaatcgttttcaacgagaacaacatgaataaaatattggaattatttcatgaaatatacgataccgatcaaattccattggactggttgaagtttatgtacattttgtgacccttccnnnnnnnnnnnnnnnnnnngacgtgcagtgataacgttaattagccacaccctttaagtanttttgcttattatataaaacacaattcttggttcaaaaa

SEQ ID NO: 5748 - DNA, 266 bp, Diabrotica virgifera
aaagactcatctactaaccaattacttatctacaagaatgtgactcatgggggagagtctgtatcaactggatatggcaaccccgtctgacaattcgcttctttgaacgtctggcccagatgccccattctagtcgtagatcagagcctagtcgatgaactttcacacttgtaacaaggaaaggagacctgatagagtagtccacgctaaatgatctggtgctttcgagatattttgaatgtactaatgatatcacacagtactca

SEQ ID NO: 5749 - DNA, 391 bp, Diabrotica virgifera
  misc_feature (334)..(363): n is a, c, g, or t
atgcataataagatctgcgcaaatgccataccaccatctcatcagatgccgacatgtcatccagttcagacaaaaaggtcatacaggaactataagagtgtctatctttagatctagtatctatagttgtcaaatttcacgattgtattccaggaagtcgtcagtgcatattaggaaaacagcagagtttgtaaaaagatggcataatctgattactctgaataggacgatcaacatatgacgttaaggaaccctctaattacgaggacaccctgtaactacctctacagtataacaaggcaacagcatccacggcagttgcctcatcagtcgnnnnnnnnnnnnnnnnnnnnnnnnnnnnnnattctgaacaacagtagcaacctttcca

SEQ ID NO: 5750 - DNA, 297 bp, Diabrotica virgifera
  misc_feature (41)..(88): n is a, c, g, or t
gcgtccgagttcacgtcgtcccgtgacgtgtctttggcatnnnnnnnnnnnnnnnnnnnnnnnnnnnnnnnnnnnnnnnnnnnnnnnncgtagacattggattcggtatatgcagagctggttttgccgtggatgatgcagtgtgagcggtcagtccttggattatatgatttccaatacatcacggtgtgatagtaggattgggcctgctagagtcatatgttagtcaccatacgtagagcgtgtcaggtatgtctatgtcaaagttgccaatccaacatgataactttgcaagtg

SEQ ID NO: 5751 - DNA, 337 bp, Diabrotica virgifera
tctttacctgtgaaatgatgcaacatacacctgcaatttgcaagtatatttatctacagaatgtggaaagacagtttatccgactttactttatagaactatgtagaggatcaaccaaatttagtacatttagaaagttctgcaagcttacaagtgacagtggttgatataatacgttactatcacgactgctgcaatttctatttaggaaatgtgacactggaaaggccataagctgactaagccacgttcatagaatcaacttataatgatagaccctatcttgattactggattactgcataccattagtctcattaattgcctcgtagtccgt

SEQ ID NO: 5752 - DNA, 396 bp, Diabrotica virgifera
gacccaagcctctagagtcagtcgtaatattgataggaaccctactcgacttcgctctatgtggtatagccgccattgcacgaaaagccttgatgaccggtctgatcactcatcatctgtcagttataattggactgaaagctattaaccacaggcataaggctacacgtaacagatagtatcaaagactgtctatagccactctagctcacactcagtaggacatgaacaacatctcagttatggacattcttcctatggaagaagttttgaagagcttctcctatctttgggaatgcaacctgtatacaaaccagcataagagatacaacatagtctgttttaatttagtgattatttagtaattatttgtgtttaatataacaaagacgtttt

SEQ ID NO: 5753 - DNA, 171 bp, Diabrotica virgifera
  misc_feature (68)..(86): n is a, c, g, or t
gtgaacattataatttagaagctttacgttcatatgacaaggatcgtaagactcaggctgttcgtaannnnnnnnnnnnnnnnnnncaacgtatacaccttgtccaccatcggctgcgtgaagctcgggttcctcaattggatgtgtcaagaagccacgtcgttaaggtcc

SEQ ID NO: 5754 - DNA, 377 bp, Diabrotica virgifera
gcgtccaagagtagtctaacttcagtaatatattatccacatgatacagtagaacacaatgattatagacgatgacatgatttttgatgattcgggtaatgaaaccagtggagacgatgtacattttggtatcgacgctgattcaggttgcagcagcacagaatttcaaagcttcgaggaagaatatcaatatgatgttctttctacagaagaaatagttgtacatatgaatgattgcattcaggatgtcaatgtagtagttcaagtacctgcaacagttactagaattcacttaaattagttcacttgggatacggagaagcttatggaaaagttctttgatggcaatcaggatgaagtgttttaggaagcacatg

SEQ ID NO: 5755 - DNA, 323 bp, Diabrotica virgifera
gtcgtatcatatacattttgtctactaggtactacatccatgggcgtatgtctcactttatgctttgtcattatttatttgtatatattactattttcatgggataagttatagcggttgaactataaattggggcgtttaaaatgtgccccttttggtcatattagtaatcgtaccttgtataataatctcaaatgtattggtttaagcatctgaattcggcaacattgtttccacctgtatactactaacatgtcttttcgtattaaatatgttttcgcgccagaccactgcatacatcgtatggctgcggtattttgccc

SEQ ID NO: 5756 - DNA, 374 bp, Diabrotica virgifera
ggtgaaaatgtatttataatttacatttttaggtatattttacaaaagaagcaacatctcgatacactgtgatttatcaattcaatactacgaggcaaaaagtttcaaagtcactgtgtttatctaatggtcgcacaataatagtttaattggaacgtacgcaaacatttggggggtttaaagttcacaggaataaaacacgcataacatttctatgtaaatatattaaacgcgaaactacatctctataaaaactcgcgtatcgacaaaatactaagagccaacacagttttatcaacattgtgttgacccaatggtatcacaataattacttaactggaatgtccacaaacgttttacggggtttaaaggat

SEQ ID NO: 5757 - DNA, 385 bp, Diabrotica virgifera
  misc_feature (21)..(79): n is a, c, g, or t
  misc_feature (81)..(384): n is a, c, g, or t
gtcgatacaagcctctaaaannnnnnnnnnnnnnnnnnnnnnnnnnnnnnnnnnnnnnnnnnnnnnnnnnnnnnnnnnntnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 5758 - DNA, 270 bp, Diabrotica virgifera
  misc_feature (2)..(2): n is a, c, g, or t
  misc_feature (7)..(7): n is a, c, g, or t
cngtggngtcgacattctatgtcgttttctgaactctcacaagtcacgtctttggccatagcttaatctttaaggtctactattttagggtgtaggagctttacaggtatgtattatagctgtttataagaatccttggcggcagatctcgggacgaccctcagtgcaacctttcatttattctacctgtatttcggagtagtgatattgtaagtctctacaagttcgcttccatctggagtcatttattcatctccttaggtttcacat

SEQ ID NO: 5759 - DNA, 376 bp, Diabrotica virgifera
  misc_feature (15)..(34): n is a, c, g, or t
gttacctaaacaacnnnnnnnnnnnnnnnnnnnnaagataaaattatgaattaattaacttaatatcgaaataaaaatgcagtccaatattatacaaaatagtatcgagcttcctccagaagttactgttaaacctttggccttagtaggcgtatctggtctagatatagttaataatgcagtccataaatccatttgggagactttcagcagtaacagaaggatagaaagggctcctgttttatttaaattaattgataacgctcacgaattccctgtgatcaaaccaagaagaacttcgtacgactggtacattccaaaaggtattcttaagaaaaattggatgaacaagcatctctatgaggtgcctgccgtt

SEQ ID NO: 5760 - DNA, 105 bp, Diabrotica virgifera
ggtggacagtcaggttaagggagccgaagctctaagcccatacgtagtggtacaccttttggtatttgagtttgggtgattagcttgtcggtaatgggtcagatt

SEQ ID NO: 5761 - DNA, 434 bp, Diabrotica virgifera
cccacgcgtccggttggttttaagatatacgtaatcggaggatttgatggtatggactatttcaattcatgtagatgttttgatgctgttactaaaacctggaaagaggtagctccaatgcactctagaagatgttatgttagtacttctgttctgaaaggtacaatttacgctatgggtggatacgacggacatagtcgaaaaaatagtgctgagaaatatgatcatagaactaaccaatggtcccttatagctccaatgaacatgcagcggtcagatgcaagtgcttgtaaccttgacggcaaaatctatataactggtggctttaatggccaagaatgcatgcattcggcagaagtgtatgatcctgaactaaaccaatggtcgttaataagtccaatgcggtcacgtcgttctggagtaagctgtattgc

SEQ ID NO: 5762 - DNA, 144 bp, Diabrotica virgifera
  misc_feature (12)..(24): n is a, c, g, or t
  misc_feature (26)..(45): n is a, c, g, or t
agtatatcaatnnnnnnnnnnnnngnnnnnnnnnnnnnnnnnnnncagtagtagacggttgtagatttagtgaagatatacaggtttactaaaggaattcggacacattttctttcacctgtttatgagaaacatgtcgttgtg

SEQ ID NO: 5763 - DNA, 401 bp, Diabrotica virgifera
tttagcatttacacctcgtaactcttggtacgatagcacacggtaatcttttagtgaaaagatgaacaaaatcaattatactgttttaaaaaatgataagattggaagatacttggttgcctcaagagacattaaagggggggaagttattatttccgaaaaaccattactaattggaccacccatttcgggattattaatatgtttcaattgctgcaaagaaattaaaagaattgcgtatgtactttgtgcatcttgtggtacagcaatattatgcaatgccaaatgtacaggtaaatttcacaccaaagaagaatgcgaaatttttgcatcaaaacaaattaatggacgatgtattgcagacaattgtcaaattatctttcctctaaggtgcttaatac

SEQ ID NO: 5764 - DNA, 429 bp, Diabrotica virgifera
accacgcgtccgcatttttgtgcccttaacaagtgcgaattatcgagttcagacgatttgaaaagtagaaaactgaagagaatattgatagacacaggagatgaaggaatacctcaatacatcaaccatttgaaatctgttttaacctatgaaggcatcgatttggctcatattttcataactcactggcatcatgaccatattggaggactcaatgacatattgacagaacttagagaaaaaacaaaacattgtcaagtttggaaatacccaagccttaaagatgacatcaacaagaacgaattgatagaatcatttaaagatggtcaagagtttgctgtagaaggagcaacacttagagtggttcatacacccggacatacagatgaccacatagtgctccatttactaaaagacaatgtcatcttt

SEQ ID NO: 5765 - DNA, 409 bp, Diabrotica virgifera
cacgctcctcgagcacgccgccttctcagcagcagcctcaaattaacacggcaaacgccggaggagtaccgcatatagtatctgttaacgcaggacgaggtcggccagcaagcgtagaagtagaacatccatctgcggcgatgcagtctcaaccttgtaacgattttattgtaccttgtccgaatcctggaatccaggcagtcactcgaagacagaggctacctccaggtgtcgtttatggtgacgtcagcgtagaatctccaatccagaattacacaataatcggcggcgatggcaacgtgatggtcgaccatcccggcgcagccatgcagagccaactaatttctcaacagcaacaggaacaaccctcgcaagctccacctttggtccagaagcctgtgacgaaccc

SEQ ID NO: 5766 - DNA, 271 bp, Diabrotica virgifera
gaacttcaacagaaagtattgcgcacagcagagaactaacgtaggtcctaaccaatagttgtggcagagaatagttatcggatgttttccttaatgtagcaatttagttaaagactacactacattatccatttacatactagttatcacacattagaacagcatcattatgggttactcactcctagcggagtgtttaccgctccttccaattgtaaagtgttaacttctttatgtctccgaaatattgatctccatcttgttttgggtc

SEQ ID NO: 5767 - DNA, 426 bp, Diabrotica virgifera
  misc_feature (234)..(260): n is a, c, g, or t
gaaataaagttattgaatgaacatggccaaattcgctaaataatctaaatacatactcacatggtcatggtgtgttgtaggtattacttagttgatataagccaggatttgtgattgttttgtttctgttttgttctcgaattttatgttggttatgtaaaagaaagaggaaagaccataggaaatgattaccgtacgtagtttagcaactaaaatggggagtgacataaaggnnnnnnnnnnnnnnnnnnnnnnnnnnntcgaaggaaaattaggacaacttactccacaagaaagacagagacaatcccaaatagtaaaggaaaagttgtttggtctagaccaatttaaagacgcaaggaatatatctatttatcttagtcttgatactgaaatagacaccgaaccaattgttaggaaaatctt

SEQ ID NO: 5768 - DNA, 428 bp, Diabrotica virgifera
  misc_feature (409)..(409): n is a, c, g, or t
accacgcgtccgtgaccaacttacgagaaattaaattaagtaaaaacttcattcaaatactggaaggcaattcctttggtaatctaaaaaatctaaaaagtatatatttagatgaaaatgacatcatgttagttgaacagaattttgttaaaatgctaccgtcattaaaaatgcttaaactgcaaaagaataaattagaagaactagctattcacacgtttaacacattactaagtctacagaatttggacctacaggaaaatatcctcaagataatagaccctaatgcattcaatttggtaccacaattactaactctgaacctaagccacaatgagatttctaaaattgaagatgctggcttacaaaatttaagatctctagaacttcttgacatgagtttcaatanaatttacacgatgagtcct

SEQ ID NO: 5769 - DNA, 369 bp, Diabrotica virgifera
ccacgcgtccgttttaattatcattaacaaactcattggaggtttctaatattaagggtaattaatttactataataaacgtatctatgagttatcaacaaataaactggaatatctcgaaaagtagtcactttgggtatagggagtgtttaggagatatgcgggtgtagtgagagaacttttcgatggtaatatgaagtacagggtgttccatttaaaaatatgaagagggtcttttatttgcattttgacttaccctgtatacaatttgcgtagtggtaggaaaattgtacgttgttgcaaagctactttagtgttgacggtcaacagcagtgaaaaaataagtttatattgtactgttggagtcat

SEQ ID NO: 5770 - DNA, 74 bp, Diabrotica virgifera
acaacatccctgaagtgagtcgtattattaaggagaatatgagaatagattagaatatagttggatcatattat

SEQ ID NO: 5771 - DNA, 294 bp, Diabrotica virgifera
  misc_feature (7)..(8): n is a, c, g, or t
  misc_feature (12)..(12): n is a, c, g, or t
cctgtcnngtgngctgtggtcgtgcgtggtgtggtttctgtgtgtgcgtgatcttgcggctcttgtcgttgtcgctgtctgcgttgtgtggcgggctggcttcgccggcgatgtcgcaccgggtgccgtcgtcccctcaagcgtcgggcgcccagtgcccgtgggtctcctggctggtaggggacacagagccgcatgtgtgtgtccatgcatcccatatgaataccggtggcctcatattgaagttctgcactgtagcaggttccatgacgtactgtgctgagatcgttttgt

SEQ ID NO: 5772 - DNA, 392 bp, Diabrotica virgifera
ctctacaatgagtcgtagtatatttcggtgtatttttgtacccaataacaattgttttaagcgggtcggttgatgtcttttttccaggcgtactgttgactgatttagatgtagggtactgtgcttttcgttttattttttgttatgcggacgttgtttttgactttatgtcgttttggaagcaagctccacaatcgatctcgcatttgtaaatatcctgtaaaaattgctcatgtaaaaattgtttttgttaatatgtactgtttatcaagaaagaaacgatagatcattgcaagttttgaaacacgtctaccttttttggcatatacagaccaaggggtcagtttagcgtcaaaatttataagcatcttacgtgaaaaagttcgatcgat

SEQ ID NO: 5773 - DNA, 425 bp, Diabrotica virgifera
  misc_feature (56)..(82): n is a, c, g, or t
  misc_feature (398)..(398): n is a, c, g, or t
tgtaaaaagtttatgctctgcagagattggttcctattttaactggaagtatttcnnnnnnnnnnnnnnnnnnnnnnnnnnntaaaattcagtgaatctatttaagctaatacattagtgtttttaagacaaacaatatgttcaaatagtagatgtcagaaatttttttgatgttttgatggttacaatctgagtcgtgtggtcctgaaacttatttcttgtgaatttttatatcaactactgtattttgtttccaatttgtttgaaattgttcccaaaataccaatcaaacaaatcattattactcgaaaatagaaaaaaaatccttatagtttaattttatggtttaactcatccagttttcttcatgccattattttgttccatattttactaanatgaagataaaggaacaatagtcctgc

SEQ ID NO: 5774 - DNA, 456 bp, Diabrotica virgifera
tcgcgggtcgatacaagcgtctaaacacacgttctgatgacatcaatttctaaaaatgttcgcaaattcctaccaaagcggcttcatttcaatattctacagcgtaggaagtaatccactagcattatgggacaagcaggtaaagaacggacatatcagacggattatggacgatgatgtgaaatcattagttttggaaatatctggaactaatgtagctactacttatataacgtgccccatcaaaccacgagcttcacttggaatcagattaccttttctgattatgattataaagaatatgaagaagtactttacatttgaaattcaaatattagatgataaagatatgcgtagaaggtttagaatatcaaatttccaatcatccaccaaagtgagaccgttctgtacaacgatgccaatgggactcagcagtggctggaatcaagttcaatt

SEQ ID NO: 5775 - DNA, 239 bp, Diabrotica virgifera
  misc_feature (148)..(168): n is a, c, g, or t
agcatacttcaggtaacacaacaccactaccattaacattgataacataccgatcttaattctacatccaaaacaacaccgtggaccaggttgtgcttaactccgcaaacacatacttggttatgccaaaatggttattaaacggacnnnnnnnnnnnnnnnnnnnnntcataacaattcaatttaccacaatatgttagattcaaatgtacatgaaagatatcattatgttaaccata
